United States Patent 10,767,156 (POLYNUCLEOTIDES ENCODING BREX SYSTEM POLYPEPTIDES AND METHODS OF USING SAME) - sequence listing, part 5

SEQ ID NO: 539 - DNA, 3723 bp, Pseudoalteromonas marina
atgaagaagtacaatgaattaatccaattcgaaccagttacaaccactatcgaattggaagattccgctgatcataccaaagcggaaaaattaatatcgtcatatgttatttcagaaaaaatgaaatctaaattgaacgatactatcattaagcatcttcaatatgatgaatttacagatcaaaaagccctttggattgttggtaattacggctctggtaaatcacatttaatgtctgttatctcagctttagctgaattccctgacctaattgacaaagtaacaaatgaagaagtaaaagaatgtgcaggccagatagctggaaaattcaaagtaatacgttttgagattggcgcaagtaagatggacctaacagacatcattacttttcagttaactaaagggttagaagatcttggtgtgaattatgaatttccaccgatggatcaaataacctctaatcataagcaatacatagaagagatgatgttggcatttcatgctaaatatcctgaccatggcttattgttaatttgtgatgaaatactcgattatttccgctctcgaaataaccaacaattaccgctagatatggctatgctgcgtgttctaggtgaagttattgaaggtacacgttttcgctttatcgcaggtgttcaggaagctatatttgctgatccaaaattaagctttatctcaaaagaagttaaacgtattacagatagagcagtagaagttgtaatcgtaagagacgatattaaatttgttgttgctgaaagactattgaagaaaacggctcaacaaaaagaatggatcagagagtatctacaaaaattcacgccttactacgaaaaaatgaatgaacgcttagatgagtttgttcatatgttcccagtgcatcctgattacattaacacctttgagcgtgttcgtattgcagggttagagcaacgccaagttttacgtagcttatcaaaccatatggaaacgttaaaatctcacgatgttcctgaagatgttcctggcatattctcatacgatacctattggcacgaactaagttcagagccaagcatgaaaacgaaccctgaagtcggacaagttattgaaactggtgaaactttagttgaacgtatagaacaagcatacccaacaccaggtgaaaaagactttgctaaacgattagttgcaggcttagctattcaccgaatggctgttggcgatatatataaagaaatgggcgctacagcagctgagcttagagattctctctgtttatttattccaacggttgatgttttaccaggtgaaaaaagtaaaaacttagaaaaccatattgttacggtattaaagaaaataagaaaaacagtaaatggtcagtttttctcaaaaaataaagccaacgaccagttttatatcgatcttaaaaagactgaagactttgacgctattatcgaaaccaaagctgaacaattagctaatgataatatcaatggtgcatatcgtgccgccatgcttgagatccttgaacaaactgatacccagcaagttcacaccatgtggcaacatgaactgaaatggatcgatagaaacgttaatcgccaaggctggttatttttaggctcgccaaatgagcgtgaaacggctaaacctcaacgtgattattacatgtactttattcagcctgaagatgcgccaaagcagaaaaaagaacatatccgtgaagacgaagtgctgtttgtattaaagaatagagatgaaacgtttgatcgttaccttaaatactatgcggcatcagttgagttacgagccttagccactggtagtgcaaaaaatacctacaagctgaaagcagatgattatctaagggatatgcagaagtggatcagaaaccatattgcagatgcttttgaagttaaatacaacggccaatcaaagcctattatggattggcttaaaggaacatcagttcgtgatatcacaggcatatcagccaatgagcatggcaatgtaaaagatatttttgaagcagtggctagttatgtctttgaaggttacttccagtcgcttgctccagaataccctaagtttagtcagtggatcacgggtgataacatgcaaggggcagcaaatgatgttcttattagcttgtctagtggtgctagaactaagcgtgctactgccgttatggatgcactagaattgcttgatggagagaaactacaagcaactaagtctcgcttttctgcaacagttttagatgtgttaaaagctaaaggtcatggtcaagtagttaacaatggcgaattgctagaaaaagttaatgccaacctttattttaagcccgatacatatcgcctagagcctgaatggttactggttatcttagcaagcttggtttattcaggggagttagagctttccgtagtaggtaataacattacggcaagtaatgcggatttacttaaatctctagattttaacgacctagttaacttcaaacatatacaagcaccaaaagacttcaatacttcagctattaaagcattattagagttgcttgatatgaatgaaggtttagctattagcattcaacaaggtgacgatggcattgttcgagaaatgggtgacaaaattgagcagaaagttaagtcacttgttactgatagccaagcagtaaaagaaaggcttcttttatggggtcagcatgtacttgaagacaatgaagcggggttacttacagaaaagctaacatcagccaaaactttcttagaagaaatgcaacgcttcaatacaccaggtaagctcaaaaacctaaaagcaacgcctgaagatattgcattacaaaaagaaaacttaattgcttggaatgactataagcagttagagctgacagtaaaagagttttccgacattaccaactatctaagtaaagcacagttggttttagctgaaaatgacgactggcaagagacggttaaaagtgctcaacaagagttacgtcaaggcttagctgataaagacgtaaggcaatcaactgaatttaagcagaaaatgcttaaacaactagctaacgcaaagcaatcttatatcactcgctttgttgctttatatcaacgtgctcacttaacgttagcagaaaataaaactaaaacgaaattgatggatgatgacaggctagctacattaagcttattaagtggtatagctttattaccaggaaaccaagttaaagactggcgtgaagattgggctaaattgcagcctgcaacggctatcgatagtaaagttttaggagttgatccgaaccctgtttcattcaaccctagaacggaaaaataccttgccccagccagtgatcgcttaaacagattagatgaacaattagatgccatgctaacggaatggacttctacacttcaaacgaaccttgctgacccatttattcaattagatttaatgaaatcagagcaaaaggctgaagttacagcgtttatcaattcaggatgtttgccagaaccactaacaaaagactttgtagaagaagtgaataaagtacttgatggtctagttgctgtatcaataacgtcagaagagctagtagctaaccttggtaaaggaacgccacaaagtattgatgatgtgcgtaagcgttttgagcaactcattgctgaacgttgtaaaggccaagatatcgataaagttcgtattgttattgaataa

SEQ ID NO: 540 - DNA, 3675 bp, Desulfotomaculum nigrificans
atgaaatatagtgaacttattcattttgaacccatagaatcagtggtccagttaagggaatcaaatcaaaaagattatgccatgcagttactggatacctatgtgatttccgaacggatggctgatgccattaatgaaattattatcgaacagctgcaataccaccgccaggcggataacaaaggtctgttaattgttggtaactatggtaccggtaaatcacacctgatgagtgtaatcgctaccatcgccgagcaaaaaggagtcagtgaccggcttactaaccagcgggtggccaccaaagcaaaggaaatcgaaggccaattccaggtgattcgtaccgagattggtgcttccaccatgtcattacgggacattatttgtggttatatcgaagaccacctggccgatatcggggtggactataaatttcccccggccaaccaggtgcgtaacaacaaggattccttcattgaaatgatggccgccttccaagaggtttatcctgaccagggcttactcctgctggtggacgagttgctggattacctgcgggcccggaaagagcaagaaatcatcctggatttaggctttctgcgtgaggtgggtgagatttgccgcaccacccgttttcgctttattgccggtgtacaggagatgttgtttgataatcccaaatttcaatttgtggctgagcaactgcgccgggtacgagagcgttttgaacaagtgcaaatcgtgcgagaggatattgcctatgtggtatcccaacgcctattaaaaaaagatgatcaccaaaaggcgctgattcgggaacacctacaaaaattcactacccattatgaaaaactcaatgagcggctggaggaatatgttgctcttttccccatccatcctgcctatctagccacctttgaaaaggtgatggtggcggaaaaacgggtcatcctgaaaaccatcagtaatgaaatgaaaaaactcctggctcaggaagtgccagcgaaccaacctggtttaatctcctatgacagctactggccctacatagaaaatgacccctctttgaaaagtaaccccgatatcagagaggtaattaataaatccaaaatactgcaggaccggattcaaaatgcctttacccgtccggtatataaaccgatggcgctgcgtatcgttcaggccttgtcggtgcatcggttaaccaccggtgatattaatgccaaactgggggttacctccgaagagctgcgggataccctgtttctttatgtgcccataccggaagaagactcaaccttcctgcgcaccaccatcgaaacggtattaaaagaaattttaaaaaccgtcagctggcagtttatttccttcaatgaagccaatggccagtattatttggatctgggtaaggtagaagccatcgacgatttaattgaacaaaaggccgaggggctaaccccggatcaattggatcgttattactttgatgccctaaccctggtgactgacagtgccaagaatacctatgtcaccaactatcgtatttggcagcacgagctgccatggtgggagcgcaaggtaacacgcatgggttacctattctttggtgcacccaatgagcgatccaccgcccaacccccgcgggatttttatatttacatgctccagccctttgatttgccaaagtttaaggatgaagaaagggcagacgaagtattcttcgggctaaaacacaaagatgaaaaatttctgcgcatcttgtccctctacgctggagccaaggaactaagcgccaccgctgcctcgggcaccaagcatttatacgaagcacgggccaccgataacctgaagctgttaacccaatggctaagggaaaaccttttaactgcctttgaagtgacctatcggggtaccaccaaaaagctggtggaatgggtcagtattctcccaccccaagccagtgtgcgggaaatcatcgatgctgtggccgccagttgcctttcctcatacttcgaagaaaaatacccggattacccgcacttcagcaaactaaatctacccctcaccagggaaaatctgcccggttatgtgcaggatgccttaaaaaacattgccggggcccaaaccaagagcggtatggccatactggacggcctagtgctgttggagaatgaaaagctaacaccccgaaagtccggctatgccaggtggatactggaaaaattggcagtcaaggccccgggacaggtggtgaaccagtcagaactggtggagactatttatacctgccagggaagtccggatgtaaagttaaccaccgaatttaaactggaaccggaactgctggtggtgttgctggcagccctggtttatagtggtgacattgtggtaaccatctccggcaccacctacgatgctatgaaattggaccagttaatcaagctacctttagaggatctgagggaatttagccatattaaaaaacccaccgggctgccgatccgggaactacaagaactctttgatttattcggtattccccacggtctgttacagcaaaatgccctggccaagggtattgaagaactgcataagcagaccaataataaattgattgatactgtcaacattttgcaggtggtgcgtaccggcattccctgttgggacggcgtgatactatctccggccgagcagcagcagtataaagaaaagctggaagtttttaaaaccttcctggaagttgtcatggtctacaatactccggccaaattacacaactttaaatttactgtagaccaagtggccgaacagaaagcagctctggatctactgaagaaattaaaagaactgcagcagcgggtgaatcacctatcaccccatgccaattacttggtaaccgcccagcagcacctgcccctggaccaccaatggcaggcagatgtagaagcggccctgggtgagctgctccaggccctaaaagaaggccaaccctatgatgcccaacttcagcaaatccgggaattaaagaaacagtaccaagactattacatgtctatgcacaccaggtcaagactcaatgcggcggaaggcaatcagagaaatatattattgaacgaccccagggtagcagctttaaaacagttgtccaccattgatctacttccggatacccagttaaacctgttgctgggaaggattaccgctttacaggaatgttggaaattaactaaaaacgatttagaatatcaggccatttgcccccactgcaaataccgtcctaaggaagagccgggggtaattaaaaatctaaaccaactggcagaaaagctgcaggatttactggatgactggactaaaacgctgctaaataaccttaataaccaggaagtaaagaaaaacatcagcctgctcaagccagagcagcaagagttaatcaatacgctcctaaccaaacaggaatttaccctgcccattgatgtaaaactggtgcatgctataaaagaactgttacagggtattgaacgggtggaagtcaccttggatgacctaaaggaaatgatgggtaacggtagccccctgaccgtagaagaggttaggatacgtttggagaagttattaaaggatcggatcggcaaccaggccaccaaccgggtccgtattatgctggcgcataagtaa

SEQ ID NO: 541 - DNA, 3744 bp, Dethiosulfovibrio peptidovorans
atgaagtacggagagctaattcaatttgatccaatagaatcggtcgttcagctacgggatgctgataaaaaaagtgctgctcatcaactggttgatacttacgtaatttctgatgaaatggcagagcgaatggttcgcattgtaattcctcagcttcagtttgaacagcccgtcgataacaaaggcctcttggtggtcggtaattacggtaccggtaaatctcacttgatgtctgtcgtttccagtattgctgccgatgcatctctgcttgacagtctaaaccacgaaagcgttaagtcggacgcagaaaagattgccggtaaatttaaggtcatccgtacagaaattggagcaacgaccatgtcactcagagatattctggtggcagaactggaagagcatctcgagaatatgggcgtaagttacctcttcccggactcgggaacaatcaccagccataagcgggtttttgaagacatgatgtccaagtttggcgaagtttttcctgaacaaggtctcctactggtagtcgatgagctactggattatctgaggactcgaaaggatcaggagcttatcctcgatttgaacttccttcgcgaagtcggcgaggtttgcaaggaccttcgcttccgttttatggccggtgtgcaggaagccatatttgacagcccgagattcgcctttgtcgctgacagcattcgtcgggtaaaagaccggtttgaacagatacttattgcccgaaacgacgttaagtttgtggtctcggagcgtctgttaaagaaaaccacagaacaacaggcaaagatcagagattatctcacccggtttgccaaatattacggtggcatgaacgagcgcatggacgaatttgtccggctatttccgatacaccctgattacatagatacgttcgaaagagtgaccgttgtcgaaaagcgtgaagtcctcaaaaccctatccataggcatgaagggctttttggataaagacgtcccggacaacgagcccggcctgatcgcctttgacagctactggaataccttaaaacaaaatccatccttccgggctatcccagaaatccgggcggtgattgactgtagtcaagtgttggaatcacggatcgaaaacgccatcacccgcaagcaatacaaacccatggcactccgcctgatccacgcgttatccgtccaccgcctaaccactggtgatatctacgcgccaatgggagccagcgcagaggaactgcgcgaccgtctctgtctgtttgatccattgattgcagagctgggcagtgatgagcccgacaaggacctgcagacccacgttgaaaccgttcttcgagaaatacataaaaccgtcagtggtcagtttatctcctttaacgctgataaccgtcagttctatcttgacctaaagaaaaccgacgattttgacgccctgatcgacagacgggccgagagcttgggtgatgcacagctcgatcgattctattatgaagccttaaaacgagtcatggaatgccaggactcgacctatgtgaccggttacaaaatatggcagcacgaactggtctggcaggatcacaaggctgcccgcaccggctacctctttttcggtgcacccaacgagcgatctactgccgtaccgacccgggatttttatatctacttcattcagccaaacgacccaccacgatttaaagatgataaggtcagcgacgaggtcttcttccgcttaaagccgtcaaaggataccggtgaagaattccagacatctctgaaaagctatgccgcagccctcgacttagcgggcacatcttcaggccatgccaaggccacctatgacgccaaagcgaatggcttcctgaaaaaactggtgcaatggctgcaaaaacatatgttggaggccttcgaggttacctatcagggccgggccaaatccatgacggaatgggcaaaaggcaagtccatcagagacatttcaggtctatcaccgcacgaaaccatcaacttccgggatcttgtcaacaccattgccggagtgtgccttgcacctaactttgaaaatcaggcacccgagtacccgttttttcccgtcctgattaccgagagcaacagggctcaagcggcccaagatgctctccgggcaatcggcggccagaaccgaacaaaacaggcaacggctgtactagatgccttggaacttctggatggagaaaagatagccccttacaaatccaaatacataagtttcatcctcgacatcgtaaaggccaaaggtcacggccaggtcgtcaaccggaatgaaatcatcaaggacgatcacggtttggaatatatgaatccggatagctctcgtcttgaaccggaatgggtaacggtgctgatagccgctctggtttactccggcgacatcgttctgtctatccctgggaagaagttcgacgctaccggactccagcagcttgcggcaactggaatggatgaactcatccgattcaagcacattgagcaacccaaggaatggaatctcccggcactcaagtctatgttcgaacttctcggcatgacacctggaatggcccagctgattactcaaggcaaagaagaaccgattcaggatctgcagcaagccgtaggaaaactggttaaacggatcgtgatgacacaacaggccttgcgtgaagggctttccttctggggacttgatcttcttgccgggaccgatctggccaatcaggtatctggactggatgctgccaagacgttccttgagtcgctccaagcctacacatcaccgggcaaattgaagaatttccgctacagcatggacgaagtgaaggcccatgaaaaagcggtaaaagcgctggatgatctagatgctctgcgaaaatttgtcatggaccacagtccgacggcctcatggctttcaaccgccgagggcgtccttcctccagagcataactgggtgaaccgcatgaaaaacacccggcaggatgtactggaaatgctcaatcagactgacctgacaaagctggcgaaccagtcccaggttatcggagcaaaacttcagcagcttaaaaaagactacatcgttgtctacatcggcctgcataccaaggcccgactgggcgtaaacgacgacaaacgcaaagcagccttggtggaagaccatcgactgcagacgctcctgaagctggcaggtgtcgatctgatgccgagacagcaactcattgattaccagaaccggttggccgggctgaaaagctgctttgccttgaccgaagggaatttggataccacaccggtctgtcctcactgcgggttccgcccatcggtggaaacgggtgtcgcccaaggttcacagatgatcgatcagatggataacgatctcgaagccatggtgggtaactggacttcaacgcttctggctaatctggaagatccgatcacccaagctaacatgaacctactgaaggtagacgatcgtgagccgctggaagcgtttatcaaatccggggagctgccggttccgttggatacaaactttgtccatgccctgaaagaagtgctgtctgggttggttaaagtatcggttaaagcgcaggagttacaaaaagcattgcagattgaaagtggcccggcaacacctacagagatcaaaaagcggttcgacgatttcatcgatcagctgaccaaaggccaggatccggctaatgtgcgaatcgtcatggagggatga

SEQ ID NO: 542 - DNA, 3741 bp, Kingella denitrificans
atggccaagaacatgaaatacggagatctgatccagttcgagcagatcgagtcagtcattcagctgctcgatgccgagcgaccggacgaggccaagaagctcgtcgcgacctacgtcatctccgacgacatggccgagcggatctccaagctcatggttcctcagctcagtttcgacgactcagtcgatcacaagggcgttctcatcgttggcaactacggtaccggtaagtcgcacttgatgtcggtgctgtcgctggtggccgaggatgcggcctacgcaccgatgatccgccaccccaaggtggccgaggcggttgccccgatcgctggccgcttcaaggtgctgcgcatcgaggtgggtggcttgcagatgccgctgcgccagatcatcaccctgcagcttgagcgcttcctcgaaaagatcggcgtcgactacaccttcccgaccgccgacaaggagctcaacaacaaggactccttcgaggagatgatggccgcgttcgcggagaaattcccggaccagggtgtgctgctggttgtcgatgagttcctggagtacctgcagtcccgtcgcgatcacgagctggtgcaggacctggccatcctgcgtcagattggcgaagtcaccaagcacttgaagttccgcttcgtggctggcgtgcaggaagccatcttcgacagcgtgcgcttccagcacgttgccgacagcatgcgccgcgttaacgagcgcttcacgcagatcctgatcgaccgccaggacgtcagcttcgtcgtctccgcgcgcctgctcaagaaaacggccgaccagcagaacaagatccgcgaatacctcacgcctttcgccaagttctatggctccatgaacgagcgtatggacgagtacgtgcggttgttcccggtccacccggactacctgaagaccttcgagcagatccacttcaccgagaagcgcggcgcgctcaagaccatcgaggctgccatactggcgatcctcgaccaggacgtgcccaccgacaagccgctgttcatcagctacgaaagcttctggaacaccatcaaggccaactcggtcctgcgcgctgacccgaacatcaaagaagtcatgcgcgtgtccgaagtgctggagtcccgcgtgcagcaggccttcacgcgcccagcctacaaatccatggcgttgcgggtcatcaacgcgttggccgtccaccgcttgactacgggcggcgacatccatgtccccatcggccccacagccgccgagctgcgcgacgccttgtgcctgttccagccgggcgtggaggacatgccgggtgatccggccgagaacctgctctctatggtccagaccgtgatgcgggaagtgctgaagaccgtcaacggccagttcatctccaaggcgtcggacaccgagcagtactacctcgatctcaagaaagacatcgactacgacgcgcagattgaaaagcgcgccgaagccctgtccaacgatgcgctagaccgcgcctactacagcgccatcaaaacactgatggaatgcagcgacgacctgcgttaccccggcttccagatctggcagtaccagatcgagtggcaggagcgccgcgtcgagcgcatgggctacctgttcttcggggcaccgaacgaccgtcccacggcgcagcctgagcgcgacttctacatctatttcctccagcccttcgacaagccgaagttcagcgacaacaacctggctgacgaagtgttcttccgtctgaagtcacccgacgaagactacaagcgctacctgtcgcaatacgcggcggcgctggatctggcgtccaccgccagcggcggtgcgaagaccatctaccagtccaagactcaagattccttgcagtccatgagcaaatggctgcaggaaaggcagatgaccgcgttcgaggtcacctgccagggcaagaccaagacgctgcaggactggttcaagggcgtgtccctgcgcgaccgtgcgcgactgggcccggacgagcgcatcaacttccgcgacgtggtgaacatcgtctccggcctggcactggaccagcgttttgtcgatctctcgccggaatatcccaccttctcggtgcttgtcaccgaggccaaccgcaagcaactgatcggcaacgcgctgcgcgcactggccggcggtactcgcaccaaggatgcactcgccgtgcttgatgcgctagaactgctcgatggcgaccgcgtcgatccggccaactcacgctatgcgcaggaagtgctgaaccgactcaaggccaagggccacggccaggtgctcaaccgcagcgaactgctgtcgggaacgtctgacgtcgagtattttgcgccgatcaagtaccggctcgaacccgacctgctggttaccgtgctgggcgggctggtctattccggcgacatcgtgctgtcgatcaccggcgacaagatcgactccggcaagctggggcaactggctgagcgatccattgaagagctcaaacagttcaagcacgtcgaggcacctaaagagatcaacctcgcggtgctgcgtgccttgttcgaattgtttgacctgccgtccgggctgactcagaaggccagccaaggcgataccgaaccggtcatcaaactgcaggagaaagtcagcgcgctggtcccgcgtgtgctcaaggccggctccgacctacaacaaggcaagctcggcttctggggccagaacctgctgcgcgaagaagaagccaaagactggcacgagcggctggattcgctaaagaagttcaccgaatcactggcgccgtacaacaccgtcggcaagctcaagaatctgcgtgtcacccaggaagacctggacggccagaagaagaatctggagatcctggccgccgtcgagcgactgctcgaactggtggtggagctgggcagcacggcgtcctacctgtcgcaggccgaaatggtgcttcccgccgagcatccgtgggtgaagcaggccgaagcagcccgaaaggctctgcaggaaaagctgagccaggaccgtacagccgagcacgccgccgaatacaggcagacgctcaatcagctcaagaaggattacatcaccgcctacatcgccagccacagcaaggcgcggctgggcgtggccgaagacaagacccgcaacgccctgcgcaaggacgaccgtctgctggcactgcgtgtgttggccggcgtgtcgctgatgcctaccagccaactcaccgcgtttgaggagtcgctcaacggcctcaagagctgttcgtcgctggacgagcccacgctgatgacagctgcggtatgcccgcactgccaattccgcccttctgccgagcagttggagctgataccggcggccaaacgcctgcacaagctggacgacgacctggaccagttggtggccaactggcagcagaccctgctggagaacctggaagacccgtttacgcaggacagcctgggcctgttgccgcccacgtccaagaaactgatcgacgcctttctagcctcgcgcaagctgccggacccgatgaccagcgagttcgccaacgccgtgcaggaggcgctatcagggctggagaagatcacggtcaagggcgacgagatcaagcaggcgctgctgcaaggcggctcgccagcgacgccggacgatctacgcaagcgcttcgacaccttcatgaacgagcgctgcaagggcaaggatgccaccaagttgcgcttcgtgatcgagtga

SEQ ID NO: 543 - DNA, 3726 bp, Alcanivorax hongdengensis
atgcaatacggggaccttatccagttcgaaccgatcgaatcggtcatccaactccttgacgccaacaggccggacgaggcgaagaagctcgttgctacttacgtcatttcggacgacatggctgaccgtatcgctgggcaaatgatcccccagctctccttcgatgagtctgttgatcacaagggcgtactcatcgtcggcaactacggcaccggtaagtcacacctgatgtcggtgctgtcgctagttgcagaagacgatgcctacgtgcccatgctgcaccaccccaaggtgcgtgatgccgccggggccatcgccggcaagttcaaggtgcaccgtatcgagatttcaagccagatgtcactgcgagacatcattacccaggagcttgaagccttccttgaaaaccatggcatcagctatagcttccccccggcagataaagtggtaaacaacaaagccgcattcgaagaaatgatggcggctttccacgacgcgcatccaaatcagggggtgctgctggtggttgatgagttcctcgaattcctgcgctctcgtaaagaccacgacctggtacttgacctatccttcctgcgcgaaattggcgaagtcaccaaacacctgcgtttccgctttgtagctggcgtgcaggaggccatcttcgatagcagccgcttccagcacgtggctgacagcctgcgtcgagtaaacgagcgtttcacccaactgctgctggctcgccaggacgtgagctttgtggtggctgaacgtctgctcaaaaagactgccgatcagcagcacaagattcgtggctacctgacccccttcgccaagttttacagcaacatgaacgagcggatggacgagtacgttcgtctgttccctgtgcacccagactatattggcaccttcgagcgcctggtgttcaccgagaagcgcggcgcactggtaaccctgcgcgatcaaatccaggccatcctggagagcccagtaccagaagatcgccccggtctgatcggctttgatcagttctggaaaacgatcactgataactccgtactgcgatccgaccccaacatagggccagtgctgaaagtagctgaagtccttggtgaacgtgtacaaaaggcattcacacgccccgcctacaaggccatggccattcgcgccatcaacgggctttcggtacaccgccttaccaccggcggcgacatctatgtcccggttggcccaacggcggaagagctgcgcgataccttatgcctgtatcagccaggcattgaagacctgggcggcgagccctccgatgacttgctgacagccgtacagaccacgctgcgcgagattgtaaaaaccgtcaacgggcagttcatttccaaagccccggataccgagcagtattacctcgacctgaagaaggacgtggactatgacgctcagatcgaaaagcgcgccgaagcgctgtctgacgacgcgctggaccgagcttattacagcgcgctcatgcagctcatggaatgcactgacgatcacgcctatgtcacgggctacaaaatctggcaacaccaggttgaatggcaggatcgccgagtagaacgtaacggctacctgttcctcggcgcgcccaatgatcgtccaactgcccagcccgaacgcgacttctacgtctacttcattcagcccttcgagccgccacgctttcgtgatgaagctaaggccgacgaagtgttcttccgcctgaaagatccagatgcagacatgcgtcgctacttgtcgttctatgccgcagcgcaagagctggcatcaactgccagtggtgctgccaagtcagtctatctggacaagaccaaagacgcgttgcgcgacatgagcaagtggctgcaagacaagcagatgagcgccttcgaagtcacttatcagggtaaagccaaaagacttcaggactgggcaaaaggggtatcgatgcgcgacaagctacgcctcggccccgatgaacgcgccaacttccgtgacatcgtcaatgtcacttctggtctggcccttggcactcatttcgcggatctcgcaccggaatacccgacattttccgtgctggtcaccgaatccaaccgcaaacagctcatcaacaatacgctcaagaccctggcgggaggcacccgtaccaaggatgccgtcgccatcctggacgccttggaaatgcttgatggcgaccgtatcgagccgactcgctccaaatatgcccaagaagtactcgctcgcttgcaagcgaaaggccatggtcaggtactcaaccgcagcgaactgatcagcggtgccagcgaggtggaatatttcgcaccggttcgcttccgactggaacctgatctgctggccgccgtattgggcgggctcgtctattccggtgacatcgtactggcggttactggagacaagatcgactccggcaagatctctctgttggtcgagcgaggcatggatgaccttacgcacttcaagcatgtcgaagcacccaaagaaatcaatgtcgcggtgcttcgatccctgtttgaattgctggggctgcaacccggtctggctcagatggcaacccaaggtaaggaagagccagtcaagaaccttctcgacgctgtggctcagcaagtacagcgcgtactgacgattggcaccgacctgcaaaaccgcctcagcctgtggggacaaccactcctgcgggaagaagaattgagcgatagacgatcacgactggaagccctgaaaggcttcctggaaagcctgtcgccctacaacacagtgggcaagctcaagaatctacgcattacccaggcagacatcgatacccagaagaagaacttcgacgtactggcctcggttgaaaagctgcgcgatctggtggctgagttgggctccaccgccacctatctgagccaggccgagatggtgctggcaccggaccacccctgggttcagcagacccaaactgcgcgcaaggaaatccttagcaagctcattcaggatcacggcgctcagcacgccgctgaataccgccagcgcctggccgctctgaaaaaggactacatccacgcctatgtggcagaccacagcaaggcgcgcctgggtgtagcggaagacaagaccaagacggcgttgcgcaaagacccacggatggccaccttgcgcgccctggcgggcatatcactgctgcaccccagccaactcacaacctttgacgacaagctggacaagctcaagagttgtgccgccctggtggagtctgaactgaacacaaacccggtgtgcccacactgtggttttcgtcccgccaacgaacagagtgactggattcccgccaccaatgtgctcaaggcattggacgacgagctggatcaactgctggatagctggcagcaagcgcttctcgacagtttggaagatccgatcattcaggccaatttcgagctgctgaaggataagcaacgcacgctggttgaaagtttcctgaaagcgaaatcattgccagaccccgtgaccccggaattcattgccgccatacaggaagctttgtccggtttggaaaaggtggtgatcacggcggaggacgtcaagaccgctctggtcagcggtggttcaccggccaagccagacgacctgcgcaaacgctttgagaacctcatcaatgagcgctgcaaagggaaggacgccagcaagctgagatttgtggtggagtga

SEQ ID NO: 544 - DNA, 3705 bp, Bacillus cereus
atgctatatcaagatttactacaatttgagccaatcgagtccatcattaaactgacagatgcgaatatggaagaacacgcaaataatttattaaaaacatacgttatctctgaacgaatggccgagcagttaaatgatttaatcattgagcaactacaatttaaccgtgtattagaaaataaaggtctatttattgttggtaactacggaacgggtaaatcgcatttaatgagtgtgatttcaacgattgcggaacgtgaaaatgtgagtcaatatataacaaatccttctgttgctgaaaaagctaaggaaatcgaagggaagtttaaggtcatccgaattgaatttggtgctgtaaaaacaccattgcgcgatattttagtgcatgcactagaggagaacctagcaaaatggggcgttgatttctgtttcccaccggttgatcaaatcataaataacaaagaagcgctagaagaaatgatgggcttgttcaatgagaaatatcctgaccatgggctattattagtcattgatgagttactagactatttacgtggtcgaagagagcaggaactcgctttggacttaggtttccttcgtgaagtgggtgaaatctgtgcaaaaacacgtttccgctttattgcagggatccaagaaatgcttttcggtaatgctcgttttaactatgttgcagattccttacgacgcattagcgaacgtttcatacaagtgagtattgtacgtgatgacattgcttatgtagtttcacaacgtcttttaaagaaaacagatgaacaaaaatctctaattcgagaacatttaaaacaatttgcaacgctttatacacgtttaaatgaggacatggagacttatgtcaacctattccctatccacccagcatatttaacagcatttgaacgagtaaacattgcagaaaaacgtgtcgcacttcaaacaattagtagcgaaattaaaaaaatcattaacacaccactacctgaaggctcaccgggcttaatctcttatgatagctactggaattatatacaagagaatgcaacaaatcgctctgatgccaatattcgtgtagtaatcgataaacataaaattttaaaagatcgtatagaaaatgcgtttccatctaaaaagaaactttatcaaccaatggcacttcgaatgattaatgcattagctgtttatcgactttcaacagaagacattcatgacaaagtcggtttaaccgcgacagagctacgtgatgatttatttttacatccaacaatcagtatggactttttattagaagaagatgatgcctcagatttcttaaaaacaagtattgaagcaacaataaaaataattcaagaaactgtaagttatcaatatatctctacgaacgaatccaatgggcaatattatttagatttaaagaaagatatcgatgtcgatagcttaattcaggcacaagctgaaacgattgaggacgataaattagatcactattacttcaaccttttacaaaaagcaatggaactagatgataatacccatgtatctcacgtgaagatttggaaatataatttagcgtgggaagcacatcatgtgatgcgtccgggttacttattctttggcgcaccaaatgaacgttcaacagcacaacctgaacgagatttctatatttatatgctccgtccatacgataaagtaacgtttaaaaatgaacataaacctgacgaaattttctttgaatacaaccgtagcaacgaagatttcgataagtacttaaaactctatgcagcagcacaggacttagcaatcgatgcttctccagctacaaagaaactctatacatcgaaagtagaagaatatcagaagaaactattcaaatggctcattgaaaactttgatagtacatttgaaatcacgtataaaggtaaacaatcaactgttgctgacttacgcatgtatattttaagtaatccgacggtcaaacaaatcatcgacacaactgctgaattttatttaacagattggtttgaactaaaatatgaaaactacccttctttcggaaaaattcaaggaacattaacgaaagataatatggaaacatatgtccgaaaagcccttcagtatataaacggtgaagaatcgaaaatgggtgctgatattttaaatggctttgtcttattagatgcgaaaaataaggtctctatcaaacaatctggctatactaaatggattttgagcttactagaagcgaaaggtcatggacaagtcatcaatcacagtgaattgattgagacgattcatatcaaaggaacgcctgatttacaatatacaaagcaattttctttagagccggaactatttgttgtattacttggggcaatgattagtgcaggtgccattgaagtaacaattgaaggaaaaacatataatgcacttaacttgcatgaatatatccaactaccattaaacaaactaacgcagtttagctatatcaaaaaaccaactggtttaccaataactgaaatcaatgcaattgcagatttgtttaatgaacctttaccaaactatgaagaagatacattaactcgtgtcattattcgagttacagaaaaagaaaataacaaaatagctgagacattatccattctacagttagtgaaaaaaggtattccaacttgggatggtcaattattaaataatgctgaaatacaagaacagacgaaattacttgaagaattcaaagagttttgtgagggcttgaaacgctacaatacacctgctaaactgcataatttaaaatatgatttagctacgattgaagcacagcgtgaagcattagaaagattggaaggcttactaaaactagatagtcaactaaaagatatttctcaacttgctaactatctacgtgtcgcacaactaaatatgggaaaccaatctgattggtcaacacgtgtcgaagaagtattagatgaaatacagtttgcactaaaacaacagcaagacatttcgaaagaactttcacagctaaatcaattaaaacaagagtacatcaagctatatatcgaagcgcatgatcaatctcgtttaaatgcaagcgaaaacttacgtaaaaccgctttttctaatgatcctcgattaaaagcattaaaagaattagccagccgtatttccatcttaccgaaagaggaaatccttaaatgggaaaaagcgttggctgaactaaaagcttgctatcatgtttcggaagataaattacaacatacacaaatttgtagtgagtgtaaatttagcccaaaagatattactacaaatgaaaaagttattttacaaaaactcgaagaagaactaccagttatctatgaaaactggacagaaacattactaacaaactttaatgatgcagctataaaagaaaacattacattactaagtgctgaacaacaaatactgattgaagaatttatcaatcgtaaagattttacattaccaatagatgttcgcttaagccaagctattaatgatttattaaaaggtattgataaagttgaactatccttaacagatatcgaacaaatgatggcgaatggacatccattaacagttgaagaactacgtaaacgttttgaagacatgctgacaaaaacagtcggcaccgccccatcaaacagagtacgtattatgctaaagaaataa

SEQ ID NO: 545 - DNA, 3657 bp, Nitrosococcus oceani
gtgaatacctatgtcatttccaaggaaatggccgaacggctcacgcagcttgtcattcctcagatgcagttcgaccaaccggtcgataacaagggtctgctggtcgtcggtaactatggcaccggtaagtcgcacttgatgtcggtggtctccagccttgccgcagacgcctcactgctggaggagctgaaccacgccagtgtacgcgacgccgccgctcagatcgctggacgtttcaaggtgatacgtaccgagattggagccaccaccatgtccctgcgcgacatcctggtggccgaactggaagagcatttcgaaaaactcggcgtggagtatgtgttccctgaagccgggactatcatcagccacaaacgggccttcgaagacatgatggccaagttcggcgaggtcttccccgaacacggcctgctgctggtggtcgacgagctgctcgactacctacgcacccgcaaggaccaggagctgattctcgaccttaacttcctccgcgaggtcggcgaggtctgcaaggatctgcgtttccgcttcatggccggtgtccaggaagctattttcgacagcccgcgcttcgcctttgtggccgacagcattcgccgggtaaaggaccgcttcgagcagatccttattgcccgcagcgacgtgaaattcgtcgtggcggagcgcctgctcaagaaaaccgccgagcaacaggccaagatccgcgactacctgatgccctttgccaaatactacgacgggctcaacgagcgcatggacgagtttgttcggctcttcccggtacatcctgattacatcgacaccttcgagcgcgttaccgtggtggaaaaacgtgaggtgcttaagaccctgtctatgggcatgaaaggcattctcggcaaggatgtaccgcaggacgaacctggtctgatcgccttcgacagttactggaacacgctcaagcagaatgcctccttccgcgccattcccgagatccgggcggtcatcgattgcagccaagtgctggagtctcgcatcgagaacgcactgaccccgaaaaactacaagcccatggcagtgcgcctaatacacgccctgtccgttcaccgtctcaccactggcgacatctatgcccctatgggcgcatccgccgaagaattgcgcgatcggctctgcttatttgaaccgttaatcacggaaatggggagtgatgagcctgacaaggatctacagacccatgtagagactgtactgcgcaaaatccacacagctgtcagtggacagttcatttctgaaaacaaggacaaccgccagttttatctcgatctgaagaagaccgatgatttcgacgccctgatcgacaaacgggccgagagtctgggccaggctcagctcgaccgtttctattacgaggcactcaagcgtgccatggaataccaggacgccacctacgtgaccggctacaagatctggcagcacgaattggtctggcaggagcacaaggccgcccgtaccggctacctctttttcggcgctcccaacgagcgctccaccgccgtgccgcagcgggacttctacctgtatttcattcagcccaacgatccgccgcgcttcaaggacggcaaggtgagtgacgaggtttttttccgcctgaagagcaccgacgaggaattccaaaccgcgctgaagagctatgcggcagccctggaccttgcgggcacatcctcgggccatgccaaggccacctatgaatccaaagccaacggcttcctgaagaagctggttcagtggctgcagaagcacatgagcgatgccttcgaggtcacctatcagggccgcgccaagtccatgaccgaatgggccaagggcaagtccatccgcgacttgtccggtctgctaccccacgagaccatcaacttccgtgacctggtcaacaccatcgccggtgtctgcctggcaccgaacttcgagaaccaggctccggactatccgttcttctcggtcctgattaccggcaataaccgcgcccaggccgcgcaggatgccttgcggaccatcgccggacagaaccgcaccaagcaggccaccgccgtgctggacgccctggatctacttgacggcgagaaaatagacccctacaagtcgaagtacaccaagtttatcctcgatgcggtcaaggccaaggggcacggccaggtagtcaaccgcagcgagatcatccaggatgaccaggggctggaatacatgaacccgggcggttcgcgtctggagccggaatgggtgagcgtcctggtggcggcgctggtctactccggcgacatcgtgctcgccatcccgggcaagaaattcgatgccaccggcctgcagcaacttgccgcgaccggcatggacgagctggcccgctttaagcacctggagcagccgaaggaatggaacttgccagcgctcaaggcgctatttgagctgctcggcatgacgcccggcatggcccagctcgtcacccagggcaaggacgagccggtgcagaacctgcagcaggcggtgggcaagatcgtcaagcgcatcgtcatgacccagcaaaccctacgcgaagggctttccttctgggggctagacctgcttgtgggcaccgacctggccagccagaccagcggactggacgaggccaagggcttctttgaatcgctgcaggcttactcctcgccgggcaagctgaaaaacttccgctacagcgctcccgaagtactggcccacgaaaaggccatgaaggcgctggacgagctggatgccctgcgcgcgttcatcatggacaatggcccgacggcgtcctggctctccaccgccgaggcggtgttgcctgccgagcatgattgggtggatcgcatgaagaccacccgacaggacgtactggatgccttcaagcaggctaatctgaccgagctgaccagccagtcccagagtcccttatccggaatcggcgccaagctacagaagctgaagaaggattacaccgtcgcctacatcggtctgcacaccaaggcccggctgggggtgaacgaggataagcgcaaggcgggactgctcaacgacccgcgtctgcaaaccctgcgtaagctggccggtatcgacctgatgccacggcagcagctcaccgattaccagaaccgcctggccgggctgaagagctgcttcgccttgaccgagcaaaacctcgacgcctcgtccatctgcccgcattgtggcttccggcctgcggtggaaaccggtgcggccgtggggtcgcagatgatcgaccagatggatacccagctcgatgccatggtggcggcctggacctccaccatcctcagcaatctggagggcccgatcacccaggccaatatggatctactgaaaatcgacgaccgcgaaccgctggaagccttcatcaagtcgaaggaactgccggtgccgctggacagcaacttcgttcacgccctgaaggaagtgctctccggtctggtcagggtcaccgccaaggcacaggagctgcaacaggccctgcaggttaccgacggcccggccaccccggtggagatgaagaaacgctttgaggagtacatcgatcaactcaccaagggcaaggacccggccaaggtgcggatcgtcatggaaggttaa

SEQ ID NO: 546 - DNA, 3741 bp, Methyloversatilis universalis
atggccaagaacatgaaatacggagatctgatccagttcgagcagatcgagtcagtcattcagctgctcgatgccgggcgccctgacgaagccaagaagctcgtcgcgacctacgtcatctccgatgacatggccgagcggatctccaagctcatggttccccagctcagttttgacgactcggtcgatcacaagggcgtgctgatcgtcggcaactacggcaccggtaaatcgcacttgatgtcggtgctgtcgttggtggctgaagacgccgcctacgcgccgatgatccgccacccgaaggttgccgaggcggttgccccgatcgctggccgcttcaaggtgctgcgcatcgaggtgggcgggctgcagatgccgctgcgccagatcatcaccctgcagcttgagcgttgcctcgaaaagatcggcgtcgactacacgttcccgaccgccgacaaggagctcaacaacaaggactccttcgaggagatgatggccgcgttcgcggagaaattcccggaccagggcgtgctgctggtggtcgacgagttcctggagtacctgcagtcccgtcgcgaccacgagctggtgcaggacctggccatcctgcggcagatcggcgaagtcaccaagcacctgaagttccgcttcgtggccggtgtacaggaagccatcttcgacagcgtgcgcttccagcatgtggccgacagcatgcgccgcgtcaacgagcgcttcacccagattctgatcgaccgccaggacgtcagcttcgtcgtctccgcgcgcctgctcaagaagactgctgaccagcagaacaagatccgcgaatacctcacgccgttcgccaagttctacggctctatgaacgagcgcatggacgagtacgtgcggttgttcccggttcacccggattacctgaagaccttcgagcagatccacttcaccgagaagcgcggcgcactcaagaccatcgaggccgcgatgctggccatcctcgaccaggaagtacccgccgacaagccgctgttcatcagctacgagagcttctggaacaccgtcaaggccaactcggtcctgcgcgccgacccgaacatcaaagaagtgatgcgcgtgtccgaagtgctggagtcccgcgtgcagcaagcattcacgcgcccggcctacaaggcaatggctctgcgtgtcattaatgcgctggccgtccaccgcttgaccacgggcggcgacatccatgtgcccattggccccacggctgccgagctgcgcgacgccttgtgcctgttccagccgggcgtggaggacatgccgggcgatccggccgagaacctgctgtcgatggtgcagaccgtgatgcgggaagtgctgaagaccgtcaacggccagttcatttccaaggcgccggacaccgagcagtactacctcgacctcaagaaggacatcgactacgacgcgcagatcgaaaaacgcgccgaagccctgtccgacgacgcgctggaccgtgcctactacagcgccgtcaaggcgctgatggagtgcagcgacgacttgcgctatcccggcttccagatctggcagtaccagctcgagtggcaggagcgtcgtgtcgagcgcatgggctacctgttcttcggggcgccgaacgatcggcccacggcccagcccgagcgcgacttctacgtctacttcatccagcccttcgacaagccgaagttcgccgacaacaacctgtcggacgaggtcttcttccgcctcaccgggctggacgacgatctcaagcggcacctgtcgtcctacgcggcggcacttgatctggcctccaccgccagcggcggcgccaaggccatctacctctccaaggcacaggacttcctgcgcgccatgagcaagtggctgcaggaaaagcagatgaccgccttcgaagtcacctaccagggcaagaaaaagaacctgcaggagtgggccaaaggcgtgtcgctgcgtgaccgggcgcggctgggtgcggacgaacgcatcaacttccgcgacgtggtgaacgtcatttcgggcctggtgctgggccagcgtttcgtcgatctctcgccggaataccccaccttctcggtgctggtcacggaggccaaccgcaagcaactgatcggcaacgcgctgcgcgccctggccggcgggactcgcaccaaggatgcgctcgccgtactcgatgcgctggagttgctcgatggcgaccgcgtcgacccggccaactcccgctatgcgcaggaagtgctgaaccggctcaaggccaagggccacggccaggtgctcaaccgcagcgaactgctgtcgggcacttcggacgtcgagtatttcgcgccgatcaaataccggctggaaccggatctgctggtcaccgtgctgggtggtctcgtctactccggcgacatcgtgctgtcgatcaccggcgacaagatcgactccggcaagctggtgcagctcgcagagcgctcgctggaagaactcaagcagttcaagcacgttgaggcgcccaaggagatcaacctcgcggtgcttcgcgccttgttcgagttgttcgacctgccgtccggtctggcccagaaggccagccagggcgacaccgagccggtcatcaagctgcaggagaaagtcagcgcgctggtgccacgtgtgctcaaggccggctccgacctgcagcaaggcaagctcggcttctggggccaaaacctgctgcgcgaagaagaagccaaagactggcacgcccggctggattcgctgaagaagttcaccgagtcgctggcgccctacaacaccgtcggcaagctcaagaatctgcgcatcacacaggaagacctggacggccagaagaagaatctggagatcctggccgccgtcgagcgtctgctcgaactggtggtggagttgggcagcacggcgtcctacctctcgcaggccgagatggtgttgcccgccgagcacccgtgggtcaagcaggccgagacggcccgcaaggcactgcaggaaaagttgagtcaggaccgcacagccgagcacgccgccgaataccggcaaacgctcaaccagctcaagaaggactacatcaccgcctacatcgccagccacagcaaggcgcggctgggcgtggccgaggacaagacccgcaacgccctgcgcaaggacgaccgcctgctggcgctgcgcgtgttggctggcgtgtcgctgatgcccaccagccagctcaccgcgtttgaggagtcgctcaacggattgaagagctgttcctccctggatgagccgaccctggtcatggccgccgtctgcccgcactgccagttccgcccgtctgccgaacagttggagttgatcccggcggccaaccgcctgcacaagctggatgacgatctggacgagttgctggccaactggcagcagaccctgttggagaacttggaagatccgttctcgcaggacagcctgggcctgttgccgccggcgtccaaaaagctgatcgacgccttcctgacttcacgcaagctgccggacccgatgacgaccgagtttgccaatgccgtacaagaggcgctgtcggggctggagaagatcgcggtcaagggcgatgagatcaaacaggcgctgctgcaaggcggctcgccggccacgccggacgacctacgcaagcgcttcgacaccttcatgaacgagcgctgcaagggcaaggacgccaccaagctgcgcttcgtgatcgagtga

SEQ ID NO: 547 - DNA, 3630 bp, Thermoplasmatales archaeon
atggtgaaagtaaaagagttaattgattttgtagaaattaaagatgttattgatattgatagtgatattgactcaactgagggtaagaaaaatattgtaaaagattacataatttccgataatttaaaggagcatattcttgatgttgcagaaaatatttcaaaaccaaagcataaatctgttcagattataggtggttatggttctggtaaatctcatctacttgcatggtttgtttctattttagaaaataaagagttaattgataatataactaatgacggtgttaaaaagcgttttaaagaggttcttgatagggaatttgctgttgttcagtttgagcttcagccaggtgtttctgctttaagtgatttcttttttgatagaattgagcaacagttgaatgacaagcatgatatagaagttcctaaaagagattcttccaaggtggaggatttcaagaaagatattaaagatattattgatgctgttaaaagaaaagatcctaagatgggtcttgttgttgttattgatgagatttctgattttttaaagcagaaaactatgcagcagattcatcgtgatatgcagtttttaagaattctgggtcaggtttctcagtctttggatttcttgtttattggtgctatgcaggaaaatgttttttcaaatcctaaatatgttggagaagcagtaagttttggtcgtgttgctgagcgttttcatattgttaccatttctcgtgaggatattaaaaaggttatttctgagcgtgtcttaaagaaagatagtggacagagagagcaaatagacaagttgctttctgattttaagaggatgttttctcctattaattctgagcctgataaatatattaatttatatcctatacatccatctgtaattgatgtttttagtgatcttccttattttgagaaacgtggtgttatccaatttgctacagtttgggttagtaaaattttagattgcgagtttccaaaatttgttacttatgatagtgtttttgatgagattaactcaaagcatcatgttagaaatcttgatgaagttcgtccagtaattgatattattgaaactcttgattcaaaaattgagcttgttgataaggataaacgtgatgatgctcgtcgtttgattaaagctcttgctgttttaaaacttcatggtaaaagtgctgataatggtgcaactcctgaagaacttgcaaatattttattaattacttcaaagactattaagaatacagatagaattattgtgattcttgataaacttcgcgaggttacaagtggtcagtttattgctaaaactgagaataattattattatttgaatcctgagcagagtattgactatgatgaggttgttaaaaggaagatgaaaactcttcctgagggaatggaaaatgaggagttattaaaaattttaaaatatactgatttaattgaagctgatttagctgaatcatatgtgcgatcttttaaggatagttgtccttggtctgataaaaaatcatttagacttggtaattttatttttgatgacgggtcagatcaagttaaatctgatgatcttgattttaatctagttgtacaatcaccttacgttagtagttcaaaacttgatagttcaaaagagactgctattctttctattaaatattctgatgaacttgatgatgctttaaagtatcttgctgcaacaaagctgttgataaatgaaaattatgctaaatctgtgatgataaaaaaacagaatacgtgtagcgatgatgcgcgaaatttgattttacagaaaatgattgattcagaaattgaaatagatggttcaaagaaaaaagttaaatcgattattagtaaagaacctgataatattgatgaatttttccatcatgtaaaagaaaatgtgtttaatgattattttagttcaacttattcaaaatatcctaagtttttaaaccaaatatcttatgaaaatgttaaaggagaagttgaaagcactattaatgaacttcttagtaaaagcgagcggaatttgttttcaaatgcaaaaaatattttgtcttctcttgatctgatggatattgatggaaatattgatacttcgaattctttatatgtgaaggtaatcgttgaggagcttgaaaaaaataagggtaaaaatgttaaaattgatgatatactagaaaagttacaaaagcctccatttggtcttgatgtagaagttatttatcttgtatttgtagtgttaacatataatggtgagataaaccttagaaaacgtggtggaggaactattacttcttccgatcttaaagatgttttcaatattggtattagtgcttttagagatattccttatgcaactcttgaaactgaatttccaatagattctgtaataaaactatttagagctttaaaattaaatcaaggttatgttagaaacattaaagataggaccaaagccgttcaggagtttcgattaaaaacattagaactaaaagaaagtttagatattattttcagaatttttcaggagatttcttctaaacctgatccaattattgataaacaagaactttctaaaaaaatcgatgaattagatacatttccgattggtgatttcttagaagttaaaaccgttaatgattttcgtaaagttgaatatgatgataaacaaatagattctatctcaaaaaatcttgagttgattcaaaatatcaaaggatttattgacgattataatggttttattaatcgagaatatctatatatgaaaaattctatggaatggatgaattctaatcctgtgatttttaatgattccgacaaaaaagctttgaatgaaatacgtgttgaatgtcgtccattagttgaagaaacaaacaatgttttaaatagtgaacaacgtcgaattttaaaaggtaaactacagcagtacaaaaagaaatatgttgatttgtattttatgaagcataaaacaacaattggagatagtatccattgggaacgtcttgaaaatgttagtaaaagtaatgaactgaaaagacttcgtgacatgaaagcaatacgttgtattgctccattgaatttaattaaacttgaagaaaaacttctttcactttcaaaggcacgatgcacaaatcttacagaggaccatttaaaggaaaattatctatgtacttggtgtaggtttcctgagactttaaaaaatataaaagacattaatgaagaaatttcaagtatgcaagaatcacttggaattatttctaaacaatggaatgagacaattctaagtgaggttgaaaactatagcgacaatgttaaacttttatctactcctgagaagaaaataattcaagatattcaatctaaaaaaagtttacccgatgatattgagcaagatgctataacagcattaaataatctgttttctgagctttctgaaattgaaatctcccctaaggaagttatagattttattttttcagaatcaagtgttttagattttgaaacattttcaaataaacttgatgaatataaggataaaatacttgaaactggagataagaaaaatattcgtattaaaagaatggagagtcaatcttga

SEQ ID NO: 548 - DNA, 3735 bp, Pseudomonas sp.
atgtcgacagctatgaagtatggcgatctcattcagtttgagccaattgagtcagttatccagctgctggacgccaaccgtcctgatgaggcgcagaaactggtttccacttacgtcatctcggatgacatggctgagcgcattgcgtcgctgatgattccccagttgtcgttcgatgagtcggtcgaccacaagggcttgctagtggtgggcaactacggtactggtaagtctcacttgatgtcggtgatttcattggtggcggaaaacgccgattacgcctcgaagattcgccaccccaaggtcgctgaggctgctgctgcgatcgccggcaagttcaaagtgcaccggatcgaggtctccagtcagatgtccctgcgcgacatcattacctatgagctggagcgtttcctcgccaagcatgatgtgagttacgccttcccgccggccgatcaggtggtcaacaacaaggcatctttcgaagaaatgatggcagcctttgatgagacccatccgggcaagggcgtgctgctggtagtcgacgagttcctcgactacctgcgttcgcgcaaggaccatgatctggttctggatctgtccttcctgcgtgaaatcggcgaggtcagcaaacacctgcgctttcgtttcgttgctggtgtgcaggaagcgatttttgacagcaaccgcttccagcacgttgccgacagtctgcgtcgcgtaaaagatcgcttcacccaggtacaattggcgcgccaggatgtcagctttgtagtcgccgagcggctgttgaagaagtccgtcgatcagcaggaaaagattcgcgcatatctgaccccctttgccaagttctacagctcgatgaacgaacgtatggacgagtacgtgcgtctgttcccggtacacccggactacctgaaaactttcgaacagctggtattcaccgagaaacgtggcgccctggtaaccctgcgcgaccagattcaagccatcctcaatgatgtggtgcccaaagatcggcccggcttggttgcctacgattctttttggcaaaccgtaaaatccaactcggtgttcaaggccgacccgagtgtcgggccggtgatcaatgtctctgatgttctggaatcccgtatccaacaaggcttcacccgtccgacctacaaggccatggcgttgcgtatcattcatgccctgtcggtgcatcgtctgactactggcggtgacatctatgtaccggttggccctcgggcccaagagctgcgcgactctctgtgcctttaccagccaggcttggaagacatgcccgagccggctgaggatctgctcagttttgtggtaaccgccttgcgtgaaatcctaaaaaccgtgaacggtcaatttatttccaaggccgcggacactgagcagtactaccttgacctgaaaaaagacattgactacgacgcgcagattgagaagcgcgccgacgtactgtccgatgacagtctggatcgcgcatacttcggtgccatcaagcagctgatggagcaggcagatgacaactgctatgtgaccgggcatcagatctggcaataccagatcgagtggcaagagcgtcgtgccgagcgtgatggttatctattcttcggtgcccctaacgatcgcccaacggcccaacctgagcgtgacttctacatctatttcgtccagccgttcgagccgccgcgcttccgtgatgagagcaaggctgatgaagtgttcttccgccttaagggactggatgacgagatccgcaaacaccttgctttttatgctgctgctttggagctagccaactcaaccagtggagctgccaaaggcatttaccaggggcgcgcgcaagacttcctcaaagccatgagcaaatggctgcaagagaagcagatgagcgcctacgagattacctaccagggtaagaaggcgaccttgcaggactgggtcaaaggcatttctctgcgcgacagggcgcgcttgggcagtgacgagcgtatcaacttccgcgatgtggtcaacgtggtctcaggattggcaatgagtcagcaattcgctgagacagcgccggaatacccaacctttccagtgctggtaactaaggccaacctcaagcaaatggtcggtagtgcactcaaggcgctggccggtggtgcgcgtagcaaggatgccaatgccatgctcgatgccctggaaatgctcgatggcgaccgtattgaggcgggcagttcgcgctatgcccttgaattgctcaagcgcctcaaggacaaggggcacggccaagtactcaaccgtagcgaattgctggtgggcggcggcgaggttgaatacttccatccgatccgattccgtctcgagcccgagctgcttgtgatcgtgttggccgggttggtgtattccggcgacattattctggctattaccggcgacaagatcgactctagcaaactcaacttgttggccgagcgctcacaggacgagctcaagaacttcaagcatctggaagcacccaaggaaatcaatgtcgcggtgctacgcagcctgtttcagttgcttggcctgactcccggcctggcgcagatggccgtgcaaggctctgaggaaccggtcaatcagttgcaaactaaggtaaccgagttggtgaatcgtctgctttcggccactaccgatatgcaaaatcgcctcagcttttgggggcagtcgctgcttactagtgctgaagcagcggactggcgcgcacgtctggagtccctgaagggctttattgaagggatttcaccgttcaatacggtaggcaagctgaagaacctgcgcatcagctccgacgacatcaacgtccagcaacagaatctgctggtgctggaatctgtcgagcgtctgctcgatttggtcagtgggctgggggctatcgctgcgtatctgtctcaggcagaaatggtgctgccgagtgaacatgcctgggttaaacaagcgcaggctgctcgaacatctattctgggcaagctcagccagaatcggacggcgcagcatgccagtgaataccgccaggcactcagtaccctgaaaaaggactacctcaacgcatacatcggcctgcacagtaaagcgcgccttggcgtggtggaagacaaaaccaaggcggcactgcgcaaggatccgcgacttgcgaacctgcgcacactggccggcatctcgctgatgcccaccagccagctaagtgcttttgatcaacgtctcgacagcctaaagagctgccaccagctcactgaattggagctcaacgccagcccttgctgcccacattgcagcttcaagccggctaatgagcaactgcaattgggggtggcggccagtgcgctcgctcagctggatgatgagctggatcagttgctggccaactggcaacagacgctgctggacaacctcgaggacccgaccattcaggccaacctggaactgctcaaggccagcgcccgcgaattgattgagagcttcgtcgtcagtcgcacgctgtcagacccaatcactctggcctttgtcagcgcggtgcaagaagccctgtcagggctggagaaaatcacagtcagcggtactgatatcaagcaagccctgctcagtggaggttcgcctgcgactccagatgatctgcgtaaacgctttgaggttctgctcagcgagcgttgtaagggcaaagatgccagcaagctgcggtttgtggtcgaatga

SEQ ID NO: 549 - DNA, 3699 bp, Bacillus cereus
atgttaaaatatggagatttaataaagtttgaagcagttgaatcggttgttcaactaaaagaagcaaatgatacagattatgcaatttcactattaaatacatatgttatttcagataacatggcagaaaaactaacaaacgagattattgaaaatattcaattcgatcgttgggttgataataagggaatgcttattgttggtaactatggaacgggtaaatctcacttaatgagtgttatttccacaattgcagaattaccaggtgcgagtgagcacttacgacataaagaagtagctgaaaaggcaaaagaaattgaagggaagtttcaagttgttcgtgccgaatttggtgcagttacaatgccactacgcgatatcatttgtcgtgaattagaacgtggactggaaaaaatgggaattgattatactttcccagcagcggatcaagttacgaataacaaggaaatgttttatgaaatgatggaattgttccatgagcaatatccagataaaggattacttttagtaatcgatgagttacttgactatttacgtgggcgaaaagaacaagatttgactttagatttgggttttttacgtgaagtaggagaagtatgtggtaaatcacgcttccgttttatttctggtgtacaggaaatgttatttgataatcctaaatttagttttgttgctgattcgcttcgtcgtgtgaaagaacgttttaaagaagcacgcatcgttcgtgaagatatagcgttcgttgtatctgagcgtttgttaaagaaaaacgatgaacaaaaagcattgattcgtgaacatttaaacaaatttacaaaattgtacaatggattagcggaagatatggaaatgttcgtaaatatgtatccaattcatccttcctatcttgaaacatttgaaaaggtaaatattgctgaaaagcgtgtcgtacttcaaacaattagtaaagaaattaaaaaattgctaatgcttgaagttcctgaagatgctacaggattaatctcttttgatcgttattggcaatacattgaggaagactcgtctcttcgaacaaatgataatgtaaagttggttatgaataaagttgaaatgttaaaaggatgtattcagacaggtgtgaagcgccagtataaagttatggccaatcagttagttgatgcattagctgtgtatcgtttaacaacagatgacttaaaaacaccaattggtcttacatctgaatcattacgtgacaaattatttataagtcacccaatgttgttagaattagatgaagaggcttctgaatttttaacaacgatgattgaatcggctatgaaagatttaatgactgcagcgagtttccaatttgtatcgttaaataaagataatggtcaatattacattgatattgcaaaagtaacggcagttgatgaattaattcaacagcgtggagaaggtttaacagataatcaattagatagttattatttccaggtgttaaaacaagcgacagaagtagcggatacttcttatgtaagtggatataaaatttggttgcatgaaatcccatggattgatcgtcgtgttaaacgagaaggttatatattctttggagcaccgaatgagcgctctacagcgcaacctgaacgtgatttttacatttatatgcttcaacctttcgaggaaccaaaatttaaagatgaacaaaaagaagatgaagtatttttccgtttgattaagaaaaatgatgattttattaatttgctacgtctatatagtggttcatgtgaaatgtataaagatacaacaacaaatcgtcatctatataagccgaaaatggatgattacttaaagaaattagtgaagtggttaaaagaaaactttgttgaagcttttgaaattgtttatagaggaaagcacgctgatgttttagagcatggattcttccttccaagtaatccagatacactaattcaaatcattgattctgtttcacaggatttactttcacaatggtttgaggtgaagtatagtgagtatccgactttccgtaaattagataaatcgtttgttacaaaatcgaacatgcaaacatacgtaaaagatgcgttagattatttaaatggaaagaaaacaaatcaaggagaagcaatcctaaatggtttagttcttcttgataataatggaaatttaactgcaagaaactctggttatgcgaaatgggtattagaattactaaatcaaaaagaacctggacaagtgttaaatcaaaatgaattaatagaagtcattaatacagtacaaggaacaccagatcagagagtaacaaaacaatttgcaatggaaccagaattattagcggtagtgttagcatcgttaattcaaagtggtgaaattgttgttactgtaaatggtaagacatatgaagctatgaattttgctgaatttgttcgtttgcccataaatgacttaacatactttagtcatattaaaaagccgagtggtttaccagtcccagcagtgcaagggttaattgatatgtttggcgcagtgcaggctgactttacgaattcaaactctgtagatttttctattaaacaaattatatctaaggcaaaagaggaaacaaccagaactgttcaaatgattgcatctgttagagataaatttcaaatatgggatggacaactgttttcatcggaagagaaagaagaaaaaattaaaaagttaaatagcttaagtgagtttttacaaggactgcaagtgtacaatacgcgtgctaaaatggtgaacttgaaatatgatataaatcgtattgaggaggagaaagagcatttagcgattgtttatcaactagagaagttacagcagaaaattaatgagtatacaaaagtggcgtattatttatcaaaagcgaagtatattgtcgctcctagtcaggagtggatagatgatgcggatgtgtcacttgataatttaagtatcgctttaaaaaatggtgaagattgttcaagagaagtgggagagcttgagcgactaagaaaagaatatattgaacattatatggcacttcatcaaacagcaagattaaatgcaacagagaataagaaaaaatcagagttattaaaggatccgcgttatgatgctttaaatgtattagcttctaagatatcgttcttacctcgtcaatcctttgataattggcaaatgagtttaaaagcgttgaaagattgttataacctaacagtggaaaaactacaacatacgccggagtgcccacagtgtagattcaatccacgagaggaacaaaataaatcaaagccttcattggtacaactagaagaccaattaggagaacttctaaattcatggacagaaacattattaacgaattttaatgatccaattgtaaaagaaagtattgatttactcgaatctgaacaaaaacgtttaatgaatgaattaattcaaaataaagcatttacacttccaatctcattaaatttaattaatgcaattaatgctgttcttaaagggattcataaagagcaaattgaattgggacaacttatgaaggtatttggagatggaaatcctatcacagtcgatgaagcacgtaaaaacttcgatatgctattaaaagggttagttggtacgaatgaaacaaaccgagttcgtttaacggttaagaaataa

SEQ ID NO: 550 - DNA, 3675 bp, Treponema primitia
atgaaatacgccgatttaatcagttttaatcctatagagagcgtccttgcaatagcagaggccaatgataaatctcaggctagtaacttagtcaaaagttacgtcatgtccgatgatatggccgaaaaattacaaatcaacatgctttctcaattaaaactggaagatgtggttgataataaaggcgtgtttctggtcggtaactatggaaccggtaaaacgcaccttatgtccgttatttccgcagttgccaacgatgctgacaatctggcctttctgcaaaataaaaaatttgccgattatgcaaagaatatagccggaaaatttgaagttcttcgcttcgagttaagcgccgttaaaacctccttacgtcaaatagtcctgtcccggctccaggaagatttaaaaggacgaggactttctttctcttttcccaaagaagatgaaaccatcagcaataaagatgttttgaaatccgccatggaattgttttcatctaaacatcctgataagggttatttaatcgttatagatgaattccttgattttcttggcggcaaagatgatcatgcggtccgttatgaccttgggtttatgcgtgaacttggcgagatagtaaaagaaacccgcctgcggatcattcttggggttcaggaaaaactgtatgataaccccaatttcagctttgtttctcagaccatcaacaaaattaaagaccgctttgaacaggtagtcatccgtaaagaagataccgcctatgtggtagcggaaagcatcttgaaaaagaccgctgatcaaaaggcaattatccgtgaacatttgcaaaaatttacttccctttattccaatatggatagccgtattgaggaatatgtagatttatttcccatacacccctcttatatcgatgtttttaataaaatctacatgatagaaaaccggcatatcctaaagaatgtctcggaaattatacgccggaatctggacaatatactgtcagacgaaagtaccggagttatatcctttgacagctactggtctttcataaaagagaacaatgcgcttcataccgatccgaatattaaggaagtggtggataaaagtggaaaactcgaagacatattaaaccgctctttccccaaaaaattgtacaagccccttgcagtacagataattttcgcattaagtgtccatcgtctgaccactggcgataccagtattcgcgccggtttaaccagtgaaaatctgcgtgatgacctgtgcctgtatttacccggaatgcccgaccagacttccgataccctgcaatcaatcgttcagaccgtcctaaaagacattatgaccaccgtaagcggtcaatatatcgacagtaatcccgataacggtcaatactaccttgagctgaccaaggatattgactatgatgaaaaaattaatcagcgggcggctgtccttgccgatgacagtctgaataattactattatgaccttatctattcctctcttgagtgggacatccaggaatatgtgcctggctttaaaatttatgagcatgcccttaattggcagtctcataatatcttccgaaagggctatctttttctaggcacccccgtagatcgaccaaccgcacagccaccccgcgattactatatatactttatacccccctatggaacctccacttggaataatgaaaaaaaggatgatgaagtatttttctttcttaaaccaaacgagagctttaagaatgatctcaaactatatgcggcggcattattaaaccgtgattttgcagacgataaaaacaaggcgcagtaccagggcaaagccgaaatcttcaagaaaaaattattgcactattttagtgaaaataaaaataccggatttgaagtcatttttaagggagaaaagaaacaaccccttgaaattatacaagccaaatacaataaagacagtacctttgtgcaaactattgatcttattgcaactatttgtctggatggatgcttttccaccctgtatccgctaactcctttatacaaaacaaatattacccttaaaaacctctccgataccgtccgttccggtattgaatatattgccggacgtaaaacacaaataggcgccgcgtttcttgatagctttggattaattgataccgattcggtatcaattaagaattcaaaatacgcccagtattatttgcagaaattggaagcccttccggaggacacagtcataaattttactgatatatatgaaaatatttcagccgaatatatcgataaacagtttaaaattagttatgatatattgccggttgtcttcttaagtttggtctattcagggaaagcggtattatctcttaagaataccatcataaccgcttccaatatcgaaaatttggtaaagacgcccggcgccgatattaacgaatttaaatacctctcaaggcctaaagatgttcaactaactgagcttgcccatctttttgacgtattaggcttacagagcgctttaatactgaatccagcaactcgggaaaaagccctggataagttattggcagaagcaaaagtcttgaccgataaagcagtaatcgctgccagcaaactgaatgataactttgaactatggggtgaacctctgtctccgtcccatatcgccgctgagtacaaaatttcgacaaaatcggtttccgatactttgggcaattttcacgcacgatttaataccgtagccaaactcaataattttaccctttcaacgggcgaaattgataaacttgcgaaagatataggcaacgtaaaaatagtcggtgaatatgaaaccttaaaggccgaaacctatcccaatgtactttacatggttaatcttgaaagcatcgacttgggcgccgccatacggggtgaaattgaagcggcaaaagaggcgttcaggaaaatccgtgatgccattccgcaatccttggatggaattacgggagcacagcaaataaacgaaaccttatccaaggttaaagaaaaatatatcaacctctattttgaggaacataaaaagaagcgccttaacaacagcgacgcaaagaaaaaaggcgatattatcgcatcccctaatctcaccgcgcttaaacagcttaggaaaataagtatcctttctacttcaaaactggataccatcgaaaaagagcttgccagtcttaaagtatgttatgaacttaccaccgacatgcttaaaacaagccatttttgtaccaaatgtaattttatgctgggcgcccaggatttgcctattcacggtaagttggaagaattaagtgaccgtatcgatacacttttagctgagtggaataccacattgctcaataccgtttcagatcccttagtgttggaacaaaagcaatatctttctgcggatcaacagaaatgtattgatgattacatagccgccaaaaaattgccccagactatcgatcagttttttgtcaatgctatcatagccttattgcatggttttgagcctgtcactattccggcaatggaccttattgacaaactggatgctcttggtccctgcgaagttgaaaaattcaaggtggaaattactggtataatcaattcctataccgaaggtaaggataagtccaaactgcgtatcgtgataaagaggtag

SEQ ID NO: 551 - DNA, 3708 bp, Bacillus methanolicus
atgttgcgttatagcgatttaattcaatttgaaccaattgaatccgtcgtgcaattacgcgatgcggatgataaagaacgtgcgtttcacttacttgatacatatgttatttccgaccgtatggccgagcaactagacgatattatcatcgaacaacttcagtttgatcgggtggttgacaataaaggattattgattgtcgctaactactgtacaggtaaatcgcacttaatgagtgtcatttcgacgattgctgagcagtcaggggcaagtgagcatattaaaaatgaacgtgttgcaaaaaaagcaaaagaaattgaaggaaagtttaaagtgattcgtacagaaataggcgctgttgcgatgtctttacgtgacattatttgccaagcactacaacaaggtctagcgaatctaggaattgattatacttttccaagagctgaagaagtaacaaataataaagacatgctttatgaaatgatggaattattccacgaacaataccctgatcaagggctcatgcttgtggtagacgaattattagactatttacgcagccgaaaagagcaggaactcactttagacttaggatttttacgcgaatttggggaagtttgtagtaaaactcgtttacgcttcatcgctggaattcaggaaatgttatttgacaacccgaaattccaattcgttgccgattctttacgtcgggtaaaagaacgtttccaagaagtaagaattgtccgcgaagacattgcatacgttgtgtcagaacgtctattgaaaaaggatgaaaaacaaaaagcgttaattcgcgagcatttaagcaaattaacatcattataccatcgtctcggtgaagatatggagacgtatgtgaatcttttcccgatccatcctgcctacttggaaacatttgaaaaggtaaatatcgcggaaaaacgtgttgtactgcaaacaattagtagagaaattcgaaagctattgaccgaagaagttccggaaaatgaaacagggattatttcctttgaccgttattggcaatatattgaagaagactcttcactaagaagtaatccgaatgtaaaagaagtgatgagtaaagttcggacgttaaaagatcgtgtacaaaatggtttgaaaagtcctaactataaacccgctgcattgagaattgttaatgctcttgctgtttaccgattagctgtcgatgacattaattctcctgtgggactaacatcaggtgagttaagagataaattgttcttaaatattggaatgttattagacttaggagacgaagctgctgattttttgaaaacaagaattgaagcaactttaaaagaaattatgacagcagttagttttcaatatatttctaccaatcaagaaaatggtcagtattacctagatgtaaaaaaagatattgctgtagacgatttaatagaaaaacgtggggaagagttaacggacaatcaattggatcgctactattttgaaatattaaagcaagcaaccgaagtggcagataacacatacgtaaccggctataaaatttggctgcatgaaattccttgggaaaatcgccgtgtcaaacgtcaaggatatttattctttggtgcgccaaatgaacgttcaacggctcagcctgagcgagacttctacatttatatgttacagccatttgaaccaccaaaatttaaagacgaagaaaaagcggatgaagtgttcttccgtatgactaaaaaggatgatcgatttgtccatttattgcgtttatatggcggagctcgtgaaatgagtaacgatgctgctgctacgacaaaacgtttatataatgataaagcagcaagctatttaagaagtcttgttacttggttaaaagaaaactttgtagaagcctttgaaattcaatatcgtggcaaaaaaggatctgtattagaattcggtatgtttcttcctggaaatgccacattaattgaaatcattaacacagtggctgaagggttacttagtcaatggtttgaagaaaaatataaagattatccttctttccgaaaattagagagaggatacttaacgaaagacaatatggcaacttatatcagtgatgctctttcttacattaatggaagaaaaacgagccaaggggaagcaattctcaacggactagtgttattagatcaaaaaggcgacttaaacgttcgcgcttctggatatgcacgttgggttattgaaaaactagaagaaaaagggcatggacaagtacttaatcaaaacgaactaattgaaacaatctatactgttcaaggtacagaagatgtaagattgacacaagaatttcgcatggaaccggagttattagttgttgtgttaggtgctcttatccaacaaggtgaaattgtcgtaacggtagacaataaaacatacgaagcgatgaactttggcgagtttattaaacttcctttaagtaagttaacgcattttagccatattaaaaaaccgagcgggttgccaattccagcaattaacgctttaattgatatgtttgatatcggtaaaggaaatgtgactgatgaaagttggctagaattcgccattaagcaaatcattagccaatcgcgccaagcggttgaaaaaacggttaagatgataaacgatgtacgcaataaattccatatttgggacggtccgttattctcaagtgacgaacgtgcagaatacattgcaaaacttgaaagcttaaaaacgttcttagaaggccttcaagtttataacacgcgggcaaaaatgacaaacttaaaatatagcgtgtccgatattgaacaacaaaacgaaaacttaaagattgttactaagcttgagcaattacaacaaaaaattcacgaatacaccaaagtagcggattacttatcaaaagccaaattagtcatgtcgacaaatcgagagtggctcgaaagcgttgacgtagcgttagacaacttagcgattgcattaaaagaaaatagcgactgctcaagtgagattcgtgaattggagaaattaaaagaagaatatattcaacattatttacagttacaccatcaagcgcgtttaaatgcgactgaagaaaacaagaaaaaagcattattgaatgacaaacgttaccttgcattaaaagagttggtatcaagaattgatttattgcctcgtcaagcattagatgagtggaataaaaacattcaatcattaaaagcttgctatcaactaacacgtgaacaattacaacattcaccaatttgtcctaaccctgattgtaagtttaatccgcgtgaagaaggtgtagtacaacgctattcattagagcaattagaagaacggttagatgatttgttaaatacgtggacagagacattattaaccaactttaacgactcagctattcaagaaggaatctcattattaagtgctgagcaacaacaactcgtaaacgattttatccaaaagaaacagtttgatttaccaattgacattcgccttcttgaaattattaatgacttactaaaagggattcataaagaagagattcatattgaccaacttgtgaaaatgatgggcgatggcaacccattaacagtcgacgaagtgagaagaaactttgaaatgttgatgagggcaattgttggcaacaaccaaccacatcgtgtgcgcatcatggtaaagaaataa

SEQ ID NO: 552 - DNA, 3726 bp, Vibrio scophthalmi
atgaagaagtacggcgacttgattcaatttgaatcagtaacagcgaacattcagcttaaaaactcaagtgatcatgataaagcgacaggcttggtttcgtcatatgtaatctcagataagatgtctcagaagctgagcaatgtcattatcgaacaacttcagtatgaagagtctgttgataacaaagcgctttggatcgttggtaactacggttcaggtaagtcccacttgatgtccgttatctccgctgtcgcagaattccctgacttagcaagccatatttcaaatgatgttgttcgtagtgcatcagacaagattgcgggtaagtttaaagttattcgatttgaaatcggtgcatcaaaaatggcactgactgatatcgttacgcaaaatttgactgacggcttagccgatatgggagtggactatgaattccctccaatgaccgaaatctcttcaaaccacaaaccttattttgaagagatgatggccacattccatgaaaaatatccagatcatggtttgcttctggtttgtgatgagatgctagattatttccgctcacgtaatgaacaggagctaccgttagacattgcgattctacgagttatcggtgaggttattgatggtacacgtttccgctttatggccggtgttcaggaagcgatttttgatagcacgcagctagagtttctatctaaggaagtaaaacgaattcgcgaccgtgcagaacaagtacttattgctcgtgaggatattaagtatgttgttgctgagcgcttgttaaagaaagatgcccaacagcaggaatggatccgcgagtatctgcaaaagtttacgccttattacgacaaaatgaacgagcgtttagacgagtttgttcgtatgttccctgtgcacccagattacatcaatacgttcgaacgagtgcgaatggctggtcttgaaaatcgtcaagtactgaaaagtctttcccgtcagatgaaagaattgatggaagacgaagtgcctcaagatgtgccggggatcttttcttacgatacctactggaacgagctaagcagtgagccaagcatgaagactaacccagaggttggtcaagtcattgaaacaggtgagcttctagtagatcgtattgatcaagcgtacccaactccaggtgagaaagagtttgccaaacgtttggttgcaggtctagcaatccaccgtatggcggtaggcgatatttatgcagagatgggcgcaacagcagctgaactacgtgactctttatgtttgtatttgaagaacatcgagatcatgcctggcgataagagcaagaacttggaaaatcacatcgtcactgttcttactaaggttcgtcgtactgttaatggtcagtttttctctaagaacaaaaccaacgatcagttttatctggatctgaaaaagaccgaagactttgatgcacatattgaagcgaaagccgcaggattgtccccagatagcatcaactctgcttacagagcggcaatgttagagatcttagagcaaacagactctcaacaatcaaaaacagcaatgtggcagcatgaactgaagtggttagaccgaaacgttagtcgtcctggttggctattccttggttctcctaacgagcgtgaaaccgcgaaacctcagctagattactacatgtatttcattcagcctgagaacccgcccaagcaaaagaaagagtttatccgtgaagacgaagtgcagttcgttctcaagaaccgtgatgaagagtttaatcaatctctaaagaactatgcggcatctgtagcgctgcgtgcactagcaacaggcagtgcacagcatacatacaaaatcaaagcggacggttatcttggtgagatgattaaatggattcgcgccaacatcaaagacgcgtttgaagttcaatataatggtaagtcgaagccaattatggactggttgaagggagcatctgttcgcgatatcaccggtattgcagacagtgaccatggcagtgttaaagacatctttgaagcggtagcgagctttattctggaaggctacttccagtctcttgctccagaataccctaagttctcacagcgtattactgaagataccattagtgtcgcaagtaaagatgtattgagctatttagctggtggtgctgcaactaaacgtgctaccgctgtacttgatgcacttgaattacttgatggtgataagctaaaaccaagacgttctcgctatgctcaagcagtactagaagtgctagcagcaaaaggccatggtcaagttgttaaccaaagtgaattgttagaggcagtttatgcgcgtctatacttcaaacctggcacttaccgattagagccagaatggttactagtgattttagcaacgctagttcatgccggggaattagagctatcagttgtaggtaaagtcatcacggcaagtgatgtcgatgctttgaaagggcttgattttaatacactacttgactttaaacacattcaagcaccaaaagactttaatgtcagtgcaattaaagctgttcttgaattacttgggatgaatgaaggcttagcgacgtctattcagcaaggtgatgaaaatgtcgttcgtactatgggacaagagattgaaaaattagttaaatatctcgtacatgatcagcaacttgtaaaacatcgacttatgttgtggggtaatcatgtccttgctgagaatgaagcgacactgttagcagatcgtttgggtaaaacgaaaacattccttgagtctctgcagcgtttcaatacgccaggtaaactcaagaatttcaaagactcggcggagtcaattgtagagcacgcagaaactttgaaagagtggaatagctttaaacaactttcggaagtggtggatagctttgctgaatacgctcaatatcttaaagaagctcagctcattcttgaggataatgatgagtggcaatctgatgtgcgagatgcagcgctagcacttagaaatggtattgaagataaaactacacgcttagagttaagctttaagcaagagcatctagcaaatcttcaacagcttaaaaaagcgtatacacagcgctatgtttctttgtaccaatcggctcgtttaacaatggagcaggataaagagaaagcggcactgattggcgacgaacgtctgcaaacgttagaagcattctctgggatctcattacttcctgcagagcaggttaagcagtggaggtcagattgggcctctttgcaagttgctgagtcgatagaccctaaaacaattgaattgacgccaaaccctgttaacttctcaccacgcagtgagggaagtaaagcttcagcaagtgaacgtcttgttgagctagatacgcagctaaccgagatgttgtcagagtggacccaaagtcttaaatcgacgttagccgacccgttcttacagctggatttattgtcagaagtccaacgcggtgaaattaatgctttcattagttcaggaagtttatcaactcctgtgagtaaagagtttattgcaggcgtaaacgaggccttagctggcttagaagaagtgaaaatctcaacaatggatctagttgcaagtttaggtaaaggaacgccgcaaacattggatgatgttaaagctcgctttgaagaactgcttaatactcattgcaaaggtaaagacagcagcaaagtgcgaatcattattgattaa

SEQ ID NO: 553 - DNA, 3753 bp, Thiorhodovibrio sp.
atgaagtacgccgagctgatccaattcgatccgattgagtccgtcatccaactgcgtgacgccgaccagtcaagcacggcgcagcaactggtcagcacctacgtcatttccgatgaaatggccgagcggctcacctcgctggccattccacaattgcaattcgaccagccgctcgacaataaaggcttgatggtgatcggcaactacggcacgggcaaatcccacctgatgtccgttatctcaagcgtggccgccgatgattccctgctcgacggcctgaaaaacgcaagcgtacgcgaggccgccgcgcaaatcgccggacgtttccaggtcatccgcaccgagattggcgccaccaccatgtcattgcgcgacatcctagtcgccgagctggaagagcatctcgataaactcggcgtcgattacgtctttcccgacgccagcaccatcgtcagccacaagggcgccttcgaggacatgatggctcggttcgccgaggtcttccctgatcaaggcctgctgctggtggtcgacgagctgctggattatctgcgcacccgcaaggatcaggagctcattcttgacctcaacttcctgcgcgaggtcggcgaggtctgccgcaacctgcgctttcgtttcatcgctggcgtgcaggaagccattttcgacagcccccgcttcgccttcgtcgccgacagcatccgcagagtcaaggaccgcttcgaacagattccgattgcccgcaatgacgtgaaattcgtcgtcgccgagcggctgctgagaaaaaccactgaacaacaggccagaatccgcgagtatctatcgcccttcgccaagttctacggtggcatgaacgagcaaatggacgagttcgtgcgacttttcccggtgcaccccgattacatcgacaccttcgagcgggtcacggtggtggaaaaacgccaagcgcttaacaccctgtccgccggcatgaaagacattctcacgcgcgatgtgccagcggaccaacctggcctgatcgccttcgatcgctactggaaaacgctgacccataaccgcgcctaccgctccattcccgacattcgcgccgtcatggattgcagcgaggttctcgaatcgcgcatcgagaacgccatcgcgcgcaagcactacaaacccatggcgctgcggttgatccatgcgctatccgttcatcgactcacccacggcgacatctatgcccccatgggcgcctccgcgaccgaactgcgtgaccgcctgtgcctgttcgaccccatggtggaagagctcggcagcgatgagccggatgaggatctgaaaacccaggtcgagaccgtgctgcgcgaaatccacaagaccgtcagcggccagttcatctcctacaatgccgacaaccaccagtactatctggacctcaaaaagaccgacgacttcgacgccctgatcgacaaacgcgccgaaagcctcggtcaggggcagctcgatcgcttctattacgaggccctcaagcgggtcatggagtgccaggacgccacctacgtgaccggctataaaatctggcagcacgagctgacctggcaagagcgcatggccacccgtgccggctacctctttttcggcgcgcccaatgaacgctccaccgccgtgccgcaacgggacttttacctctatttcatccagcccttcgatccgccgcgcttcaaggacgacaaaatctgtgacgaggtctttttccgcctgaaaggcaccgacgaagacttccaaaccgcgctgaaaagctacgcagccgctttagaccttgccgccacctcctccggccacgccaaggccacctatgaagcgaaagccaatggctccctgaaacaactggtccagtggctgcaaaaacacatggccgaggcctttgaggtcacctatcagggccgcgccaagtccatgaccgagtgggccaagggcaagtccatccgcgacctgtccggtctgtcgcccgacgagaccatcaacttccgcgatctggtcaacaccgtcgccggtgtctgcctggccccgagcttcgagaatcaggctccggactacccgttcttctcagtgctgatcaccggcaacaaccgcgcccaggccgcgcaagacgccctgcgcgccatcgccggccccgctggaaaacagcagcccaccaagcaagccgcgtctgtactagacgccctggaactgctcgatggtgataagatcgacccctacaagtcgaagtacagcaaattcatccttgatgccgtcaaggccaagggccacggccaggtggtcaaccgcagcgagatcatccaggacgaccacgggctcgaatacatgaaccccggtggcggtcggcttgagccggaatgggtggtggtcatcctggcatcgctggtctattccggcgacatcgtgctcgccatcccaggcaaaaagtttgacgccaccggactccaaccgctggccgcgaccagcattgacgagctgatacgcttcaagcacctggagcagcccaaggaatggaatctgccggcgctcaaggccctattcgagctgctcggcccctacggaacaacaccgggcatggcccagcttgtcacccagggcaaggacgagccggtgcaaaacttgcagcaggcggtgggcaaggtcgtcaagcgcctcgtcatgacccagcaaaccctacgcgaggggctttctttctgggggctggacctgctcgcgggcaccgacctggccagccaggccagcggactggacgaggccaagggcttttttgaatcgctccaggcttactcctcgccgggcaagctgaaaaacttccgctacagcgcacccgaagtgctggcccatgaaaaggccgtgaaggccctggatgaactggatgctctgcgcgagttcatcatggatcacagcccgacggcgtcctggctctccaccgccgaggcggtgctgcccgccgagcatgattgggtgaatcgcatgaagaccacccggcaggccgtgctggatgccctcaagcaagccgacctgaccgaactggccagccagtcccagtccattggcgccaagctctcgaccctgaaaaaggactacagcgtcgcctatatcggcctgcacaccaaggcccggctgggcgtgaacgacgacaagcgcaaggccggactgctcaatgaccagcgccagcaaaccctgctcaagttggccggcatcgacttgatgccccggcagcagctcaccgattaccaaaaccgcctggccggactgaagagctgcttcgccctgaccgaacaaaacctcgacgcctcgcccatctgtccgcactgtgggttccggccctcagtggaaacctttgcttcggcaggcgcgcagatgatcgaccagatggacacccaactcgacgccatggtagcggcctggacctccaccatcatcagcaatctggacgatccgatcacccaggccaacatgaacttgttgaaaatcgacgaccgcgaaccgctggaagccttcatcaactcaaaggaactgccggtgccgctggacagcaactttgtccatgccctgaaggaagtgctctccggtctggtcaaggtcaccgtcaaggcgcaagcgctgcaacaggctctgcaagtgaccgacggcccggccaccccgatggagatgaagaaacgctttgaggagtacatcgatcagctcaccaagggcaaggacccggccaaggttaggatggtgctggaataa

SEQ ID NO: 554 - DNA, 3726 bp, Ectothiorhodospira sp.
atgcgctacggggatcttattcagttcgagccgattgagtcggtcattcagctgctcgacgccaatcggcccaatgaggccaagaagctcgtcgccacctatgtcatttccgatgacatggccgagcggattgccaagcagatgatcccgcagctctccttcgatgagtcggttgaccataaaggcgtgctggtggtcggcaactacggcaccggtaaatcgcacttgatgtcggtgctgtcgctgatcgccgaagacgccgcctatgtgccgatggttcagcaccccaaagtcgccgaggcggccggcagcatcgccggcaagttcaaggtgcaccgcatcgagatctccagccagatgtccctgcgcgacatcatcacccaggagctggaaatcttcctggagaagcagggcgtcagctatgccttcccgccggccgacaaagtcgtcaacaacaaggccgcgttcgaggaaatgatgacagcctttgacgaagtacaccctggcaagggcgtgctgctggtggtcgacgagttccttgagttcctgcgctcgcgcaaggaccacgacctagtgctggatctgtccttcctgcgcgagatcggcgaagtcaccaagcacctgcgcttccgtttcgtggctggcgtacaggaagctatcttcgacaacagccgcttccagcatgttgccgacagcctgcgccgcgtaaacgagcgctttgcccaggtactgctggcccgtcaggatgtcagcttcgtggttgccgagcgtctgctgaaaaaatccgctgaccagcaacacaagatccgcacctatctcacgcccttcgccaagttctaccacaacatgaacgagcggatggatgaatacgtgcggctgtttccagtgcacccggactacatcggcaccttcgagcgcctgatctttaccgaaaaacgcggcgcattggtcaccctgcgcgaccagattcaggccatcctggacgatgaagtgcccaccgaccgcccaggcctgatcggcttcgacaagttctgggaaacggtcacatccaactcggtactgcgctcagacccgaatatcggccctgtactcaatgtcgctgaagtgctgggcgagcgcgtgcaaaaagcgttttctcgcccagcctacaaggccatggccattcgcgtcatcaaaggcctgtccgtccaccgcctgactactggcggcgatatctacgtgcccgtggggccgaccgcagaagagctgcgcgacaccctttgcctgtaccagcccggcatcgaggacatggggggcgagccggccgacgacctgctgaccaccgtgcaaaccacccttcgcgagatcgtcaaaacggtgaacggccagttcatttccaaggcgcccgacaccgagcagtactacctcgacctgaagaaagacgtcgactacgacgcacagattgagaagcgcgccgaagccctgtccgacgacgctctggatcgcgcctactacggtgccctgatgcagctgatggagcgtaccgaggaagacacctacgtcaccggctaccgaatctggcaacaccaggtggaatggcaggagcggcgtgtcgaacgtaacggctacctgttcctgggtgcccccaacgaccggccgaccgcccagccggagcgcgatttttacatctacttcatccagccgttcgagcctccgcgctttcgcgacgacagccgcacggatgaggtgttcttccgcctgaaaggcctggacgatgccatcaagcgctatctggcctgttatgccgctgcccaagagctggcttcctcggccagcggtggcgccaagtcggtgtatctggacaaggccaaagaagccctgcgcgacatgagcaagtggctgcaggacaagcagatgacggccttcgaagtcacctaccaaggcaagaccaaaaccctgcaggagtgggccaagggcgtttccatgcgtgacaagctgcggctggggccggatgagcgcgccaacttccgggacatcgtcaacgtgacctcaggcctggccctcggcacccattttgccgacctggcaccggagtacccgacgttctccgcgctggtcaccgaagccaaccgcaagcagctcatcggcaatgcactgaaggcacttgccggcggcacccgcaccaaggacgccatcgtcatcctggatgccctggaaatgctcgacggcgaccgcatcgagccgacccgctcgcgctacgcccaggaagtcctcagccgccttaccgccaagggccacggccaggttctcaaccgcgccgagctgatcagtggtgccaccgatgtcgagttcttcgcaccggtacgcttccgcctggagcccgatctgctgatggccgtgctgggcgggctggtctactccggtgacattgtgctcgccatcaccggcgacaagatcgactccggcaagctctccctgctggtggagcgcgccctggatgatctcaagaccttcaagcacgttgaagcccccaaggagatcaacgtcgccgttcttcgctcactgttcgagctgctgggcctgccaagcggctttgcgcagatggctacccaaggcaaggaagagcccgttaaggaactgctggaagccgtcgcaaagctggtcaaccgcgtgctcaccgtgggtaccgacctgcaaacccgtctgagcttctggggtcagtccctgctgcgtgaagaagagctgcgtgattggcgcagccgcctggaggccctcaagagcttcctggaaagcctgtccccctacaacaccgtgggcaagctgaagaacctgcgcatcacccaggccgacattgaggcacagcagaagaacctggacgtgctctccgctgttgagaaactgcgtgatctggtcgccgagctgggtagcgtggctggctatctgtcccaggcggaaatggtcctgccgagtgaccacgcctgggtgcagcaggctcaagcagcccgcaaggatattctcgacaagctcgcccaggacaagagcgcagcccacgccgccacctaccgccaacagctggctgcgctcaagaaggactacatcaatgcctacgtggcccagcacagcaaggcacgcctcggcgtagccgaggacaagaccaagaccgccctgcgccgcgactcgcgcatcaccaccctgcgcgccctggcgggcatctcgttgatgcctaccgggcagctcaccagcttcgaagacaagctcgacaagctcaagagctgcgcctcgctggtcgaagctgagctggccaccagtccggtatgcccgcactgcggtttccggccagccaacgagcaagccgacctgctgccggccgccaacgtactcaaggccctggatgaagaactggatcgcctgctcgaaggctggcaacagaccctgctggacaacctcgacgaccccatcatccaggccaacttcgagctgctaaaggccagccagcgcgagctgattaccgccttcctggcgtccaaaacactgcccgattcagtcacgccggaatttgtagccaccatccaggaggcgctgtccggcttggagaagatcctggtcaccggcgacgacatcaagcaggcattgctgacaggcggctctccggccacgccggaagacctgcgccgccgcttcgagtcatttatgaccgaacgctgcaagggcaaggacgccagcaaactgcggtttgtggtggagtga

SEQ ID NO: 555 - DNA, 3669 bp, Clostridium papyrosolvens
atgaaatatagtcaattagtacaatttgatcctattgaaactgtcgttaaactaaaagatgctgattcaaagggagaagccgaaagacttgtaaagacctatgtcatgtccgacagtatggccgatagccttataggagttgtaattccacagttacagtttgaacaaaccgttgataataaaggagtttttattgttggtaattacggcacaggtaaatcacacttaatgtctattgtatcgactattgcagaagacgcaagccttttggattatataaaacatgataaatttagggaacatgctaaatccattgcaggaaagtttgaagtattgaggttcgagattggtgcttcaaagatgaatttaagggacataatcgtcagaaagctggaaagcgaccttaaacaaagagggattgattataaattcccaccacttgaagaagttactgataataagcagtatcttgttgaaatgatgggactatttgaagaaaagtatccagataaagggtacctcattgttgttgatgagcttctggactatcttggcagcagaaaagaattggagattaagctcgacctgggctttttaagggagattggagaagttagcaagaatactcgcataaggttcatggcaggcgttcaggaaactctgtttgataaccctggcttttcttttgtagcaaaaactatacttaaggttaaagatagatttgaacagatcattataagaagagaggatatatcgtttgtagtctctcaaagattgctgcagaaaaataatgagcagaaagcctggataagagaacacttgcagaaggttagctcaatgtataagaacatggctgataggattgaggagtacgttaatttgtatccaatacacccagcttttcttgagacttttgaaaaggtatatatagcagaaaagagagaggttttaaaaaccataaccttaaccataaaggaaatgctcgacagcgaagtacccaatgaggagcctgggcttgtttcctatgatgcatattggtcctacataaaaaacagtccatcaaagagaacagaaacagaagtaaaggatgttattgataaaagcggcatattggaaggtattattcagcattcctttacaaagccccaatataagcctattgctttgaggattatttacgcattaagtgttcacaggttgaccacgggtaatattaatgctcctctgggtattacagtgcaaaatatgaaggatgatttgtgcatatacgatcctctgcttccagagaaggaagaagattttcttatcacaaccattgagactattatgagagaaatctctaacactgtcagcgggcaatttattgaatataaccaggaaaacgagcagtattaccttgatcttaaaaaagatattgattacggtgcaaaaattcagcaaaaagctgatctacttgatgaagatagtttgaacgaattctattataaattaataaatatatcaatggaatggaatgcacaggaatatataacgggttttgaaatatatgaatatgatttaatatgggaggataaaaatgtagagcgggaaggataccgttttatggggactcccaatgggcggtcaactgctcaaccaccgagggatttttatatttatttcttgccaccatatggaactgataattccgcatatataaagaacgaggacgaagtgtattttgagttcatgtgtgatgctgggtttaccaatttactgaagatgtattccgctgcacacaaaatggcaagtatttcatcaggtgatagtaaaaactcttatctaaagaaagcagaagactaccaaaaagatgctataaaatggataagacagaatataaatcaatgctttattgtcagttatagaggtgaaagcaaaacaatattatcttggttaaaaggtaaaagaataggagataagtcgctcaaagaacaagtagacatggctgcggcatcttgtttagatgtatggtttaatgaacaatatcctgattatccaaagttttatattacagttactcacaataattataatcagctgtttaaggctgctatggactatatcgcaggtaaaaaaacagatacaggctcaaagatacttgactccttacaacttttagatgtagaaaatatttctcccaaaaactctgtatatgcaaagtattttattgacctaatcaatcatttgcctcaaggaaaggtattaaataggtcagaaatcatagagcgtattaacgaagaagttgaatatgataagagatttaagttggaaccaatctggattgctttgataatgtcatctttagtatacaacggagacattacacttgctgctggtggtaagaactttgatgctacgatgttaaaggaattagcagcagagaataccatgaaccttatagagtttaagcattgtgacaggccaaaggatgtgcctgtagctgtgctgaagaaactatttgaaattcttgggctgccccctggacaaatcgttaatgcaaatacaagggatgttgctgttgccagtatgctggttaagattgatgaatatattgataaggctttgaaggctacccttttcttgaatggtgatatatccgtttgggggaagccctcaatggaatcttataaggtggataactataaggaaagtataaaagaatttaagaatttcctggatggtttgaagatttttaatacccaggcaaagctgaaaaatttcagacacaccgaggaagagattgataagcaaggagcagcattaaggctgcttgtggacattgataagattaaggatttgaaatcaaagatagaagccaatacagcttatctgtctggggcagaaattgtattgaaggaccagtcgtggattgacaaggtaaatgctttgaagctgaagctggaaacagttcttaagaaccttgataatattgatgaagattttataagagtatttaatagcgaattatcaggtttgaaggatgagtatagaaatgtctatatggaacttcataaaaaaaataggcttgatttgaatggcgataatgcaaagaaaaaaattatgcagagcaaagagcttaataatcttaagaaattgacggctatagaagacatacttcctgtagttaagctaaatggaatcacagaaaaaatttcaaggcttcgtacttgctataaccttacccagcaggatatggaaggtaaatttatgtgtccgcactgccaatttaacccttccgagaataatcaacctgttcatggggtaattgacagtgtagaagatgatattgagaagatttataaggagtggaccgaaattattgtttccagcgttgaggatccaatggttaaagagaatattggcttccttaaagcagagcaacagaatgtgattagtaaactgcttgaaacaagaaaacttccagacgttatagatggcaactttgtatctggcgtaaacactctgatgaaagggctggaaaaagtcgaagtgcttgtagaggatatgaaaaaagcaatttcaggtgatggtcctgttactgttgaggatattagagcaagatttgaaaagtatgtccgtgacttgacgaagggcaaggatgaaagcaaagtaagaatcatattgaaataa

SEQ ID NO: 556 - DNA, 3762 bp, Thermoanaerobacter ethanolicus
atgaaatatggagatcttattcagtatgaaccgattgaaactgttataaaacttaaggatgcagacaagatcgatgaggcgaaaagacttgtcaaatcctttgtagtatcagaagggatggcagatagtattattaatatttgtataccccaattgcagtttgatgaaacaattgacaataagggtatatttatagttggcaattatggtactggtaaatcccatttaatgtctgtaatttcagcagtagcagaaaataaggaaatgctagattatgtttctcatgaagagttaaaaaaagagatgggaaagattgcaggaaaatttaaagttttaagatttgacattggggctgtaaatacacccttaagaaatataattacgaaagagatagaaaaggaccttgccagatacgggatagagttttattttccaccaattgatgaagttacaaataacaaagatgcttttatggaaatgatgagtaaatttgaagacaaatttccggacaaaggctatctcatagtggttgatgaattattagattttctaaaagcaaggaaagaacaggaattgattcgcgatttaacttttttaagagaaataggagaaataacaaagtctaccagattgagatttatgacgggagtacaggagaccctgtttgataatccggcatttaatgctgttgcacaaactgtattaaagatgaaggacagatttgaacagttaataattaaaagggaagatatttcctacgtagtatctcaaagattattaaaaaagaatgacagacaaaaagcatggataaggagccatttagagaaattcagtccgttgtataaaagtatttccagcagaatcgaagaatttgtggaattatatcctatacatcctatgtttatagaagtatttgaaaaaatgtttattgtagagaaaagagaagttttaaaaacaatatcacatttgatgagagaactgttagacaaagatgtacctgaagatgagcctggaattatttcttatgattcttattggaagtttttaagagacaatccttcattaagggcagagccagatataaagagagtagttgataaaagcgttgccgtagaagatttaattgaacattcctttacaagacctcaatataaagatgctgcattaagaattgtacatgcattaagtgttcataggtttactacaggagatatacatacatctgttggtataacagttgaaaatattaaagatgatttgtgtttatatataaaaatgccagagatagaagaggactttttaataacgactatagaaacaataatgaaggaaataatgaaaacattgagctggcaatatatttcatacaatccagacaatcagcagtattatcttgacatggtaagagaaggcataaattatgatgccaaaattcaggagaaagcagaaatattgtcagaagatatttttaacaggcattattttgaattgcttataaaagtccttgattggaatgctcctgaaaaagtgccaaacatgagaatatgggagtatagtcttacttggaatgagaaaaatgttaaaagatatggctatctttttatgggatatcctgatgaaaggagtacagctcagcctccaagagatttttatatttactttttacctccttttgttggagttaactataataaaaaatatatattaaatggaaaagaagatgaagtattttttgaatttgttaatacggatgaagaaataatagagaaaataaaaaaatatgccgctacaatggagttaagtgaattatcctccagtgaccagaaaaaaatttatgaagataaagctaatggttttcaaaaggatattactaaatggataagagataatgtgtcaaaatgttttaatgtttcttataaaggagaaacacaaagtataatctattggcttaaaggaaaaacagctaattatgatactattaaaagttatattgatgaggcggcttcttcttgcttatcattgtatttcagtgaaaaatacagtgaatatcctacattttacacaaaaatcacagaggcaaatttaaacgaagtttttaaaagtgcaatgaattatttagctggcaagaagacagaaacaggcaagaaagtattgcagtcttttgatttaattttaggggatgatattgtacccggaaattcaaaatatgctaattattttttaaatgaattatataaacttccaccagggaaagttttaaatagagaagatattatagagaatgtaaacggtgaggatattgataaaagattcaaattagaagtgcagtgggtggttcttttgctcagtgcccttgtgtacagcggagatataatcttgaggataaaaaataaagtttatgatgctactacaatagaggcacttgctaatatgaacgttggagagcttatagattttgacagttttgagaggcccagagatatacctgtcagagaattaaaaactctatttactttgttaggcttgccatcagggttagtaacagcaagtcttagcaaaccagaagaagctataagacaaatggtggcaaagagtgaagaactggctaaaaaagttgtaactgttaatcaatttgttgtttcaaataaaactatatggggtaagcctgtatttgatgaatttgaaataagagattataaagatttgctcaataattttagagattttcttgacagtttaaaagcctttaatacccctggaaaattaagaaactttaagtatactgaagaagagctaaaagaaaaattcaagacattggagacagtaaagaaaatagaaaaaataattgattttaaaaatgaagtagaagaacttgtcaaatacttgtcctctgccgaacagcaattacccgaagaaattgaattaaagcaaaatataaatgaaatgaaaaatgaagtagaaagatttataaaacaaattgatactaaagaaagtgaagatataaaaaggctgacgagagaattagaagaattgaaaatagagtatattgatttgtaccttgagtatcataagaaacacaggcttgattataatggagatgagcgtaaaaagaaaataatggcaagtgatctgtttaataatcttaagaagcttaaagatgtaggaatatttcctgttaacaaatttagcgaaattgaggatatattggcctctttaaaaacctgttatagtttaacagaaaaaaacatggaaattgagacacaatgtcctaattgtggatacagtataaaaagtggcgaagttcctgtgtttggaaaattggatgaaattgaagacaaaatagaaaatttgtatatggaatggactaaaattttattagataatattgaagatccaatgattcaagaaagaatggaaattttgaataaagaccaacaaaaagttatacgtgactttttgaataaaaaagaattgccggagaaagtggataatctgtttgtatcagcagtaaaagacttaattgctggtcttgaaaaagtagagattgaaataaataagtttatttctgcgataacctatgatggacctgtaacagtagatgagtttaaaaagagatttttagaaaatgtcgattttcttataaaaggcaaagataaggacaaagtaagaattattataatagggatgtgcaaaattaataaaaataatcacgacaaaaaaccaaaatatgtattacatacaatatatagtaatcaacactga

SEQ ID NO: 557 - DNA, 336 bp, Thermoanaerobacter ethanolicus
atgaggtatggtgagcttattcagtatgaaccgattgaaactgttataaaacttaaggatgcagacaagatcgatgaggcaaaaagacttgtcaaatcctttgtagtatcagaagggatggcagatagtattattaatatttgtataccccaattacagtttgatgaaacacttgacaataagggtatatttatagttggcaattatggtactggtaaatcccatttaatgtctgtaatttcagcagtagcagaaaataaggaaatgttagattatgtttctcatgaagagttaaaaaagagatgggaaagattgcaggaaaatttaaagttttaa

SEQ ID NO: 558 - DNA, 3381 bp, Thermoanaerobacter ethanolicus
atgggaaagattgcaggaaaatttaaagttttaagatttgacatcggggctgtaaatacacccttaagaaatataattacgaaagagatagaaaaggaccttgccagatacgggatagagttttattttccaccaattgatgaagttacaaataacaaagatgcttttatggaaatgatgagtaaatttgaagacaaatttccggacaaaggctatctcatagtggttgatgaattattagattttctaaaagcaaggaaagaacaggaattgattcgcgatttaacttttttaagagaaataggagaaataacaaagtctacaagattgagatttatgacgggagtacaggagaccctgtttgataatccggcatttaatgctgttgcacaaactgtattaaagatgaaggacagatttgaacagttaataattaaaagagaagatatttcctacgtagtatctcaaagattgttaaaaaagaatgacagacaaaaagcatggataaggagccatttagagaaattcagcccgttgtataaaagtatttccagcagaatcgaagaatttgtggaattatatcctatacatcctatgtttatagaagtatttgaaaaaatgtttattgtagagaaaagagaagttttaaaaacaatatcacatcttatgagagaactgttagacaaagatgtacctgaagatgagcctggaattatttcttatgattcttattggaagtttttaagagacaatccttcattaagggcagagccagatataaagagagtagttgataaaagcattgttgtagaagatttaattgaacattcctttacaagacctcaatataaacacgctgcattaagaattgtacatgcattaagtgttcataggtttactacaggagatatacatacatctgttggtataacagttgaaaatattaaagatgatttgtgtttatatataaaaatgccagagatagaagaggactttttaataacgactatagaaacaataataaaggaaataatgaaaacattgagctggcaatatatttcatacaatccagacaatcagcagtattatcttgacatggtaagagaaggcataaattatgatgcaaaaattcaggaaaaggcagaactattgtcagaagatatttttaacaggcattattttgaattgcttataaaagttcttgattggaatgctcctgaaaaagtaccaaacatgagaatatgggagtatagtcttacttggaatgagaaaaatgttaaaagatatggctatctttttatgggatatcctgatgaaaggagtacagctcagcctccaagagatttttatgtttactttttgcctccttttgttgaagctaattataataaaaaatatattttaaatggaaaagaagatgaagtgttttttgaatttattaatgcagatgaagaaataatagagaaaattaaaaaatacgctgccgctatggaattaagtgaattatcctccagtgatcagaaaaaaatttatgaagataaagctaagggttttcaaagggatattactaaatggataagagataatgtgtcaaaatgttttaatgtttcttataaaggagaaacacaaagtatgatttattggcttaaaggaaaaacagctaattatgatactattaaaagctatattgatgaggcggcttcttcttgcttatcattgtatttcagtgaaaaatacagtgaatatcctacattttacacaaaaatcacagaggcaaatttaagcgaagtttttaaaagtgcaatgaattatttagctggcaagaagacagaaacaggcaagaaagtattgcagtcttttgatttaattttaggggatgatattgtacccggaaattcaaaatatgctaattattttttaaatgaattatataaacttccaccagggaaagttttaaatagagaagatattatagagaatgtaaacggtgaggatattgataaaagattcaaattagaagtgcagtgggtggtccttttgctcagtgcacttgtgtacagcggagatataattttgagaataaaaaataaagtttatgatgctactacaatagaggcgcttgctaatatgaacgttggagagcttatagaatttgatagttttgaaaggccaagagacatacctgtcagagaattaaaaaccctgtttactttattaggtttaccatcagggttagtaacagcaagtcttagcaaaccagaagaagctataagacaaatggttgcaaagagtgaagaactggctaaaaaagttgtaactgttaatcaatttgttgtttcaaataaaactatatgggggaagcctatatttgatgaatttgaagtaagagattataagaatttgctcaatagttttagcgattttcttgatagtttaaaagcctttaatacccctgggaaattaagaaactttaagtatactgaagaggagttaaaggaaaaattcaacatattggagacagtaaagaaaatagaaaaaataattgattttaaaaatgaagtagaagagcttgtcaaatatttggcttctgccgaacagcaattacccgaagaaattgaattaaagcagaatataaatgaaatgaaaaatgaagtagaaagatttataaaggaaattgatactaaagaaagtgaagatataaaaaggctgacgagagaattagaagaattgaaaatagagtatataaagttatacatggaatatcataagaaacacaggcttgattataatggagatgagcgtaaaaagaaaataatggcaagtgatccgtttaataatcttaagaagcttaaagatgtaggaatatttcctgttaacaaatttgatgagattgaaaaggtattggcttcattaaaaacctgttataattttggaaaagaaaatataaaaacagaagtgctatgtcctaattgtggatacagtataaaaagcgacgaagttcctgtatttgggaaattggatgaaattgaagataaaatagaaaatttgtataaggaatggactaaaattttattagataatattgaggatccaatgattcaagaaagaatagagattttgaataaagaccaacaaaaagctatacgtgactttttgaataaaaaagaattgcctgacaaagtggataatctgtttgtatcagcagtaaaagacttaattgctggtcttgaaaaagtagagattgaaataaatgagtttatttctgcgataacctatgatggacctgtaacagtagatgagtttaaaaagagatttttagaaaatgtcgattttcttataaaaggcaaagataaggacaaagtaagaattattataaaataa

SEQ ID NO: 559 - DNA, 3726 bp, Nitrococcus mobilis
atgcgctacggggatctcattcaattcgagccaatcgagtcggtcattcagctgctcgacgccaaccggcccgatgaggcgaagaagctcgtcgccacttacgtgatctccgatgacatggccgatcgaatcgccaagcagatgatcgcgcagatatcgttcgatgaatcggtggatcacaaaggcgtgctcgtggtcggcaactacggcaccggtaaatcgcacttgatgtccgcgctgtcactgatcgccgaagacgccgcctatgtgccgatgctccgccaccccaaagtcgccgaggcggcaagctccatagccggcaagttcaaggtgcaccgcatcgaaatctccagccagatgtcgttgcgcgacatcattacgcaagaactcgaagtcttcttagagaagcagggcgtcagctacgcgttcccgccgggcgacagggtggtcaataacaaagccgccttcgaggagatgatggcaaccttcgatgaggtccaccccaaccaaggcgtactcctcgttgtggatgaattcttggagtttttgcgctcccgaaaggaccacgacttggtgctggacttatcgttcctgcgcgaactgggtgaagtaacgaagcacctgcgcttccggttcgtggcgggagtgcaggaagccatctttgacagcagccgcttccagcatgtggcggacagcctgcgtcgggtgaacgagcgctttacgcaagtgctgctggcccgccaagatgtgagctttgtggtggcggagcgtctgctcaaaaagtcagccgaccagcagcacaaaatccgcacctaccttacgccctttgccaagttctacagcaacatgaatgagcggatggacgagtacgtccgcctgtttccggttcacccggactacatcggcaccttcgaacagctgatcttcaccgagaagcgcggcgcattggtcaccctgcgcgaccagattcaggctcttctggatgacgaggttccgaccgatcgccccggtctgatcgggttcgacaggttctgggatacggtcacctcgaactccgtgctgcgctcggacccaaacattggcccggtgttgaaggtctcggaagtgcttggcgagcgcgttcagaaagccttcacccgcccaccatacaaagcgatggccatgcgcgtgattaaggggctgtccgtgcaccggttgaccaccggtggcgatatctacgtgccggtcggtccaaccgccgaggaactgcgggatacgctctgcctgtaccagcccggcatcgagggcttgggcggcgagccctccgacgacctgcttacagcagtgcagacgacattgcgtgagatcgtcaagacggtcaatggccagttcatctccaaggcgcccgacaccgagcagtactacctcgatctcaagaaagacgtcgactacgacgcccaggtcgaaaagcgcgccgaagcgctgtctgacgatgcactcgaccgcgcctactacagcgcgcttatgcagctcatggaacgcaccgatgagcatgcctatgtaaccggttacaagatctggcaataccaggttgaatggcaagaccatggtgtcgagcgaaacggctacctgttcctcggggcgcccaatgatcgaccgaccgcccagccggagcgcgacttctatatttacttcatccagccgttcgagccgccacgctttcgcgatgaagcgaaggccgacgaagtgttcttccgcctgaaagggctggacgacgccatcaaacgccatctggccttctatgccgcggcccaggagctggcctcgacagccagcggggcggccaaggccgtctacctggacaaggccaaggatgccctacgtggcatgagcaagtggctccaggacaagcagatgaccgccttcgaggtgacccatcagggtaagaccaagaccctgcaggaatgggccaagggggtgtcgatgcgcgacaagctccgactgggttcagacgagcgcgccaacttccgagacatcgtcaatgtgacgtctggcttggcgctgggtacccacttcacggacctggctccggagtatccgaccttttcggtactggtcaccgaatcgaaccgcaagcagctcatcggcaacgcgctcaaggcactggcgggcggtacgcgcaccaaggacgcggtcgccatcctggatgcgctggagatgctggacggcgaccgcatcgagcctacgcgatcgaagtatgcccaggaagtgttaagccgactgaaggcaaaaggccagggccaggtgctcaaccgcggtgaactggtaagtggaccgaccgacgtcgagtatttcgccccggttcgattccgtttggaaccggacttgctcgtcaccgtgttgggcagcctggtgtactcgggcgatatcgtcctggccatcaccggcgacaagatcgattccggcaagatctcgctgctggtcgagcgggggctggacgagctcaaacagttcaagcacgtcgaggcaccaaaggagatcaatgtcgccgtcctgcgctcgctgtttgagctgctgggcctgccgtctggccttgcccagatggcgacccaaggcaaggaggagccggtcaaggaacttctggatgctgtagcgaagctcgtcaaccgcgtgctggcggtcgggactgatctgcagacccggctcagcttctggggccagcccttgctgcgtgaggaagagctgcgtgactggcgcacgcggctcgaagcgctcaagggtttcctcgaagggctctcgccttataacaccgttggcaagctcaaaaacctgcgcatcacccaagaggacatcgacgctcagaagaagaaccttgaggtcctgtcgtccgtcgagaagctccgtgacttggtggccgagttgggagccatagcagcctatctttcacaggccgagatggtgctcgtcgctgaccacacttgggtccagcaggcgcaggcggcgcgcaaggagatcctcgacaagctcgccgatgaccgcagtgcgcagcacgccgccgaataccgccagcgtctggcggcactgaagaaagactacatcaccgcctacgtggcccaacacagcaaagcgcggctcggcgtagcggaggacaagaccaagtccgcgatgcgcaaagatccgcgcattgtgaccctgcgcgcactcgctggcatctctctcatgcaccccggccagcttacggcgttcgaagacaagctcgacaagctgaagagctgtgcctccttgatcgagtccgagctggccgccagccccgtctgtccgcactgcagcttccgcccagcgaacgagcagggtgatttcctacccgcagccaatgtgctcaagactctggacgacgaactggacagactacagcagggttggcagcaggcgctgctcgacaacctcgacgacccgatcatccaggccaacttcgagctactgaaagctgtgcaacacgacctgatcaagggctttttagtctcgaaggcgttgcctgaccctgttacgcctgagttcgtcgccgccgtgcaggaggcactctccggcctcgagaagatcctcgtcaccgacgatgaaatcaagaaggcgctgctcgctggcggatcgcccgcgacgcccgatgacctgcgcaagcgatttgagtcgtttctgaatgagcgctgcaaaggcaaggatgcgagcaagctgcggtttgtcgtggagtga

SEQ ID NO: 560 - DNA, 3888 bp, Saccharomonospora glauca
gtgagcacgaacgaggtgtacctgcgcgacgtcctcgacatccccgaatccgtccacgccggggacttcaaagtcgaactcaccggaggcttcacccaagtcgaagcccgcgtcgccgaatacgtcgtcaccgaccaactccggcaagccttcgacaaagccctgtccatcgtgcgcgccgccgtgcgcgacggcacctcgcacgccgcctacctgcacggctcgttcggctccggtaaaagccacttcctcaccgtgctgcacgccgtgctcaacaaccaccccgcggcacgggccaaacccggcctgcaacccgtcatcgccgaccacgacgactggctgcgcggcaagaagttcctcatggtgccctaccacctcgttggcgccaccgacctcgactccgccatcctcggcggctacgtcaacaccgtccgcgccctgcaccccgaccagcccaccccgcccgtgtaccgggcggacgcgatgctcgacgacgcccgccgctaccgcgaagccaaaggcgacgccgcgttcgtcgactggctcagcatcggcgccaccaccccggttcccgctggttccggcgtcgacgacgaggacgacgacgacctcgacctcgatctcgacctcggcacggcagaggaaggcgcggacaccggggacaccgggtggaccggcgagcagctcgaccgcgcgttcaccgcgcccgccggtgaccccgtgcgcgaccggctcgtgcaagccctgctgtccgggcccatgtcctcctacgttcgcggagccagcggcgacgcggaagcgttcctgccgctggagaacgggctggcgatcatcacccgccacgcccgcgacctcggctacgacgggctgatcctcttcctcgacgagctgatcctgtggttgcaggcccacatgagcgaccgccagttcgtcaacaaccaggtcagcaaactcgtcaaactcatcgaatccggcgacgcgagccgcgtgctgcccatcgtgtcgttcatctcccgccagcgtgatctgtccaaactcgtcggcgaggacgtcaccggcgccgaagtcaaggaactcgaacggcaggtcgaatacctcgcagggcggttcgacaccgtgtcgctggaagaccgcaacctgcccgccatcatcaaagagcgcgtcctcaaaccccggcccggcggccgggagatcctcgacgccgcgttcgccggcatcgaatcggccaaacaggccgaccgcgacgtgctgctcgactcggccggagccaccggcgccgactggcaggacttccgcgacgtctacccgctctcgcccgccctactcaacgtgctcgtcgcgctgtccggcgcgctgcaacgcgaacgcaccgggctcaagctgttgcaggagatgctgcgccgccgccgcgacgacatgaaggtcggcgaactcatccccctcggtgacctgtgggacgtgctcgccgacggcgcgggtgaagccttcaccgaccggctgcggcgcgaagccgaagccgcccagcgcttctacgccaaggcccgcgcctggctcgtcgaccgccacggcgaacacacccagcagttccgcgccaccgaccggctcgtcaaaaccctgatcctcgccgcgctcgccccgcaggtgcccgcgctgacccggctcaccggcggcaggctcgccgcgctcaaccacgggtcgctgcgcgcccgcaccgtctcagccggatcgctggccgtcacccggctgcgcgagctacaggccgagttcggcgaactgcgccacgaaggcgacgaggaccccgtgttccggctgcaactgtccgacttggacgtcgagccgtatctcgacgccgtcggcgaacgcgacaccgtcggagcccgccgcctctggctgcggcagcagctctggagcgaactcggcatcaagtacaccgacgacttcgtgtgcgagaaggagatcgtctggaagggcacccggcgcaccgccgagttcgtgttcgccaacgtgcgcgacgaacacgagctgcccgacgcccagttcctgcccagcacacccggccgcatccggttcgtgctcgactacccgttcgacgacaccggcgactacacgccccgccacgacgccgaacgcatccaccggatgcgcaggaacgacgtcaccgccgccaccgtcgtatggctgccgcacttcttctccgcgcagaagtccgcccagctcggccgcctactgaagatcaactatctgctggagcgcgaccggctcgacgactacgcgggcaaccgctccgccgacgaacgcgtcaagatccgccaccagctcgaagcccagcgcgacaccctggaaagccagctcaccgcctcgctgcgccagctctacggcatcgcgggcggcgacgacaccaccatcggcgcacccgtcggcgaggacgggcacgtgatgtcgctgcaccccggccaccagccccggctcgccggaggcgccggcttccagtacaacgcgctggccctcgccgacagcctgttcgacacgctgtatccgaaacacccgaacttcgaccccaacggcaaccgcaaggccgtcaccccaggggaactgcgcaccgtctacgactggatcaccaaggccatggaggacggcagccgccgcgtggtggtcgaccgcaaccacctcgccctcgtgcgccgcatcgtgcatcccctggaactcggcgaggtcagcgacgggccgctcaacgtctccaccgaatggcggcgccgcatcgagcaggccgccacccagcgcggcgtgaccggcgacctgcgcgtggaggacatccgctcgtggatcaccgaggccggctacaccgggctcgacaagctcgtggtgaacctgatcatcgccacctacgcgctgctggccgaccgcacctggaccctgcacggctccgtgctgcggcaaccgcccgagttggacaagatcgggcccggccacgcgctgcgcgcccagcgactgcccgaggccgccgagttcgccaccgcccgcgaacgggccgccgcgctgttcggcgtcgtcgtgcccgacacgcggttcgcccgcaacatcaaccggctcgccgagggcgtgcgcgccaaggtcgccgaactcgaaacgcccgtcaacggcgtgcggcggatgctggaccggcacgccgacgcgctcggcctcgcgggcaggcccgacgcgcgccgggtcgtggccacccgcgacgccgccgacctgctcgccgcgctgtccgccgccgcggacgacaccgacctcgtcaaccggctcgcgcgggcgagctacgacaccgtcgacaccgtgctcgccaccaccatgacggccgcgcccaagctggccgacgcgctgcgcgacgtcgagtggtcgctggtgtcgtcggtgcgcggcttcgcgggccggggcgacctcatcggcaaccgcgccgacgcgctgctcgacgaactcgcccacaccgccgaggccgacgagttcacccgcccgctcgcgcccgtgctcaccgaactcggctcgaaggccgtggcgctggtcagcgaagccgcccggctcgccgccgtggtcaaccccggcccctccccggagaagacgccggaaccggtccccgagaagaccggagagcggccgagcccgccggacgggcaggccggtgccgacacggtgagtctcaccgacaacggacaacccgccgtcagcaggcgggaacccgcaccgcgccgggcaccgcgacgggtgcgggccggggccgcggagggtgaactcgccgcgctgctcgacggagtgcgcgccgagatccgcgactacgcccgcgaacaccccggggcggagatcgaggtcgtgtggcggacggtcggcggagaggacagcgcgggatga

SEQ ID NO: 561 - DNA, 3771 bp, Rhodococcus triatomae
atgttcccaggcgccacgtccaacgctcgcacgctgcggcagaccttcgacatcccggtctctcacggcaccaacgactacgtgctgcgcctgtcggactcggtcgctgaggaccagctggctgcgaccgtcgactcctacgtcgtcacccccgccatcgcagaagcgttcgaccaggcgctgtcggtcgtcgaggagtcgctgcgcaccggagagaacaaggccgcgtacctgaacggctcgttcggctccggtaagtcgcacttcatggccgtgctgcacggcatcctcgggcactcacccaaagcactctcggtccccgagctgcagccgatcgtcgccaagcaccccaagatcgccgacgcgaagctgctgcggttgaccttccatttcctcgactccgcaacgatcgagtcggcgctgttcgagcagtacctccgccagatcggcacgctccaccccgacgtgctgccgccggtgttgcactcggcgggtggcctgttcaccgacgccgacaaccggcgcgccgaagtcggcgacgacaagttcttcgccaccctcaacaccaccggcgggtcagccgcatccaccggcacggtcaactgggcagcgctcggggcatccgccggcacctggaccgccgacacctacgcggccgccaccgccccgcacgccgaccccgccgaacggtcccgtctgcagcaggcgctgatggcgtcctacttcaccagctattcccgcaacaccgactggctgtccctcgaagacggactcgccgtcatcgccgatcacgcccagtccctcggataccagggcgtcgtgctcatgctcgacgagctggtgctgtggctgacgttcctcatcaccgaacgcgacaagttcaacgccgaggtccagaagatcaccaagctcgtcgaaaccagccgcggccgcctcgccgtccccatcacctcgttcatcgcccgccagcacgacctgtcccgctgggtcgccggtggcgccgaatccggcgccacccagcaggccgtcgaacaggcattcgcccaccaggccggccgcttcggcgacgtcaaactcggcgacgagaacctcccgttcatcgcgaagaaacgcctgctggagcccgtcgacggcgaagctcaggctgccctcgacgccgccttcgcgcgcctcgaccgcaaccccggcgtgtgggacgtcctcctcgacggcgtcaacaccgacgaccagcaccgtggctccgacgccgacgcctttaaactcacctacccgttctcccccgcactcatcgcgaccctgcgcgccctgtccgggcagatgcagcgcgaacgcaccgcgctcaaggtgatgcagcagatgctgcaggacagcgccgaccgcctcaccatcgaccacgtcatccccgtcggcgaagcgttcgactacatcatcgacagcgccaactccacccccatcaacgacgccgccgcacaaaccttcaagaccgcccgcaccctgtggaccgagaagctgcgaccgctcctcttccgcaacgccggtgtcgacgaagccacccccgacgccgacgtgccgcccggcctgcgcgccgacatccgcatcgccaaaaccctgctgatgtccgcggtggcgccgaacgtgcccgcgctcaagcaaatcgacgccagccggctcgcctcgctcaaccacggcagcgtcgtttccctcatccccggcgaccaggtcgggcagatcaccaacaaagtcaagcagtgggccgcggagatccccgaggtctccgtcacctccgacgcgaacccgatcatctccgtcaccctcgaatccgtcgactacgaacggatcatcacccgcgcccagggcgaggacaccgacggacgccgtcgcgaactcatgcgaaccctcctcggcgaacacttcaacgtcgtcggcgccgaacgcaccctcgacgacgcgatgctgcgtaccgtcatctggcgcggcaccgaacgccccatcgaggtggtgttcggcaacgtccgcgaccgcggctacctctccgacgaccgcttccgacccgccacccagggtgcgctgcggctcatcgtcgacctgcccttcgacgaccctggccataccatcgccgaagaccacgaccgcatcgaagagctgctccgcaccgggcaggaccggttcaccatcgcgtggctgcctaacttcttccccgacaaagtcgttcgccagcttggccgcctcgtcgtgctgaactacgtgctcaccggcgaccgctgggccacctacgccaacgagctttccgaaggcgaccgcatcgccgcccgcaccatcctcgaacagcagcagtcgcaggtccgggggcagctcggcaacgccatccaggtcgcctacggcaccgccagcggcgccaagttcgccgagagtcagccgccgctgcggtcgctgcacgccggcttcgtcgcgcagccgcccatcggcaacaccctcggcgaggccgtcgatcgtctcatccgtgacgcgttcgatgccctgtaccccgaccatcccgacttcacgcctgccgacaagctgatcacccggcgggacctcaacaccgtcctcacccggctacgcgaagcgcagtcgcaatccgacggccgcatcgcgctcgacggcggcacccgcggcgaccgcgacaccgcgcgccgcgtcgtcgaaccgctcgccctggcgaaggtcaacgaaacgcacctgatcttcgggcccgaacagttcaccgcttggcagacccgcatcacgcaggaactcgctcgtctcgcgatcgacgagcacggcgacgtcgacatcgacgtgctgcgcaccgccatcaacgccagcggacccaagcgcggcctcacccccgacgtcgtcgacctgatcgccgccgcctgggccgcgcagacgaagcggtcgtggttcctgcattcttcgcccacccccgaggcgatgatcggcgacatccggcgtggcaccaccctgcgcctcgaggagctgcccgaccgtcagacgtggtcggacgccgtccgccgatggactatgtggaccgggcagaacgtcaacgactacctcaccgccgccaacctcgcgacgttcgccgagcaggtgcgcgagtacgcgcgatccaccttcaccggtcgcgggcacttcgtgaacgccctcgggcaggcgtacagctatttcgagctctctgccgaccagggccgctacgcgctcgccgcggacttgttggatctgttcgagattcggctcgcgcgcgcaacgaacctcgagctggtggccgccgtcgcgggagccgaactgcgtggcaccgacaccgaagcgagcaagtcgctctcgaccgcggatcaggtggagcgggttctgctccgctacccaccgacgcggtgggatgtgctcaagaacggtgctgcgggcggtgacgctcgcgcggcgcaggcgaaggcgatcctgacggacctccagaaggcggtgctggcgcaagaactcacccagtcgcttgacagtgccttcaccaccgcggaccgcgcccgggatgcgtggctcgaagcgctggtcgaagttaagccaccggtcgtcaccccgcccccgccgccgaagccgggccccgacgtcgtggtgctgcccccgcccgcgccgaccacaccgcaaaccttcaccgtccgcggtgccaatgcacagtcgatcgtcgagcagcagttgcaggcgctcatcgccacctaccccgacgacgagttcaccgtcacgatcacccggaagcagtcgtga

SEQ ID NO: 562 - DNA, 3882 bp, Saccharomonospora cyanea
gtgagcacgaacgaggtgtacctgcgcgacgtcctcgacatccccgaatccgtccacgccggggacttcaaggtcgaactcaccggaggcttcaccgccaccgaagcccgcgtcgccgaatacgtcgtcaccgaccaactccggggcgccttcgacaaagcactcggcatcgtgcgcgccgccgtgcgcgacggcagctcccacgccgcctacctgcacggctcgttcggctccggtaagagccacttcctcaccgtgctgcacgccgtgctcaacaaccaccccgccgcccgcgccaaacccggcctgcaacccgtcatcgccgaccacgacgactggctgcgcggcaagaagttcctcatggtgccctaccacctcgtgggcgccaccgacctcgactccgccatcctcggcggctacgtcaacaccgtccgcgccctgcaccccgaccagcccaccccggccgtgtaccgggcggacgcgatgctcgacgacgcccgccgctaccgcgaagccagaggcgacgccgcgttcgtcgactggctcagcatcggcgccaccaccccggcccccgctggttccggcgtcgacgacgaggacgacgacgatctcgacctcgacctcggcccggccgccgaaggcgcggacctcggggacaccgggtggaccggcgagcagctcgaccgcgcgttcaccgcgcccgccggtgaccccgtgcgcgaccggctcgtgcaggccctgctgtccgggcccatgtcctcctacgtccgcggagctaccggcgacgcggaagcgttcctgccgctggagaacgggctggcgatcatcacccgccacgcccgcgacctcggctacgacgggctgatcctcttcctcgacgagctgatcctgtggttgcaggcccacatgagcgaccgccagttcgtcaacaaccaggtcagcaaactcgtcaaactcatcgaatccggcgacgcgagccgcgtgctgcccatcgtgtcgttcatctcccggcagcgtgacctgtccaaactcgtcggcgaggacgtcaccggcgccgaagtcaaggaactcgaacggcaggtcgaatacctcgcggggcggttcgacaccgtgtcgctggaagaccgcaacctgcccgccatcatcaaggagcgcgtcctcaaaccccggcccggcggccgggagatcctcgacgccgcgttcgccggcatcgagtcggccaagcaggccgaccgcgacgtgctgctcgactcggccggagccaccggcgccgactggcaggacttccgcgacgtctacccgctctcgcccgccctgctcaacgtgctcgtcgcgctctccggcgcgctgcaacgtgaacgcaccgggctgaagctgttgcaggagatgctgcgccgccgccgcgacgacatgaaggtcggcgaactcatccccctcggcgacctgtgggacgtgctcgccgacggcgcgggtgaagccttcaccgaccgactgcggcgcgaagccgaagccgcccagcgcttctacgccaaggcccgcgcctggctcgtcgaccgccacggcgaacacacccagcagttccgcgccaccgaccggctcgtcaaaaccctgatcctcgccgcgctcgcgccgcaggtgcccgcgctcacccggctcaccggcggcaggctcgccgcgctcaaccacgggtcgctgcgcgcccgcaccgtctcagccggatcgctggccgtcacccggctgcgcgagctacaggccgagttcggcgaactgcgccacgaaggcgacgaggaccccgtgttccggctgcaactgtccgacttggacgtcgagccgtatctcgacgccgtcggcgaacgcgacaccgtcggagcccgccgcctctggctgcggcagcagctctggagcgaactcggcatcaagtacaccgacgacttcgtgtgcgagaaggagatcgtctggaagggcacccggcgcaccgccgagttcgtgttcgccaacgtgcgcgacgaacacgagctgcccgacgcgcagttcctgcccagcacgcccggccgcatccggttcgtgctcgactacccgttcgacgacaccggcgactacacgccccgccacgacgccgaacgcatccaccggatgcgcaggaacgacgtcaccgccgccaccgtcgtgtggttgccgcacttcttctccgcgcagaagtccgcccagctcggccgcctactgaagatcaactatctgctggagcgcgaccggctcgacgactacgcgggcaaccgctccgccgacgaacgcgtcaagatccgccaccagctcgaagcccagcgcgacaccctggaaagccagctcaccgcctcgctgcgccagctctacggcatcgcgggcggcgacgacaccaccatcggcgcacccgtcggcgaggacgggcacgtgatgtcgctgcaccccggccaccagccccggctcgccggaggcgccggcttccagtacaacgcgctggccctcgccgacagcctgttcgacaagctgtacccgaagcacccgaacttcgacccgaacggcaaccgcaaggccgtcaccgccggggaactgcgcaccgtctacgactggatcaccaaggccatggaggacggcagccgccgcgtggtggtcgaccgcaaccacctcgccctcgtgcgccgcatcgtgcatcccctggaactcggcgaggtcagcgacgggccgctcaacgtctccaccgaatggcggcgccgcatcgagcaggccgccacccagcgcggcgtgaccggcgacctgcgcgtggaggacatccgctcgtggatcaccgaggccggctacaccgggctcgacaagctcgtggtgaacctggtcatcgccacctacgcgctgctggccgaccgcacctggaccctgcacggctccgtgctgcggcaaccgcccgagttggacaagatcgggcccggccacgcgctgcgcgcccagcgactgcccgaggccgccgagttcgccaccgcccgcgaacgggccgccgcgctgttcggcgtcgtcgtgcccgacacgcggttcgcccgcaacatcaaccggctcgccgaaggcgtgcgcgccaaggtcgccgaactcgaaacgcccgtcaacggcgtgcggcggatgctggaccggcacgccgacgcgctcggcctcgcgggcaggcccgacgcgcgccgggtcgtggccacccgcgacgccgccgacctgctcgccgcgctgtccgccgccacggacgacaccgacctcgtcaaccggctcgcgcgggcgaactacgacaccgccgacaccgtgctcgccaccaccatgacggccgcgcccaagctggccgacgcgctgcgcgacgtcgagtggtcgctggtggcgtcggtgcgcggcttcgcgggccgcggcgacctcatcggcaaccgcgccgacgcgctgctcgacgaactcgcccacaccgccgaggccgacgagttcacccgccggctcgcgcccgtgctcaccgaactcggctccaaggccgtggcgctggtcagcgaagccgcccggctcgccgccgtggtcaaccccggccccgccccggagaaggctccggaaccggtccccgagaagaccggagagcggccgagcccgccggacgggcaggccggtgccgacacggtgagcctcaccgacaacggacaacccgccgtcagcaggcgggaatccgcaccgcgccgggcaccgcgacgggtgcgggccggggccgcggagggtgaactcgccgcgctgctcgacggagtgcgcgccgagatccgcgactacgcccgcgaacaccccggggcggagatcgaggtcgtgtggcggacggtcggcggagaggacagcgcgggatga

SEQ ID NO: 563 - DNA, 3795 bp, Gordonia polyisoprenivorans
atgttcccaggaaccgcttccgggcccgcgcacaccctgcgtgaggtcttcgacatcaccgaatccgcgggacgcaacgattacgtcctcaagctgtcggactcggtgggcgacgcgcaactcacgcagaccatcgactcctatgtggtcacgccggcgttggccgaggcgttcgacgtcgccctcggggtggtcgacgaggggctgcgcaccggagagaacaaggcggcatttctcgacgggtctttcggttccggtaaatcgcacttcatggccgtgttgtacgccatcctcggacacgccccgcaggcactcgccgtgcccgaactccagccgatcatcgtcaagcactcggctatcgagcagaagaagctgctgcgcttgacctttcacttcctcggagccgagaccgtcgagtccgcactgttcagccagtacctgcagcagatcgccaccctacaccccgacaccgcaccgccggtgctgcactcggccggcggactgttcaccgacgccgacaatcgacgggccgccgacggcgacgagaagttctttgccacgctcaacggctcctccgcctctaccggagcaaccgtcgactggggtaaggccaatgtgtcggtgggagtgtggaacgccgagacatacgcgcaggcgagtgcggccgacgccgacccggccgcgcgcgcgcggctacagcaggccctgatcggcacgtacttcaccagttactcgcgcaacaccgattggctaccactcgaggacggccttgcggtgatcgcctcgcacgcgcaggggctcggctaccagggcgtggtgctgctgctcgacgagctgatgctctggctgtcgttcatcatctccgagcgggagcgcttcaacggcgaggtccagaagctgacaaagctcgtcgagaccagccgggggcgccttgcgctcccggtgatctcgtttgtggcccggcagtttgatctcacccgatgggtggccaccggtaccgactcgggcgccacccagcaggcagccgaacaagccatccgacaccaggccggacgtttcgcgaatgtggttctcggcgacgagaacctgccgtacatcgcccacaagcgactgttgaaggtgcgggacgcacaggctcagcaatggctcgacgccgccttcgcagccatcgaccgcaaccccaaggtgtgggacgtgctgctcgacggggtcaacaccgatgatgtgcaccgcggctcggattccgccgcgttcaccctcacctacccgttctcgccggcgctcatcgcgacgctgcgcagcctctccggggtgatgcaacgcgaacgtactgcgctcaaggtgatgaagcagatgctggaggacaacgccgaccggctcaccgtggagaacgtgatcccggtgggtgaggcgttcgactacatcatcgacagcgccggaagcactccgatcaacgacgccgtcgcccagagcttcaagacggcgcgcaccctgtggttcgagaagcttcgcccgttactattcacgcaggccggcgtcgaccccgataccgccgacgccgacgttcccgccggcttgcgcgccgacatccggatcgccaagacactgctgatgtcggcgctcgcgccgaatgtgcccgcgctcaagcagatcgacgcctcacggctcgcgtcactcaatcacggcagcatcatcagcctggtacccggcgatcaggtgggccagatcgtcaccaaggttcggcggtgggcagccgacgtccccgaggtcaccgtctccggcgacgccaacccgatcttctcggtgaccctggaatcggtggactacgagcggatcatcgaacgcggccgcgagaacgacaccgatggtgaacgtcgaaaactgatgcgcgagttgctcagtgagtacttcggcgtggccggcgcccaacagaccgtcgacggtgcctacctacggaccgtcacctggcgggccaccagccgtgacgtggaagtggtgttcggcaacatccgcgaccacggttacctctccgatgaggcattccggccgtcccgcgagggagtgctgcggatgatcgtcgacctccccttcgacgaggccggacacaccaccgccgaagatcacgatcgcatcgacgcactcatgcgcacggccaccgaccggttcaccatctgctggacgccggcgttcttccccgagaagatcacccgtcaactcggtcggctggtgatcctcaactacgttctcgccggcgacaggtgggcgagcttcgccaacgagctggccgaggccgaccgtccggccgcgcgatcgattctgcagcaacagcagtcgcagctgcggagccagctcggctcggccatccaggtctattacggtgtggcgtcgacagcgggcgccgacgcggcgttgttcgccgatcagccgccgttgcggtcgctgcacgagggcttcgtggcgcagccgccgatcggcaccaccctcggtgaggctgtcgaccgactgatcgccgatgcattcaccgccctgtatcccgatcatccggatttcaccccggccgacaagctgatcacccgcaaagagttgtcgatgacgctggaccggttgcgggaggcccaatccgatcccgaaggtcgactggcgttggatcgcagtgatatccagaccgtgcggcgcatcgtcagcccgctggggctggccaagacaagcgaaacccacctgatcttctcagccgatcagttcgccggctggcgcacacgcatcactcaggagctgggtcgcgccggtgtgtcgacggacgagtcgggtgcggcatcggactccgaggtaccggtggaggcggtacggaccgcgatcgtcacctccggtccccggcgcggcctcaccgacgacgtcatcgacctgatcaccggcgcgtgggcagcgcagacacggcggtcgtggtttctgcacggatcagccgtcgccgagcctgctctcggtgacttccggcggcgtgggctggcgctgcggatcgagcaactgcccgatcggcaggtgtgggtctcggccattgctcgctggaccacactcaccggccgacgggtcaacgacttcctcactccgtcgaatgtcgcggcattcgccggggatgtgcgagcgtacgcctccgagcgagcagtgcgtcgtacccgtctcgcgcgtgcactcgagaaggcctactccgcgcggcatctggacggtggtgcccggttgtccacggcaacagcactcgacgggctcttcgcgccggagttggccacgctcaacaacctcgagatcgtggcccgtgttgccgatgccgatctcggcggtgccaccgatgtacaggccagtagggcgctcggaacagaaggtgccgttgccgatgccgtcgaggccttcaccttccgtaggctcgaaccgctgttgacatgcgccggcaccgagtccgagacggaggacgggcgagacgcagcgagtatcgtcgcagaactcgacgacgcactcgtcagccacgagctcacgattccgctggttgccgctctggcgagagtcggccagcgtcgcgacgcgtgggtcgatcggcgattgagccagcgacccgcggtcgtcgacgatccgcagcccactccaccaccaccgccgccgggtccgcgagccttccagatggaggtgtccgatccgtcaggcttctcgaccgtggaacgcaagctcgctgagctcttggccgctcatcccggtaccactttcacggtgaccgtcaccgagtcgaccggagccactgcggcgcgatga

SEQ ID NO: 564 - DNA, 3705 bp, Amycolatopsis azurea
atggccgaggaggtgtacctccgggatgtgatccacatgccggaggaggtcaaccggggcgacttcaagatcgacctgaccaagggattcacggcgacggacgagctggtcgacaactatgtcgtcactgatcagctgcgcggcgccttcacccaggccctcgcgctgatccgggctgcagtccgcgacggcaactctcatgccgcttacctgcacggctcgtacggttccggtaagagccacttcctgaccgttctgcacgccgttctgaacggaaacaagaccgcacgcgacaagcccgagctgcggaaggtcgtcgccgaacacgatgagtggctggccggtcgcaacttcctcatggtgccgtttcacctgatcgggtcggtcgaccttgacgcggcaatcctaggcggctatgtcaagcatgtgcaggacaccatgccgggcaagccggtccctgcggtctttcgagacgacgcgatgctcgtggatgccaagaatctgcgcgaggcggtgggcgacgtcaagttcgcggagatgctcgggaccgaggacgccaagccgtcagacctggacgacctggaaccaatcgagggagcggctcccagcgtttggaccagtctagaacttgataaggcattcggtgcgcagcctggagatccacgacgggacgctctggtttccgcgctcctgtccggtccaatggcctcctatgcccgcggagcgttaggggacaaggacgcctacatcccactggagaacggcctttccgtcatcagccggcacgcgcagcaactcggttacgacggcgttgtgctgttcctcgacgagctgatcctttggctgcagggctacttatcccgccgcgacttcgtcaacgttcaggtgaacaagctggtcaagctgatcgagtcgggggacagcgatcgaccggtgccgatcatttcgttcgtctcccgtcagcgggatctcggcaccctcatcggctcggacatcatgggctccgaggtcagcaacctcgaacagcaggtccagtatctcgccgggcgattcgacacgatcagcctcgaagaccgcaaccttccggcgatcgtcaaggagcgcgttctcaagccgctccccggcaaggaccatctactcgatgcggccttcaagaacatcgagtcgaccaaatccaacgtcaaggaagcgctactcgacgcgaacggcgccacccatgcggactggtccgacttccgcgacgtctacccgatctcacccgcgctgctcaacgtgctggtggcgctttcgggggcactgcaacgcgaacgcactggcctcaagcttttgcaggacatgctccatcggcggcgcacggacatgaagctgggcgacctcattccgctcggagacctgtgggacgtcatcgccgaagatgcaacggcagccttcaccgacaagctgcgtacggacgccgaagcaggccagcgtttccaccggagggttcgccgctacctggagggtaggtacggctcgaccaccgatgcccggttcatcgcagacgaacgtctggtcaagacgctcctgctggcgtccctcgctccagacgtgcccgcgttgacccggctcaccgggcagcggctggccgcattgaactacggctcgatcacctcacgcactgctcagccgggcgatctagcgaccaccaggctgggtgacctcaagaccgagttcggcgagctgcgcagtgatggtgacgagaacccagtgttcagcctgcacctgtccgacctcgacatcgaaccgctgctggacagcgcgaacgacgaagacaacaccgccaaccggcgaaagtggctacgcagccagctttgggaggcgatgggtgtcaaggacaccggtgtcttcgtgagcgagcgtgagatcgtctggcgaggcaccaagcggaccgccgagttcgtattcgagaacgtccgcgacccacagtcgatgccggacttccagttccggcccagccttgacggcgtaatccggttcgtcatcgactatcccttcgacgaacccggacgttcaccccggcaagacgccgagcgcgtggaggaattgaaacagcatggccacgcctaccccaccctggtgtggctgccggccttctggtctgagcagcggtttaaccagctcggtcgcctgctgaagatcaaccacctgctcgagcgaggtaggctcgaagcggtcgcagcaaaccgatcggccgaggaccggatccgcctacgcacccagctcgaggtgcacaaggagaacctcacgtcgagccttcgaggcgtgctgactcagctttacggcctctcccgcggtgacgagtcgaacctcatcgacccggagggcgaacccgggcgagtgctcagcatgttcccgcagcacactccccggctccatgtcggcgctccgttcgaatacaacatgttcgaactggccgacagcctcctgggcgcgaagtacccgaatcacccggacttcgatccgaagaaggaacgcaaagctgtcaccgtcggtgagcttcgtacggcactaaactggatcaccaaagcagcagaacaaggcggccgcgttgaactggagaagagcaaccttgccctgatgcgcaagatcgtgcacccgctcggcttgggtgaggtccacgacggcccgctcacactgagcaacgagtggcgacagcgtatcgaacagcacgcggcaaggatgcaggtcgcaggtgactactcggtcgacgacatccgacggtggctggaagagcttgactacaaggggctcgacaagccagtcgagaacctgatcatctccgtatacgccctgctcgctgatcgagcttgggtccgcgagaccatcccgcaagacgccccagacgtcggcaacatcggtccaggttgggctctgcgcgcacaagaactgcctaccgaggacgaattcgaagcagcccgcaaccgagcgggaacgattctgggggtgtcggctccggcagcccgattcacgcgcaacatcaccaagctgaccaatagtgtgctcgaacaggtccgtgaacacgagaacgctgtccaccgcctgcacgaagcgttgcacaagcatgcgtccgaactcgggatcgagacttcatcaccacgagtagtggcgacccgggccgcagcggacctgttggccaagctgttcggcattagcgactcgacaaagctgatcaggacactcgcacagctgccggacccagacaacgacggtgtgctggcgaggacgatctcatcggcccagtccgtcctgagtgcactcgacgcagcagacttcgaactcctgcgaacgatccagccgtatcttgaccgttctgacggcattcgagaccgcaccgaacgcctgatggccgacatagcggagacggcccaagccgacgagcaaacccggcagctcggccccatgctgcacggattccgggcgatcgctctcaagatcatccaggatgccacggcagcagcaggagccccgccggcgccaccgccgccagcacccacgcccacgcccacgcccacgccccagcagacacgccgagtgaccgctgacgcgactcccgcaaagttgactgagacgatggcagccgtgcagcaatcggtcagtgagttcgccaaggaacacccgggtcaggagatagagatctcgtggcgtgttgtcgacgggaaggcttga

SEQ ID NO: 565 - DNA, 3675 bp, Marinobacter sp.
atgacactgataaaagatttgattgcgattccggaaaaggttcagcgtggtgactttgttctgaacctgtccagcggcctggctgaggctgccattagccaaacgctggaacagtatgtggtaacaccgcagctgcaaaagtcgtttgatgacgccctcagctttataaaaagcacggttgtggataaccaaaaacgccagaaaggggcttacctgcacggcagttttggcagcggtaagtcccacttcatggcggtgctgaacttgctgctgcaaggcaacgcccaggcccgcgccatcaatgagctggcgccagccgtggcaaagcacaacgactggctgcaaaaaaccaacatattgctggtgccctaccacatgattggtgccgccagcatagaggccggtgtactgggcggctacgccaggcacataaaaaacctgcaccccagcgcgccagtgccgggcttttacatgagcgatcgcttgttccgcgatgcccagcagctgcgggcgaacattggcgatgaggtcttttttgcgaccttgaaccgcggcgcaacggcggctgaagacgacggctggggcgacctggctgaaggttggaatgcggtcagctttggcgcggtggtgaaagaccaaggtagcagtgacgacaaggcgcggctggtcggcgatttgattggtactttttttacctccatggcggatatggccaacagtgagttcggcggttatgtagacttcgatgaaggtctgcgaattatgaccgagcatgccaaagcactgggctacgacgctattgtgctgtttctggacgaactgattctgtggcttgccagccacctgtcggatcagcgatttattgccaataatatccagaaagtggtgaagctggtggaagtgagcgagcagcgcgccttgcccatggtcagtttgattgcccgccagcgcgacctgcgtgaatttgtgggcgaccagtacaacggggccgagcaggagtcgttgagtgactcgttaaaatattgggatggccgttttcacacgattactctggaagaccgcaatctgccggtaatcgctgaacggcggttgttgaagccaatcaacgcggcggccaaagcggaaatcgacgatgcgtttaagtctatggacagcagcttgcgtaaagaagtgcaggaaattctgctaaccaacaccggcgaccgcgatatgttccgccagctgtacccgttcagcccggccttggtgcaggcgctggtggccctgtcgtcggcgctacagcgcgagcgcacggcgctaaaagtgatgttgatgctgctggtagatcagcgcgatagccttgagctgggcggctgcattccggtgggggatttgtacgatgtgattgcgtctgacgccgagccgttttcagacgccatgcggctgcattttgataacgccaaactgctgttcgaacgcaagctgctgccgctggtggaagaagaccataatcttaaactggaacagctggatgaactgcctgcagacaacccggcaaagcgcgcatttgtgaacgatatgcggttgctgaaaacgctgctgctgtcggccctggtaccagaagtagagtgctttaagcagctaacgccaaacaagctggcggcgctgaaccatggcaccataaagtcccccattcccgggcgggaagcgcaaacggtgttgagcaagtgccgcaagtgggccggtcgcgtgggtgaaatcaaaatcagcgacgataccaacccagtgatcactattcagctgtctggggtggataccgagagcattttagagcaggccaaaatcaatgacaccgacggtgcccggcgcaagctggtgaaagatttggtgtttgacgctttcggtgtgcaagacgataaccagctgtttatagaacactctgttcagtggcgggggacgcgccgcagtgtggaggtgatgttccagaatatacgtgagatctcggataacacggtgtttgaagcccgcggcgatgactggaaaatgatcatcgattttccgtttgaccagggaagtcattccccagcggatgacaaagcccgaatacagaattatgaggcaacgggtaatgccactcagaccctgtgctggctgccttactttttcagccagaatgcccagcgtgatttgggcacactggtaattttggaacatgtgctgaagacaaacgatcgcttcaattctttcagcaatcacttgagcccggtagaaagagcgcaggcgcgtacgctgcttgataatcagcgcagccaattgcgccagcgtatgcgtgactatttgatgggcgcctatggcgctgcccaggcggtggcaggctcgatagacacatctatgccgttagatgaacacgtgttttcgctggagcccagttttacgccgcaattgccggtgggtagcaatctgcaagcggcttttgagcatttgctggatcaggcgttggcgtttcagtatccggatcacccacagtttgaaacagaacttaagcaagcggatttggcaaaggtaatggagcaactgcgccgcgcggttcatgccactaacggccgaattgatgttgattcaccgctgcgttcgctgatgcgctgcatcgctcagccgttgaagttgggtgacatgcatgagcgccattttattttcaaagatgactggcccaaacacatggctcgcgaactggctcgcgatggcagcactggcgacccggttatggtcaagcgcttgcgggcagccattgatcagcccagcccgaaagggctgcccgagatggtgcagaatctgctaatactggtgtttgccgaatatgggcagtatgccttttctcttcacggtgccgacttcgacccaacgatgaaggaattgccggacaacctggtattgaccaagcaggagctggccgagccgaaagtctggcaacaggccgttgataatgcgtccgccattttcggtctggttattaacaagttgcgcacggctaatcaccagaatttacttgaaaaaaaggtgctggaagaagttaagcggcgccttgagcatagccaaaatttggccgatgagcttcggcttgccttggcaaaggtgggccagccgctaacgtgtaaccgcatgcgcaacgccgaatatgcctgttccctgatgcagttattacaaagtaagcaaggcgccgagctgaccgctgcgcttgcagatattcagccggtcaccaatgccaatgcgttggccaagagcatcgccagcgcagccagcgtggctcaggccgttcaagataacaattggcagttgcttgataccgcgtggcgcagcagctctgctgaagctgagggtataaagcagcgagtgtgtcatgcgctggcgtctgatgaactggtggtcgcactgcaacaggcattaaggcaggcccagaccgacgcaacggctttgatcacgcgcaatgcgcaacccgcggcgcctgatgattctgcagctgtggtacgggcaaatcccgacacgcccgcaaggcgcgtggtaacaagggcacagcagtcgggtttgaccgggccgcaggccaaggttctgtttgctgaaattgaaaaagaactgttggaaggatacgtgctggatgtgagttacagcatcgttcgggctaatggcgcagaggaataa

SEQ ID NO: 566 - DNA, 3822 bp, Saccharopolyspora erythraea; identical to SEQ ID NO: 187

SEQ ID NO: 567 - DNA, 3888 bp, Streptomyces turgidiscabies
atggcccagcagcagcccctcctccgcgatgtcatcgacatcaaagagaacatctccacctcggacttcgtgctgtcgctcgccgaggcgacgacacccgagggcgcacagaacgcgctcaaggactacgtcgtcaccgagcggctgctggagaacttcgacgaggcgctggcactcatcaagtcctcgctcgacgggcaccgctccaaggcggcctacctgcacggctcgttcggttccggtaagtcgcacttcatggccgtgctgtacgcgctgctcagcggcgacccggccgcccgtgcccgtaccgagttcgacccggtgctgaccaagcacgagtggctgaccacggacggcaagaggttcctgctcgtgccgtaccacatgctcggcgcgaaggccctcgaacagcgggtgctcggcgggtacgtcacgcacgtcaagaagctgcaccccgacgctccgaccccgcaggtgtaccggaccgactccctcttcgccgacatccgcgccaaccgtgccacctacggggacgaggcggtcgtccgaggtctgggcggcggcgacgcgggcgacggtgagacggacgagtggggtgagggcttcgcctggaccccgcagctcctcgacaccgccctcgccgccgaggagaaccacgaggggggcaccccgctcaacctccgcaacccctccaccccggccgaactgcgcgccaaactggtcaacgacgccggcaccaaccttttccccggcttcgccaggaacgccatcgagaacgagcacggcttcatctccctcgacgccggtctgtccgtcatcgccgagcatgccaagtcactcggctacgacgggttgatccttttcctggacgagttgatcctctggctcgcgacgctcatccacgagcagaagttcgtggcccgtgaggccagcaagatcacgaacttcgtggagggcggtgacgcccggcgtgccatccccgtcgtgtcgttcatcgcccgccagcgtgacctgcgtgaactcgtcggcgaagaggtgtcgggagcggcggaggcgtccatccaggacaccctgaacctggcttccggccggttcgacaagatcaccctggaggaccgcaaccttccgcagatcgctcacgcgcgcatcctcaagccgaaggacgccgacgcggaacaactcgtcgacgctgccttcgagcagaccaaacgggtcggcacccaggtctgggacaccctcctcggctcggagaagggcaccaccggcgcggacgccgagtccttccggctgacgtacccgttctcaccggcgttcatggacaccctcgtccacatctcgtccgccctgcagcgctcccgtaccggtctgaagctgatgggcgaactcctcgcagaccaccgcaacgagatccgcctcgggcagctcatccccgtcggtgacctctacccggtgatctcgaagggcggcgacaagccgttcaccgacagcctgaaggtcgtcttcgaggccgccgacaagctgtacaagaccaagctgcggccctatctcctcagttcgtacgacatcaccgaggacgacgtcgagcagtacgtcaaccggcccgagtccatcaccgacccgcagcgcaccaaccgttgccggatgttcgtcggcgacaaccgcctcgtgtgcaccctgctgctgtccgcgctcgcgcccagcgtgccctccctggcggagctgaccatccgacggctcggcgcgctcaaccacgggtcggttctcgcgcccatcccgggcgccgaggtcgggatcatcaagaacaaggtcgccgagtgggcggccaggttccccgagatcaaggagaccggcaccgacgccaaccccggcgtacggctggagctgtccggcgtcgacgtggactccgtcatcgccaacgcccaggtcaacgacaaccccggcaaccgggtcgccctcgcccggcgcctgctgtccaaggaactgggcgtcgagcacgggcagttgagcgacctgctcggcttcacctggcgcggtacctcccgcaccgccgagatcgtcttcggcaacctcgccgacgaggacgagctgcccgaccacgacctgatgccgcaggaggacggccgctggcgtatcgccatagacctccccttcgacgagggggagtacgggcctcgcgaggacgccatccgaatgcagcggctgcgcgagcgccaacagggcgagcggtcccgtgtcgtcgcctggctgcccgcacatctgtccgcgcagcgctttgccgacttccggcgtctcgtcgtcatcgacaaggccctcgccgacgagcaccgcttcgacacccagtacgccggacacctcaacgccgacaaccgcagccgcgccaagggcctcctcgaaacgcagcgcgaggctctgctcaagcaggtcagaggcgccttcaagcaggcctacgggctcgcccagaagcaggccgccgacgtcgtgcccgacttcgacgaccacctggtcccgctgcccgatgtcgacggcctcaccctgtccttcgggcagagcctgcacgacggcatccggcacgtcgcgggcaagctgctcacccaccagtacccggcgcaccccgacctcgacgtcgacggcaccggcatcgccgtcaaatccgcggacacccgcaaggtgttcacccatgtgcgggccgccgccgaggcgcgtgacgggcgagtggaggtcccggccgtcgatcggaagctcatgcagcggatcgccgggcccctgcgcctcgggcagcagaaggaggcgtacttcgagctgtcccgctactgggccgaccacttccgtcagctcgccagcgcccagggcagcaccggggacctgtccctgatcaccctgaccgactggacggacaagcccgacccgcgcggcctgcccgaattcctcgcccggctggtcgtcgccgcgttcgccgagatggacgaccgggtgtgggtgcgcggcggcaccgtactcgaccccgcgcccgaactgtccgcgatcaaggaccatgacgcgctgcgcagccagccgcggcctgccgagacggactgggacaccgcgcggcagcgtttcgagacgatcttcggagccaagccgcccgctctacggcgcgggcgaatgatcaatcaattcgcccgccagatcgtcgaggccgcccgcacgtaccgcgaccacgcggccgacctggtgcaccaactggaggcccacgcctccttcctcggcctcgaccagaccgccgactccggacggctcgccctcgcccgccgttcgctgcaactgctggacgccgtcatggcggaggcgggcaagggcgcggccggggcgaagaagaccgtggaggctctcgcctccttcgacctcggcgacaccagtgcggaccggtacgggacgtccatcaagcaggcccgaagcgtcgcggaggcgatcgcctccgcgccctggagcaccctcgaactcgccgccggactcggccccgagggcgcggcgctactcgactcgctgcgcaacgtggcccgcgacgaccagcgcaccgcggacctgcgtgacgccctggcccgcacccagcgcgaggtcgtcgccctcgtgaagcgcagccaggccgtcgcccagccgcccgcgcccgtcgcgccgcagcccacggccgacgacctggacctgggcaggccgacgagcgatccgcgcatccccttcaccccgccggcgacacccacaccggcctcctccagcagcggctccgcgcgaacggccggtggccgccgtacgaccgtggcacgcgccgccgccgacctccaggcggaactgtccgaactggccgcccgccaccccgacgcgacgatcgagatcacctggaaggtcgtcgaatga

SEQ ID NO: 568 - DNA, 3702 bp, Gemmata obscuriglobus
atgacattgctgcgcgagctgatcgacatccccgaacacgtccgcaagggcgacttcgtcctccgcctgtccgagggtgtggtcgacccggccgggacgttgggggagtacgtcgtcacccccgaactggtccggtgcttcgaccaggccctcgacttcatccgggccgcggtcaccggccggacgagcaaagcgacctacctgcacgggtcgttcgggtccggcaagtcgcacttcatggccgtgctgcacctgatcctccagggcaacgcgcaggcccgcggcatccccgaactcgcaccggtgatcgccaagcacaacgactggctggccgggaagaggttcctgctggtgccctaccacatgatcagtggggcgcacaacagcatggagagcggcatcctcggcgggtacgccgacttcatccgccgcacccgaccggacgctcccgtgcccggcgtgttcctcgccaaggggctgttcgaggacgcccagcggcagcggcggcgggacggcgacgagaagttcttcgccgagctgaacgccggccggggcaacgagcaggcgtcgggctggggcgacctcgaaagcagttgggacgcggcccggttcgaggcggcgatcgacgccgaccccggttccgaggagcggacccggctggtgagcgacctcgtggggacgttcttccagtcctacgcgtcggtggcgcacgggggccgggaggcgtacctgtcgctggacaaggggctgtgcgtgctcagccagcacgcccgcgacctggggttcgacgccctcctgctgttcctcgacgaactgatcctgtggctggccacgcggtcggtggacctcgacttcgtcaagcgggaggcggccaagctcaccaccctggtcgaggcgcagacgcccgaccggccgatccccgtggtcagcttcgtcgcccgccagcgggatctgcgcaagctgatcggggaccacgttgccggggccgagcggctgaacttcagcgactcgctcgactggcaggaggggcggttcagcaccatcacgctggaggaccggaacctcccggcgatcgccgagaagcgcgtcttgaagcctgtcagcgaggccgcgaagggcgagctggacgccgccttcgagaagaccgcgaaggtccgcgacgtggtgtggaacacgctcctggcgaacgagggtgacaagcggatgttccgccaggtgtacccgttcagcccggccctggtgcagacgctcatcgccgtgtcgagcgtcctccagcgggagcgcaccgccctcaaggtcatgcgacagctcctggtcgaccagcgagattcgctccaggtcggcgacctcgtgcccgtcggcgacctgttcgacaccgtggcccacggggacgaggcgttttcggcggagatggcgatccacttcgagaacgccaagcggctgtaccaccagaagctgctcccggtgctggagaagcagcacgggcgggcggaggagctggagcaactgccctgggagaacccgaagcgggtcgcgttccgcaacgacgaccggctggtgaagacgctcctgctggccgcactggtgccgggcgtggagacgctccgcgggctcaccgccgagcggctggccgccctcaaccacgggacgatcaagaccccgatccccggtcgggaagctcaagaggtgctgcgccgggtcaagacgtgggccgcgggcgtcggcgagatccgcgtcggcgagggccagaacccgacgatcacggtgcagctcaccggagtcgataccgaggccatcctggccaaggcccgcggcgaggacagtgccggcaaccgccgccgccgcgtccgccagatgctgttcgagcagctcgccattgaggacccggataagttgttcttcacctacgggttccggtggcggaacaccgaacgggcctgcgagctgatcttcgccgacaagcacgtccgcgacctgcccgacacgtcgctggagtcggaggacgggtggcggctggtgatcgacgtgccgttcggggagcccggccacggcccccgcgacggcatcggccggctccagcagttccgccacgcccacccgaacgggacgcgcacgctggtctggataccgaactacttcagccaggacgccctccgcgacctggggctcctggtagtgctggagcacatcctcgccggggagcggttctccgggtacgcctcgcacctgaacccgcaggacaagctggccgcccgcaacctgctggagaaccagagcagcgaactgcggcagcgggtgcggcaccacctggaggcggcctacgggctggacgccctgctgccgggctcgctggacgccacccaggaactggagccgcacgagcagttccagtccctgaagagcgggttcgacccgcagcccccggctgcggccacactccgggcggcgatggagcaactgctcgaccaggcgttggccgacgactacccggcgcacccgcggttcgaggccgaggtgcgggcggggaacctgcggaaggtgtacgacgtggccagtcaggccgcccgacgggaggacgggcgggtcgaggtggagaagacgctccggccgctcctgcgtcagatcgccaacccgctcctgctgggcgagatggggccggacgccacccacttcgtcctcggccagcactggaagaaccacttcacgcgcaagatctcgcaggccggcggtgcggccctgacggtgggccagttgcggaagtggaccgacgacccgaagccgatggggctgcccaaggaggccgcgaacctcgtcatcctcgtgttcgccgagcagacgaaccggacgtttttcctgcacggcggtgccaccgatgccaccctctccaacctctccgacgcactggagctgcgggagtggaaggggccgtcggaggccgtttgggatgcggccgtgcggcggggcgggagcatcatgggggtggcagtctccccgctcctcaagtcgaacaacgtcagcagcctggcgaatcaggtgaaggcgaaggcgacggagtgccggcccggcttgcagctctacgcccgccgactgcgggagcggctcacgccgatgagactcgcggactcgccgcgtctgaagaccgcccaggcgacggccacgctcgcggagcgactggcggcgggcgacggggacgggctggtgggggtgctggcgaccgccgaggtggcgacctccgaggccgcgatgagcacctgtctgggccgggccgccgaactggccgtggccctcgactcgttcagctgggagatcctcgacgcggtctcgaagctcgacggcagccagcgagccgcggccgacgaggtcgtccgaacggtccgggaggccctcgcggccgacgagcacgcggtcgcgctcgccccgacgctgaaggaggcgcagtcgaaggccgtgcgcctgctcaccgcccggccacccgccccgcccgctgttcccccgccggccgttcccccaccatccgacccgccggtcgtcgtgactcccgtgccagtcaccccgaagacggtgctgcggggggagaaggccgggctcaccctggaggaggcccagacccaactcgaccgactgaaggaggagttgtccgccgggcagacggtgaccgtcagcatggcctggaaggtcgagtcaggaggacccggaacgtga

SEQ ID NO: 569 - DNA, 3696 bp, Rhodococcus ruber
gtgagcattctgctgcgggacgtcatcgacattcccgaacgtatcggcgccgacgactacgtgctgcgcttgaccgacagcaccgacgacgacgcgcacatccgcgcgacggtcgaggcgtacgtgctcaccgactcgctcaaagacaacttcgcggtcgcgatctctctcatctccgacgcgatcaccaagaacacctcccgcggcgcgtacctcgccgggtcgttcggttccggtaaatcgcacttcatggcggtgctctacgccctcctcagcaatcacccggccctgcgcaccgaacggttccgcgacctcaccgaccgctacgacgccaacatcgccggcaagaagatcctcagcctcacctaccacttcctcggcaccaagtcgatggaagaggcgatcttccgtggttacgtcgatcagatccgccgtctccaccccgaagcgccgctgccggccctgcacgtgtccgacaccctcctcgctgacgccgagcacctgcgcgaaaagatgggtgatgatcggttcctctccggactcggcggcgacagtgcggacggcgacgacgcgtggggcggactggtgtccgacacttggaccctcgagcgataccgggcggggctcgtcgcccgcgcggagagcgaggagcgcaaggaactcgtctccgcgctggtgcgcaactacttctcgtcgttcctcgagcaagccgaatacgtcgacctcgaccgcggcctgagcgtcatctccgagcacgccagagaactcggctacgacgccgtggtgctgttcctcgacgaactgatcctctggctgatcttctacgtgcgcaacaacgagatcttcagccgcgaatcgcagaagatcaccaaactcgtcgaaggctccggcaacccgcgccccatcccgctggtctccttcatctctcggcagatggacctgcgcaagtggctcgccgatgcgggtgcctccggcgccgaacaggacgccaccgaccgcgccctgcaataccagcagggccggttccgcaccatcgaactcggcaacgacaacctcgccgaagtcgccaacatccgtctgctgcaaccgaagaacgccgacgccaagcagatcctcgacgatgcgttccgctccgtcacccgcagccccgacgtatgggacgtgctgcgtgattcgatgaacaccaccgaggagcatcgcggcgcctccgaacaggaattccggctcacctacccgttctccccggcgctggtggccacgctgcgcgaactcgcctcggtgatgcaacgcgaccgcaccgccctgaaggtgatgcagcgcatgctcgtcgaacgccgcgacaccctcaccaccgccgacctcatccccgtcggcgacgctttcggtcccatcgtcgacggtgatgaaccgatcgacggtgtcgcgtccaccctgttcaaagcggccgactccctctaccacgacaagctgctgccgctgctgctcacccgccatcaggtgacccaggagcaactcgacaccgaccccgactcggtgcccgccgggttccgcgcccacgaccgtatcgccaagaccctgctgctgtctgcgatcgccccgaaggtgcccgcgctgcgcgacatcaccgcgtcccggctcgctgcgctcaaccacggctccatcaagacccgcatgaagggcggggaagcccgcgtcgtcctcggcgtggtgcgcgaatggtccaaggacgtccccgagatcaccgtctccgagggcaccaacccgatcatccgggtgcaactgtccaacgtcgactacaactccgtcctcgaacgcatccgcggcgaagacaacaccggcaagcgcaaggtgctcatccgcaccctcgtccaccaggcgctcggtgtcgacaccaaacaggacgacctcgccggcggcgccacccgcaccgtcatctggcgcggttcccgccgcgaagtggacgtggtgttcggcaacgtccgcgacgcctcgtcggtgcccgaacagaacttcgacaaccggcccggcacgtggcggctcgtcgtcgactaccccttcgacgagggggagttctccgcggccgacgacatcgcccgcatcgaccgactcctcgcgggcggcgaccggcacaccatcgtgtggctgccgaagttcttctccgacgaagccaggcaagacctcgcgctgctcgtcaagctcgactggctgttcggcggcaccggcgaccgctggcaggagaacaccgatcacctatcgcccgccgaccgggcgcaggcccgaggcatcctcgaaaacctctaccggggaacgctcaacgccttccaacgcctcctcgagcaggcgtacggtatcgaagcgcccgacccgaaatacttcgtcgacgaccccggccataccgagatcctcgtctcgctcagcaaggacttcagcccgaaactgcccactgcgctgaacctgcgggacgccttcgacaaggtcgtcgaccaggcgttcgcggcgctgtatccgaaccatccgcagtatccgagcccggacgacgaggtcaccactcgccactacgagatcgtgcgcggtttcgtcgaggaggcggtcgcggatcgtcagggccgggtacctaccgccggcgccgaacgcaaggttgcgcagcgcatcgccgcgccgctgaaggtgggcaaggccaccgaagaccacttcctgttcggtgaagacaccttcgcgtactgggccggtgaactcgaccgcgcggccgccgaagccgaccgcgtcaccgtcggcgcgctccaacaccgcatcgacgccgtcagccccgcctggggtctgcgtcccgaagcccgcgacctgatcgtcgccgcatgggcgttgctgcggaaacgtgcctggttcgaggcgggcgcgcccgttccggcaccgccgctcggtcggatgcgcgaaagcatcgaactgcgcgccgaggaactgcccgaacaggcggcgtgggacgcagcccgcaccaccgccacctacctgctcggctacaccatcccgcgtacctttctcaccggcgcgaacgtcgccgacttcgcacaacaggtgcgagccagggcgggggagaagacctcggacctgcgtcagctcgtcgacaggctcgccgacgcccacagcgccctgaagctggacgtcaccgacaccgaccgcatcagcgtcgcccgcgcgctcgtcgactacctcgacaccctcgccgctaccggcggcaacgttgcactgatcgacctgctcgccactacgcctgtgccgggctccgcggaatccgccgggcggatgcggaccgaagccgcgcatgacgccgcagcgctgcggggattccagtggaaactgatcggcgcattgctcaccggtgccgaaaccggcggtgagcgcggagaatctgcgcgcgtgatcgtgaagaaactcgaggagctgatcaccacccccggcgtctccctggccgacgaattcaaccgcacggaaacccgcgtggtcgagtgggtggtgagcgaacgcgtcgacgacgatcccgatgatgacggtgacgacgacacttccggcggcgaggtcgtcacggaccccgaggaggtgctcctcgacgacatcgtcgatatcgagtgcgtcgccaaacgactgcgcgccgcccacaagaagcatggcaagcgtctgcacgtgaagtggtgggtggagtga

SEQ ID NO: 570 - DNA, 3696 bp, Mycobacterium xenopi
gtggcgtcccgagcccacgcgcagaacacgaagggccgcaacgtcatgaccacactgctgcgcgatgtcatcgacattcccgagcgggtgggcagcgacgactacgtgctgcgcctgaccgacagcaccggcgacgaccagcgcatcgccgccgccctcaacgagtacgtcatcaccgactcgctgcgagacaacttcttcgccgccatcgacctggtatccgacgcgctagcccgcaacacgtcgcgcgccgcctacctcaccgggtcgttcggctccggcaagagccacttcatggccgtgctctacgcgctgctaggcaaccaccccgccgtgcggacgtcgaagttcaccgacctcaccggccgctacgacggggcgttggcgggcaagaagatcctgcgcctgacctatcatctgctcggcgcgaaaagccttgagcaggcggtgtttcggggctacgtcgagcagatcacccggctgcaccccgacgcgccgctgcccgcggtgcatctgtcggacaagctgctcgccgacgcggagaacatgcgcgcgcagatggccgacgacgacaagttcctcgccggtctcgggtccggctccggtgcggacgatgagtggggcggcctcgtcggcggtggctgggatctgccgcgataccaagcggcccttgccgcctcacccgaagaccccgaacggcgcgacctggtgtccgcgctggccggcagctacttcaaatcgttcgccgagaccgccgactacgtcgacctcgaccgcggcctggtcgtcatctccgaacacgccaaatcgctgggctacgacgccgtcgtgctgttcctcgacgaactggtgctgtggttggcgttctcggtgcgcgacaccgagttcttcgcccgcgaatcgcagaagatcaccaagctcgtcgaatcgtcgggccgcaaccgtgcaatcccgttgatctccttcatctcccgccagatggacctgcgcaagtggttcgccgatgcgggagcctccggcgccgagcaggaggcactcgaccgcgcgttccactaccagcagggccgcttccgcgagatcggcctgggcgacgacaacctcgccgaggtcgcccacgcgcggctgctcgcacccaaggacgacgccgcccgcgccgtactcgacgaggcgttcgcgaacctcacccgccgcgccgaggtgtgggaagtgctgcgcgacagcctcaacaccgacgagcaccaccgcggcgcgtcggaggccgaattccggctcacctacccgttctccccggtgctcgtctccacgctgcgcaacctgtcgtcggtgatgcaacgcgaacgcaccgcgctgaaggtgatgcagcgcatgctcgtcgaccgccgcgacaccctcaccgtcgacgacctcattcccgtcggtgacgccttcgactacatcgtcgagggcggcgaccccatcgacgcgcacgccgcagcgatgttcaaatcggctaccgagctctaccacacccggctgctgccctccctgctggagaagcattcggtcagcagggaacaactcgacgacgatcccgcttcggtaccggccgggttccgcgcacacgaacgcatcgcgaaaaccctgctgctgtcggccatcgcgccgagagtcccagcgctgcgcgacatcaccgcgccgcggctggccgcgctcaaccacggatccatccggtccaagctggccggcggcgaatcccgcgtcgttctcggcgttgtgcgcgagtgggcgcagaaggacgtccccgagatcagcgtctccgacgccgccaacccggtgatccgggtgcagctcgccgacgtcgactaccagtcgatcctggaacgcattcgcggcgaagataattcgggtcgccgtcgggtgctcgtccgccgcctggtgcacgaggcgctcggcttgtcgagccggcaggacgacctgagcggcgacgccacccgcaccatcgtatggcgcggatcgcgccgcgaggtcgacatcgtgttcggcaacgtccgcgaccccggctcgctgcccgagcagtccttcgacaaccggccgggcacctggcgcgtcgtcgtcgactacccgttcgacgaggagggctacaccagcaaagacgacatcgaccgcatcgaccggttgctcaccaccggcgaccggcacaccgtggtctggctgcccaggttcttcaccgacgcggcgatggcggacctggcgctgctggtcaaactggactggctgttcaccggcggcggcgagcgctggaacgaatactccgaccatctgtcggcgaccgaccgggcgcaggcccgcgggatcctggagaacctgcgcagcggcaccatgaccagcttccagaccttgctcaagcaggcctacggcatcgagcccgccgaccccaaacgcatcaccgccgagtcccagcagtacgacgtgctcacctcgctgtcccgcgatttccagcccgaattgccgcccgccgccaccctcggggacgcgtttaccaagatcgtcgatcaggcgtataccgcgacctaccccaaccatcccgcgttcgagcccgccgacgaagaactcaccgcccgccatttcgagacggtgcgcgactacgtcgagcaggccagcgcccaccgcgacggtcgggtacccaccaacccgggcaacgaccgcaagatcgtgcgccgcatcgccgggccgttgcgcgtcggcaaggccaccgaagaccatttcctgttcggcgaggacacgttcgcctactgggcccatgaactcgaccgcgccgcacagcaggcgcagccgctgaccgtgcgtgtgctgcaagaccatatcgacggaatcagccccgcctgggggctgcggccggaagcacgcgacctggtgatctgcgcgtgggcgctgctgcgcaagcgggcctggttcgaggcgggcagcgcgatcaccccgccacccttgggccggttgcggcccagcatcgaactgcgcgccgaggaactgcccgcccagcaggcctgggacgacgcccgcgccaacgcgtcgaaactgttcggctacaccatgccgcgcacctacctcaccggcgccaacgtcgccgaattcgccgctcaagtccgcgccaaggcctccgacgccgtcaccgaactgggtcatctcatcgaccaactgcagcccgcgcattcacggctgggctcgacacccggcgccggcgatcggctgaccgttgcggtggccctgcgggacttcgtcgaaaatctcagcaccacaacgggaaacgtcgctgttatcgacgcgatggccgcggttacccttcccgtcgccatcgagaccgccgggcagatccgcaacgacgccgcccgtgacgcccgtgccctgcgcaacttcaaatggccactgttgcagacgttgcgcgccggggccgaccgggcgggtgaggccggcgacagcgcgcgggcgatccaacggtcgctgcaggacgcgatcgccgtgccgggccgctcgctgagcgacgaactggccagcggagaggacaagctcgtcacctgggtggtcgaggaccagccgaagtctcccgccggtgagctcaccgtcagcagcccgcaggaactgtccagcctgcaatcgcagctggcgcaggcattgtccaagcacggcaagacaattcacgtgcgctggtgggtcgagtga

SEQ ID NO: 571 - DNA, 4155 bp, Micromonospora sp.
gtgcctcgtcggtgggtgtcgtggtgctcggtcggcacgtcaatccggaacacgcggcgtcccgattcctgctcagggcgatcgaggagccgctgttcgatctgtcggtgtgtgccgtcgagcgatgaccgccacctgtccggtatccgactcctcctcgcgttccctgttgctgcgccggcaacgcagctgatctgcggcttctccgacgaatggcgcaactgcgcgccatcggtccactgtggctacgtcgaccggaccacaatctggccatccggggcggtacccgagcaaacgcatcaatgggtagcgtgtcgggcaccctggggaggctttggaggcacaccggtgacgctgctgcgcgacctgatcgacatcccgacgtccgtcggtgagggcgacttcgtggtgaaggccgccgagggcgcggatctgagccggtacgtggtcaccgaccagcttcgggacaacttcgtcgacgcgctgcgccggatcgggcacgcggtcaccaccggccgttcccaggcggcgttcctgcacggctcgttcggctccggcaagtcgcacttcatggccgtgctgcgggaggtcctcgcgcacaacccggaggcccggaaggtgcggaacctgacgggcccggtcgtcgccgccgacccctggctgcccggccggaagttcctcacgctgaccctgcacatgctcgacgcccgttcggtggagcaggcgatcctggagggctacctgcgccacgtcgccgtcgcccacccggacgcgcccgttcccgccgtgcaccggtcggacgcgctgctggagaacgccgccggcctgcgccggacgctcggtgacgacaagttcttcgcggccctgggcggcggtgccaccgcgcccggcgcggccgtcggcctggccgcgatgcgcgccagcaaagagggcttcaacccgcagcggtacgccgaggccgccgcgcagccgcccggcaccaaggagcgcgacgccctggtcagcgcgctcacccaggcgttcttcagcggcgcggtgcacagcgccgaatacctcgacctggacaccggcctcgcggtgatcacccggcacgcgaaggccctcgggtacgacgcgatcgtgctcttcctcgacgagctgatcctctggctctccggccggatcgccgactacaccttcgtcaacaccgagggtgccaagctcaacaagctggtggagtccgccgacgccgcccggccgctgccgctggtctccttcgtggcccgccagcgcaacctggaggacttcctcggcccgcaggtcggcggcaccgagcgggaggcgctggcgcacgtgatgcgcagcctccaggggcggttcggggagatcgtcctggccgacacgaacctgcccgagatcaccgagaagcggctgctcaagccgaacgacgacacggcccgcgcggtgatcgacaacgccttcgccgcagtgcggcacaacggcgaggtgtgggaaacgctgctgctcggcgcgcagtacggcgacgcgggtatcggctccgacgccaccgccttccgccagctctatccgttctcgccggccctggtggcgaccctcgtcgcgctctcccaggcgctgcagcgcgagcggacggcgctgaaggtgatgacagaactgctggtcgagcggcgggagaccctgcgggtcaacgacctcatcggcgtcgccgccctgttcgacccgctggtgctgcacggcgagctgcccgaccggcccaagctgcgccagcagttcgaggccgcccgcacgctctacctgcgcaagctgcgccccatcctgctcaccgtcaacggcatcgacgaggagaaggccgcctcgcacacccagttccagctcgacgacaagctggtcaagacgatcctgctgggcgccctggtgcccgacgtgccggccctgcacaacctcaccgccgcgaagctgcacgcgctgaacttcggctccatctcctcgccgatccccggctacgagaacacgatggtgctcaaccggttgaagcggatcagacaggacgccggcgagctgcacctgaccgacgaccatgaccccgtcgtgtcgctcaagctctacaccgtcgacttcgacaagctgctcgacctggtcccgcacaacgagacctcggccggcgtgcggcagcaactgctgcgcgagctgatcagcgccgagatgggcctggccggcagcgagggcagccacggcgagctgcagcagccgcgcgagtggcgggggcggcggcacatcgtccaggtgaagttcggcaacgtccgcgacaccgacgcgatgccgatcgccgcgctgctcgcccccggcgagtcgtggcggatcgtcatcgactacccgttcgacccgcaggactacccgcgcagcgccgaccgggcccgcatcgaggaactgccccggggttccaacaccgtgttctggctgccgctctatctgaccgacgacatgatgagccgggtcgcccagcttgcgaagatcaactatctgctcggcgtcggcggcgcgggggagcggctcaacaccctcgccgccgactggcccaaggccgaccggcagcagggccgggtctacctgctgcagcggcagagccagctccgcgacgggttgatcaccgcgctcaagcaggcgtacggggcggccagcccgcagccctccgacgtacacgacgacaccgtcggggtgctgcacaccctggccgaggggctgcgcatcggggatccccggggcggcacgctcgccgacgcgttccgcaacctcaccgccgagctgctggaatggtcgtacccgggcaccccggcactgccggtggacgagaagccgctcacccgcggcgacctggccaaggtcctggagtacgccaagcgggccgccgccgatcccacccgcggcgtctccgtcgactcgcaggccgaccagcgggtgctccgccgcatctgcaacccgctgcagctcggcgagatggtcgaccaccggtatgtgctcgcgatcaccacctgccactggagccggcacctgctgcaggaggcggcaaaggaggactaccgcgaccacttccccgtgcaccggctgcgcgactggctggacgtgccgaagcggcgcggcttcgaccgcgacctgcagaatctcatcatcgccgtcttcgcgctcgaacagcagttgagctggtacgacaacggcgtcaagaccagtgtcggcgcggtcaacggcgtggaggaccgcctcgagctgcgccacccgccgatgccgggcgaggacgcgtggaaggcggccctggagttcgggcagcccttcttcggcgtcgtcctgccccggttccgcacccctgccaacctcgccgacatggccaaggacatgcgcgaggtcgccaggacgtacgccgactccacccggaccctcgtggccagcctggaggcgcacgcggtgcccctcggcctggacctgaacgcgcccaccggccggctcgccaccgcccggcgggtcgccgagctgctcacccagatcgccggcgagcgggacgacgtggtgctcgtcgaggtggtcgccgagggggaggaccgcctcgccggcctggacggccaggcggcgagcggcgtcttcaagcaggcacagcggctcacctcggcgctggccggcacgcagtggccgctgatcaacgcggtggagcagcgggccgggagcgacccccgcgcccgcgcgctgctcgaccggctcagggccgccgcccgggacgagcaccacggctccgacatggtcaaggcgctgcaggaggcggtcgccgccgcagccgccctgctggccgagcacaacccgccggtccccccgaacccgcctgtccttccggacccgccggtcgtcgaccgcgattcggccatcgtcacgccgccgttcgttccgccgaccggtggtgtcccgtcgtccggcgatccgaacccgttagccgtcattccggtgcagcgcaagccggcagacccgctcctcccgccgcccgccgcccgccgggtcacggtcgccgaggagcgggaactggaccggctcgtcggcgagctgcgcgccgaggtcaccgccggtcggcggatcaccgtcgcctggcaggtcgaggagtcggagcagccgtcgtga

SEQ ID NO: 572 - DNA, 4011 bp, Saccharomonospora xinjiangensis
gtgagcacgaatcccgtgtacctgcgcgacgtcctcgacatccccgaagacgtccacgccggaagcttcaaagtggaactcaccggcagcatcaaacaggtcgaggcacgcctcgccgaatacgtcgtcaccgaccagctccgcgacgccttcgacaaggcgctcggcatcgtgcgcgccgccgtgcgcgacggcagctcccacgccgcctacctgcacggctccttcggctcagggaaaagccacttcctcaccgtgctgcacgccgtgctcaacaaccaccccgcagccagagccaaacccggcctgcaacccgtcatcgccgaccacgacgactggctgcgcggcaagaaattcctcatggtgccctaccacctggtgggcgccaccgaccttgactccgccatcctcggcggctacgtcagcaccgtgcgcgcactgcaccccggcaaacccagcccgcccgtgtatcgcgcggacgcgatgctcgacgacgcccgccgctcccgcgaagccatgggcgacgccgcgttcgtgcgctggctcaccatcggctcggaccccgccaccggcggccccggcgcagccgcagacgaggacgacgacgatctcgacctccagctgcccggcgaggacaccgacaccgggtggaccggcgaacgcctcgaccgcgcgttcagcgcgccagccggtgaccccgtgcgcgaccagctcgtgcaggacctgctctccgggcccatgtcctcctacattcgcggcgccaccggggacgccgacgcgttcctgccgctggagaacgggctgtcgatcatcacgaagcacgcccgcgacctcggctacgacgggctgatcctcttcctcgacgagctgatcctctggttgcaggcccgcatggtggatcgccagttcgtcaacacgcaggtgagcaaactcgtcaagctcatcgaatcgggcgacgccgggcgcgtgctgcccatcgtgtcgttcatctcgcggcagcgtgacctgtccaaactcgtcggtgaggacgtcaccggcgccgaggtcaaggaactcgaacggcaggtcgaatacctcgcggggcggttcgacaccgtgtcgctggaagaccgcaacctgcccgcgatcatcaaggagcgcgtgctcaccccgaaacccggtggccgcgagatcctcgacgccgcgttcgcctcaatcgaatcggccaaaccggccgaccgcgaggtgctgctcgacgccgcaggagccaccggcgccgactggcaggacttccgcgacgtctacccgctctcgcccgcgctgctgaacgtgctcgtcgcgctgtccggcgcgctgcaacgcgaacgcaccgggctgaagctgttgcaggaaatgctgcgccgccgccgcgacgacatgaaggtcggcgaactcatcccgctcggcgacctgtgggacgtgctcgccgacggcgtcggcgaggcgttcaccgaccggctgcggcgcgaagccgaagccgcccaccgcttctacgccaaggtgcgcgcctggctgctcgaacgccacggcggggccgacaaccagcagttccgcgccaccgaccggctcgtcaagacgctgatcctcgccgcgctcgccccgcaagtgcccgcactgacccggctgaccggtccccggctcgcggcgctcaaccacggctcgctgcgcgcccgcaccgtctcggcagggtcgctggccgtcaagcacctgcgcgagttgcaggccgagttcggcgaattgcgccacgagggcgaggaagaccccgtcttccggctccaactgtccgatctggacgtcgaaccgtatctcgacgcggtcggcgaacaggacaccacgggcgcccgccgcatctggacacgccagaagctgtgggaggaactgggtatcaaggacagcggcgacttcgtgtgtgagcgggacatcgtctggaagggcacccggcgcaccgccgaattcgtgttcgcgaacgtgcgcgacgagcaggaactcgccgacgcgcagttcctgcccagcacaccaggccgcatccggttcattctcgactacccgttcgacgactccggcgactacacgccacggcacgacgcccagcgcatccaccgcatgcggcgctccgacgtcaccgcggccaccgtcgtgtggttgccgcacttcttctccgcgcagaagtccgcgcaactcgggcggctgctcaagattcagtacctgctggaacgcaaccgcctcgacgacttcgcgcgcacccgctccgccgacgagcgcatcaagatccgccaccagctcgaagcgcagcgcgacaccctggaatcgcagctggtcgccgcgctgcgccagctctacggaatctcgggcggcgacgactccaccatcggcgcacccgtcggcgaggacgggcacgtgctgtcgctgttcccagggcacaaaccccgcctcgccggaggcgccgggttcgcctacaacgtgttgaccctggccgacgggctgttcgacacgatgtatccgaaacacccgaacttcgacccgaacggcaaccgcaaggccgtcacctccggcgagctgcgcaccgtctacgagtggatcaccaaggccatggaggacggcagcagacgcgtggtggtggaccgcaaccacctcgcgctcgtgcgccgcatcgtgcacccgctggaactcggcgaggtcaccgacgggccgctcaacgtctccgtcgagtggcgccgccgcatcgaacaggccgccacccagcacggcgtcaccggcgacctgcgcatcgaggacattcgcgagtggatcgccgaactcggctacaccgggctcgacaaactcgtgctcaacctgatcatcgcgacgtatgcgctgctggccgaccgcacctggaccctgcacggctccgtgctgcggcaaccacccgaactcgaccgcatcggaccagggcacgccctgcgcgcacaggagttgcccggcgccaccgaattcgccaccgcccgcgaccgggccgccgcgctgttcggcgtcgtcgtgcccgacacgcggttcgcgcgcaacatcaaccggctcgccgaggaggtgcgcggcaaggtcgccgcgctggaagcgcccgtcaacggggtgcggcggatgctcgaccggcacgccgcagcgctcggcatccccgacgggaccattgcgtctgacaagtccactgtgtccggtgagtcaactgtgtccggtgagtccgctgcgtccgacgcgccgagaatcgcgccgagaatcgcggccacccgcgacgccgccgagctgctcgcccggctcgctgcggcgaacgacgccaccgacctcgtgaaccggctcgccggcgccaccttcggcacacgcgacaccgtgctcgccgcgacgatctcggccgcgcccgcgctgctggacgcgctgaacgccgtggaatggtcgctggtgacgtccgtgcggggcttcgcgggcaggggcgacctcgtcggcaaccgcgccgacgcgatgctcgacgaactcgtccacgcagccaccagcgacgagttcaccgtggcgctcggccccgtgctcggcacactcaaggaccgggccgtcgccctcgtcaccgaggccgcgcggctcgcggccgtcgtcgagccgtcacccgcaccgcccgctgctgccactcgttccgccgaggagggaacgggggaacagcgtgccgacgcggtgagcctcaccgacaacgggcggcccggcgtcagcggcaccgcgcccgaggcggcgtttaccccggcgtccacaccggcgtccaatccggcgtccaatccggcgtccactccggcgggcgctccggcggaggctccggcggggcggaaggcccggcgcgtgcgggcgagcgcggcggaacgcgacctcgccacgctgctggccggcctgcgcgaggagatccgcgactacgcccgcgcccaccccggcgcggagatcgagatcgagtggcgcacggtcgggggagaggacagcgcgcgatga

SEQ ID NO: 573 - DNA, 3690 bp, Bradyrhizobium sp.
atgcacgagctgctcaacctccccgaggccgttcgcaagggcgacttcgttcaggacctcacgggcggcatctcgaaccccgagcgcacgatgaaggactacgcgatcacgtcgaagatcgtgcagactttcgagcacgcgctgtcgatcatcggcagcgcgctgcgcgacggccgtagccaagccgcctacctccacggctcgttcggctcgggcaagagccactttatggcggtgttggatctgatgctcgccgaccacccggccccatggagccgcggggagctgcatgcgctgcgcagcaagaacgactggatcggcaagaagaagctcctccagctcccgatccacatgctcggcgcgcaggacatggagtcgaagatcctcggctcatatgtcgcgtgggtcgccaaaaaccaccccgatgcgccgacgcccgccatctatgccgaccagggcctcttcgacgacgcgcgcgacctgcgccgccggatgggcgacgagaagttcttcgaagagctgaacgggggtgtgaagcaggcagcgagcggctggggcaagctcgccgaggcgcgcaagtgggacgcggccgcgtttgaagccgctgccggcgcgcagtatgtcggcgaagccgatcgcgatgcccagagcccgcgtgccaagctgttcagcgatctcgtgcggaccttttacaagtcctggaccgcgcagcaggggcggtttgttgacttggacacgggacttggcgttatgagtcgccatgccaagtcgctcggtttcgacgccatcgtgctctacctcgacgagcttgtgctttggctcgcgggcaactcgagcgatctgcccttcgtcggccgcgaggtgcagaagatggtgaagctgaaagaggcgcaggatgccgaccgcgccatccccattgtcagcttcattgcgcgccagcgcgacctgtcgcagttccttggcgagcaggcgcagggcgcagtccgcaacgagctgtcgcgcaacctctcgcaccacgatggtcgtttcgagaccgtcacgctcgcagattcgaacctgcccgcaatcgtcgcacatagggtggtgcgcccgaaagaccggtcggcagcggagaagctcgccgacgatttcgcgaaaacgtggcgcgcggccggccaggcgcagagcgtgctgatcggcagtgaaggcgacgaagctgacttcaagaaggtctacccgttttcgcctgcactcatcgaggcgcttgtcgcactgtcggactgcctgcagcgtgagcgcacggcgatccgcatcttgatggagctgctggtgcaccacttgccggaccttgagaccggccgcgtggtgcccgcgggcgacgcgttcgacgcccttgcggagagcgaagaccccatcgatgacccggtcatgaaggcgcgctttgaccgcgcccgcgatctctaccgcgagagcttcctgccgatcatccggcggcagcacaacacagacaacccggccgcgtgtcagcgactgcgtgagaaccatgaccgtcggctcggctgcagcggttgccagcagatgatgtgccgcaacgacaaccggctcgcgaagacgctgctcatggcggcgctcgcgccggaggccaagcccttcaaggggctcacggtcaagcggctcgcgtacctgaaccacggcaccatcgcgtcgcccatccctggcgcggagatgcaggtggtagcgcagcgcattcgcgattgggcgagccaggtcggtgcgctccggctcggtgagcaggctgaccccgaggtgaacatccatctcgcgggtgtcgacctccagccaatcctcgcgcaggccgccgaggccgacacggcgggcgcgcgcaagaatacgatgcggcgccttctattccaggctctcgaacttgagagtgatggcaccgtagccgaagcagagctgtcgttccacggcacgcgccgcaagggtcgcgtccgctatggcaacgtgcgggaaatggacgacaccacgctcacgtgccctcgcgagcacgagtggcagctcatcatcgactaccccttcgacgagcgcggtcacgggcccgacgaagatctgcgcaccgtcgagcggtaccgcgacacgcgttcccccgacgcgccaccgaacccgacggtggtgtggttggcgacgttcttctcccacgcgctcgatcgagagctcggcgatctggtggtcctggagcacatcctcgacggcgactcgcgcaagtacctcggccatctgcgcgtggaggaccagccgacgacgcgggccgatctggcgagcctccgcgcccaaaaagagtcgctcgtgaagcgcacactcgcacaggcctatggccttgcgatggcgaaatacagcccccacctcgacccgtcgcgcacagtggacgaacacttcatcccgctgctcagcgacttcgaaatccgtgcggtgctcgcgggaacgatgaaggacggctaccgccaggtagtcgacacacttctgtcgaagagatatccgcaccacccccgctttgacggacccgtatcggcgtcgcgcatggaacgggtcggcgcgctcctagagaagctcctcgatgaacgtgaccgtcgcatgaacgtcgagaaaggggagcgcaacgacctgcgcgcctacgccgatccactgggtatcaccgagacgggagacgtcgcggtgctgttgaacgagcgccccttcaaggagatcgagcagcaacgccagcagggcggcatcgacacgccgaccgtcagcaacgtgcgtggctggctcgatccgcagcggacgcgcggcctgcccaccgaagtacaggatatgctcatctcgctatacgcttcgtggagtgggcgcactttccggcgcgatagtaagaactacccgcagccgcgaccgggccagctcccggatgacgtcgagttgctgcgccccgacctgcccacgccggccgaatggagcgacgcgctgaaccgcgccggcgagctgtttggcatcgccatcggtggtcgctcgctgagcgcacgcaatctctcggcctttgccgacaagctgaaggagaagctgagggcggtcggcgacgccgccgagctgcccgctgcactggagtcgaagatccgagactgggccgagcccgaaaacgcgcaccggcttgcgacggcgcacgcatcggcggcgctgctccagcagctctcgcacggtgacggcgcatccctcgtccgcgaccttgcgagcttcacgcccaagacctccgtcccagcgatgggccgcaacttcacgaccgcggcggccagcaagcgcttacttcaagaggacgcgcgctggatcgtgctgcggcaggtgaaggggctcgtcggcgatgccgagcggggccagcgcgcgaagctgctgctccaggatctcgccacgctgctcgaaactgacgaggtgaacaagatgctcgccgacggactcagcgagctgactcgccgtgccgacgagttgctctatgtgcccacggattggggactgcaggagtcgccggtcagcgaggaagttgtgctcgagtcatcgaacgatctcggtgacgcgaaggcagccgcgaagatgctccgcgagctggccgcgcgcatcgaggtcgagggcaaggatgcctcgcgtgtcatgatccggctcacggcctggaagcggaggccggaatga

SEQ ID NO: 574 - DNA, 3684 bp, Burkholderia thailandensis; identical to SEQ ID NO: 172

SEQ ID NO: 575 - DNA, 3705 bp, Planctomyces maris
atgacactcatcaaagaactcatcgacatccccgagcgtgtgcagaagggggattttgtcttaaagctctctgaggacattgatcggccggatgtggtcctcgatcattatgtcgtcacgcctgagctggcgacctgctttgacagtgcgctctcgtttatcggcaactcggttcagaaccgctccagcaaagccagttacctgcacggcagcttcggttccgggaagagtcatttcatggcggtcctgcatctgatcctgcaggggaacaccgccgcccgcagcattcccgaactggcggccgtcattcagaaacacaacgcctggctgggcggcaaaaagttcctgctggttccctaccacatgatcggcgcgcacgacatggaatcgggcatcctggggaactacgtcgacttcatgcggcgcacgcatcccgaggcccccacgccccccgtttatctttctgcctcactcatcgaacaggcgcagaacgaacgtgaaaactacggcgacgaaccctttttcaaacgcctcaacaatgaccagggtgccagcagcggcggatggggagacctggaaagcgtctggacggcagagtcgttcgaagcagccgcggccgccgatcccgattcggaaccgcatctcaagctggtcagcacgctgcttaagacagtcgcttcgtcccacgccgaagtcgtcagccagcgcggcgggaactttgtccgtttcgacaaagggctctcgctgatgagccagcacgcccacagcctgggctacgatgcgctgatcctgtttctggacgaactgattctctggctggcgacacaatcggccgatctgagttttgtccgcagcgaagccgccaagctgaccaatctggtcgaagcccagtccgccgaacgcccgatccccctgatcagcttcgtggcccggcagcgggatctgcgcgagctggtcggcgatcatgttcccggtgccgaaaaactcagcttcagcgattcgctcgactggcagcagggacgcttcgacacgattaccctggaagaccgcaacctgcccgcgatcgcttccaaacgtgttctgcgatgtaagaatgattcggcccgcagggaactgaatgccgccttcgacaaaaccgcacggatcaaagacaacgtcatgaatattctgctgacccatgaagggaaccaggagatgttccggcaggtctacccgttcagccccgcgctggtacagacgctgattggcgtctcaagtgtcctgcagcgcgaacgaacggcgctcaaggtcatgctgcagctgctcgtcgatcatcgcgaaacgctggaactgggcgagttgattccggtgggcgacctgttcgatgtcgtcgcgcatggagacgaagccttcagcccggaaatggggattcacttcgacaatgccaagcggctctatcatctcaagctgctcccgctgctcgaaaaagaacacaacatacatcacgaagatctggaagacctgccttacaatgaccccacgcggaaggcatttcgcaacgatgaccgcttgatcaaaaccctgctgctctcggccctggttcccaatgtggaatcactgcgggctttgaatgctgaaaagctggctgcgctgaatcacggcactatcaaaactccgatccccggtaaggaagcagccgaggtactccgtcgcttcaagcactggtctggaagtgttggtgaaatccggctgggcgatgaaagcaacccgacgatcacagtccagctttccggcgtggataccgaaagcattatcgagcaggtccgtcgcgaagacaaccaggggaaccgcagccgcctgatccggcagattctgttcgagcagctcggcattcagggagagggtcagttcgaacagtttcacgaatttacctggcggaatacaaagcgggtctgcaatgtgctgttccgtaatattcgtgagctgccagattcatcgctggataatgaaagcgccgactggaagctggtcatcgattttccctttgatgaaccaggccatggaccccgcgacgacctgagcacgctccagcggtttatgcagtcgcatccggaaggaagtcgtaccctctgctgggtcccctcgttctttactgcggattcccaaaaggatgtgggcatgctttacctgctggactttctgatgaccggtgagcgtttcagcgagtattccagccacctctctccgcaggatcgtcagtcggcaaaaactattctggagagtcaacggaaccagttgagacagcgtgtgaaaaataacctggatgccgcctacggtctggatcgtcacgccagtgagtccatcgacagcacacacgacctggagctgaacgaacattatgcctctctgaaaccaggctttacgccgcaaccaccggtcgcagcgaatctgtcaggcgcgatggagaatctactcagccaggcgctggaacacgaatttccggcagccccgctgtttgaaggcgagatcaaaaagagtacgctgaataaggtctatgaactgatcctgccagccacgcagaccaccgatggtcgactcgccatcgacaaaaccctgcgtccactcctgcgacagatcgccgttccgctgcaactgggcgagatgggcatcgatgcgacgcacttcgttctggggcaccactggaaatctcacttttcaaaaaaatcagccgagaccggcagtgagcagtcagtcacacaactccgcaaatggatcgacgatcccaagccgatggggcttccgaaagaagcgcagaacctggtgatcctgatttacgctgcccagaccagctggactccctttctgcacggcgcgccatttgaggcaactattgccaatctgccggatgcctgtgaactgcgccccatttcgctccccacagaaaacgagtggcagcgggcccaggcactggccgccagtctgtttgggtattccggttcctccctgctgagtgccggaaacgtgaattcgctgtccgaagcctgccagtcaaaagccgtggaaacccgcaaagcctgtcaatcgtattgccagaatctgaagcagcacatgaccgatctggagataacagccgaatcgacagatcggatgcagaccgcagtcgccagccagatcctgattgaaaatctgagtactgccaaaccggaagaaattgtgtcattgctggcagaagccacgatcgtcaccagcgaaaccgccatgggagaatgcatcagtaaagctgctcgactggaaggtcaattgaatgcgaccaactgggaatcgtttgaattgcttcagaaactgccacccaattttcatagtgcctcgaaacaaatcctggtggatctgaaagaaaccatgatgagtgatgaacatgtactggacctgggaccggctttgaatacagcacaggcgcgtgccatgcgactcgtctcgcaggcgattgaaactccgcccacccccgaaggtgaaactacgacagctgaaacaccgacagacaacgattcgccccctcttccgacatctggcgcagcggctcagatcatcgaccagggaacaaagcaggggctaacgctctcagcagcagaggagatactttcagaactcaaagctagactgaaaccagcccagcaggcgcgcgtgaatgtcagctgggtgattgaagaaggaggcagtcagaaatga

SEQ ID NO: 576 - DNA, 3885 bp, Streptomyces gancidicus
atggcccagccgcccctcctccgcgatgtcatcgacatcaaggagtccatctccacctcggacttcgtgctgtccctcgccgaggcgacgacgcccgagggggcccagcacgcgctcaaggactacgtcgtcaccgagcggctgctggagaacttcgacgaggcgctggccctcatcaagtccgcgctggacggacaccgctccaaggcggcctacctccacggttcgttcggttccggtaagtcgcacttcatggccgtgctgtacgcactgctcagcggcaatccggccgcccgtgcccgcaccgagttcgacccggtgctgaccaggcacgagtggctgagcacggacggcaagaaattcctactcgtcccctaccacatgctcggtgcgaaggccctggagcagcgggtgctcggcggatacgtgcaccacgtcaagaagctgcacccggacgcgccgaccccgcaggtgtaccggaccgactccctcttcgccgacatccgggccatgcgcgccaacatgggcgacgaggccgtcatccgcggcctgggcaccaccggcgcggacgacggcgaggaggacgagtggggtgagggcttcgcctggaccccgcagctcctggacaccgcgctcgccgccgaggagaaccacgaggcgggggtccacctcaacctcaccaacccctccactccggccgagttgcgcgccaagctcgtcaacgacgccggcaccaacctcctccccggcttcaccaagaacgccgccgaggacgagcacggcttcatctcgctggacgccggtctgtccgtcatcgccgagcacgccaagtcgctcggctacgacggcctgatcctgttcatggacgagctgatcctgtggctggccaccctcatccacgaccagaagttcgtggcgcgcgaggccagcaagatcacgaacttcgtggagggcggcgacgcccgccgcgccatccccgtcgtgtcgttcatcgcccgccagcgcgacctgcgcgaactggtcggcgaggaggtgtccggcgcggccgagtcgtccatccaggacactctgaacctggcctccggccggttcgacaagatcaccctggaggaccgcaacctcccgcagatcgcccacgcccgcctcctcaagcccaaggacgacgaggcggccaagctggtcgacgccgccttcgagcagaccaagcgggtcggaccccaggtctgggacaccctgctcggctcggagaagggcaccaccggcgcggacgcggagtcgttccggctgacgtacccgttctcgccggcgttcatggacaccctcgtccacatctcgtccgcgctgcagcgctcccgcaccggcctgaagctgatgggccagctcctcgccgaccaccgcgacgagatccgcctcggccagctcgtccccgtcggcgacctctacccggtgatcgccgagggcggcgacaagccgttcaccgacagcctcaaggtcgtcttcgaggccgccgacaagctctacaagaccaagctgcggccctacctgctcagctcgtacgacatcaccgaggacgacgtcgagcagtaccgcaaccggcccgagtccctcaccgacccgaagaaactcaacggctgccggatgttcctcggcgacaaccggctcgtgtgcacgctgctgctgtccgcgctcgcccccagcgtgcccgcgctgtccgagctgaccatccggaggctcggcgcgctcaaccacgggtcggtcctcgcgcccatcccgggcgccgaggtcggcatcatcaagaacaaggtcgccgagtgggccgccaggttccccgagatcaaggagaccggcaccgacgccaaccccggcgtccgcctcgaactctccggcgtcgacgtggactccgtcatcgccaacgcccaggtcaacgacaaccccggcaaccgggtcgccctcgcccgccgcctgctctccgaggaactgggcgtcgagcacggccagttgagtgaccagctccacttcacctggcgcggcaccgcccgcaccgccgagatcgtcttcggcaacgtcgccgacgaggacgagctgcccgaccacgacctgatgccgcaggaggacggccgctggcgcatcgccatagacctccccttcgacgagggcgagtgggggccggtcgaggacgtcaaccgcatccagcggctgcgcgagcgccagcagggggagcggtcccgcaccgtcgcctggctgcccgcgcacctgtccgcgcagcgcttcgccgacttccggcgcctcgtcgtcatcgacaaggccctcgccgacgaacaccgcttcgacacccagtacgccggccacctcaacgccgacaaccgcagccgcgccaagggcctcctcgaaacccagcgggaggcgctgctcaagcaggtcaagggcgccttcaagcaggcgtacggactcgcccagaagcaggccgcagacgtcgtgcccgacttcgacgaccacctcgtcgcactgcccgacgtcgacagcctcaccttgtccttcgggcagagcctgcacgacggcatccggcacgtcgcgggcaagctgctcgcccaccagtacccggcccaccccgacctcgaccccgacgccaccggcaccgccgtcaagcccgccgacaccaagaaggtgttcgtccacgtccgggccgccgccgaggcgcgcgacgggcgggtggaggtcccggccgccgaccgcaagctcatgcagcgggtcgccgggccgctgcgcctcggacagcagaaggaggcgtacttcgagctgtcccgctactgggccgaccacttccggcagctcgcccgctcgcagggcgtcaccggggacctgtcgctgatcacgctcaccgactggaccgaccggcccgacccgcgcggcctgcccgacttcctcgcccggctcgtcgtcgcctccttcgccgagatggacgaccgggtgtgggtgcgcggcggcaccgtcctggaccccgcgcccgaattgtccgcgatcaaggaccacgacgcgctgcgcagccagccgctgcccgccgagaccgactgggacaccgcacgccagcgcttcgagaccatctttggtgcgaagccgcccgcgctgcggcgcggccggatggtcaaccagttcgctcgccagatcatcgaggccgcccgcgaccaccgggaccacgcggccgacctggtgcaccagttggaggcccacgcctccttcctcggcctcgaccagaccgcagacaccggacggctcgccctcgcccgccgctccctggaactgctggacgccctcacggcggaggccggcaagggagcggccggggcgaagaagacggtggaggcactcgcctccttcgacctgggggagaccagcgccgaccggtacggcacctccatcaagaaggcccgcgccgtcgctgaggctgttgcctccgccccctggagcaccctggaactcgccgccggactcggccccgagggcgaggcgctgctcgactcgctgcgcaacgtggcacgcgacgatcagcgcaccgccgacctgcgcgacgccctgggtcgcacccagcgcgaagtcgtcgcgctgatcaagcgcacccaggccgctgccaccccgccgcccgcgcccgtcgcaccccagccctccacggccgacggccagtccctggacacgccgaccagcgacccgcgcatcccctacaccccgcaggaaacgccctcctcggggagcggcggcacggcgcggaagtcggggcgccgcagcacgaccgtgcgccaggccgccgccgacctccaggcggagctggccgaactggccgcccgccacccgaacgcgaccatcgagatcacctggcaggtcatcgaatga

SEQ ID NO: 577 - DNA, 3732 bp, Gordonia amicalis
gtgttcccaggttcctccacgcccgcgcgcacactgcgggagaccttcgcgatcccgaagtcgcatggcaccaatgactatgtcctgcgactgtccgattcggtcggggacgcgcggctcgcgtccacgatcgactcgtacgttgtcactccggcgttggcggatgcgttcagtgctgcgcttggtgtcgtcgaggagtcccagcgcaccggtgagaacaaggcagcgttcctcgatggctctttcggatcaggtaagtcccacttcatggccgtgctctacgccatcttgggacgcgcaccgcacgcgcttgccgtgcccgagttgcagccggctgtcactgcgcatgcggcactcggccaagcaaagctgttgcgactcacgttccactttctcgacgcgcgcacgatcgagtcggctctgttcgaccaatacctaaggcagatcactacccttcacccggagacgttgccgcctgtactccactccgcgggagggctgttcactgacgcggataaccgccgcgctgaggtcggcgacgacaagtttttcgcagcgctcaacggcggcagcggcaccagtggtgcaacgatcgactggggcaaggtcggcgctgcttctgcagactggaacgctgagtcctacgcatctgcaactgctccggacgctgaacctaccgagcgcgcccgggtacagcaagctctgatctccacctacttcaccagctactcgcgtaacactgactggttgccgttggaagacgggcttgccgtcatcgcagatcacgcgaaatcgcttggctacgacggtgtcgtactcctcctcgacgaattggtgctgtggctcacgtttcttatcagcgaacgggaacgcttcaacgccgaggttcagaagattaccaagttcgtcgaaaccagtcgtggtcgattggccgttccgattgcctcattcatcgctcgccagcatgatctcgcggactgggtagccggcggctccgacgccggcgccacacagcaggcggtcgaacaggcctttgcccatcaagctgatcgcttcggcaaagtcgtcctcggcgacgagaaccttccgttcatcgcccacaagcggctactgcagcccctcaatagcgacgcctcggcggcgctcgacgaggcgttcgtccggctcgatcggaatccgcaggtgtgggatgtgctcctagacggcatcaatactgacgaccggcatcgggggtctgatgcagatgcctttaaacttacctacccgttctcgccggcgctgatcgcaacactgcgcagcctgtccgggcagatgcagcgcgaacgtaccgcgctcaaggttatgcagcagatgctcgaagacaacgccgacaggctgaccatcgacaacgtgatccccgtgggggaagcgttcgactacgtcatcgacagcgccaacgcgacgccaatcaacagcacgatcgcccaaaccttcaagactgcccgcaacctgtggtcagaaaagctgcggccaacgatcttccgcaaccacaacgtgcccgagacgacacccgacaaagacgtgccaacaggactgcgagcagacattcgaatcgccaagacactgttgatgtcagcggtcgcaccgaacgtgcctgccctcaaacaaattgatgcctctaggctggcgtcactcaaccacggcagcgtcatcagcttgatccccggtgatcaagtcggtcagatcacgaacaaggtcaaacagtgggcagctgagatccccgagctgtccgtgaccagcgaagcgaacccgatcatctcggtgacgctggagtccgttgactacgaacgaatcgtcaaccgcgccaagggtgaagataccgacggacgtcgccgcgaactgatgcgcgaactcctcgccgaacacttccgcgtgcaaggtgccgagcacaccgtcgacaatgcactattgcgcacagttgtctggcgcgcgaccgaacgcgaagtagaggtggtattcggtaacgtccgcgatcacagttatctgccggacgaagcatttcgcccgtcacgggatggggcactgcgtctgatcgtcgaccttccattcgacgacccaggtcacacgaccggcgaggaccacgaccgagtcgagcagcttctccgtactgggcaagaccggttcacggtcacctggctaccgaactttttctccgacaaggtcaatcgtcaactgggccgactggtcatcctcaattacgtgctcaccggtgatcggtgggccggttactccaatgaactatccgatgctgaccgggcagcggcgcgatcaatcttgcagcaacagcaaacgcaggtccgcgggcaattgaacaacgccattcagattgcctacggtgtcgcggccggcgccgagttccccgacgggcaaccgcccctgcgttctttacacgccgggttcatcgtgcaacctccaatcggcaatacgctcggagaagccgccgaccggctcatcggcgacgccttcagcgccctgtaccccgaccaccccgacttcacgccccccgaacgtctgatcacccgacgagacctcaatctcacgttgagccgcctgcgggaagcgcagtcgacggctgacggccgaatcgccttggatcgtggtgaacgcgagaccgttcgccgcatcgtggagccgttaggcatcgcccgcaccagcgaaacacatctcctattcggacccgaacacttctccgcgtggcggacccggctgacacaggaactctcacgctctgccatcgccgaagacacagaagtacccatcggtttgctgcgttctgcaatctcgccggcgggatcgaaacgcggactgaccgacgacgtcgtcgatctggtagctggagcatgggccgcacaaaccaaacggtcgtggtatttgcactccacatcggtggatgagccggcgatcggcgagttccggcgttacctcactctccggatcgaaccgctaccggagcgacagctgtggctcgacgcgtgccggcgctggaaaacactgactgcgcaaggcatcaacgagtacctcactgctccgaatgtgtcggcgttcgcccagcaagtccacgactacgccgcagccggacgcgacgaccgagcgcgcttggttgaggcgctgtcgcgtgcttaccagttcctcgagatcgacgcgggcgaacggctcaccgcggcacgagcgctcgacgaactgttcggcgccacgctgaaccgcctcgacaccctcacgcttgtcgacaccctggcgcgcgcgaacttcggcgccactgatctggaagccagccgttcactgacacaggccggagcgcttggcgaggccgtcggcgggttcgagctcaaccgtctgaacgtgcttcgcagtgcatccgaagccgacaacgatcggggccggcaagcggcagccatccttgccgcactgaagcaagccttcatcgagcacgaattatctcggcccctcagcgaggcactacggaccgcaagtatcgcccgcgacaagtggctagaggaaggggtcacgcaaccatctacgccgctccccccgaagcccgaacctcgggcggacccgccggcaaggcccgatacgatccaactggtcgtgtcctcgaccagcgattacagcgtggtcgaacagcgcctgacggagcttctccggaacaatcgcggaaccaagtacacggtcacgattaccccggagcagccgtga

SEQ ID NO: 578 - DNA, 3741 bp, Mycobacterium intracellulare
atgaccgaaagcgccttgctgagggaggtcatctcgatccctgagcgcgctggaaccgaggactacgtcctcaaactgaccgagggagtcggtcagggtcgacttgacgcgacgattaacgactacgtcgttacagacgacattgtgaaggcattcgccgacgcgcttgatcttgttgcagcggcaattggcgacggtgggagtcgggcgtcattcctctccggatcgttcggctcggggaagagccacttcatggcggtgctttacgcgctacttggacagaacccaacagcgcgtgcaagggcagagctcgcttccgtcattgcggctcatgacaaccagctccaaggcaaaaagatcctgcgtctcgccttccactttctcgacgcgcagagcatcgaacagtgcgtgctgggtggctatgtcgcgcagctcagagccctgcatccagaggcgccacttcccgctgtccacaagagcgatcagcttctgcacgacgcggagaaactgcgcgaaacgatgggcgacgacgcgtttttggcgggcctcaacaacgccaacggtgcgggcagcgcggctggatccgtatggaacaaggtcctcaatgagggcaactggacggccgtctcctacgacgcagcgcgggctgccgcccccggcagcagggagcgtcagtccctcgcctcagctttggtgaaggcttacttcaccgctttcacgagcggtgctgaattcgtcgacctcgataccgggctcgcggctatgagcgagcatgcaaagtctcttggctacgacgccatcgtcatgttcctcgatgagctcgtgctatggctggcatttcgcgtgcgcgacgccgagttcttcggacgggaagcacagaagatcaccaagttcgtagaagcaaacaacgttcgagctgtccccatcatgactttcgttgcccgccagcttgacttgcgtcgatacttcgctgagtcaggtggaggcgtaggtgccgagcaagatgcccttgatgccgcgttccgccaccaggagggccggttccggaccatcgtcttgggtgacgacaaccttccctacgttgctcaaaagcgcttgctcaggcccgtttccgactctgcgagggcgacgctcgacgaagcatttgcgcgcatcgaccgcacgccagcggtgtgggacgttcttctcgacggagccggggctgacggcggccagcggggagcagatcaggcagcgtttcgccgcacatacccgttctcgccggctttggtctcgacattacgtactctcgcctcggcgatgcaacgtgaccgcacggcacttaaagtaatgcagcagcttctggtcgaccagcgtgatcacctgaccgtctcggatgtcattcctgtcggtgacacgttcgacttggttgtgcacggcaaccaagcgattacagcggatatgcagggccgttttcgcaacgcaaaagatctgtacgacaacaaattacggccgctactgctccgggagcacaaactcactgacgtcgaggcacgcgcgcttccccccggccatgccttccgcacagatgaccgcctagttaagacactcgtactgtccgcggtcgccccggaggtccccgctcttaaagaaatcaccgcagggcgccttgcagcacttaaccacggatcaatcgtcagccctcttcccggccaggaagcatcggtggtcttgacgaagttgagacgatggagcgccgagatccccgagatccacataactagtgatgcccgcaacccggtcatccgtctcaagatctccgaagtcgactacgagtctgtagttgagaaggctcggggcgaggacagcgaggggaagcgccgccaactcatcaaatcccttgtgtgggaggcgtttagactcgaacaggttgaggacgacgttaccggcgtaaaccgccagaaccgtgtgtggcgaggctcacgacgtgaggtcgaaattgtattcggcaacgttcgcgaccacacctggttagccgaggagacattcaaggcaggtaaagacacctggcgattcgtcgttgattttcctttcgacgatcaaggccacagcgttcgtgacgacgacaaacgtgtcgacgacctgtcgcaacgtggtctcgtcacaaacacggttgtatggcttccgcactttatctcggcggagcgccggaacgatttgggcaggctcgccattctggactggctcctcagcgggccaggtgatcgatggcagaacatgtccaatgacctgcccgtcgccgatcggccgcaggcgagaagcatcttagagaaccagcgagacgctctgcgcgagcgtctccgccgcgtcattcaagaggcgtacggggcggccaagccgacgccaggaaacctcgaccttgacgaaggccacgaccgggttcttcgatcattaaatcccgagttcaacccgcaagcgccggtcggccacgacctggccgcagcgtttagcaaccttgtcgaccaggtctttaccacttctttccccggccaccctaagttcgaacccgcggactcggaggtgaagacgaacgacctccagcgggtgttcgaagcggtgcaggaggcacatcaggatccggatgggcgggtatacatcgagcctgcaaagcgtgaggccctccggcgtatcgggaacccgctcggagtcggccacatgggagagacgcactacctgttcggcgccgatcgtttcccatggagcatgaagttcgcgcgagcgatgggttcggccggaatcgacatgaatgacccagtcaccgttggaacactgcgtcgctggatccgagaagaacaacccgggtcgggattgcgcccggaagtagttgaccttgtcatatctgcatgggcagtacagcagggccgagcctggtatcgccacggttcagcgcttacgccggcgcccaaactcggccagctgaccgacgaagtggagctgcgtcccgagcctttgccgtccgcagaagactgggaagcagcagtgagacgggcggcgaccctgctcggagtaacctgttcaagctttctcaccggagcatccgttgccgagctcacatcagggattcgagaccaactcgcatcccacagctccgccgcccgcgctcttccaggaacgctcgcgcaagcgtacgaaaagcttggaatcatggctgacgccgatgtgcctggtcgctatagcaccgcgactaacgtggcgacgctcgtcgctaatgtcctcgcgcaaagggacaatgtcgcgttcattcgtaccttcgctagcacgagtcttcctggcaccgatgaggccgctgcacgttctcttctgacggcctcttctgtcacgagtagcttggaagaattcaattgggatcgactcaatcccctgttaaatgttgagaatcagaacgacgtccgtggcacgaaggcgaaggcttctctagaccggctgcgatcagctctagtcgccgatgagctagccgagggcatcagtcctgccttgcagagagccgacaacgacgcattcgcatggcttgcctccgccgcggcaccgagttcatctccggtccccgggcccactccggcgcctcctccacagccgatggctagaggtaagcgcgaaataagcacaagagccgacatcgcttgggtgaccgccgatatcgaagctttcgtcgacgagcacggaggagagaacgtcgtcgtggagtggcggattgagccgtga

SEQ ID NO: 579 - DNA, 3681 bp, Phaeospirillum molischianum
atgaccctgatccgcgacctcattgccatccctgaacgggttcactcgggcgatttcgtgctgcagctctctgacggcctgacccggcccgaggaaacggtgcgcgactacgtggtcacgccgcagctgaaaacctgcttcgatgatgcgctggctttcatccgatccgccatcgacggcaggaaaagcaaggcgtgctatctgcatggcagcttcggctcgggcaagagccatttcatggcggtgctggatttgttgctgtcggggaatctcgccgcccggtcgatccccgaactggccgaggtggtggttcggcataatgaatggacacaggcgcgccggttcctgatggtgccctaccacatgatcggcgccaccagcctcgatgcagccgttcttggtcagtacgccgaacatgttcgtaagctgcaccctgaggcgccggttcccggcttctatatcgcagaatcgatgttcgaggatgcccgcaaccttcggacgaccttgggtgacaacgagtttttcgaccggctgaacgaggggcacgtcgccaccggcggatcggggtggggcaagattgccggcggacaggggcgctgggacaatgacagcttcgcgctggccatgctggaaggccccggtggagaagagcgccaacggctgatcggcgacctcatccgccagttcttccgtcagtacgccaccgttgctcacgacttcgtgtcgttggacgacggcctgtcgatcatgagcaagcacgccaagtcgctgggctatgacgccgtcattctcttcctcgacgagttgatcctgtggctggctacccgcgcagcagatcccgccttcgtatccaacgaaggagcgaagctgtccaaattggtcgaagccgctaatgccgatcgccccattccgttgatcagcttcgttgcccgccagcgcgatctgcgggaactggtcggcgacaccctggccgggtcgctgcagcttcagttcaacgatgtgctgcgttggtgggaagcgcgcttcgccaaaattaatctggaagaccgcaacttgcccatcatcgctaacaagcgggtgttgcggccggtatccgaagaagcccgcgccacccttgctgaggcctgtgaccagacgctgaaggcgcgccaggacgtggtggagacactgctgacctccaccggcgaacgcgacatgttcaggttggtttatccgttcagcccggctctggtacagacgctgatcgcggtgtcgtcggtgctgcagcgcgagcgcaccgcactgaaattgatgatgcagttgttggtcgatcgccgggccgaccttgaacttggccagctcattcccgtcggcgatctgttcgatgtgttggcgacgggcgatgattcgttctcggacgccatgagcatccatttcgagaatgccaagaagctgtggcggatgaagttgctgccgatcctggagcggcaacatgacatcgcctgggaccagccggagcccgccgatcgcgcgcgaaacctcaggaacgatgcccgcctgctgaagacgcttctgttggccgctctggtgccggaagtggaatcgctgaaggtgttgaacgccgttcggctggcagccctcaatcacggcacggtgaagtcccctattgccggtggagaagggcgtgtcgttctccagaaattgcgcggctgggcggccgaggtgggcgagatcaagatcagcgacggtgataaccccaccatctccgtccagatcaccggcgtcgataccgaccccattatcgattacggccggcaatacgacaatccgggcaaccgccgccgcaagatccgcgaggccctgttccaggaattggggctggaggtttcgggagatctcttcgccaccttcgccttcacatggaggggcacccggcgggaaatcctgatcggctatgacaatgtccgcgagttgtcggatgatcgcctgtcgggggacagcgaccgctggacggtgatgttcgactatcctttcgacagcgcgaactattcgtcggccgatgatctggtacgactgtcgtccttccgggagcgcgggcaggcggcggcggtgctggtctggctgccgtcattcctcagccagaaagcccaggatgagctggggcgcctgattatcgttgaggaattgctcaagggtgatcgcttcaacgaggcggcccgccacctctcgccgaccgatcgcgagcaggcacgctccctgcttcagaatcagcggagccagttgcagcagcgcctgcgcacctgcctgcatgctgcctatggtatcgaaaatgagccgcgcgacgcgcttggaagctcgccgatcgatccggcgcagcaggtgcagtcgctcgacgagaccttccagccaattctcccggtgggccgggatctcaaatcggcgctggagcagttgttaggacagttgcacgaatatctcttcccggcggccccacgcttcgaggccgaggtgaaggctgctgtgctcaagaaggtgcagatcgaggtcgagaaggcattgtcggaatcggagcatcgcgtcctggtggccgacaaggggatgcgccaactgctgctaggggtggccggccccctgaagctgggcaccatgggttcgacccaccttaccctcgatgtcctttggcgccagcatttcagccgatgccaggccgccgatggcgttgagacgatcacggtggcgagtttacgccgatggatcgacgttcctgagcgaatgggcctgccaaaggatgcgcaggatctcattattctgacctatgccggccagaccaatcgcaccttcttcctgcgcggaattccctttgccgccggattagggactctggccgacgatgccgaacttcgtgagcaggcattgccgccgcaggtgcagtgggatgaagccgtcgatcgggcctccaagctctttggcctgaccattccgcgcttgctgaacgccgcgaacgcgcatcacctgaccgaggaagtcagaaagaaggcgcgcgactctcggcctgccatcgacgcctatgccgcgagcttggcaacacgtcagtccgtcttcggcccggcggcttcgccgccatcagacgttagggcgcctgcgcgcccggccggaacgacgaatcggtctatcaccgccaagtcgtgccaggcactcctgaaggcacttgacgaaagtgccgacgacgctttgatccagcgattggccgaggcgtcgctgcagacctcggacaccgctatggcgcaaaccatcagccgggcacaggcgctggatgaggttctgcgcggggatgcttggcgcgtatttgaagcattgcgcaagctgtcggacgagcgtgcctcagaggctcgtacaatcctcggacggctggcgcaggcccttggtgccgacgagcatgtcgtcgccctgcgttccagtatccaggacgaccatggcaaagcggtcgagttgctgaccgcatctacgacggcgcaggccccatcaccaccacctccttctgccccacaaccgctaaagggaagggtcatcgagaaaaatgtggtcaccggaatcaaggcggctgaggtccgttctgtgctgacggatttggctgatcgcgtcgcccgcgagccggccagccgtttggacatttcctggaccctggtccgggacgaggattga

SEQ ID NO: 580 - DNA, 3669 bp, Nitrococcus mobilis
atgaccactattggcgatatcttcgacatccccgatggcgttcatcagggcgacttcgtgttgcgcctgaccgaggggctgcgaagcgatcggcgcaggcagaccttgcggcaatacgtcgtaacgccgcaactggtgcgctgcttcgaccaggcgctggcgctgatcggcggcgcggtgaccggcaacagctccaagggtgcgtacctgcacggcagcttcggcagcggcaagagccatttcatggcggtgctggatctgatcctggaaggcgacgccgacgcccgcgcgatccccgagctggcctcggtcgttagcaaacacaaccgctggtggcagggcggaaagtttctggtggtgccgtttcacatgatcggcgccgaaagcatggagtcggcgattcttggcggctacgcggcccatgtgcgccaacatcatccggatgcgcccacgcccggcttttaccgcagcgaaggcttgctcgccgatgcctcacgcctgcgcgagcaaatgggcgctgagcgtttctttgccgctctggccggcaacgacgccggcggcggttggggcgcgatcggcagcggctgggatgccgacagctacgccgtcgcagccaaagcgccgccggaggatatcgagcaccagcgtttggtcggcgatctggtggatgcgttcttcgcccatctgagaagcgacaccggcgccggcgactacgtcagcctggaccgcggcctggcggtcctgtcgcgccatgcgcaaagcctgggctataccgcggtggtgctgttcctggatgagctgatcctgtggcttgccagccattcgcaggaccaggcctttctcaatcgcgagggccagaaagtctccaagctggtcgaggccggcgaggccggccggccgatcccgatcgtgagcttcattgcccgtcagcgcgacctgcgcgagctggtgggtaaggccgtgcccggcgcccagcaactggcgttcgccgacgtgctgcaatggtgggaggcgcgtttcgacaagatcgtgctggaagaccgcaacctgccggcgatcatcgagcggcgcctgttgcaggtgcagggcccggagcagaaacgccggctgcacgaagctttcgaacagaccgcgcgcgtgcgccgggaggtgctcgacatcctgctgacccacgagggcgacaagcggatgttcgagcaagtgtacccgctcagcccggcgctggtgcaggcgctggtggcgttgtccagcctgctgcagcgcgaacgcaccgcgctcaagctgatgctgcaactgctggtgagcaaccgcgacagcctcaccctgggcgatgtgatcccggtgggggatctgttcgacgtgatcatcgacggcgacgagccgttcacgccggcgatcaagaacctgttcgaccgcgcgcgcgaggtgtggacgcgcaagctcgcgccgctgctggaggccgagcatggcgtgtccgaccaagccatccatgagggcacggccgcccccgagatcacccgccgctaccgtgcccatgcgggcctgctcaagaccttgctgctctcggcgctggccccggacgtggaggcgctgcgcaatctcacgcccctgcggctggccgctctcaatcacggcaccatccgctcgccgctgcccaacgccgaggcgaccacggtgctggctaagatgcgcgaatgggccagccatgccggcgagatccagatcagtcccgacgccgccaacccgctgatcagcctgcagctcagcggcgtggacgtggagggcgtgctggagaacgcgcgcagcatcgataactctggcaatcgcgtgcgcaccgtcaaggagctgctgttctccgatatcggcatcgacacccaaaccaccaccatgctggcgccggaatacgcctggcagtggcgcggcacgccgcgccgcaccgaaatcctgctacataatgtgcgccaatgctcggacgacaacttccgcccgggcgacgatgtatggcgagtggtgctcgattaccccttcgacgaggacgaacactgcacccccgccgatgatcgcgcccgcgttgacaccttccgcgaacgcggcgaatcggtacgcacgctggtgtggctgccttcgttcttcaacgaacgcgcgatgagcgatttggggcggctgggtgtgctgaaccatgtgctgtcaggcaaccggctggaggaatacggcgcgcacctgcagccggcggaacgatccgaagcgcgcgccacgctgaaaaaccaacgcgatcagctcgagcagcgcgtgcgtgatgcgctcaagcaagcctacggcatcgcccagggcatggattcagccatccataccacgcattcactcgatgagcatttccagtcgctgtatggtggcctgcgcctgcaaccgccgcctggcggcagcttcaagcagagcctggagcatctgctggatcaggctctggacggccagtacccggcgcatccgaagttcgagatcgaggtgaagcgcggcggcctgcgccgggcctggggcgtgctggagaaggccgtggactcgcccgacggccgctacggcatggagcgtagccagcgtgacgagatccgccgcatcgtacagcctttgaaattggccgattgcggtgaaggacacctggcgctgagcgaccactggcgcaatcacatcgagcgtttgatggcgggcaagggcgttgctaccccgactgtgcggcagctgcgcgagtggcttgacgaaccgcgcccaatgggccttcaggacgatatcgccgacctggtgatactgacctgggcggcgcagaccgggcgcagctttttcctgcacaatagcccgctaccgggccagatcggcaacctgaatcgcgaatgcgagctgcgcgaacaaacgctgccgcccgaggaccgatggcgctgcgccgtgcagcgcgccgctgagatcttcggcgaggccggcagcggtgccgggcgcaacgccggcaacgtggcgacgctggcgcaggcgctggaggcgcacgccaaggaacgtttggcggcgttacgcgactatcagcgggcgctggaaaaacgcctgcgtgactgggaaatgggtagcgccggcgcgcgcgcgctgaccgcggcggcgagtctcgacctggcggtggcattgaccgagggggattcgtccaatcgaatcagcgccctggccgccgcgcgcatcgagacctcggccgccgccatgggcacgattatggcccgcgcgccggcattagcgcagacgctgcgctccccgcaatgggatgtgatcgacctgatccgacggcgcgctgacaaagacacgaaagtcagcgcgatcgtcgacacgatgcgtgccgccctcggcgccgacgagcacgtcaccgcgttggagcagcaactgggcgcccagcatcggctggcgctgcagtcgatggagcaaccgacgacgcccacgcccttgccgccaacacccgttacaccaacgcccaagaccccggcgccgggtacccgtcaggtatgccgcaacgcggctgcaatcggcggcatccgggaagcgctgcgcgaggtggagcaggcgttggccgacgatccggagctgcgtgcggacatcgattgccggctctatcatccgcaggcaagcaccgagtcgaagtcgtga

SEQ ID NO: 581 - DNA, 4143 bp, Frankia sp.
atgaccaggccgagcccgtcgtcgcagccgcagccgctgctgcgcgaggtcatcgacatcccggagcggacgtccgacagcgacttcgtcctcaagctcgtcgaaggggtcaccgacaccgcgacgctgagcagctatgtggtgacggaccggctcgtcgggaacttcgacgaggcgctcgggctgatcgcgcaggcggtgagcaccgggtcgtcgaagggcgtgtacctgcacgggtcgttcgggtccggaaagtcgcatttcatggcggtgctgcacgcgatgctgcgcggcgagccggccgcccggacgctggacgaccggctgacggacgtcctcggcaagcatgacgcggcgctggccggcaagcggttcctgctcgtcccgttccacctgctcacctcgaagtcgatcgagcagcgggtactcggcgggtacgccgaccatctccgcgtgctgcacccgcaggcaccgatcccggcggtgcaccgggccggggcgttgctggacgaggctcgcagcgtgcgggcgaaggtcggtgacgccacgttcctcgccgagctcaaccgcgccggctccggcggccccggcggcgcgggcgcggatgcggaccgggccaccggtgcgggggcagacgaggacgaggacccctggggtgacgccggctggacggccgctgaactggacgcggtgctcgcgccgggcgcgccgaccgacagcgaggaccgccgcctgctgatctccgacctgctctccacctggttcgcgaacacgttccgcgacctgcgtgaggacgccgagggcttcgtctccctcgacgccggcctcaccgagatcgcccggcacgcgaaggacctcggctacgacgcggtcatcctgttcctcgacgagctgatcctgtggctggcgaacaacatgggtgaccaggcgttcgtctcccgcgaggtacagaaggtcacgaacttcgtcgagggcgggctgggtgcccggccgatcccggtcgtcagcttcatcgcccgccagcgcgacctgcgggagctggtcggcgactccatcgccggtgatgtgcgcctgtcgttcctggacgtcctcaccctcgccgacggccgcttcgacaagatcattcttgaggaccgcaacctgccgctgatcgccaaccggcggctgctgaagccgcgggacgccgacgccggggcggcgatcgcgcgggcgttcgacacgaccgcgaaggtccgcgccgaggtgtgggacacgatgctcggcggcagcgaccagctcggcgccgaccgggacgccttccggctgtcctacccgttcagcccggcgttcatggacacgctcgtgcacgtctcgtccgccctgcagcgcaaccggacggcgctcaagctcatgcgccagctgctcgtcgaccaccgtgacgacctgcgcctcggccaggtggtgccgctcggcgacctgtgggatgtgatcacccgcggcgccgacacgccgttcaccgatgtcctgaaggccgagttcgacgcggcgcagaagctctacacccgcaagctgcgcccctacctgctcgacgccgagggcctcgacgaggacaccctcgcccgcgtccgccgcgcccaggccaccacagccggcggagccaccacagccggcggcgcagccgtcgacccggcgctggcaacgaaggtccgccggttcaccgcggatgaccggctggccaagacgctgctgctgtccgcgctcgccccgagcgtgccggcgctgcgcaacctgaccccgcggcggctctcggcgctcaaccacggcagcatcaccagccccatcccgggcggtgaggcgggcctcgtcggaaagaaggtcgaacgctgggccgggcagttcggcgaggtcaagtacgtcccggtggacggcggtgatccgggcgtcggcctggagctggtcgacgtcgaggtcgacagcatcctcaactcggccgtcgcctacgacaacggcggcaaccggcgcaccctggtgaagcggctgctcgtcgaggagctcggtgtcaccgtcaccggggacgtctacggcgaccggctcgacctcgtctggaagggcagcaagcgctcagccgaggtcatcttcggctcgatccgcggcgcggacctgcgcgacgaccagttcgccccggtcgacccggacgcctggcggctcgtcatcgactatccgttcgacgacgctggcgacgggcccgtctacgcccgggcgcgggtcgagcggatgcgaggcgcgggcgccgggcaccggacggtctgctggatccccgccgacctgaccgccacccgcctggccgacctggggatgctcgtccggctcgaccatctgctcaccggcagcgggcaccggttcgacagccatgcgcagcacctgagcgccgacgaccgccagcgtgcccgcggggtgctgaagagccgctacgacgcgctgctgaccaagacccgcaccgtgctgcgctccgcctacgggctcacctcgaaggacgagcaggacgtcaccgccgacttcaccgaccatctgcgcgcgctgtggccggggctgaacccgacgctgccgctgggcgcgtcgttccgcgacgccctccggcgcctcgtcggcgacctgctcgccgaccagttccccggccatcctgatctcgaccccgaccagaccgggacggcagtcaagcccgccgagctgaagatcgtcctcggttacgtgacgaaggcggcggaggccgacggcgggtcggtcgaggtcgcccgcgccgaccggatcccgatgcgccggatcgcaccggcactcggactcggagtgatgcacgaggtgcgtttcgagctgggccgtgaatgggtcgaccacttcacccgccaggcggcgcaggccgcggccgcggacagcgcgggcgttgccggcggcacggctggtgggggcggtgcggagccgggtgagctactggtagccgacctgctgggctggatcgacgtgccaaaggtgcggggcctggcggacgacgtcgccaacctgatcgtcgccgcgttcgcggagcagaccgaccgggcctggtatcggcaccgcggccacctgccgaccccacccgagctgaccgccatcacgaaggacatggcgctgcgcgaacagcctctgccggacgccgccgactgggccaccgccgtcgaccgcgcccaggcgatcttcggggtgctgccgcccgcgctgctgcgtggccgactgctgcgcggcttcgtcgacgaactggtcgggaagacgcacagccgccgggcggcctgccaggaactggtcagtgtcctggaggcccgtgcgacggagctcggcctcgacccacgcaccggcgccgccctggccagcaccgccccgaccgccgcgagtgggtccggcagcacggagagccttggggacccggaggccgacggctccgcggcgcagggaaggctgcggaccgcccgggcggcccgcgacctggtggtcgcgctggacgagaccagggtggcaacggagatcgtccgccggctcgcccgcgccgacctcgccggccccgcccgccggctcgcggtgagcatcagccgcgccacggaggtcgcgaccgccgtccgggcggcaccctgggatgtcttcgtggtcatcgcggggctcggcgagccgtatcgctccgaggccgacgagattctcgacgcgctgcgggccgcggctgctgccgacgagctgacatcaccactcgcgacggcgttgggaaatgcccgatccgaggccaccgccctgctgcgtcgcgcgaccgcggtgccggtagcccgaaccccgccggacccgcgtccagcgatcatccagccgccagccgaggtcccgggcacgcccagcatcgacaccgaccgcatcggggtgaccggcggcgggaccggcaccggcggcgggaccggcggcggcagtggtgagggcggaggcgtcggcggcgagacggggaccgtcgacacggaccgggttccggtcggcgataccggtggcgtgcggacgtggcgagtcaggctcggcgggctggagaacgccttggccgagttgcgcgcccatgccggtgaccggcccggcgaggtcgagatcgtctggcggccgcagccgtga

SEQ ID NO: 582 - DNA, 3675 bp, Pseudomonas stutzeri
atgacattgattaaagagctgatcgagatcccagaaaaggttcaacggggtgatttcgttcttaacctgtccagtggtttggctgatgcagctatcagccaaacgctagagcagtatgtggtgacgccacagctgcagcgctcgttcgacgatgccttgagctttatcaagagcaccgtggtgggcaaccagaaccgtcagaaaggcgcgtatctgcacggcagcttcggtagcggtaagtcgcactttatggcggtgctgcaccttctgttgcagggcaattcccaagcccgggcgataaacgagctggcgcctgctgtagccaagcatgatgagtggctgcagcaaaccaatatcctgctggtgccctaccacatgatcggtgccgccagcattgaggcgggtgtgctgggtggctacgcgcgacatatcaagcatctgcatccagattcgccggtacctggcttctacatgagcgaccggctattccgtgatgctcggcagctgcgcagcaatatgggtgatgcgaatttcttcgccacattgaacaaaggcgctgcagcggccgaggatgacggttggggtgatctatcgaatggttgggatgcagccagcttcgatgcagtgctcaatgaccaagctggtgctgacgacaaggctcgcctggtcggtgatttgatcggcaccttctacagctccatggcggatatggctaacagcgagtacggcggctacgtcgacttcgatgaaggcctgcgcatcatgacggagcatgccaaagcgctcgggtacgacgcgcttatcttgttcctcgatgagttgatcctctggctggccagtcacctgtctgaccagcgctttatcgccaacaacattcagaaagtggtgaagctggttgaagccagtgagcagcgtgcgttgcccatggccagctttattgctcgtcagcgtgatctgcgtgagttcgttggagatcagtacaacggcgcagaacagcaggcacttagcgactcgctcaagtactgggatggtcgtttccacaccatcaccctggaagaccgcaacctgccagtgatcgctgagcggcgcttgctcaagccgatcaatgcggctgccaaggcagagatcgacaatgcctttgcggccatggatgcaggtttgcgcagtgaggtgcaggagatcctgctgaccaaccagggcgatcgtgagacgttccgctcgctttatcccttcagcccggctctagtgcaggctctggtggcgctttcttccgcgcttcagcgcgagcgtactgcgctcaaggtcatgctgatgctgttggtcgatcagcgcgaaaccctggagctcggcggctgcattccggttggtgacctgtatgacgtgattgcttcagaggctgagccgttttcagaagtgatgcgcatgcatttcgacaatgctcgccatctgttcgagcgcaagctggtgccgctgctggaggaagagcacaacctcaagctggatcagctgctggagctgcctgtgaacgatccaggccgtcgcgcctttaccaacgacatgcgcttgattaagaccttgttgctgtcggcgctggttccggaggtggagtgcttcaagcagctcacggccaataagctcgctgcgttgaaccacggcaccatcaaatcaccgatcccagggcgtgaagcgcagacggttttgcagaagtgccgcaaatgggcggggcgagtcggtgagatcaagatcagtgatgactccaacccggtcatcgcgattcagctttcaggcgtggataccgagagcattcttgagcaggcgaaaatccatgacaacgatggcgcgcgccgcaaattgatcaaggatctgctgttcgaggccttcagcgttcaggatgacaaccagctgtttatcgagcaccccttcgcctggcgcggtactcgtcgcaccgttgaggtgatgttccagaacatccgcgagatttccgacttcaccacctttgaggcgcgtggtgatgattggaaggtgcttgtcgactttccgtttgaccagggcaaccactctcccgcgagcgacagggcacgcattcaagagtacgaagccactggtaatgcgacacagacgctgtgctggttgccgtacttcttcagccagtcggcgcagcgtgatctgggaaccttggtgactcttgagcacgtactgaaaagcgaagatcgcttcgtctccttcagtaagcatctgagtccacttgagagggcacaagcacggacgcttctcgataaccagcgcagccagttgcgccaacgcattcgtgattacctcatgggtgcattcggtgctgcacaaccgatcccgggctcgctggatgattcggtacaactcgaaagccaggtttattcgctggagcctggatttactccgcagctgccggtgggcagtaatctgcgtgcggccttcgagcacctgcttaaccaggcgctgagcttccaatatccggatcaccctgagtttgacggtgaggtcaggctcgctgacctaggtaaggtgatggagcagctgcgtcgggctgtgcatgccactaatggtcgcatcgatatcgacacgccgttgcgctcgatcatgcgttcgattgcacagccactgaagcttggcgagatgcatgagcggcatttcatcttcaaggatgattggccgaagcacatgacccgtgagctggccaaggatgaatacgccggggatccagtgacggtgaagcgtctacgttcggccattgatcagccgacacccaaagggctgccggacattgtgcagaacctgctgatcatggtgtttgccgagcatggccagtacgccttttcgttgcatggtcaggactatgagccgacgctcaaggacatgccggataacctgttactgaccaagcaggatctggctgagccgaacatctggaagctgggcgtagataacgcttccgccatcttcggcctgacgcctaacaagctgcgcaccgccaatcatcagaatgcattggaaaaggatgtgcaggatgaggttaagcgccaacttgggcattgcgaggaactggttactgagctcagaggtgcattgagccgggttaatcagggaacgcaatgcaatcgtctgcgtaatgctgagtatgccgtgagtttattgcagaccttgcagggtaagcagggggcagacctgatcgctgcgctggcggatattcagccgcccaccaacgcgatggctctcgccaaaagtatcgtcagcgctgctagcgtgacccaggcgatccaggacaataactggcaattgctggaaaccgtttggaagtcaggggccgctgaggctctgcagattaagcagcgtgttagtgctgcattgaccgcggatgagctggtgacggcgctggcccaagcgcttcgacaggctcaggcagatgctacatcgcagttgacgcgaaacgtcgttccgccggccgttcagaacgttccgcctgccgataccagtatcaaaggtgccggtggcagaaaggtgctggagcaggttcagcagagcggtttgaccagcaagcaggcgcgcactttgttcgccgagattgagagtaaattgcaggacggctatgtgctggatgtgagctacagcattgtgcgcatggatggggcagaggattga

SEQ ID NO: 583 - DNA, 3984 bp, Dietzia cinnamea
atggccttcaccccaccaggcgcgacggcagggtcgggcaccagcccgaccctgcgtgacgtcttctcgatccccgagcactcagggacctcgacgttcgtcctccaactctccgacgccgtcaccagagacgaactcggaaccaccctggccgagtacgtggtgaccccgtccatcggcgatgcctttgacgaggcgctcgcactagtcgacagcgctcttgccaccggagagaacaagggagccttcctcaagggctccttcggctccggcaagtcgcacttcatggctgtgctcctggccctgctcaccggggaccctcgcgcccgcgccattgccgaactccagcagcacatcgccgaccacccgcgggccacgtcgagcaagatcctcgcgctgcccttccatttcctgggctcgaactccatcgaggacaccctgttctcggcgtacctcgaacacctgaaccggcttcacccgggagtcaccccgccggtactccacatggccgacgggttgctcgagaacgccgaacagatgcgtgccgaggtcggcgacgagaggttcttcgcccgcctggccactgccgccaccggacctggcggcgtcacctcgtcgtcgtcctccacccccggcggcctcgacttggcagcgctcggcggcgccaccgccaccaactgggaccgcgattcctacgaccgcgcccgacaccccgccgcgtcccgcgctgagcgggatgcgctcgtctccgcgctcggccagacgtggatcacctccgcgcacaccaacaccgactggctgcatctgcccgagggactgtccgccatcgcggcgcacgccaagaccctcggctacgaggccgtggttttgctgctcgacgagctgatcctgtggctcaccttccacttctccaaccgcgagttcttcggccgcgagatccagaagctcaccgggttcgtcgaatccgaccaggggcgcatggccgtgccggtcgtcagcttcatcgctcgccagcacgacctcaaggcgtggaaggactcctcgatcgaggccggcgaggccaccaagatccgcgagcaggccatcgcccaccaggaaggccgcttctctggcattgcgctcggctcggccaacctgccgcagatcgcccaccgtcgactcctcacgcccaagaacgccgcggcggttgaggctctcgaggcctcgttccagcggctgcacctgtccccggccgtcaagcccgtcctgctggacaaggtcaacaccgacgaccagcatcgcggtgccaccgaggaacagttccggctcacctaccccttcagcccggtcctcatcgacaccctcgtccacctgtccaccgccatgcagcgcgaccgcactgcgctcaaggtgatggagtcgatgctcgtcgacctcgccgacaccatgaccgtcgaccaggtgatccccgtgggcgaggtgttcggctacatcatcgacgggacccagaaaggtggtaccgacgaggcggtggccgcccgcttccgcaccgcgcgcacactgtggcaggacaaactccggcccgccgtcctcgcccagttcccggacgccgacccgagcgtgcgggacctggaccagcccaagggcgtgcgggcccagctccggctggccaagacgctgttgctctccgctctcgcgcctgaggtgcccgggctcaaggcgctcaccgccagccgcctggcgcacctcaaccacggggagctcgtctcgatcgtcgcctctgacgcgcctacccgcgcgctcgcctcggtccgcgagtggaacacctcggtccccgagatcaccgtgggcacagacagccacgacccgctgatctccatcacgctggaggaactgcccttcgacgagatccttgagcgcgcccgcggcgaagacaccttctcgcggcgccgcgaacggctccggtcgatgctgcaggaagagttcgggatcgccgccatcgacccgcaggccgacggcgcgcgctcgacccggatcacctggcgtggcacgaatcggaccgtcgagatcgtctttggcaacgtccgcgaccccggctccgtgcccgacacccttatcgcccccgtcgaaccgggggcgctgcgggtgatcgtggacctgccgttcgatgaagagggccacggagtcgccgaggaccacgcccgactcgaccgcctccgcaccgacggccacgatcacttcacgctcgcctgggtccccgcgttcctcgatcgcaagcagatggacgacctgggcaagctcgtcaccatggactgggtgctgcagtccgagaagtggctcagctacaccagctacctcgccgacggcgaccgtgagcgggtccgccaggtcatggtgacccagcgcaaccagctcgccgggcagctcgccgccatcctgcgcaagatgtacggcatcgccgagggggcagtgttccccgaggggcagccgcccgtccgctcgttgagttcctccgtggtggtgcagcggcccgtcggcgcttccctgcgcgaggccgcccggcggctctacgatcaggcctttgaccagcgctaccccgaccacccgcggttcgacaccaccagcgcgctcacgcagaaggacttcgcggtctcgctcgacgtgctgcgccggtccgacgcccgtgaggacggccgcgccgcgtttgtcgctgccgagcgcaagtccgtccagctcgtgctgggtggcctccgggtggctgacgtccacgagtcacacctcgtgttccccagcgccacctttgccagtttcgctgggcagatcgaccgcgcgctcgccgagacagagaagtccgggcagaccgacggtgtgctcacggtggcgcaggtcgtggccgccgtcgagaagctcatgccgcaagcagggctcaaccgcgactgcaccaccctcctcgcggcggcgtgggccgagtcccgcgaccgcagctggttcacttacggaacgcccgtcgcagcgccggccttcaaggacatccagcagtcccaccagctgcgcgaacccgtactgcccgaacagggcgagtgggatcgcgccgtccaggccgcccagcatctgttcggcattcccgaacgaggccacctctcccccaccaacctcacccacctggcgggcgaggtgtcgagcaaggcggacgagttcaagcagtccagcgaggacttggtcgcgcaactgtccaagctcgagcagcgtctggggcggagcgaggaggggcgccgcctccagctggcacgccggcagacgcagctcctgcagacgttggtgcgcaagaagcagcaccacggcgagatcgtggcggccctcgccgccgcgggtgaggggccgggcacctacctcggggccaccaccaacgaggcgagcctgtccatcaccaccgccgaggaggtggcggccgtggcgcgcaacgtcaccccgaaccttgggaccctactcagcgggcgaggcaggcaggcacccctcgggagcgaggccgcgcagatcgtgctggacctgagcaacggggtcgacgctcacgaattcgtcatgcacctggacaccgccgtgacgcggttcgaggcgcgcgcccaggactggatcaacagggtgatcgcgggcggcgatggttcgggcggcggacccgggggcgatggttccggaggcacgggcaacggaggtaccggagatactggggacgccggagaaaccggtgattccggtggaggaccgggtgctggagataactccggcgacgactccgggtccggtccgggcggcggggccggtgacaccggcggcggcccggaggtcggtgccgtgcgtatcgagggttccggtccgcgccggtcctttgaggcccgcggtagccaagttgaggccgcgctccaccgggcactcgccgacctcgagcggtcctacgggacgggcacccgcttccggatcgagatcaccgccgaggagccccgaacgtga

SEQ ID NO: 584 - DNA, 3654 bp, Eubacterium saburreum
atgcagatcaaggacatgttccgaaagaaaattgaccgtgaaatacagggtgttatcattgtcggtcagggtgaagaaacgaatgtggcgcaggagctggaagagtatgttgtgacccgtgagcttcagcgtcattttgcagatttctttgcagcatataaaaaaggtattcagggaaccacaccgaaaatgggcgtctggatttccggcttctttggaagtggtaaatctcatttcctgaaaattctgtcctatctgcttcagaataaacaggtcggagacaaacatgccattgactacttcattgaggatcagaagattaccaatcagatggtgctggcagatatgcagttggcagcaaacaccccatcggacataattcttttcaacattgattccaaaagcgattccaatggcaaggaaaacaaagatgccattgtgaacgtgttcctgaaggtattcaatgagatgcagggcttctgcggttccatgccgcaccttgccgacctggagcgcaggctttccgaggaaggtcgttttgaagagtttaaggaaaagtttgaagaagagcatggcgatccgtgggaaagctctcgtcaggacttcgatttcattcaggattccgttgtcgatgttctttctgacatggatttcatgagcgaatcagctgcccgtaactggtgtgagaaagcaactgagggctaccagatcagcattgaggattttgccaagcgtgtgaaatcctatattgataaaaaaggtaacaaccaccatgttgttttccttgtggatgagatcggtcagtacattggtgatgattccaagctgatgctgaaccttcagacagtgacggaagaagtgggcaaggaatgcatgggtaaggcttgggtaatcgtaacgagccagcaggatatcgactccattaccaaggtgaaggggaacgacttctccaagattcagggacgtttcgatacacgcctttctctatcctctgccaatgtagacgctgttatcaaaaagcgtattctggataagactgagaccgcagcacagagcttgcgtctgctctatgaccagaaagcaaccatcatcaaaaatctgattgtcttcaatgacggtgtggagaaaaaactgtacgccaacgcagaagattttgctgaggtttatccttttgttccgtaccagtttaatttgcttgccagcgtgctgaccagcatccgtacccacggtgcatccggtaagcacctgtccgaaggtgaacgttccatgctggctctgttcaaagagtctgccatgcagttgatggattcggagatgggggcaatcgtgccgttctatcggttctatgatgcattggagaacttcctcgaccacagccacagcagcgtgctcatccgcgcttatgataacagttacatcaacccggaaaagaaggaaaaagatgtcttttctatcaatgtgttgaagacccttttcctgattaaatatgttctggagatcgaagctaacgtggataacatcgtcagcctgatgattaccagcattgacgatgatcgtatctctttgaaggcacaggtggaggatgcgctgaaagtgctgatgcgccagatgctgatccagaagaacggttccatctatgtattcctgaccgatgaggaacaggaaatcaataacgaaatcgaaaaagaaaatgtggagatgccggaggtcatcacgaagatcgcagagatgatctatgaggacattttctccggtaagaagtatcagtaccccagctttggtggacgatatgcgttctccttcaatcagacagtggatgatcgcccctataaggcaaaccagaattacgatatcggcctccgtgtgctgaccccatggtatgagggcggcaccgatgacggtacgctgcgcctactctccggccagggcaaggaagtcctggtggttctgccgaatgatgatgcgttcctgacggaaatgcgtgcatacttaaaaattgaacggttcctacgcaagaatacttctgtgcagcttgccaagtatgagaccattaaggaagcaaagcgtgtggagatgcgggaacgcaacggtaatgctaagctttacctgacggaagctctgaaagaggctaccatctatgttaatggcgatgtgctgcacacctccggcaaggaagtgaccagccgcatcaatgaggctatcggcagactggtgcagacggtttaccacaagctgtcctacattgatgcagcgatgggcgaagcagacatccggaagatgttcaagaccagcaaccagctgtcgctggcactgggaaataccggagaatccaatgtccacgcactggatgatgtgctgcaatttgtggcaggcaattcccggatgcacatgaaaacttctatgaaaaccatcaaggatcgctttatgaaagcaccctatggctttgtggaagatgacatccattggctggtggcacggctctttaagcgcggagatctgtcatttacggtcagcggtgagagcgtcaatctgaacaaccgttccgaagaagaaatcatctgctacatcacaaagaagcagtttgtggataaactgctgacggaagtgcgcgtccgtgtgccggaaaaccagaaaaaggccgttcgcaccgtgatgaaagagctgttcaagatgacgccgcctgccgatgacgaagataccatcatcaaaaacttccggtattattgcgagaatcggatcaccgagatcgagcggctggaaccgaaatatgagaattacgcctatcccggaaaagaaattctggaaaagggcaagaagcggctttccgcactggtgcagattcaggcaccgccggagttctttaaaaccgtatttgatgagcaggacgatctgatggattttggcgaggactatgagcctatccgtgatttctttggcagtgaacagctgaccatcttcacccgtgcactggatatgttgaacatctatgaggacagcaagacctacatcgtggatgcggaactggaagatgtggtgtccaagatgcgcaccatcgtccggatggtgaagccctacaaggaaattccgaagctgccggagctgcgcgagaagtttatgaactgctatatgcgcattctggaagagcaggcagaaccggtcaaggattccatcaatcaggatcggaaccgtgtttttgaagtgctgaacaccaagtcctataaggatgtgaagttcaaccgttatctggagctgtttaaggaaatcatggacggtgtggaactgtgcaacaatgtctccactctgcgaagctatgcagacaaggctgaggcactgaagctgcgcctgctcaatgagatgacggcagaagataaccgccttgcaaaagaagcagcggcaaaggccgaggccgagcagaggcgccaggtagaagaggcgaaaaagcgcggcgagactgtgaaaccggcagaaaaggtcacagaaccgcagccggaatataaggtgcgcaccacgaagaacgtttccatcaagacggttgccaagactgcatcgtggcggctggagagcaaggaggatgttgataaataccttgccgcattgcgtgaaaacctgctgaaagagatggacgaagatacaattgtcaacattgaactataa

SEQ ID NO: 585 - DNA, 3690 bp, Vibrio cholerae; identical to SEQ ID NO: 123

SEQ ID NO: 586 - DNA, 3669 bp, Eubacterium saburreum
atggaggaaactgttatgcagatcaaggacatgttccgaaagaaaattgaccgtgaaatacagggtgttatcattgtcggtcagggtgaagaaacgaatgtggcgcaggagctggaagagtatgttgtgacccgtgagcttcagcgtcattttgcagatttctttgcagcatataaaaaaggtattcagggaaccacaccgaaaatgggcgtctggatttccggcttctttggaagtggtaaatctcatttcctgaaaattctgtcctatctgcttcagaataaacaggtcggagacaaacatgccattgactacttcattgaggatcagaagattaccaatcagatggtgctggcagatatgcagttggcagcaaacaccccatcggacataattcttttcaacattgattccaaaagcgattccaatggcaaggaaaacaaagatgccattgtgaacgtgttcctgaaggtattcaatgagatgcagggcttctgcggttccatgccgcaccttgccgacctggagcgcaggctttccgaggaaggtcgttttgaagagtttaaggaaaagtttgaagaagagcatggcgatccgtgggaaagctctcgtcaggacttcgatttcattcaggattccgttgtcgatgttctttctgacatggatttcatgagcgaatcagctgcccgtaactggtgtgagaaagcaactgagggctaccagatcagcattgaggattttgccaagcgtgtgaaatcctatattgataaaaaaggtaacaaccaccatgttgttttccttgtggatgagatcggtcagtacattggtgatgattccaagctgatgctgaaccttcagacagtgacggaagaactgggcaaggaatgcatgggtaaggcttgggtaatcgtaacgagccagcaggatatcgactccattaccaaagtgaagggtaacgacttctccaagattcagggacgtttcgatacccgtctttctttgtcctctgccaatgtggacgctgttatcaaaaagcgtattctggataagactgagaccgcagcacagagcctgcgtctgctctatgaccagaaagcaaccatcatcaaaaatctgattgtcttcaacgacggtgtggagaaaaaactgtacgccaatgcggaagattttgcagaggtttacccgtttgttccctaccagtttaatttgcttgccagcgtgctgaccagcattcgtacccacggtgcatccggtaagcacctgtccgagggtgagcgttccatgctggcgctgttcaaagagtctgccatgcagctgatggacgatgagatgggggcaatcgtgccgttctatcggttctatgatgctttggagaacttcctcgaccacagccacagcagcgtgatcattcgtgcttatgacaacagctacatcaacccggaaaagaaggaaaaagatgtctttgcgatcaatgtgttgaagacccttttcctgattaaatatgttctggagatcgaagccagcgtggacaacatcgtcagcctgatgattaccagcattgacgatgatcgcatctctttgaaagcacaggtggaagatgcactgaaagtgctgatgcgccagatgctgatccagaagaatggctccatctatgtattcctgaccgatgaggaacaggaaatcaacaacgaaatcgaaaaagaaaatgtggagatgccggaggtcatcacgaagattgcggagatgatctatgaggacattttctccagcaagaagtatcattaccccagctttggtggacgatatgcgttctccttcaatcagacagtggatgaccgcccctataaggcaaaccagaattacgatatcggcctccgtgtgttgaccccgtggtatgagggcggcaccgatgatggtacgctgtgcctgctctccggccagggcaaggaagtccttgtggttctgccgaatgatgatgcgttcctgacggaaatgcgggcatacttgaaaattgagcggttcctgcgcaagaatacttctgtgcagcttgccaagtatgagaccattaaggaagcaaagcgcgtggagatgcgggaacgcaacggtaacgccaagctttacctgacggaagctctgaaagaggctaccatctatgtcaatggcgatgtgctgcacacttccggtaaggaagtgaccagccgtatcaacgaggctatcggccgactggtgcagacggtttaccacaagctgtcctacattgacgcagcgatgggcgaagcagacatccggaagatgttcaagaccagcaaccagctgtcgctggcactgggagataccggagaatccaatgtccacgcattggatgatgtgctgcaatttgtggcaagcaattcccggatgcacatgaaaacttctatgaaaaccatcaaggatcgctttatgaaagcaccctatggctttgtggaagatgacatccattggttggtggcacggctctttaagcgtggagatctgtcctttgcggtcagcggtgagagcgtcaatctgaacaaccgttccgaagaagaaatcatcggatacatcacaaagaagcagtttgtggataaactgctgacggaagtgcgcgtccgtgtgccggaaaaccagaaaaaggccgttcgcaccgtgatgaaagagctgttcaagatgacgccgcctgccgatgacgaagataccatcatgaagaacttccagcactattgtgagaatcggatcaccgagatcgagcggctggaaccgaaatatgagaattatgcctatcccggaaaagaacttctggaaaagggcaagaagcggattttcgccctggtgcagattcaggcaccgctggaattctttaagaccgtatttgacgagcaggacgatctgatggattttggcgaggactatgagcctatcctcaatttttttgacagtgaacagctgcccatcttcacccgtgcgttggatatgctgaatatctacgaagacagtaagacctacatcgtggatgcggaactggaagatgtggtggccaaaatgcgcaccatcgtccggatggcgaagccctacaaggaaattccgaagctaccggaactgcgcgaaaagtttatgaactgctatatgcgtattctggaagagcaggcagagccggtcaaggattccataggtcaggatcggaaccgtgtctttgaagtgctgaacaccaagccttataaggatacaaagttcaaccgctatctggagctgtttaaggagattatggacggtgcagagaactgcaacaatgtctctacgctgcgtagttttgcagataaggcggaggccttgaaactgcgactgctcaatgagatgacggcagaagataaccgccttgcaaaagaagcagcggcaaaggccgaagcagagcagaggcgccaggaagaagaggcgaaaaaacgcggcgagaccgtgaaaccggcagaaaaggtcgcggaaccgcagccggtatataaggtgcgcaccacgaagaatgtttccatcaaaacggttgccaagactgcatcgtggcgactggagagcaaggatgatgttgataaataccttgctgcattgcgtgaaaacctgctgaaagagatggacgaagatacaatcgtcaacattgaactataa

SEQ ID NO: 587 - DNA, 3654 bp, Lachnospiraceae bacterium
atgcagattaaggatatgttccgaaagaaaattgaccgcgagatacagggtgttatcattgtcggccagggtgaagaaacgaatgtggcgcaggaactggaagagtatgttgtgacccgtgagcttcagcgtcatttcgcggatttttttgcggcatataaaaaaggaattcaggggaccacaccaaaaatgggagtctggatttccggtttctttggaagcggtaaatctcatttcctgaaaattttgtcctatctgcttcagaataaacaagtcggagaccgacatgccatcgactactttatcgccgatcggaagattagcgaccagatggtgctggcagatatgcaactggcagcaaatacgctatcggatgtcattcttttcaacattgattccaaaagcgattcgaacggtaaggaaaacaaagatgccattgtgaatgtgtttctgaaggttttcaatgagatgcagggcttctgcggttccatgccgcaccttgccgatctggagcgcagactttccgaggaaggtcgttttgaggagtttcgggaaaagtttgaagaagagtacggcaatccgtgggaaagctctcgtcaggacttcgatttcattcaggattccgttgtcgatgtcctttctgacatgaacttcatgagcgaatcggtggcccgcaactggtgcgagaaagcaactgagagctaccggatcagcattgaagatttcgccaagcgtgtaaagtcctatattgagaaaaaaggcaacaaccaccatgtggtattccttgtggatgaaatcgggcagtacatcggtgacgattccaagctgatgctgaacctccagacagtgacagaagagctggggaaggagtgcatggggaaagcttgggtaatcgtgacaagccagcaggacatcgactccgttaccaaggtgaagggcaacgatttctccaagattcaggggcgcttcgacacacgcctctccctgtcctctgccaatgtagatgccgtgatcaaaaagcgtattctggataagacagagacagcggcacagagtttgcgtctgctctatgaccagaaagcaaccgtcatcaaaaatctgattgtttttaacgacggtgtggagaaaaaactgtacgccaatgcggaggattttgcggaggtttatccgtttgttccctaccagtttaatttgctggcaagtgtgctgaccagcatccgcacccacggggcctccgggaagcatctgtccgagggcgagcgttccatgctggcgctgttcaaggagtcagccatgcagctgatggattcggagacgggcgccatcgtgccgttctatcggttttatgatgctttggaaaacttccttgaccacagccacagcagtgtgattatccgcgcctatgataatagcttcgtcaacccggaaagaaaggaaaaggatgtctttgcaatcaacgtgttaaagaccctgttcctgattaaatatgttccggagattcaggccaatgtggataatatcacaagcctgatgattgccggcattgacgatgaccgcatctccctgaaggcacaggtggaggatgcactgaaggtgctgatgcgccagatgctgattcagaagaacggctccgtctatgtattcctgaccgatgaggaacaggaaatcaacaatgaaatcgaaaaagaaaacgtggagatgccggaggtcatcacgaagattgcggagatgatctatgaggatattttctccgggaagaagtatcagtatccaagttttggcggacggtatgcattctccttcaaccagacagtagatgaccgtccttataaggcaaaccagagttacgacatcggcctccgcgtgttgaccccgtggtatgaaggcggcacagatgacggtacactgcgactgctctccggtcagggcaaagaagtcctcgtggttctgccgaacgatgatgcgttcctgacggaaatgcgggcatacctaaaaattgagcgcttcctgcgaaagaatacttccgtgcagcttgccaagtatgagaccattaaagaagcgaagcgcgtggagatgcgggagcggaacggcaacgccaagctttacctgacggaagcgctgaaagaggctaccatctatgtcaacggagatgtattgcacacctccgctaaggaagtgaccggtcgcatcaatgaggcaatcggaagattggtgcagacggtttatcacaagctgtcctatattgatgcagcgatgggcgaggcagacattcggaagctgttcaagaccggcaatcaaatgtcgctgacactgggaaatgccggagaacccaatgtccatgcactggatgatgtgctgcaattcgtggcaggcaattcccgggtacacatgaagacttctatgaagaccatcaaggaccgctttatgaaagcaccctatggctttgtggaagatgacatccattggctggtggcacggctctttcagcgtggcgatctgtcctttaccgtcagcggagaaagtgtaaatcggaataaccgctccgaagaggaaatcatcggctacatcacaaagaagcagttcgtggataaactgctgacggaagtgcgcatccgtgtgccggaaaaccggaaaaaggccgtccgcaccgtgatgaaagagttgttcagggagacagcgtccgccgatgacgaagataccgttatgaaacggtttcagcatgactgcgagaagcgaatctccgagattgtgccgctggaagcgaaatacgagaattatgcttatcccggaaaagaaattctgaaaaacggtaaaaaacggctctccgcactgatgcggatacaggcaccgttggaatttttcaagaccgtctttgacgagcaggacgagctgatggattttggcgaggactatgagccggtccgcaatttcttcgacggcgagcaattgcccatcttcacgcgtgtactggatatgctgaacatttacgaagacagtaagacttacatcgtggatgcagagctggaagatgtcgtggcaaagatgcgcaccatcgtccggatggcaaagccctatcaggagattccgaagctgccggaactgctcgagcagtttacatactgctacaatcgcatcctggataacaaggcagagccggtgaaggattccattcaccaggatcaaagcagagtgtttgaagtgttgaacaccaagccctataaggatgcaaaaatcaaccgctatctggaactgttcggggagattatggacggcgcggagcggtgcaacaatgtctctacactccgcagctttgcggataaggcagaggccttaaaactgcgactgctcgatgagatgacggcagaagataaccgccttgctgcggaagcggcggcaaaggccgaagcagagcagagacgccgggaggaagaggcgaaaaagcgcggggagaccgtgaaaccggcggaaaaggtcgcggaaccgcaaccggaatacaaggtgcgcaccacgaaaaacatctctatcaagacagttgccaggacagcgtcatggcgactggagagcagggaggacattgataaatacctgtctgtcttgcgtgaaaatctgctgaaagagatggatgaggataccatcataaacattgaactgtaa

SEQ ID NO: 588 - DNA, 3543 bp, Lachnospiraceae bacterium
gtgattattcgcgatatgttttatgatgacattaaccgcaaggtaaatggcgtcatcaaggttgaccaggacgagaccggtgttatcagtcaggaagtccgtgaatatgtcatcacgaaagagctgaagaagcacttcatctcatttttcaattactatggagattctttcactacgcccacttcggatatgggtgtctggatttccggcttctttggaagcggtaaatctcacttcctgaagatgctcagctacctgcttgaaaacaaagaaattgacagtgtgaagacagtcgagcgtttccgcgagaaatttgcggatgaccccgccaccttcatgcttatcgataatgcaacccgatatgagacagagacgatcctgttcaatattgatattgagggttccatcaacaaagacaagacggcagtgctgcgtgttttcgccaagatgttctataaccatctgggattctacggcgagaatttgaaagttgcaatgcttgaaaaatatatagaccaaagcggcaagactgaggagttccgccgcatatttgaagagaagaaaggcaagccgtgggttgagcaacgcaaggcatttgctttcaacggcaagttcatcgtaccgacactgatggaagttctcggtatgtctgaggcagatgcacagaactggttcagcgacaagtctgctgttgatttctccatcgcgcagttagtggatgatatcaaggcatatatcgccagcaagccgaaaaactttcgccttctgtttatggtagacgaagccggccagtatgtaggcacggatacagatatgctccttaatctccagtctctgaccgagaagatcggcagcgagtgcggaagctccgtgtgggtgatttgcaccggacaggaggccatcgacgaaatcatcaaggttcgcgcggatgagttctcccgtatccaggcacgtttcaagacccgtctgtctcttacctcgtcttccgtggatgaagtcatccagaagcgtatcctgaagaagaagccggaggttactccgaagctggaagcactgtacaacgaaaatgattccgtactgagaaacctcttcagctttacggattccattctggatattaagggattcagtggttcacaggaatttgcagaggactatccttttgtgccatatcagttcatcatcatgcagaaggtgttcggagaaatccgtaaacacggcagtgttggaaaacacttctccggtggtgagcgttctatgctctcaggtttccaggaagcagcgcagaaggttcagaaccacgatgagtatacgctggttccgttcttccatttctatgacacggtgcacagcttccttgatggttctattcgtcgcgtaatcgagcgctgccagaaagcagcagaaagcggcgcaggcattgaagcctacgacgtgggtgtgcttaagctcctgtaccttatccgctatgtggatgacatcaagtctaatctggacaatatcgtgatcctgatggcagacgatatccgcacggataaaatcacgctacgcgagttcgtcagaaagtcacttgatcgactgctcagccagaactatatcggtcgcaccggagacacttataatttcctgaccgacgaggaacaggatgttcagcgtgaaatcaaaaatacgcctgtcgatactgctgctattgtggagcgtattgcgcaaatcgtatatggtgatatctacacttctaagaaattccgctacggtaagtacgatttctcctttgaccagatggttgacggagtgacggtcggtgctgtgaccggaggcatgaagctgcgtttcctgacagtggcgacggatgccattgaaaagagcgatatgcgtctgatgacggaatcttctggtcaggccattgttgttctcggcgataccccatactacgagtctctggaaaatgccatgaagattcgtaagtatgtcaagcaacgcaatgtagcccaactgccaaaatctgttcaggacatcatccgcgaccagcaggacgaggctaatgcctatgacctgacggcaatggatgcactccgcaaggcaatcgaaagcgcagaattcttcgtggacggtgagcgcctgacatttaagggcggcgatgctaagagcaagattgagcaggctcttgagtatctcgttgctcatgtgtacagcgaactggatctgattacacagaatgccgaaagtgatgaggatatcgttcggattcttaccggaggcggacagcagcgtttggacggaatgcgccataatcagtctgccgcggcaagggtagaagaatatctggagatgcaggcgaagaagatactgccgacatccatggcagatatccagtcccgttatcaggcgattccctacggctggcgcgaaattgatgtcgctgctgtgattgccatgctgatctacgaccagaaggttacggtcaagtatgccggcaacaccattcagccacgcgactcgaaacttccggatatgctgcgcaaaaagagtgaaatcggcaagacaatggtttcccaacgccagagcgtgacagtagcaaatttgaaagaagcgaaggagttccttcgtgattactttgatgtcatgaatgtgccggacgatgaggacggcatgattgactttatcatcaataaattcaccgagcagaagactcattacgaagacctgctgaagggctatgagggcaagaagtatcccgataaggctcttgtgcaggatgccgtcggcctcatgaaagatgtgctttctcagcgcaaggacaatgttgcgctcgtgtctgctgtcatcaagaaggaaaatgccctttacgataacaaggatgctatgcagaatgttgaagcattttttaagagccaggtacaggtattcgatgcagcaagcaagatgcttactgatttgcagaacgaattggactacctctcccacgaggaagaagctaacagggcactcaaccgtatccgcctgctcgttatggtgcagaccaagtttaattataagtgcatcccggagctgaacactctgatggcaactgtccgcgagggccataaccgtcttctcgccacaaagcgtgaggagctgttggaaattgtccgccagtgcttagaggcaatccacacagctgcgggcgataatgttgccgcaagagatatcagcgctgcggcagataccttctatactgagaaacagcagcgcatcaacgaattggaaagtttggcacttttagacggcttgattccaccgatgctgcagcagcagaacaccacttgcagccgtattgaggcacttaccaaaccggcgccgaagccggtaactcctccccataccggtggcgttgcggaaacgccgaagccgtatgccaagaaaatcatcaagacatataaccgtcagatcgtcttcccgacgaagcgtttggaaacagaagccgatgtggatgcctatgtggagatggtgcgcggtcaactcaagacacttatgaagaactgcgatggaattgaactgaaataa

SEQ ID NO: 589 - DNA, 3642 bp, Salmonella enterica; identical to SEQ ID NO: 8

SEQ ID NO: 590 - DNA, 4350 bp, Saccharomonospora glauca
atgtccgacggtcggaggccgacaccgaagccagctccgccgcctccgaagcagcggtggttccaggagcggacgtctccgtatccgtgggagcaggacggcctggaccacatccgtaggttgatgccgcaggcggagccgtatcgcgcgtgggccactttctcgttcaccgcggcctccggccgggtcaacgagtgtgacctgctgatcgcggttcccggtgggctctacctggtggagctcaagggccacaccgggcgcgtggtgaacaacggagacacctggattttctacgacgagggtgcgaggcgcccgcgcacgctgcgcaacccgctgcatctcaccgacctgaagtgcaaggagctcaagcagcgcctggagtgggcggccaagcagaaccactacaccggccggattccgcgcatcgaacccgcgatcttcctgtccgcaccggggctgacctcggagctcgacgaggtgcagcgcacccgcgtctacggccgtgacgggcaggtcgacgggctggactggatctggcgtgacctgctgtcgcgcccgccgcagcgggagcaccagcggatcagcccggagttctcccgccacgtgctgccgaagctgctggagaagatcggcatccgggcgtcgacggcgcatctgcggttcggcgacgactgggagctctccggtgaggtgctggacgcgggcccgacgtgggaggaccgtctcgcgttccgcacgggcctcgtgcgtgaggaaggccgggtccgcatctacctcaccgagcagcaggccgccgaagagcggcggcagtcggtggagcgggccgcgcggcgcgagtaccaggtgttgcagggcatcacccaccgcggcatcgcgcaggccgtgcagatccgggagcatcagagcggtcccgcgatcctcttccgccacagctcgtcggacctgcggctggactcctacctcgacgtgcacggcgagcggctgagtatcgacacgcggctcgacctggtgcgccagctcgccgaggcggtgcagtacgcgcaccaccgctcgctctaccaccgtgccctgtcggcgcgttcggtgtgggtgtcggcgaaggacgacgggtccgacccggtgttgcggatcaccgactggcaggccgccgcccgtgacttcgacacgacgtcgctgtcgacggtgggcaagacctcgttgacgggtgagcacctggcgggctcggcggaggtgtatctggcgccggagttcgccccgcatgccgacccggtggatctcgacgtgttcggtctgggcgcggtgtcgtttctgatcctgacggggcagccacccgccacgcagcgcagcggcctgatcgagtggctggccgacagccacggcctgcacccctacgccgtgtcggacggcatctccgacgccctcgacgcgctggtcttcgacgcgacccgcacggagctgtcgcagcgactggagtcggcggacgccttcctgaagcggttggacgcggcggagtgggagtcgctgcccgagtcgtcggtgcccgtggtggatccgctcacggtgtcggcgggccagatggtggacgagcggtggcgggtcgagcgggtgctcggcaccggtgccacggcgcgggcgttgctggtgcggagggtggacaccgacgacgagcagcccgagcgccgggtgttgaaggtggcgctcgacgacgacaaggcgcagcacctgcacgccgaggcccgggccctggcgctggcgggcggcggcgtggtggtgcaattgctcgacggcccccgcgaggtgggtggccgcaccgtgctcgaccttgagtacgcgggtgggcaggatccgcagggctacacgctcggcgagcacctgcgcgccgagggcaggctcagctaccacaacctggagcgttacggccgcgacctgttcatcgcgttggaccagctcgcgggtaagggtgtgcggcaccgggatctgaagccggacaacttcggcatctatcgcagggccgaccgctcgacacagttgatgttgttcgacttctcgctggccgacgtctcggagcgcgacgtcacggcgggcacccgcgggtatctggatccgttcctcggcacgaaccgccgtcccgcctacgatgatcacgccgagcgttacgcggcggcggtgacactgcacgagatggcgtccgggcagcggccggtgtggggcgacggggtgagcgatccccgcaccaccaccgacgagactccggtgctggcggcggagttgttcgaaccggcgttgcgcgatgggttgacggcgttcttccggcgtgcgctgcaccgggacgtcaaccgccggttcgacacggtgcggcagatggaggacgcctggcgggaggtgttcaccgccgcggacaccgcccagccgctcaccacgcccgacacggtgggtgtcgagggcgagacgctggaggccacccgcgacgcgcatgccgagcgggccaccctggacacgcagctcgacgtgtccgggttgagtccgcgtgcggcgtcgttggcgcagtcgttcggggtgacgacggtgcgggagctgctggagcaggtgcgcccgtacgagatcagccgggcgcggggcgcggggaaggtggtgcgcaacgagctgaaccgccgtcacaagcagtggacgcgggcgctgttgcagccctccgaacccgaccgtccggagccggagtcgccatccggccgatccactgtggacgaactggtcgccgtgttgttgcctccgaggggcaggcggggttcgcgtaaggcggatgtcgtgcggttgacgctcgggttgccggcgggggagggcgaacagccgcctccgccgtggccgacgcagaccgaggtggctcggcggctgggtatcacgcagggcccggtgtcgcagcactatcgcgcggcggtgaaggcgtgggcggccgagccgcggttgtcggcggtgcgggacgagctggtggagctggtcgccgaggcgggccgggtgatgccggcgcacgagctggctgccacggttcgggcccggtacggcgtcgcggagcgggacacccgggaacacgcgcttgctcaggcgttggcggtggtgcgcgcggcggtggacaccgaggcgtgggagcggcagcagagcgaggacgaggacggtccacggttttcggcgttgcggcgcggcgagcacgtgttgatcgcgctggagtcgttgccgggcacggacgcgccgagtgctccggagctggccgactacgccgtcgcgctgggggcgcgggccgacgagctggtggagctggacccgctgccgggtcgtggtgtggtggtgcgggagttgcgggcggtgccggccccggaggggttgccgtcgcaggcggacacccggctggtggagctggcggcggtgatgtcgcggcacgcggcggcgtcggcgcgttcggagctgtatccgagggagctggatctggtgcgggcgctgcgcatgtcgcaggcggccgtgggggtgcggcgggatgcggggatcacgctcggggatctgctggcgaaggtgcgggcgcggttcccgtccgtggcggtggacgagaacatcacgtatgtgcggctggaggaggcgctgcgcgaggcgggcaccccgctggagtgggacatcgaggcgcagcggttccggcctccggcgccggagttctcccggttggcggcgtcgtcgagtctgacgcgtggcggtcccggcccccgctggtccggtggtctggacccgcaggacgtgctgcacgacaagctcaccagggcggtggagtacggcgggttcgtggcgttgacgttgtggggcgcgaacctgccgggggcggccgagtcgctggcggcgcggtatgcggtgcgggcggtgcacgtggacggcgagttcctggcggcgttccgggagttggtcgccgaacacggccaggactgggagctggtgcggaagctggatgagcggttcgggcggacgggccggccgaagccgggtttccgccgttacgtgcagcaggcgtgggagcggctgcgggaccgcctggaggcgtcgtccgacggcgagcgcacggtgttgttgctgcaccacgcgggcctggtgggccgctacgccgacctgggtgggcgcgagttcctgacgggcttgcagcaggcggcccggtcggcgcgggcgtggccgcatggtttgtgggtgttgtgtccgggtgagtcgaagcgggaggcgccgcagctcgacggtctccgggtggaggcgttgacggaggcggagcgggtggtgctggaccgggagttcctgcacggtcctcggggggctgatcgggcgagttga

SEQ ID NO: 591 - DNA, 4140 bp, Rhodococcus triatomae
gtgacaacgggcggtgacgtggcgcaaggcagtggctcgaatcggcagggcgaccgatgggtcgaggtctcgaagtcggcgttcaaccacgaagccgagggcctgagcttcctccaggacatcgtccccaacgcctccccttatcgtgcgtggacgaatttcgagttcatggacaaccacggcatgtggcacgaggtcgatgccctggttctgggccgccgccgtctgcatctgatcgagctgaagcacttcgtgggccgcctgggcggtacggagacgaactgggtgcggcatctgccgagcggcaaggtccgcacgcaacgctccccactccttttgacgcgccgtaaggcgcagcgattggcgacgcgcatcgaggaggaggcgcggaaggttgcgatcgagaacggactgaatccggagaaggtccgccgggcgttgccgttcgtgcaggagtcggtcttcctgcacgccgagggtttctcggtcgagatgtcggaagtcgcgaagtcgggtctgttcggcctggacggcgaggagcatcgctcgaacctgccgggcatctccacgcgcatcctggagtcgccgacggacggtcgccgggtcgacgaagacatcagcgtcatcgtcgcgctggcgctgaagaacctcggggtgtcacgccgcaccgagcgcgacgccggctcatggaccatctcgggtgccccgctggcgtcgggtgacgactggcaggagtggccggcgaagcacaagggcacagacgagccggcccgtgcccgcatcgtgtcgttccgcccaggcacgcccgtgcatgcgcgggcggcggcgcaccggaagatgggccgcgagtacacgctgctgtcatcgctgcggcacgaggcgatcgtcgccccccgcgacctggtgcaggacgacgacggcaacaccgtcctcgtctacccggagaccccgggctacgagcccctcgatctggcgttggcgacgcgcaccctcaccgcggagcagcagctgacggtgttgacgtcgatcgcggaggcgttggcgtatgcgcaccgcaaccacgtcgcgcaccgcgggctcgggccgtcgacggtcctgatccacaccgaacgcctcgatgcgggccgggtggatgtgcggttggtggactggtcgtgggcgggacgcatccacgacggcggcaccaagtcggcgacgatgctcggcaccgcgctgacggcgacgggcggcgcagcggcggacgaggtgtaccaggcgccggaggaccgctgggcgcccgattcggaccgcatcgcgctggacgtgttctccctgggtgcgttggcgtacttcctgctgtcgggtggacagaacccggcgcgcgaccgggccgcgctgctggagcggctgcggctggagcagggcctcgatttggcggcgtcgacgggccggttcgtcgacgagcagctgcgtgagctggtgctgcggaccacgagcccgtcggtgtcgaaacgggtggcggtcgacgcgaagtccggtcgaccgacgttcggtgcccagcacttcgcggcagcgctcgacgactaccgccgcgcacaggaaccggccgccgctgcaccggagatcgatccgctgaacccgccgaccggcgcactcctcgacgaccggttcgaggtactgcaggttctcggatcggggtcgacggcccgcggcatcctcgtcgccgaccacgacgccgacggccggcagcgcgtcctcaaggtcggcctcgacgacacggcggcgcaccgcctgcagaacgaggcggaggtactgacgactctcgcgcaacagcagccgccggtgcccggcgtggtggagctgatcgagggcccgctgcagttggcgcagcggacggcgctgctgctcagcaactgcggcgagcagaccctcgccgacgtggtccgctacaccccgctcggggaggcgcagctcaagacgtggggcctcggcctgctggacgccgtcgtcgcattggacgcggccggcatcacacaccgcgacatcaaaccgtcgaacctgggcctgtcccggccgacgggtaagcgcaacgagaagccgaagctcgccctgttcgacttctccctgtcccgcgcggccgtcgagcagaccgacgcgggcactcccccgtatcgggatccgttcctcggcaccggcatccgcaccgcctacgactctgccgcggaacgctattcggcggcggtggtgctgtacgagatggcgacggccagcaccccgctgtacggcgacggggtgagcgatccccgagtgctcgcggacgacgtgtcggtgtcggcggaggatttcggcgggcactcccgcacccgcgcggaagccctcaccacgttcttccggtcagcgctggcccgcaacgtgaaggaccgcttcgacacggccgccgcgatgcgcgcggcgtgggcggcggtgttcgcggcgaaggcaaccgaaccggaacccgtcgtgcagccaccggcacccacccccaccgagccgacacccccgccggttgtcgtggccgaacccgccacctaccggtcgctgcgggtgctgtcggcggagttcgcgcgggcggcggcgacgaagccgtcggcgatccgccggcaggtggtggagctgctgctcggcagccatcccgactcccctgccgacccgttcgtcacctaccaggtgctggcaccgttggcgggggtgacgccgggccgggtcgcgcagatcttcggtgagatgcgggacctgtggtcgaagaacccgcagttggcggcaacagtggacctgttgttccagcgcggcatcacactgctcgaatcgacgggcggcgcaagcactcccgaggtgctggcccgcgagctggcggcgtctctggacaccgatggtgtgcccgatccgcagcgcaccgcgctcggcgtgctgcgcctggtgttgacgtcggcggccgagccggagccgggcagcgaggacgacgacccccggccgctgctgacgcgccgtcagtccacgggctccgtggcaatgatcgccacgaatgctgtgtcccgccgtttgccggccgtgctggcacgtgaggtcgacggcctcgtcgccgcggcggaagaccaggggttggcgttggtgacggcggagcacgccgagcagccgttgcgcgccgctgcagccgccgcgttggacgtggcaccggaggaggtggagatccccggctacgtgttgctgcggatcgccgccgggtcgtcggtgcaggtggcgttgtcggcgcgagacgaactgcattctgtcggtctcccgatccgggacgtgttggcgctgctactgcaggggctatcgacatcggacgcgttcggccggccggagctggaatcgcgtgtcgcggcccggttccctgcactggcgaaatcgctgccccgccgccccgacctcgacgccctcgtcgcgtctgtggcgccggggatggcgtggagcgacgcccggaaccgatacgagttcgaggacgcaccgcagcggctgtcgcacgtgccgacgcggcataccctcgccggatcccccgccgccgcgggccagaagggcagcgacgtggagttgctgctgcacgcgagcgcgcgggagcgcacgttccgcgccttgggcgtgccgatgggcgcctccgaccaggtggcggacgcactggtggagcgattcggcgcggtccgcgtcgacgtcacggatgtgttgttgggtgagttgcggtcgaaggccgcgcaggccggcatcccgtgggatgcgatcctcgccgccgattccggtgcggccgccgaccgcgagggcttgaaggggtttgtcgcgcagtccatcccggccgtcgtcgacgcggtgaacgcggcaggtggtccggtcgtgttgacggacctgtcgacgctggccgcgtacgggcagttgggtgcgctgcaggcgtgggtggatgtgacgaatccgccgccgcatgcggtgtgggcgttgatccctcagccggaggagtcgggtggccggcctggcgcccgcgtcgacgggacggcgctgccgcgcaccaccccggagcagttcgtgcaggtggaccggttcggtttgcgggcactcgtttccactgatgatcgatcgatgaaggagcatgtctga

SEQ ID NO: 592 - DNA, 4350 bp, Saccharomonospora cyanea
atgtccgacggccggaggccgacaccgaagccagctccgccgcctccgaagcagcggtggttccaggagcggacgtctccgtatccgtgggagcaggacggcctggaccacatccgtaggttgatgccgcaggcggagccgtatcgcgcgtgggccactttctcgttcaccgcggcctccggccgggtcaacgagtgtgacctgctgatcgcggttcccggtgggctctacctggtggagctcaagggccacaccgggcgcgtggtgaacaacggagacacctggattttctacgacgagggtgcgaggcgcccgcgcacgctgcgcaacccgctgcatctcaccgacctgaagtgcaaggagctcaagcagcgcctggagtgggcggccaagcagaaccactacaccggccggattccgcgcatcgaacccgcgatcttcctgtccgcaccggggctgacctcggagctcgacgaggtgcagcgcacccgcgtctacggccgtgacgggcaggtcgacggtctggactggatctggcgtgacctgctgtcgcgcccgccgcagcgggagcaccagcggatcagcccggagttctcccgccacgtgctgccgaagctgctggagaagatcggcatccgggcgtcgacggcgcatctgcggttcggcgacgactgggagctctccggtgaggtgctggacgcgggcccgacgtgggaggaccgcctcgcgttccgcacgggcctcgtgcgtgaggaaggccgggtccgcatctacctcaccgagcagcaggccgccgaagagcggcggcagtcggtggagcgggccgcgcggcgcgagtaccaggtgttgcagggcatcacccaccgcggcatcgcgcaggccgtgcagatccgggagcatcagagcggtcccgcgatcctcttccgccacagctcgtcggacctgcggctggactcctacctcgacgtgcacggcgagcggctgagtatcgacacgcggctcgacctggtgcgccagctcgccgaggcggtgcagtacgcgcaccaccgctcgctctaccaccgtgccctgtcggcgcgttcggtgtgggtgtcggcgaaggacgacgggtccgacccggtgttgcggatcaccgactggcaggccgccgcccgtgacttcgacacgacgtcgctgtcgacggtgggcaagacctcgttgacgggtgagcacctggcgggctcggcggaggtgtatctggcgccggagttcgccccgcacgccgacccggtggatctcgacgtgttcggtctgggcgcggtgtcgtttctgatcctgacggggcagccacccgccacgcagcgcagcggcctgatcgagtggctggccgacagccacggcctgcacccgtacgccgtgtcggacggcatctccgacgccctcgacgcgctggttttcgacgcgacccgcacggagctgtcgcagcgactggagtcggcggacgccttcctgaagcggttggacgcggcggagtgggagtcgctgcccgagtcgtccgtgcccgtggtggatccgctcacggtgtcggcgggccagatggtggacgagcggtggcgggtcgagcgggtgctcggcaccggtgccacggcgcgggcgttgctggtgcggagggtggacaccgacgacgagcagcccgagcgccgggtgttgaaggtggcgctcgacgacgacaaggcgcagcacctgcacgccgaggcccgggccttggcgctggcgggcggcggcgtggtggtgcaattgctcgacggcccccgcgaggtgggtggccgcaccgtgctcgatctggagtacgcgggcgggcaggacccgcagggctacacgctcggcgagcatctgcgcgccgagggcaggctcagctaccacaacctggagcgttacggccgcgacctgttcatcgcgttggaccagctcgcgggtaagggtgtgcggcaccgggatctgaagccggacaacttcggcatctaccgcagggccgaccgctcgacacagttgatgttgttcgacttctcgctggccgacgtctcggagcgcgacgtcacggcgggtacccgcgggtatctggatccgttcctcggcacgaaccgccgccccgcctacgacgatcacgccgagcgttacgcggcggcggtgacactgcacgagatggcgtccgggcagcggccggtgtggggcgacggggtgagcgatccccgcaccaccaccgacgagactccggtgctggcggcggagctgttcgaaccggcgttgcgcgatgggttgacggcgttcttccggcgcgcgctgcaccgggacgtcaaccgccggttcgacacggtgcggcagatggaggacgcctggcgggaggtgttcaccgcggcggacaccgcccagccgctcaccacgcccgacacggtgggtgtcgagggcgagacgctggaggccacccgcgacgcgcatgccgagcgggccaccctggacacgcagctcgacgtgtccgggttgagtccgcgtgcggcgtcgttggcgcagtcgttcggggtgacgacggtgcgggagctgctggagcaggtgcgcccgtacgagatcagccgggcgcggggcgcggggaaggtggtgcgcaacgagctgaaccgccgtcacaagcagtggacgcgggcgttgttgcagccctccgagcccgaccgcccggagccggactcgccatccggccgctccactgtggacgaactggtcgccgtgttgttgcctccgaggggcaggcggggttcgcgtaaggcggatgtcgtgcggttgacgctcgggttgccggcgggggagggcgaacagccgcctccgccgtggccgacgcagaccgaggtggctcggcggctgggtatcacgcagggcccggtgtcgcagcactaccgcgcggcggtgaaggcgtgggcggccgaaccgcggttgtcggcggtgcgcgacgagctggtggagctggtcgccgaggcgggccgcgtgatgccggcgcacgagctggctgccacggttcgggcccggtacggcgtcgcggagcgggacacccgggaacacgcgcttgctcaggcgttggcggtggtgcgcgcggcggtggacaccgaggcgtgggagcggcagcagagcgaggacgaggacggtccacggttctcggcgttgcggcgcggcgagcacgtgttgatcgcgctggagtcgttgccgggcacggacgcgccgagtgctccggagctggccgactacgccgtcgcgctgggggcgcgggccgacgagctggtggagctggacccgctgccgggtcgtggtgtggtggtgcgggagttgcgggcggtgccggccccggaggggttgccgtcgcaggcggacacccggctggtggagctggcggcggtgatgtcgcggcacgcggcggcgtcggcgcgttcggagctgtatccgagggagctggatctggtgcgggcgctgcgtatgtcgcaggcggccgtgggggtgcggcgggatgcggggatcacgctcgcggatctgctggcgaaggtgcgggcgcggttcccgtccgtggcggtggacgagaacatcacgtatgtgcggctggaggaggcgctgcgcgaggcgggcaccccgctggagtgggacatcgaggcgcagcggttccggcctccggcgccggagttctcccggttggcggcgtcgtcgagtctgacgcgtggcggtcccggcccccgctggtccggtggtctggacccgcaggacgtgctgcacgacaagctcaccagggcggtggagtacggcgggttcgtggcgttgacgttgtggggcgcgaacctgccgggggcggccgagtcgctggcggcgcggtatgcggtgcgggcggtgcacgtggacggcgagttcctggcggcgttccgggagttggtcgccgaacacggccaggactgggagctggtgcggaagctggatgagcggttcgggcggacggcccggccgaagccgggtttccgccgttacgtgcagcaggcgtgggagcggctgcgggaccgcctggaggcgtcgtccgacggcgagcgcacggtgttgttgctgcaccacgcgggcctggtgggccgctacgccgacctgggtgggcgcgagttcctgacgggcctgcagcaggcggcccggtcggcgcgggcgtggccgcacgggctgtgggtgctgtgcccgggcgagtcgaagcgggaggcgccgcagctcgacggcctccgggtggaggcgttgacggaggcggagcgggtggtgctggaccgggagttcctgcacggtcctcgggcggctgaccgggcgagttga

SEQ ID NO: 593 - DNA, 4167 bp, Gordonia polyisoprenivorans
gtggcggacgaccggtggatcgaggtgtccacgtcggcgttcgcccacgaaaccgagggtctgcgcctgctgcgtgagatcgtcccgagcgcttcgccgtaccgtgcgtggaccaacttcgagttcatggacaatcacggcggctggaatgagatcgacgccctgatcctgggccgccggcggttgcacatggtcgagctcaagagctggaacggcgtcctgagcggcaacgagaagaactggattctcaccggcagtaatcggcagagccgcacccagcggtcggcgctcctgaccactcgtcacaaggcccagaagctggcctcacgactcaaggacgaggtgcgcaaggtcgcacaggagcatcacctgaacgtcgacaaggtgatgcgccagttcccgttcatccaagaagaggtgtacttccacggcgatcgcttcgctgtgaatctctccgatctcgcgaagtccaacctcttcggtatcgacgggcgcgagagccagaccggcttacccgggatcgctgcacgcctgctggagccaccgaacgagggccgggacgtgtacggcgaggacatgagcgtcatcatcgccctcgctctacgcgaactcggtgcgacgcgacgtaccgagcgtgacgccggatcgtggacgctgaccggtgagaccctcgacagcggcgacgactggcaggacttcgatgtggtccacaaggtgaccggcgtgcacggtcgcgcgcggatcgtcaccactcgtcgcggtgcaccggcacaggctcgcgcagcggcccggcgccgcatccagcgggagtacgaactgatccggtcgttgcggcaggagtcgatcgttccgccgctggatctggccaccgacgacgacggcaacgccgttctcgtctacgagaagctcgacgacttcgcgccgttggatctggcgctgctcacgcgcacgctgaccgccgagcagcagctcgaggtcttgacacaggtggccgaggcactggcctacgcgcaccgcaaccaggtctccaaccgtggcctgtcgccgagcacggtcctgatcaacaccagctgcctcgatgattcgggcgcgatccagattcggctcgcggactggtcgtgggcaggccgaatccatgcgaccacgtccgcgtcacccactctggccggttcgcagatcgctggaaccaccagtgatgacgacgtctatcaggcacctgaggatcgctggtcgccgaccgcggaccggatggcggtcgacctgttctcgttgggggcactggcctacttcgtgctcagtggcgagccaccggcgcgcgatcgcaccgacctgcggacccgcctgcgcgcacagaacggtctcgacctcgcagccgtggacggccggttcgtcgacgaacgattgcgctcactcgtcctgcacgccacccgaccatcggtctccgaacgcgtcgacctcgacgccaagacccagcagccccgattcggcgcggccgagttccgctcggcgctgcaggaatacaagagcgatagcggcccggatcccgaggtgcgcacggaccctctgaacccccaacccgacgacgaactcgctgacggcaggttcatcgtgctcaaggtcctcggagcgggttccaccgctcgcggcatcctcgtggccgacaacgctgccgacggcgaacaccgcgtcctcaaggtgggcctcgacgactccaagacggcacggctgtacgaggaagccgaggtgttgaccgcgctgggagaactgactcccaaagtccccggcgtggtggaattactcgagccgcccctgcacatcggtggccgaaccgcgttgctgctcagcgactgcggcgaacaaaccctctccgacatcgtccggcacaccgcagtcagtgacgctcagctgaaactgtggggtacccaactcctcgacaccgtggtcgccctcgacgccgccgggatagcccaccgtgacatcaaaccgtcgaatctcgggctggccaagcacgcgtccgccggaaagaccaagcgccccaggacgtccctcgcactgttcgacttctcgctgtcgcgggccggcgtgacggagaccgaggccggcacaccgacctaccgcgatccgtttctgggcatgggtacaagaacagcgttcgattccgcggccgagcggtattcggccgcggtggtgctgtacgagatggccaccggcaccactccggtctacggcgatggccagtccgatccgacgtcgatcaccaatgacgtgaccatcgacgtcgagtcgttcatcgacgccggactcagccagacccgcgccgacgcgctggccgcgttcttccggacggcactcgctcgcgaggcacgtacccgtcacgacaccgcagcagcgatgcgcgatgcgtggcgagcggtgttcgacgcgcgcagcccggcaccgaccaccgatcccacgcccgtaaagcctcagggcgcgaaggcatatccggcacccgtgatcgtcatcgatgcgccggacgacgtctccatgcagccggcgttcacctcgctgccggagttcgtgagcgccctcaccgagctcgccggccgacgcccgtcggtgatgcggcgccaggtactcgagatgctgctcgggactcacgaggacgcacccgacgatccgttcgtcaccttcaacgaactcgcgctccgggtccacctcactccggcccggatctcgcagatcttcagcgagttcccggcactgctgtcgaccgacgatccggtccgcgcattcgtcaccgggcgcgtcaaggccaccgtcgacgacctctaccagcgagcgcagacgttgctgaccgcatccggcggcgcctccacgccagagctcatcgcccgagaactggtgggacagatgcagatcggtgatctgcacgacgtcgggcgcaccgcgttgggcgtactccggttcgtcctcgcctgcgcgcccaagccgactgtcgaggacaccaccgccgccgacgcccagccgaccggcatcgagatggtccgtcgccagggtgcgggaacggtggcgatgctggcgaccgccgcaatcgatcgccggttgccggcgatgcttgcgcgccgggccgagcgccttgtcgccgaagcacaggagcagggcaccacgctggtgccgtccaccgatgcggcacccgagctcaaagacgaggtggcggcagcgctgggcattgcgcagcagagcgaggtggagattcccccgcatgttctgctggcgattgcggtcacctcgtcaccggagctgggactctcctcgcggaatgagctgcattcggcgtcactgccggtggagtcagcgttgcgcgcagtgctgcaaggactctccgacaccgacactttcggccgagctgaactcgagactcgtctcctcgcccggttcccggcgctgcggggtgcgttgccgcggcgcccggcacttgacgcagtggtggccacggttgctcccggaatggtgtgggacgagcccagtgcccgttaccgattcccgagaacggacgagccgaagggttcgaccatcccgacctatcggacccgcacaccccaccccaacaaagtggtcggcccacgctcggacgttctcagtgcactgggtgctggtgagcgggggggcggtgagcgccggttccgcgcgctgggggttcccataggccacagcgacgcggtcgccgaagcattgagcgagcgttttgcggccacgcgtatcaacgtcaccgacgtcatcctcgacgcgatgcgcgcccgcgccgccgaggtcgggctggactggtcgatgatcctcgccgccgacgccggcgcgactgccgatcgcgagggcttgaaagggtttgtcgcccaatgtgctcccgcgatcatcgacgtggtggccgcagccaacggccccgtggttctcaccgatctgtcaaccctggcggcctacggtcagctcaacatcgtcagcgcctggaccgatctggctgcacctccgccgcactcggtgtgggcgatgatcccgcagccgcacacgaccggcggtgccgggccacttgtcgacggcgtggcgcttccactcaatagccccgaacagttcattccgctcaccgacgacgacgtcggagcgctgatcgcacccgccgacgccgccccgtaa

SEQ ID NO: 594 - DNA, 4359 bp, Amycolatopsis azurea
gtgacaccgggcgccaattcaggctcctcctcagtacgttggtatcagcgcaagcagtcggactatgcctgggaacaggagggcctcgacttcatcaagcgccagatgccggacgccgagccttaccgtgcctgggcaacgttctcgttcacagcggcctccagccgcagcaacgagtgtgacctgctgattgcagtcccctcaggcctctatctactcgagctcaaggcgcatcccggcagggtggtcaaccacggctcgacctggcggttcaccgaccggcacagcggacgagtccgtactctgccgaatccgcttgagatgaccaatctcaaagccaaggagctgcgaggacagctgactcgcgcggcacagaaagtcggctacaccggccgggttccgtggatcgaaccgatcgtgttcctgaccgatgccggacttcgcagcgaactggacgagttccaaacgccgaacgtctacgcacgccacgcgaacagcggcctccccactgtctgggacgacctcctcgcacgccctccgcaccgcgaggcggacaggatccgtccggagttcgcgtcacgcgtcttgccgcagctgatgacggccatcggcatcctgcccgccaccgcgcatctgcgctacggcgacttctggaagctcgacccgaaagcactcgacgccgggccattctgggaagataggctggtcaggcgcgacgacggccaactcgacgagcagggccgcctcaggatttatctgatcagctcgggcaccagcaaggccgacgccgaaaaggcccaccgggccgccaaacgtgagtaccaggtgctgcagggcatcgaccaccgaggcatcgcccaagcccgccagttcggagaacaccagggccggcctgcgattctgttccgacaccacgagtcggacctcaggcttgacgcatacctggcgacattcagcgactcactgacctcggaaacccgccttggtttggtccgccagcttgctgaagccctgaaatacgcccatgaccggatgctgtatcaccgtgctttgtcaccccggtcgatctacgtctcctgtcggccagacggctctagccctgtactccggctgatcgactggcaaacagcagcaagggacttcgagaccacgtcactgaggtccattggagattcatcgctggacggtgcgttcatcgaggacaccgccttgcggtatttggccccggaggccgaacatcagtatccggatccagtggagatggacgtcttcagcctcggttcggtgtcctacctggtgctgaccagtcgtccgcccgcctcgagccgttccgagctagtcgagcgggtaggcaccgacggaggccttcaggtctctgccgtggacgacaccttgcctcccgagatcggcgacctgatctacgacgctagccgctcggacgtcgtcctccgtctcgactcggcggcggcttttctcgaccggcttgacgacgcagaagaagacgccacgccgatgcctgccggaaggtcctttgtggacccgcttgaggcgatcgcagggcaggaggtggacgaggaatggttcgtacgccgtgttctcggcaccggggctaccgcgcgcgccctgcaggtcgagcggctcagggaaactgacgacggcgccgtcgtcgatgagcgagtcttcaaggtcgcgctggatgaggacagccgggccgcaagactgcatgacgaggcggaggccctccgcaaggtcacgggtggcacgattgttcagctgctggacggaccccgcctcatcggcggtcacaccgcgctggagctggaactcgccggtgaagtttcgctggcaaagcatctgcgcgaggagggcaggctcagctaccacgacctggaaaacttcggccgagagctaatcctggcgatgtaccagctcgaagccgccgagatccaccatcgcgacatcaagccggacaacctcggcatccaccgccgggcgaaccggtcgcgacagctgaagctgttcgacttctctctggccaaggcatctccgacggataccgtaggtacccgcggttatctcgacccgttcgtacacaccacgcggcgacaattctacgacgaccacgccgagcggtacgcggccgccgtcacgctgtacgagatggccaccggtgagcgtccactgtggggtgaaggcattaatgcgccgacagtcacccaggacgagacgccccaaatcgaagggcatttgttcgacgaccgacttcgagacggtcttactgcgtttttcaagcgggcactgcatcgagacaccgcacaccgcttcacatcgttgcgcgagatggacgacctttggcgctcggtattcactgaagccgacaaagcacgtcctgcgaccacacaggaaacggtgcggaacaccgcagccgaccggtctgacatcgaggtgctcgaccgcgcggcagaagccgccaagctgacaacaccgcttagcgcggctggcctcagccctcgggctgcttcggtggccgacggcctcggcgcaacgacggtcggcgagctgctggacatcccggcctcgacaatcacacgtgcccgaggggctggcgcgctcacacgtcgcgaattgaccaggcgacaccggcagtggagcgcaaagcttcgcacagacaccggagccgcggacgggccggattcggagaaactggctgtcccggtcgatgtcgagcgccagtctgtcgagctgctgctggaacgtctactgaccaagcccaagatcaacagtaaagacaaaggccccaacgtagagcgtctgacactagggctgccgagagtcgacgggtcggtcgccgacatcagtacttggcccgtgcaacgccttgtcgctgacgcagtgggactcacacaaccctcggtgtcgacgaagtacgtcagttccctcaggaagtggcagaccttcgactggatggacacaatccgccgcgaggtcgtggaggtcctcggcgaccttggtcgaatcgccaccgcgcccgaggtggcggctgagttcctcgcgaggcatggatcgaccgagaacgatccagtaatcgcgctgcgcaatgcttcggcgatcatccgggcagcggtggacaccgagctgcttctaccgggcaaggacgatctcgagaggtccgagccggcactggcggttctccggcgcaacgaccgcgtactcctggctgccgaatccctcgatggctccgacgacccaagccccagcgaattgggcgactacgcgatcgcactgggccaggcggccgacgggatctcgaaacgcgatccgctgcctagctcggcgacagccctgcgcgaccttcatgcagtcgaacggccggaggggatgtcaccactggccgacactcgccttctttccctggccgcttcgatgtccgcgcattcagccgcctcccgccgcctggaactctatccgctcgacctcggtctggtccgcggtttgcgcatctcgcaagccgcagctggggtaagcgacgacggaatcactctggatgcgcttctcgcgaaggtcagggtccgcttcccggagatctcgctgggaaccccctcaccgatcgacgttggcgaggccttgcgtgacgctggcagcagcctgacgttcgatccagtcaagaatcgcttctgcccaccgaggcctgcggaaagtctgcgaccggctcgatcatcttcacgcacgttgacttcgatcgaccatgctgcgctcaacactgggcgcagttcctcggagctgatcacagcaaggcttgtcgacggacacaggctgggtggattcctggctctcaaggtcaaggcgaagaacctgcccggcacggcaacactcgtcgcgtctgaacatgatgtggaggccgtcgaccttggtcggttattcctcaccgagctccgggcgctggtgaaggagcgcaaccaggggtgggaccgagttctggtcgccgacacccgcgttggtcgcgacggcacagtgccgccaggactagcgtcctacgtgtcggtgagctggcagcgcgttcagaaccggctcatggccaccatggctgaagctggaccgcgaagtgtgctgttcctgcataatgccggcctgatcggccggtatttcgacgccggcggccacagtttcctcaccgagctgcagcgtgcagctcgtgacccacaggcaacaccgcatggcctgtggctgctgtgccccatggagaccgccggagaagcacccagcctggcaagccagattgtcggtaccgaaggtgaccacgaggtcctgctcctgcgcagcaagtacctcgacgagctccacaagggcgaggtcgcctga

SEQ ID NO: 595 - DNA, 4182 bp, Marinobacter sp.
atggatatgctgtggaagcaaatcacccagtctgactacgcctgggaaatagaagcgctggaattcgctaagcagttgttaccagaccatgatccctatcgcgcctgggctaacttcgagtttattgccttagatggttccatcaatgaagtcgacctgatggtgctaacacccaaaggcatgtacctcatagagatcaaatcacacccgggcgttatccggggtgatgcgtctaactgggtatgggaaaagccaaagggtggccagaaaatctttgataaccccagattgctcacccggcgtaaagcgcagaagctggcgtcgctgctcaaggtgcaagcatctgttatacgtagtaaagaacgagtccccttcatagaagcactcgtgtttttgtcggcagaaaatctgaccatcaaactagatgataacgcacgccaaggcgtggtgaatcgtacagaacttcttccagaactcactcaggtcaacgaaagttggtcgcataagcaaattcctgtgtcttccgccagagtaatcaccagagcggttgaagaagctgggattaaagaatcactgcgcatgcgccgtgttggcagctacgaacttaagcaccttctgagcgaagccgataactttcaggagtggtatgcggttcactcggagctaggtgtcgagcgtaaagttcgaatctatctgacacagggcaaagctgaagccgatgtcaaaaggttggagaaagcggcgcagctggagttccgtttactcgagggaattgagcatcctggcattatgcgagccaaagactacctgcatcatgacagcgggcccgctctggtttacgaatacgacccaatggcttttcggcttgatcatctattaatgaatcttggccaaagccgccgcctggaaacaactcaggcgctctatttattacgtctgattgccgaagcggtgaagtacgcgcacggacagaagctctttcaccgtgggcttagccctcagagtgtgtgggtcaaacctttaggtgatgagaaatacgacgtaaaaatcagcaactgggcgaccgctgaacgggtgtacgagaatgaaactcgccacattaccgccatgagccatctaagccagtttgtgcaagaagatgcagggtgctacgcggcgttagaggcccacggccgggccgccgatggcgttcatctggacgttttttcgttgggcgcgattgcctatcatttgtttaccggcaaaaagcccgccgaaagtgacattgagctgctagacaagctgcgccatagcaaagggctgcaggtgaccgatgaaatcaacggtgcaagtgaaggcatgcagtacttggtgcagtacgccacacacccggatgttggcagccggttagagtctgtaacagattttttgcagcaccttgatgtgttggaagacgaaatcagccagcccgacaccttgcgcagtaataacccgaccgaagcccgcaaaggcgacaccttcgcaggtggctttacggtggttcggccccttggcaaaggcgcttgttcggtcgtttttcaggttcaatatcagggccaagaccgtgttctgaaaattgcagcaacgccagaccataacagccgtttgatcaaagaaggcaatgtgctggccaagcttcgtcatcagtcgatcgtggcttatcataaaacactggatattggcgggcacacagccctgctgctcgattatgccagcgagggaactctggctcagcggttgcgccacgttggagccgttcagttagagctgctggagcgttttggtgatgacttgctcagtgccatcgcgcacctggaggatcaggctctggtgcatcgtgatatcaagccggaaaatctcggacttgtcatgcagggcagcgccttgcatcttattttgtttgatttttcgctgtctagcgtaggcgccgacaacgtaaaagcaggcactttggcgtatatggacccgttcattcgtgaccctggcaggcgccgctgggacgatcacgcagagcggttttctgccgcgctcaccttgtatgaaatggcagccggtgctctgcccggttgggccgtagcagaaggattgccgcccttattggagggcgaactagaggtagaccgcacactgtttgaccccagtattcgcgatcgggtagtggatttcttcaagcgtgccctgattcgtgatgcgcgcgaacgctttgccagcgccggcgacatgctgcgcgagtggcgaaagatatttcatcaggcgcgaacagatacccagcattccacagttcaccccgggcagcgttcatgcccaattaatgaagcaagactggacacccagattggactgcttgagctaagccctcaggccctggataccctaagccgtcgaaatatcaataccgtagccgaactgatcaaactgaaccgctcccgagtcagggttttgaccggtgtcggcgttaaaacccgcaatgagttgtcagaggttatcgggcagctgcaagagcgcctattggaagcccagcagagggtgcagtttgatgcgggcgacaccagtatcgtcagtgtagaccggctgtttcagcaaatcctgccaaaggttacgaaagctacggatccaacacgcctgcgctttttgcatgagtacctcggcaggctagacgacgactcacccagaggcctgcataacgtgcattggcccacaccggcggcaatcagcggttatttggggatcgaaaccctgatggtgcgcgagttgattagtaaagtaagcgtgcagtggggcaaaaccaaaactattaccgacctgcgggaagacatcgccggtttactggaagacaacggcggcgtaatgaccgcggtcgagctggccgatgccgtgttgttacgccgggggtcagtgcaagacagcccgctgcgcgagcgctgggcctatgcggttgttcgcgctgcggttgaaaccgagctgagtaagcaggaaccgcgttggttgttgcgccgttctggcagtcgcatactcattgccgacaatcgccaaggttgggctgaagagctggccgattacgccaatgacctaggcgatctggccgacgagtgcgctaaccagtatcccttgttgtcaccggttcgcgcactggaaagaatacgagcggtaccggctcccgagtcattttctgagctgagtaaccctcgcctgtcgcgcctggctgctgccgcatcacagcaggcagcgctgtcgagccgcgccgagttttacccgcgtggcttgcccgccaaacgggcgctggagcttgcccagggcgcattgttgggcagtaaggccttggcggtacaggatgttcaggcccgcgtcgccggccgctatccggcggccgaagccctgccaaaacgccctcagctagatgccctggtactggcgctggatattggtttcaaatgggacgcacaatttgaattttcaaacggtaacaaaggcgcttactgcctgccatcggtgggcctaaccagctttgccacaggcactaccagctactccgcggttacgcagcaaagcgatgaagattcagcctctctgagagaagtgaaagagctgcacaaacgtgtgcagcaggttattaccgcgtcacactttcttgcgcttacggtacgcccgcgtcagtggcaacaagcccagctgaagctgtgtgctgattacccatttaaactcatcagctttgacgagctgttgctgcgccacgtgcaccaagtgtgtagcgatatgccgcgtgcgcctgactggcaagtggtgctaaatgccgacagtttcgacagagcctcccgcgattggcagaacctgcagcgtttggtgcaccgggcgttgccagcaatgactcaggaaattctaacggcaggccagcccgtgctactaacagacccagggctgatggcgcgttacgatttgattggcacctggctggcggacctgcgaatgcagctgatgcaagaaaataatggttcaagcgttgacctacccgggcttgcgttgttgattgcagccgacgatcagtttacgggcgccgctatcgacggcagcctggtaccaactggcgcggggagtaaagagtacgcacgcatacccggcagttggttcgattatgacgttaatacacgaaaagagggcgctgcctga

SEQ ID NO: 596 - DNA, 3855 bp, Saccharopolyspora erythraea
ttgcggtcggagctggacgaggtgcagcgcgctcacgtctacgcccggtccgaggactcggggctgccggagatctggcgtgatctgcttgccaagccgccgcaacgtgagcaccagcgggtgcggccggagttctcacggctgctccgagatctgttcgccacgatcgggatcagcgcggccacgtcgcatctgcggttcggcgacaactggtcgctgtggccggagaagctcgacgcgggccgcacctgggaggatcggctggcggagcggtccgttccggtcaaggaagagggccgggtacggatctatctcaccgcacagcaggccagcgagaagcagcggcaatcggtggagcgggccgcgcggcgcgagtaccaggtgctgcagggcatcaaccaccgcgggatcgcgcaggcggtgcagttcgccgagcacggcggatccccggcgatcctgtttcggcaccgacacgccgacctgcggctggactcgtatctggacctattcggtgatcgactgagtaccgaggcccggctggagctggtgcggcagttggcggaggccgtgcagtacgcgcatcagcggtcgctgtatcaccgggcgctgtcggcgcggtcgatctatgtgtcggcccgtgacgatggatcgcagccgctgttgcggatcatcgactggcagaccgccgcgcgcgacttcgagacgacgatgggcacgtcatcgctgggcaacagctcggtgaccggcgagcatctggccgactcgtcagaggtgtatctcgctccggacttcgacacgccgtatgcggacccggtggatctggacgtgttcgggctgggtgcgctcacgtacttcctgctgaccggcagcccgcccgccacccagcgcagcgcgttgatcgaccggctgcggaagaaccagggactgcggccgtcggcggtggccgacggggtgtccgacgagttggatgcgctggtcttcgaggcaacccgggcagatccgatggatcggctgaccgcggcagacgagttcctcaagcggctcgacgacgcggagaagaagtcggttccggtgggcgtggcctcagacgtggatccgctcgacgtctcggcaggccagaccgtcgggggcgagtgggacgtcgtgcgtgtgctgggcaccggcgccaccgcccgcgcgctgttggtgtcgcggatcgacgaggacgccgacggggagccgagacccgagtaccgcgtgttcaaggtggccctcgacgaggacaaggccgcgcagctgcgggccgaggccgaggcgctgacgaaggtcggcggcggtgtcgtggtgaagctgctgtcgccggctcggcagttcgccgggcgcacggtgctggatctggagttcgcgggcgggttcgacctcgagggcaagacgctcggcgagacgatccgcgccgagggcaagctcagctaccacaacctggagcgctacggccgcgacctgttcaacgccctcgacatcctcgccggccacggtgtctggcaccgggacctcaagcccgacaacttcggggtgttcaagcgcgcagaccgctcgacgcagctgatgctgttcgacttctccctggccggcgtgtcggaacgcgatgtcaaggcaggcactcgtggctacctggacccgttcctgggcacgtcccgccgccctgtctatgacgatcacgcggagcggtacgcggcggcggtgacgctgcacgagatggcgtcggggcagcggccggagtggggcgacgggatgaccgacccgcgcaccactgcggacgagaccccgaacctggcggcggacctgttcgagccggatctgcgtgagccgctgacgtcgttcttccggcgcgcgttccaccgcgaggtcgacaagcgcttcgacacgctcaagcagatggacgacgcgtggcgggaggtattccgcaaggccgaccgcaccccgccgctgactaccccgggcacagccgaggccgacgacgcgtcgctaccggacctgcgcgaggctgcggcgaagagcgcgacgctggagaccccgctggatgcggccggactgtcgccgcgcgccgtgtcggtggcgaactcgttcgaggcgttcaccgtcggcgacctgctgcgggtgccgccatatcagatctcgaaggcgcgcggagccggcgcactggtgcggcgcgaactcaaccgacggcacacccagtggagcaaggtcctcctggccggggcgacaccgcagcgcccgcaggtcgagggccgggcgccgacgatcgacgaccttgtcgagatcctcgccccgaagccgcgccgaggctccccgcggcccgaggcgatccggctgttgttggggttgccgggcgaggacgggaccccgccgccgtggccgacgcagagcgacgtggccaaggccctcggacgcacccaggcgaccgtctcacgtcacctcaactcccaggccaaggaatgggcggcggacgaacacctcaccgccgtccgcgatgatctcgtggcactgctgggcgaggcgggccgggtgatgaccgccgacgaactcgcggccgcgctgcgtgcccggcgcggctcggtcgagcaggactccgcgcgggcgcacgcgttggcgcttgccgtggtgcgggcggcggcagagaccgagatggcggcccagggcaccgacgccgagccgaggttgctggtcctgcgccgagcggagcgcgtgctggtagctctcgagtcgctgtcggactcctcggacccgagtgccccggaactcgcggacttcgccggagcactgggctcgtgtgccgacgaactggtgaaactcgaccctctgccgggccggggcgttgtggtgcgcgaacttcggtccatcgacgcacccgctggcctgccggtccaggcggacacgcggctggtggaactggccgcagcgatgtcgcgcaacgcggccgcctcaccccgactggagctgtatccgagggacttggacctggtgcgggcgctgcggatctcgcaggctccggccggggtgcggcgcggggtcgggatcgccgtcgatgatctgcttgcgaaggtcaaggcccggtttcccctgctggaactcggcgagtcgatcacgtacgtgcaactggagcgtgagctgtcggcggccgggttcccgctggtctacgacgtggagaaggcgcggttcacgcagcccgagcccgaatcgtcgcgcagcgtcggcagctcctacacctcggtcacgtcgacggagcagcggagcgatccgagcgagcaggcgcacgcgaagctgacgtccgcgttgaacaagggcggtttcgctgcgctgacgctgcgcggggtacaccttccgggggcggcggagtcgatctcctcggccttcccggtcgactcggtgcacgtggacgaactgttcctggcgcagttccgggcgctggtcaagcagcacgacgtggactggaacgacatccgcgctctcgacaacgagttcggcgcgactggggtgatcgcggacggcttcgcgtcgttcgtcgaagtgacctgggagaacgtgcaggaggaactggccaggcgggcctcgtcctcagtgctgtttctgcaccacgcaagcctgttggcccgctattacaaccggggcggccgagatctgttgacggaattgcaaaacgcggcccgccgcccagactcgcgtccccacggcatgtggcttctgtgcccaggcgattcggcgtgggagacaccgcggctggagcagcacatcgtcgaggtgctcggcgagtcggaacgggtggtgctggacggcgccttcctggcggggttgaacgcgggcgagggcgccgcgtga

SEQ ID NO: 597 - DNA, 4713 bp, Streptomyces turgidiscabies
atgcgggaaggccggtgggtcacggtcaccgagtccgagttcgatcacgaacgccgcggcctggaggcgatccgggagaagctgccggactccgatccctggcgtgcctggtcgaacttcaccttcaccgcgaacaccggtcacgtccgcgaggtagacctgctcgtcgtggccccaggtggcgcctgcatgatcgagctgaaggactggcacggttcggtcacctccgagaacggcacctgggtgcagacgactcccggcggccgccgccgcacgcacggcaatccgctgcatctggtcaaccgcaaggccaaggaactggccggcctgctcgcgctgcccggcaacaagcgcgtctgggtcgccgaggccgtctgcttcacggacaacagcctccgcgtccgcctgcccgtccacgaccagaacggtgtctacaccgtccaccagctggtcgagatgctcaagcagcccccgcgtgacgagcggcgccgcgtcacggcgatcggctcgcgcgagatcgaggcggctctcaagaacatcggcatccgcaagagcgacgcgcagtacaaggtcggtccgtacgagctggagcggaagtccttcgactccgggcccacctgggcggactacctcgcccgccacagcgaactccccgaggccgcccgcgtccgcatctacctcagcgagcgtggttccgacacatctctgcgccagtccgtcgagaacgccgcccgacgggaagccgcggtactgggccgtttcaagcacccgggtgcggtcgagctcaagcagtacttcccctccgggcacaacgccggaccggccctgatcttcgactaccacccggacaccctgaagctggacgagtacctggtccagtacggcgagaagctggacatcctcggccggatggcactggtccgccagctcgccgagaccatgcgctccgcgcactccagccgcatccaccacagggccctcgcggcacgctccgtgctggtcgtcccccgcccgcgcggcgggaagggccgggcggtcggggaggaggccgcctggctcaccccgcacctccagatctccgactggcagatcgcgacccagcgcagtggcgactcctcccagggccagggcatgacccgcttcgcgccgaccgccctgtccgcgatgcacctggccgacgacgccgacgcctacctcgcccccgaactcaccgccctcaaccccgacccggtccacctcgacgtgtacgggctcggcgtcctcacctacctgctcgtcaccggcaaggccccggccgccagccaggccgagctgctggcccggctggaggcgggggagggactgcgccccagctccctggtggacggcctgtcggaggacgtggacgacctggtgcaggccgccaccgcctaccggcccggccagcgcctctccagcgtcgacgagttcctggagctgctggagatcgtcgaggactccctcacagccccggcccaggcggccaccgccggtacggaggaaccgggcgacgaggacgacgtcaccgccgccgacaaggacccgctggaggccgtcgccggtgacacgttcgccggccgttgggagatccgccgccgcctcggcaccggctccaccagccgcgccttcctcgtccgcgacctccaggccgaagcccgtaggacccgcccgctggccgtgctgaaggtcgccctctccgacagccgcagcgagatcctcgcccgcgaggccgaggccatgggacgcctgcgcccccactccggcatcatccgcctcgtcgaacccgagccgctgcacctcggcggccgtaccgtcctggctctggagtacgtcggcgacgagcgcgacgacgccgggcagggcaccgagggcgggagccgcccgcgccgtcgtgaggagacggtcgcccgccagctccgcgacaacggccgcctccaggtggaccagctggaggcgtacggcgactacctcttcggagccgtcgacttcctcgaaggcgagggcgtctggcaccgagacatcaagcccgacaacatcgccatccgcatccgccccaaccgcacccgcgaactcgtcctcatcgacttctccctcgccggctacccggcgaagagcaccaacgcgggcaccgacggctacctcgaccccttcgtcgacgtcatcacccgaggctcgtacgactcgcacgccgagcggtacgccgtcgccgtcaccctgcaccagatggcctccggcgagctgcccaagtggggcgacggcagtctcctgccacgcatgaccgacgccaaggagtggccgtacccgaccatcgcggccgaagccttcgacccggccgtacgggacggtctcgtcgccttcttccagaaggccctgcaccgcgacgccggccagcggttccccgagctgaagccgatgcgggacgcctggcgcaaggtcttcctcgacgcctcccagacggtcccgtccagtcaccgttcccggcacccggcccctgcgacggcgggggaggggacacccgccgagggcgccgtcgcggcggcgatcgcggacgccgagccggagaccgccgagcagcagcgcgaccgcctcgccgccgaggtcacccgcgacaccccactcaccgtctccggcctcacccccgccgcccagtccttcctctacggcctgggcatcacgacggtcggtgaactgctcgactacagccgccgcaagctcgtcaacgcccccggactgggcgccaagacccgcaacgaggtccagcagcggcagcgcgagtggggcgagcggctgcgcgagatccccgtctcgccgctcacgccgaagggccgcgcggaggccaaggaggagctggagcagctcacggccgccgagtcggccttggtgggccacctcgcgacgggtgagtcggcgggtgcgctgcctgcccgcaccctgcgctcagtcagcctcgacaccctcgccaccgtcttcgtgcccgccgtcaacaacaacggctccaaccgcaacaaggcggagatggtacggctgttgctgcgcgtgcccgacgagcacggggtcctgccggacatcggggtctggccgaagcagaaggacgtcgcggaggctcttgggctgagccagggccgtatcccgcagttgctcaaggacgagcgcaggcgctggaaggcggagcccgccgtccaggcactgcgcgaggagatcatcgacctgctcgtgagcatggggcgcgtcgcgtcggcggtggagatcgcggacgccctggcggtccggcgcggcacgcacctcgccgggcgcgagcagcggcgggcgatggcactggcggccgtacgggccgtggtcgaggtcgagcaactgctcccgcaggaagccgagttcctgcaccagccgaaccgcaaggcgacggacgagtccctgggcgccggcctgctcgccctcgacgtacgggaggacgacggcccggacaccccgacggcgcccggcctgctggagtacgcgactcgtcttggtcgtacggcggatcggctggcgaagctggacaccctaccgacggcagcgactgtactggccgagctgggcgggctgacggtgccgcctggcgcggtggactgggacgagcggcgcatggtggagctggcggcggcggcatcgctgaacgccgccgctactccgcgactggagatctatccgcgtgacttgtcgctggtacgggcactgcgcctcacccaggccgggctcgtccgctggattccgggtatgccggaggggcagcagccgggcctgaccggcgaggccgtgcacgaacgggtccgtgctcgcttcccggagatggtcgttcccgacgggcgtggcggcacgcatcacgaactgccgacgggcggcccgctcaccaaggcgttgcgcgacgccggcttcgaactctcgctcaacatgcacgaacgcgagggcgtgctgcgctacttgccgacgcgggtggacgacgcgtcgagctatctgacaacgggtgcgtggcggcagtcgacgcgtacgggcgcggtgacgcggtacgccgacgacccgcaactcgcgggcgcggtacgcgcggaggaacggctgctcgcgtcggcccgccgggacgggtaccgggtgctgaccgtacggcagcagcttgtacgggacgcggtacgggagctgggtgccgggcggttgggtacggctgcggtgtcggtgacggagctgttcctggaagccctgcacgcacaggtcacgccgggcaccaagcccacctgggaaaccctgctcaaggcggacgccgccgagccgggttcgaggggcgcggtgcggttcgcggagttcacgcggacggcgtggggcgcggtggagcccaggatcgcggagttgctgggtaacggtggtggcggggccggtcctgttctgttgacggaggcaggggttttcgcgcggtacgacgcaatgggcgtcctggaccggctggcatcggtggcccggcagggcgggcgggggctgtggctcctggtcccgcagagtgacccctcgcgcgagccccggctcgggcaggtggccgtgccgtaccaggccggcctgggggagtggattcagcttccggacacgtgggtgggcaatgcccatcggggatccggcgagggtgcggcaagttctagtgcgagtgccagtggtgtcgagggagacgtcaagtga

SEQ ID NO: 598 - DNA, 4173 bp, Gemmata obscuriglobus
atgagcccaaaaacgaactgggtcaccgtcacggattcgcgctaccagtgggagcgcgacgccctcgatttcgtccgcgaccgctggcccgaccacgagccgtaccgtgcgtggtcgaacttcgagttcattgcgctcgacggcagcatcaacgaggttgacctgctgctgctcaccccgatgggcttcttcctcgtcgagatcaaaagccggccggggcgggtgtccggcgatgcgggcacctggacgtgggacaccgagggccgactcgtcaccgtcgggaacccgctcctcgctgccaacctgaaggccaagaagctccgcgcgctgctcgagcgccaaaaggcggttaaggtcaagggcggtctgccgtttgtggagccgctcgttttcctttccgcgccggggcttcagtgcgatctgcgcgacacggcggtttacggcgtctgcctgcgtgacgcggacgccgagggcggccggccggagcgggccggaatactcgctgcggtcaagaggcgcgagtgccccggcctgaagccgaagcacggcccgttcatcgaccgcccactcgcgaagatcgtcagtcaggccatccagcaggcgggaatcccgaaccagcaccgccagcggcgggtgagcgactacgtgctcggtcgactcctcgacgaggggcccggctaccaggactgggaggcgtcccacgtccagaacgtcggcggcaagcggcgcgtccgcctctacctcgtgtggaacgaggccacggccgacgaccggcagatggtcgagcgggccgcccggcgggactaccaactgaccgaggccctccagcaccccggcgttctccggaccctcggctacaccgagcacgagatcggcccggcggtcgtcttcgagcacgacccgaacgcactccggctcgaccactatctcgctcagcggggcgaccggctgggggccgacgtgcggctcgatctgctccgacagatcgcggaggtcgtccggttcgcccacgagaagaaggtcgtccaccggggcctctgcccgcggagcatcctcgtccacgacccggacgggccgcggccgcgggtgaaggtgcacaactggcaggtcggctaccgggtcggcgggtcgtcgtcgggcgggacgcgggacatcaccgccacctcacacgttgatctgctggtggaggacgcgggaacggcgtacatggctccggaggcggtcctgcccgccgacaccgccggcgagcacctcgacatcttctcactgggggccgtcgcctaccacgtcttcaccggcacgccgccggccggcaaccggctggagctggccgagaagttacggcagacccgcgggctgctcgtgagcgacgccctgaacggggcggcacccagcctccaggagttggtgcagtacagcacccacccggacgtgacgagccgcgtcgactcggccgccgacttcctggccgggctcgacctcgtcgaggaggagttgaccgccccgacgacggatgcgctggtcgacccggtgcgggctcagaagggggacgcgcttcccggcgggttcaccgtcgtccgccggctcggccaggggggcacgtcggttgcgctgctggtcgagcgggaaggtgaagagtacgtcctcaaggttccaaacaccgcggacgacgagccgcggttgcgggccgagggcgaggtgctcgccaaattgcggcacccccacgtcatcgagtacgttcagccacagaagctgtctggcctcccgtacctgttgctgcggtcggccgggccggagacgctcggccagcggctgcggaaggaggggcggctgcacctggacctgctccagcggttcggggaggatctgctggaggtggtgaagtacctggaggaacagggcataccgcaccgggacatcaagcccgacaacattggcgtcggcccggtcggacgcggggacatgctccacgttgtcctgttcgacttctccctgtcccgcacgccgccggagaacgttgaggccggcaccaaggcgtacctcgacccggccctcccgcggcgcaagcggtgggacctggccgccgagcggtacgcggccgccgtcaccctgttcgagatggccaccggcacgctcccgcggtggggcgacggccggagcgagccgtcgcagctcgactgcgaggcgacggtcgacgaggagctgttcgacccgaccctgcgggacgccttcgtcctgttcttccgcaaggccctccgccgggaggcccgcgagcggcacgacaacgccgacgagatgctccgggcgtggcgagactgtttcgcggccatcgggccgccggacgccggggaactgaacgaagaagaactccgggcgaggctggagggggcgacgttcgactcgtcggtccacgaactggggctggggacgcgggcgaccaacgctctggaccgggccaacatgctgaccgtcgaggacatgctcagcgtgtccatgcggcggctgctgcggttgcgcggcgtcggcaacaagacgcggcgggagatcgcgtccgccgtcaagatcctgcgggcccgactgggcaccccgcaggccgacgcgacggtggccgtagaagagcccgaagagccgccgacgggtgcccccggtcgattgagcgtcgatctgctggttcagcggctcacccgctccagcccgcgcgaggggggcacggccaagcagtcggtcatcgccctgctcggacttgaggagtcgctcccgaacccctggcccagccaggcggacgtatcacggttcatcggcgtgacgcgggccagggtcggggcggtcatcagcaaggtgatcgaccgctggggccgtgacaaggccctgaccgccctccgcggcgaccttgccgggctgctggtgacggccggtggggtgatgaccgccggggaactcggcgacgcaatcctggccgcccgcgggtcggtggcggaggagccccagcggtcgctgctcggccgggccatcgcacgcgccgcggtcgaggtcgagaggacgatgtccgagccgcggttcctcgtccgccgcgacgacacgcggacgctcgtcgccctgcacccggccctggctgaccacgccgcccggctcggcgaccgggccgacgaactggcccgcgaggacccgttggcttctccgacgcgggcgttgcaggttctccgcgaggtgccggccccggccgggttcgagccgctggccgactcccggctcctgcggctggccgccgcggcgtcggtcgaggccgcggtgtcgagccgtcaggagatctacccccgcgggatggacgccctccgggctctgcggctggcgcagggagccctcggcaacgtgaaggtgctcaccgtcgagcaggtccgcgaccgggtggccggacgctacccggacgcccagccgctgccggagcggccacagttggacgagttgctggaggcggccgacgtcggcttgcggtggaacccggacgccgccgacggccgcggcgggtacgtctcccgcttccaggagacggtgtcggttaccacggccagcacgccgccacaacggcaaccgaccgcgtccggccacgcgcctcgcgagacgttctcgccggaggaggccgacgcccgcctgttcgaggagaagttgcggcggtccctcaaggaaggggcgttcctcactttgctggtcgctcagcgatcgtatcagcaagccctcggtgagctgcaaagcgagcgcttctcgctgaagaccatcgacgccgaccggctgatcatcgactccctccgcgagacggcgggcaaggcccgcgtcgattggcccctcgtcctgcgggccgactcccacaccggcaacggcgactgggcgaagttgatgatgctggtcggccgggcgatgccgcgggtcgaggaacgactcgccgggtccgactccacgatcctgctcctgaaccccggcctgctggcccggtacgacaaactagacctgctcgaaaagctccgggaccgcgtcgggcggcccggcggccccgcgggtctgtggctgctcttgccgaaccagcagccgatgatcgacgggaaggccgtgccgctgctcagccccgcccagcgggtccacgtcccggagagctgggtcgagaaccgtcaccgggcctag

SEQ ID NO: 599 - DNA, 4242 bp, Rhodococcus ruber
gtgcggggccaggtgcagagtgaccgctgggtcgaggtcagtccctccccgttcgaccacgaacgcgaagggctcgaacggatcaaggagatccttcccgacgccccaccgtttcgggcgtggtcgaacttcgagttccgcgacaaccgcggccgctggcacgaggtggacctactggtcctcgcccgcgacaccctgtacctgatcgaactcaagtactacagcggcatcttgcgcggcaacgaccacgtgtggacacgcggcaatcgctccgaggactcgccgctgctcctcgcgcgcaagaaggcgcagtacttctcgtcgctgctcaaggaccgattggcggagaagaccgggcagaagaacctcaagggcatcatcccgttcgtgcaggaactcgtgtacctgcatcatccggacttcgtgtgcgcactgccgacgagttccaagatcaacctctacggcatcgacggaaacgacgaccgcagtcgactgccgggtatcagcgagcggctcctcgcgccagccacgcacgggccggtgtctgaggagaagtcgctgctgatccgcgacctcatggccgcgatcggcctcgccccacgccgccagcgcgaggtcggctcctgggtgatcgacgaccaacccctcggcgacggcgacggctggcaggactggccggccttccatcacgtcgacatggaacgcgccgcccgcatccgcttctacctgcccaaacccggtgcgacctccgcggaggaacacgcgcgtgcacgcggcgtcgagcacgagtacaagctgctgtcccggctcaagcacgacggcctgcaggtccctgtcgacgtggtcaaggacaaggaactcggcatcggcctggtgttcccgaaatccgacaccgacgtgcgcttggacctgtggctcgccgaccaccacggggagatgaccctcgaacggcagctcgagttgctcaccgaggtcgccgaggtcgtccactatgcgcatcggcaccgcgtggtgcaccgcaccctcaacccgcgggcgatcgtggtccgcgaccgcaagtccggtccgcaggcgcaggtcaccgactgggacaccgcgggagtgttgcccgccaacgcggaaaccggggtgactcgcctgtcggcgggaccgctgagtctgatggccggcagcctgagcgaccaggccaagttgttcacctcccccgagggtgtgaaccccaccgaccccgcccgcatggacgtcttcgggctcggtgcgctcgcgttctacctgctcaccggcgggcagtccccggcaacggaacgcggcgaactgctcgaccggttgcgccgcgacggtggtctcgacctggcggtggaactgccgcaggtcccgtcgatcctgcggcaattcgtgctcgatgccaccgatcccagccccgcagaacggatctcgtcggtcgcggacttcctcgagcgactcgaggcggtgcgctcggatctgttccgcgccgagggggaaaccgatccgctcgacgcgaaacccggcgacgaactcggcgacggtcgcttcgtctacaagcggcgcctgggagcagggtcgaccgccgtcggcatccttgtcgtggaccgcaaggcgggcgatcacgagcgggtcctcaaggtcgcccgcgacgacgaggccgccgctcgtctccacgccgaggcgcaggtgctcggcaaactcgacgatcctcgcatcgtgcagctcgcttccgaggagaacgtcggcggccgtgcggctctcgtcgtgcactacgcgggacgcaccaccctcgcggaggaactggccgccaagggcggccggttgtcgatcgacctgctcgaacgctggggcaccgacctgctgcaggcactcgtcgccctcgaacgggccggggtggtgcaccgcgatctcaaaccgtcgaatctcggtgtgcaccaatccagtccgcgtgccgacgcgcaccttcgcctgttcgacttctcgatggccggggtggatctgcgcaacaccgacgcgggcaccccgccctatctcgacccgttcctcggagtcggtggccgcacccagtacgacaccgccgccgagcgctacggcgctgctgtcgtcctgttcgagatggcgaccggtgcggcgccgcagtacggaccggacccacaggcgaacccggccaccgtgcaggacgacgtcaccgtcgccccctccatgttcgagacgcccgtcgcggcaggtctcaccgcgtacttcacctcggcgctgtcccgcgacgtcgcgacccgcccggacacggccgaggagatgctccgcgactggcgccgggtgttcaccgacctcgacgccgctcccgcgaacgcagacaagaccactcgcgcagtcaaggtcgtcgccggcacctccctggctgctgccgggctgagcgcccgggccgtgtctgctctcgccgcggcgcaggtcaccacggtcggcgagttgctggtgctcgattccacccgactcaaccggctggtcgccaaggaagcgaaagccacccgcaccgagatccgcgaccggcatcgcgcatgggtcaaggaactcggccgatccgccgccaagcctcaggatcagcagggcttgctcggcctcgacgacgccgtcgccctgttggtctcggcggtgggcacgggtagggccggtacccgccgcagcgcagcggaactgctcctcggtgtcgccggcactctcgatgcgttcgcgtccggcaacgaactggcgtcggcgttgaagaagagcggtccccgaggaaatcagcttctcaaggaactgcagtccgactgggcggagaacccggcgacacgcgagttgctcgacgaactcatcgacgtcgccgaccaggtcctccgcgattccggtggggtagtagcgatctccaccctcaccgccgagattcgcgcccggctgccccaatccgcggccgcgaccaccgatgtcatggccccgcgtctcgcggagcgtgctgccgccggtctgttgcgcctcgccctggatcgactcaccgagcacgaaaccgccgagggaacccgacggtgggtgcgccgccgtcacggtgggcgcctagcgttggtcgccgacgacgaacttctgctcgccggagccgaagccgcgggccgtcgtgccgacgacctcatggtcgccaccccgatttcccaggtggtcccgatgggcaccgcggcacgcgagctgcgcggcgcgttcgcccgcgcttacgcagccgcggccggaccggacgtgccggtgccgttgccaccggacgggcggctcgtgcgtttggcggcagcgatctccaagttcgcagcagtgtccggccgcggagaactccacagccgcagcctcggcccgtccgatgcgctgcgcatcgccctcgccggcctcgctcagaccgaagcgttgtcgccgacggagatccgggcgcgcgtggcggcgcggttcccggaactcgaccggcttcccggccgtcccgctctcgatgcgcacatcgaccgtgccggacttggcctcacctgggacggcaccgcctaccgctacgagcaggccgcaccgccgagcgaaacctccctgcacacccgcaccgccacgtacaccggaccgcccgccggacccgtcgtgtccgccgcgaccggcgagggtggcgcggcgcggaactcgctggtggcgcgctccttggccgaaaacggcttcctggtgttcggggtgcccgttcatcggcccggcgaccaccaggtcgtcgcgcgggaactcgtcgaggcgcacgagggtgaggtcctcgacgtcaccggagcgatcatcgacgcgatgcgggccttctcgtccgagcggggtgtgccgtgggatctcgtgcgaagcgcggatgctgcggcggcgggaagcaaggatgcgcggggtctgcgcgcggtgctcgagcaggtgatgccgcgcgtgtgcgctggcctcgaggagcgagtgttcggcgacgccgcgcaggcgaggccgctggtgctcaccgaggtgtcgccgctggcccgctacggctacctcgacatcttggcccggctggccgacctgtcggcaccacgtcgtcgcccggtgtgggtggtgttgccgcagatgcgcgggcagcgcggcgcgctggtggatggtcagccgatccagttgggttcacccggcggacagttcgttgtgtatccggtttggaagaccgggatcgtggagagcgagaaggtgtga

SEQ ID NO: 600 - DNA, 4185 bp, Mycobacterium xenopi
gtgaaggatggccgttgggtccagatcgccgagtcgcaattcgcccacgagcagcaggggctcgatgccatcaagcggattcttcccgacgcggcgccgtttcgcgcctgggcgaatttcgaattccgcgacaatcgcggccgctggcacgaggtcgatctgctggtgcttgcccgagacacgctctatctcatcgagctcaagcattacgcgggcaccctgcgtggcaacgatcacgtgtggatgcgcaacgggcagcgggcggaggactcgcccctgctgctgacccgccgcaaggcccagtacttcaagtcgctgctcacagacacactccggcagaaggcgggctacgacccgggcatcatcccgtacgtgcaggagctggtgtttctgcaccacccggagttcacctgcgagctgccggaaagctcgaagatcaacctgtacgggctggacgggctcagccacaagaccggcctgcccggcatatccgaacggctgctggccccggcccgacgagagccggtcagcgagaagaacagcttgatcatccacgggctgatgaaggcgatcggtctggcgccgcggcgccagcgcgaggtcgggtcgtggatcatcgacgagcagcccctcgccgacggtgacggttggcaggactggccggcatttcaccatgtcgacaccgaacggcacgcccgcatccgcttctacaccatcggtgagggcgtgaccaaggccgacagccacgcccgcaagcaggccgtcacccacgagttccacctgctgtcccggctgcgttacgacgggctgcaggtccccgaagaccttgtcaacgagcctgaactggggatcgggctggtgtttcctcaacctaaaggtgatgtgccgcttgacctttggctggccgaccacaagaacctgtcgttggaacaacagctggacctgattggtcggctggccgacatcgtcaactacgcccaccgcaaccgcgtggtgcaccgtggcctcaacccgcgttcggtggcgatccgcgaacgcgacgaactgctgccgcaggtcaccgactgggacagcgccggcgtgctgcccgccaaccccgacaccgcggtgagccgcctgtcgagcggctcgctgtcgctgatggccgctgcgcccagcgacatggcccggctgttcgccgccccggaaggcccgcgcccggcagacccggcgcgcatcgacgtcttcgggctgggcgccctggcgttctacgtgctgaccggcggccggtcaccggccaccgaacgcggcgagttgatggaccggctccgccgcgaccacggcctggatctggccgcggagatgccccaggtccgatcctcgctgcgccagttggtgctcgacgccaccaaccccaagcctgacgagcgcatcgccgacgtggccgagtttctcgaacggctcgcggctgcgcgcgaggacgtcctcggcaaggcgacgggcaccgatccgctggaagccgggccgggaaccgagctggccggacggttcacgtaccgccgcaagctcggtgccgggtcgacggcagtgggcatcctggtcgccgaccatcaggtgggcggcgccgaacgggtgttgaaggtggctaaggacgccgacgccgccgagcggttgcgtgccgaggcgcagatcttgggccgattcgaggacgacgaccgcatcgtcaccttgcacggcgtcgtcgaagtcggtgggcgcaccgcgctgctgctgaagtacgccgggcgcaccacgctggctgaggaactcaacaaccgcggccgcttgtctattgacgtgctggagcggtggggcaccgacctgctgacggcactggtggcgctggaacgcaacggggtgatgcaccgcgacatcaaacctgcgaatctcggtgtctaccagtcgagttcacgcgccgactcgcatctggtgatcttcgacttctcgatggccggcgtcgatcccaagaacatcgaggccggcaccccgccgtacttggacccgttcctgggcactggtgggcgccgccagtacgacaccgcggccgaacgctacggcgccgcggtggtgctgttcgagatggcgaccggcaagagcccccggtacgggcccaacccgaacgccaacccggccaccgtcgatgacgacatcacgctgactcccgacatgttcgagccgaccgccgccgcggcgatggtcgagttcttcaccaccgcgctgtcccgcgacgcggctaaacggcccgacaccgccgaggacatgctgcgcgcctggcgcgccatcttcagcgccgtcgacaccgaaaccgcgccgcaggaaagcgattcggtcgccgcgcgggcggatttgtcgacgccgctggccgcggcggggttgagcgcccgggcggtgtcggcgttggccaccgcgcaggtcgccaccgtcggcgagctgttggcgctggactccaccccgctcaacaggctggtcgccagggaggccaaggacacccgcagagagatccgcacccggtaccaagagtggaccaagcggctgggcaagcagcgcaccatctccgatcaactgatgggtctcgacgacgcggtgggattgttgatgtcggcggtgtcggcaccgcgggcagccaccacccgcaggcgggccgccgagctgatcctgggtgtcacgccggggctggacgcgttcgcgagcagcaccgagctggccgaaaagctgggcaagacaactccgcgcggcatccaggtgctcaaagaactgcaggacgactgggcgaagaacaccgacgcccgggaattgctcgacgcgatcaccgagatcgccaagcaggtggtcaccgatttcggtggggtcgccgcggtgagcacgctgaccgccgagatccgcgcgcggctgccgcagtccgacgtcaccttgcccgactggtcggcgcacgaccgcacggccggcggtctgctgcgcgcggccctggaccggctcagcgaacacgaaaccgcctcggggacaaaggagttcgtgcggcgacggcacggtcggcggctggcgctgctggccgaggatgagatgctgctcgccgccgccgaagctgcgggggagcgggccgacaagctggtcaccgatgtcgccgccgtggtgcccgcgtcgacggcggccagggaactgagggcggcgttcctcgacggctaccgcgccgtcagtgacgccgacgcgcagatcccgttgccggcggatgcgcggttggtgcggctggccgcggccatctccggtcatgcggcggtgtccggccgcggcgagctgcacaaccgcagcatgccgcccgcggctgcggtgcgggtggcgctgacggggctcgcgcagtccgagcggctgtcgccgtcgcaggtccgcagccgcgtcaccgcccgcttcccggagctggaccggattccgctgcggccgcacctggacagcctgatcgcgcagactggactggacctcgagtgggacggcgaaaagggcgaataccgcttccgggttgccgaaccgcccagcgccaccaccatgcacacccacacaccgacccaggtgccgggctccggtggcctcgacgccgaggcgctgcaacgggcggatcacgctgcggcgctgcgtcgctgcatcgacgagcgcggattcctcgcggtcggtgtgcccattcagccggatcggcccggcgagcacgagcgggtggcgcgcgaactcgccgctgcctacaacggtgaggtgctcgacgtgacgacgcgtctgatcgccgcgatgcgggaactggccgagcggcaaggcgtctcgtgggatctgattcgcagcgccgacgcggcggcaccgggcagccgcgacgcgcgcgggttgcgcgcggtgatcgaccgggtggtgccccagctggccgaggagttgcgtgcgtcggtgctcgacggccccagccgggccgagccgctgatcctcaccgaggtgtcgccgctggcccgctacgggcatctcgacattctcgccacgctcagcgacctgtccgcgccgcggcggcgtccggtctgggtgctgctccctcaactacgtgggcagaccggagcgctggtggaccgcaagccgattcagctcggatcgcccgggcagttcctcgtgtggcgggaggcggtggatgcagtacacacatga

SEQ ID NO: 601 - DNA, 4188 bp, Micromonospora sp.
ctggttgttcgggagtggcaatggtcgcgcgggggcgcagggcacggcatgcgtgaggactcaccgcgctgggagcaaatcaatccgagctcctaccagcacgagcaggagggcctgcgcgagctggccgcatacctgccggacgccgagccttaccacgtgtgggccaacgtggagttcgtcggcaccgacggctccatcaacgaggtcgacgcgctggtgctcacccgcagcggcctctacgtgctggagctcaagcactggcagggccggttctccggcgacggccagcagtggcggcggcacaagcccaacggccgcacacaggtgctcgacagcccgctgatcctggccaaccgcaaggcgaagcggctgcgcagcgtcatccagcagtacgccccgcccggcgcgcgcgtcccgtacgtgcaggcggcggtcttcctgcacgcccgtgactcgcgctccgagctggacgagatcggccgccagcacgtctacgggctggacggtcacgccgccgggaagctgcccagcctcaaggagatgctgctcgcccagccgctcgacgcccggcaccacgtcgacgcggtccggggccggcagatcgtcgagctggtgaagggcgcgcggatccgcccctccgtcgccgaccgccgggtcaaccagctcgtgctgcaccagcggccgttcgccgagggcattggctggcaggacttcctcgccgaccacactgtcggcggcgagctgctgcgccgggtccggttctacctgaccagccgggccgccgaggaggacgtaccgacaatcaagctggcggcggagcgcgagttccggctgctgcagggcatccaccacccgggcatcgcccgcgccctcgacctggtcgagcacccgtgggggccggcggtcgtcttcgaccaccgcaaggagtgggtacgcctcgaccagtggctggccgagcgggacggccggctgcaactggcccagcgcctccagctcgtgcaggatctcgccgagatcgtcgaccacgcccactcccggcggctgtcgcaccggtcgttgaacccccgggccgtcttcgtctgcgacccggacagcgcccgcccgaccctcgtggtgacggactggcagaccggcggccggttgccgggcacccggatgacgacgctcggctccccgaccgacccggccagcctcgaactgttcttcgacgacgtggtccgccgctaccaggcccccgaggcggccgtcgtcgaggggctgccgggccaccagctcgacatcttctccctcggcgcgctggcgtaccggatcttcgccggggtcgagccggcggccaccgccgaggatctgctcgcggcggtcgccgacggcggcctgcgcctggacgcggtcgccgacggcatgccgacggcgctggtctcggccgtctacgacgcgacccggggcgacccggcgcagcggatggcgcgggtgggtgacttcctcacctggctggacctggtctgggaggagctgaccgccccggagcccgagccggtggtcgacccgctgcaggcccaccggggcgacgtgctcgacggcggcctcaccgtgctcggcaacctgggcagcggggccaccgcgatcgccctcgccgtcacccggggcgacacctccgacgggcgtgaactggtgctcaaggtggcccgggacgagcagtacgccgaccggttcgccgccgaggcccgcacagtcgacaagctgcgcgactcccgggtggcggcgctggtgcaggggccgatcaaggtcggcaaccgcaccgccctgctgctggagagcgccggcaagcgcaccctcgccgaggacctgcgcggcggccggctggcgctggacctgctggagcgctacggccgggacctgctggagatcgtggcgttcctggacgggcagggggtgtggcaccgggacatcaagccggccaacctggcggcccttccccggccgaaggacaagcagccccacctgtgcatcttcgacttctccctggcgggcgtgccggccgaccagctcacggccggcaccaccgcctacctcgacccgttcctcgggccgccgcgccggctgcggttcgacgccgccgccgagcgcttcgccgccgccgtcaccctgtacgagatggcgacgggcacgctgccccgctggggcaacggcgccaaccccgccgccgtcagcgacgaggtgaccctcgacccggcggccttcgacccgtcggtcgccgaccggctggtcgccttcttcgccaaggcgctggcccgggacaccgccgaccggttcgacaccctcgacgagatgaccgacgcctggcgggcggtgttccgggagatcccggagccggcggcggccaccgacgacacgggcggggccgccccgctgggccgctcctcgccgctggagggcgcggagctgaccgcgcgggcccgttcggcgctggagcggctgggcatcaccacggtcggcgagctgctggacgccgagccgtcggcgctgacccgggcccggggcgtgcccgacgccacccgcaaggagatcctggcccgcgtccgggagctgcgggacctgctggacgccgaaccggagccggccgccgccgcccgcccgtacgcgcagggcgtcgaggcgctctgcgccaccctgctgccggcggtcaccgaccgcacggcctggcaccgcacggccgtgcaggtgctcctcggccaggcccccgacgccgacggccggtatctgcgctggccgtcccagtcggacgtggcgcgggtggccggcaagcagcagccgcagatctccaccctgctgcggcgggtcgtcgcccgggactggcagccgaacgtcgccctccgcctggtctgcgacgagatcgtcgccgtgctcgacgggcggggcggggtggcctccgccgaggagatcgccgaggcgctggtcgccgcgcgcggctcgtacaccgtcgagccgaaacgcacggcgcaggccatcggcctggtccgcgccgccgtggagaccgagctggcgcggggcggcgacgcccgggtggccatgcaccggctgcgcgactccgacaccgtgctcgtcggccgggaacccgacgacccgggcatcgagcgcaccgccgacgacctgctcgggtacgtgacccggctgggccggcgggccaccgagctggccggcgcggacccgctgcccacccgggcgcgggcggtggaggagctgcgggcgctggaaccgccgccggccggcaccccgccgctgagcgacgcccggctgctgcagctcgccgccgccggcagcggcggcagggccgccgtcaacgcgcagggccagctctacccggcggggatgcccgccgggcgcgcgctgcgcctcgccgcgggcgcgctggtcggccagaagctcgaccccgacgcggtacgcgccagagtgcgcgcccgtttcccccgcgcccaggagctgccgccccggccgcagctcgacgggctgctgcgggaggcgatcccgctggtctgggacgtgtcggcaggcctgtacgcaccgccggaccgcacctcctcggtcaccggcacccgcatgcagagcacggtcggcccgatcctggagcccgacgccgccgcgcaggtcagccggcggctgcacgatgtcatcggccggcgcggcttcctggtggcgctcacctcggtgcggcgcaccgcccacgcccgccgggccctgctgcagcgctacgacctcaccgaggtcgacgtcaccgcgatcatgctggagcggctgcgggcgctcagcttcccctgggaggcgatcgtcgccgccgacaccggctcgccgacggacgccgacttccgctccctggtggagctgttccagcacgaggtgctgcccgccgtcgagcggcggctcgccgaggcccccgggccggtgctgatcaccgaggccgcgccgctggcccgctacgaccagctccggctggtccaggagctggccgaccccacccgggcacgccccgccgcccggctgctgctggtccccgtccgccgcaccgagccggtgctgctcgacggccgacaactcccgctcacctccccggccagccagtccctgtggctgccggaggagtggagcggcgccgcccccgcacaacagcagaggaacgccacccgatga

SEQ ID NO: 602 - DNA, 4401 bp, Saccharomonospora xinjiangensis
atgtccgacggccggggcccggctccgaagcccgctccgccgcctccggtcgagaggtggcgtcaggagcggacgtctccgtatccctgggaacaggacgggctcgaccacatccgcaggttgatgccgcaggccgagccgtatcgcgcgtgggcgacgttctccttcaccgcggcgtccggccgcgtcaacgagtgcgatctgctgatcgccgttcccggtggcctttacttgctggaactcaagggtcacaccggacgtgtggtgaacagcggcgagacgtggagtttcttcagggagggcgtgcggcggccccggacgctgcgcaacccgctgcacctcaccgatctcaagtgcaaggaactcaagggccgcctggaatgggcggccaaacagaaccacttttccggccggattccccgcatcgagcccgcgatcttcctgtccgcacccggtctggtggcggaactcgacgaggtgcagcgcacccgcgtctacggcagggacgagcaggtcgagggcctcgactggatttggcgtgacctgctgtcacggccgccgcagcgggagcagcagcgcatcagccccgaattctcccgctatgtgcttccgagactgctggagcggatcggcatccgggcttccgtggctcacctgcggttcggcgacgattgggtgctcgccaacgaggtgctcgacgcggggcccacctgggaggaccggctcgcggagcgcacaagcctcgtgcacgagcagggccgggtgcgtatctacctcaccgagcagcaggccgtggaggagcggcggcagtcggtggagcgggcggcgcggcgcgagtaccaggtgttgcagggcatcactcatcgcggcatcgcgcaggccgtgcagatcagggaacatcagggcggccccgcgatcctcttccgccacgacgcgtcggatctgcgcctggactcctacctcgacgtgcacggcgagaacctcagcatcgacacgcgcctcgatctggtgcgccagctcgccgaggcagtccaatacgcgcaccaccgctccctctaccaccgtgcgctgtcggcgcggtcggtgtgggtgtcggcgaaggacgacggctccgacccggtgttgcggatcaccgactggcaggccgccgcgcgtgacttcgacaccacgtcactgtccactgtgggcaagacgtcgttgacgcgcgagcatctggcgaactcggccgaggtgtatttggctccggagttcgccccgcacgccgacccggtggatctcgacgttttcggcctgggtgcggtgtcgtttctgatcctcaccggaaggccgcctgccggtcagcgcagcgggctcatcgagcggttggccgaaagccacggcctgcacccgtatgcggtggcggacggaatctccgacgcactcgatgcgctggtgttcgacgccacccgcaccgatctggcgcagcgcctcgactcggccgacgcgttcttgaagcggctggacgcggcggagtgggagtcgctgcccgagtcgtcggtgcccgtggtggacccgctcaccgtgtcggctggtcagttggtggacgagcagtggcgcgtggagcgggtgctcggcacgggcgccacggcgcgggcgttgctggtcaggaaggtggacaccgccgacaccgacaccgccgcttcggacaccgtcgagcggcgggtgctgaaggtggcgctcgacgacgacaaggcgcagcgcctccacgcggaggctcgcgcgctggcgctcgtcggcggcggcgtggtggtgaagctgctcgacggtccccgcgaggtgggcgggcgcaccgtgctcgacctggagtacgcggggggccaggaccctgacggtcccacgctcggtgagtggcttcgcgcggagggcaagctcacctaccacaaccttgagcgttacggtcgtgacctgttcaccgcgctggatcacctcgcgggcaagggcgtgcggcaccgggatctcaagccggacaatttcggcatctaccgcagggccgaccgctcgacgcagttgatgctgttcgacttctcgctggccgatgtgtccgaacgcgatgtcgcggcgggcacgcgcgggtatctcgatccgttcctcggcacgagccgccgccccgtttacgacgatcacgccgagcgttacgcggccgccgtgaccttgcacgagatggcgtcggggcagcgtccggtgtggggtgacggggtgagtgacccgcgcaccacgtccgacgagacaccggtgctggcggcggaggcgttcgaaccggcgttgcgggacgggttgacggagttcttccgccgcgcgctgcaccgggacgtgaatcgccggttcgacacgttgcggcagatggaggacgcctggcgtgaggtgttcacctcggcggacaccgccgcgccgctgaccactcccggcacggtgggtatcgagggttcgacgctggaggcgacgcgcgacgcccacgccgacaaggccacattggacactcaactcgatcttgccgggttgagtcctcgggcggtgtcgctggcgcagtcgctgggtgcgacgacggtgcgcgagttgctggagcaggtgcggccgtatgagatcagccgggctcgcggcgcgggcaaggtggtgcgcaacgagctgaaccggcggcacaagcagtggacgcacgcgctgttgcggcgcgccgaaccggacgggcccgcgccggagaccggtgacggccccgccacgctcgacggtctggtggcgttgctgctgccggtgaaggccaggcggggttcgcgcaaggccgatgtggtgcggttgacgctgggactgccggagggctcggatcgcgacggtcacgacggcggcgaggacggtgctgccgcgctgtcgtggccgacgcagacgcaggtcgccgctcgcctcggcgtgacgcaggcgacggtgtcgcagcactatcgcaaggcgatggcggcgtgggcggccgagccgagggtggcggcgctgcgcgaggaggtggtgcggctgctcgccgaagcggggcgggtgatgacggcctatgagctggccgccgccgtcaaggccgcgtatggcggcgcggagcgggacacgcgggaacgcgctctggccagggcgttggcggtggtgcgcgcggcggtggacacggaggcgtgggaccggcagcaggagggcagggaaggcgcggaggacggcccccggttctcggtgttgcggcgcggtgagcatgtggtggtggcgctggagtcgttgccgggaacggacgaaccgagtgcgcctgagctggcggattacgcggtggcgctgggcgcgcgggccgacgagctggtgatggtggacccgctgccgggccgtggtgtggtggtgcgcgagctgcgggcggtgcgggcgccgaaggggttgtcgtcgcaggcggacacgcggctggtggagctggcggcggcgatgtcggtgcgggcggcggcgtcgccgaggtcggagctgtatccgaggtcgctggatctggtgcgggcgttgcggatgtcgcaggccgcggtgggtgtgcggcgggagacgggtatcgcgccggctgacctgttggcgaaggtgcgggcgcggttcccttcggtgtcggtggccgacgacgtcacgtatgtacggctggaggaggcgctgcgcgcggcgggcaccccgctggagtacgacacggagaagaagctcttctacccgcctgcgccggagttctcgcgcctggcgtcgtcgtcgagcaccacgcgcgacagctcgggcgggccgaggcccggcggcctggacccgcacgagctgctgcgcgacaaactggcgaggtcagtggagcagggtggtttcctggcgttgacgttgcgcggcacggccctgccgggtgcggcggaggcactggcgtcgcggtatccggtgcggccggtgcaggtggatcgcgagttcctcgcggtgtttcgcggcctggtggtggagtacgaccaggactgggagcgggtgcgcaagctggacgagcgcttcggcaggacgggcgagccgaagccgggtttccgccgggtcgtgcggctggcgtgggagcggctgcgggaccggctggtggaccaggccggggcgcgcacggtgttgctgctgcaccacgcggatctggtgggccgctacgccgacctgggcgggcgcgagttcctgacggggttgcagcaggcagcgcggtcggccgaggcgctgccgcacgggctgtgggtgctgtgtcccggtgagtcggcggaagaggcgccgcagctcgatgggttgcgggtggaggcgttgacggagtcggagcgggcggcactgggcagggagttcgtgcagggcttgcgggtgtgtgatcgggcgagctga

SEQ ID NO: 603 - DNA, 4269 bp, Bradyrhizobium sp.
gtggcgctcccggaagcacgcatccatcgcggtcgaccaactccatttccgtgggagcggcgggcgctcgacctcatctacaagcacacgtcgttgtcagacaccgatccgcatcaggcgtgggagctgcacgagctctacgatccgtcgtccggccgtctctacgagatcgacctcctcttcctctcgcggcagggcctgttcctcgtcgagatcaagagccactctggcattcttacgggtgatatcgtcgactggacgattaccgagaacgggcgccgccgtacgatcgagtgcccctaccccagcgcaaacctcaaggcgaaggtgctcggcgacctgatcgaaagacagcttggaacggatcgcccctacgttcatgccgccgtcttcctctccaacgtcaccgacgtccggctggatggtggtcgccccccatggctgctgctcccagacgatgtgggcagcaagctcgtcaacgggctgggtggccgcgacgcccggcggatcgtaaatcggccgatgatgaaggatctccttcaggctgcccacaggatcggtctccgcccgagcacgaccgcgcgcgtggtgggaggttataagctcggcttcctgcttgacgatggcgaggggtaccaagagcacctcgcgaagaatacagtcgtggagtccgaccaagcgcgcgtgcgtagctaccttgtgcctgcggcaacctcggtcgaacgtcgctcgcagcttcatcgtgccgccaagcgcgaggcgcagacgcttgcgcagatcggtcagcaccccggtatccttgcgtaccgctccttcgtcgacgacgcgccgctcggtccggcggtactcttcgaggctttcgaagactcgctcccgctccacgctttcattcgccaggagccgaacgtcaccttcgacgaccgcctcgacattctgcaacaaatcgtcgaagcggtcgctcactgccatcgctcaagcattctgcaccgcaacctgtcgcccgcctcggtgcttgtccggcggggcggcgacgggcgcatccacgtgcgccttcatcgctttcagaccgccgcgtggatcgagcattcaagcgtgggcacgcgacacttccaccagctttcgcaggacgtcgaccgcctctatcaggcgcccgaagttctggccgatcccgagaaggccacctacgagagcgatgtattctcggtcggctgcctcgcgtggttggtgctcacagggcagcacccagccgccacggtcccggagcgcgagcaacgtatcaagggcgtgaaggatggcgaaggagggttgcgcccctccgcggtgcgcgcagacctcgcgatccttgatgaagctatcgcttccgcgacgcagccgaatctccacgcgcgtgccgacgacattgccgagtggttcaacacattcgtgctcgagccgcttacaggtccggccgccgatgcgagcgccgggaccgatccccgcgaggcgcagaagggagacacgctgcaagggggcctgcgtgtcgagcgacgccttggctcgggcggtacggcgctggtgctgcacgttcgccgcgaggggcgtgacttcgcgcttaaggtcccgcacgacgcgggctgcggtgagcgcctgcttgccgaggcgaagacgctccgcgatctgcgccacgagcacatcgttgcgctacgcgacgtcgtcacactgggagggctaccgtgcctgctactcgagttcgctggtgatcgcagcctcggagatgtcctgcgcgagcagggcacgctgccactcgagctcgcgcggcggtatggagacgatcttctatcggcggttcagtacctcgaagaggccggcgtcactcaccgagacatcaagccgacgaacgtcggcttcacgagcctctcaaagaagcagagccacctgctccttctcgacttttcgctctcatcggcagacccaaccgccatcaccgcaggcaccgccgagtggcgcgatccgtggctctacctgcgcggcgcctggggggccgaggccgatcgctacgcagctgccgccgttctctattacgcgctgacggccgcccgtccggggctcccgcagggcgacgcgaccgccgagatcgtcgtcgaggcggagcgcttcgacgccgccgttcgcgaccggctgaccgcgttcttccataaggctttcgcgcgcgacgtgaatgtgcgcttcgcgagtgccgaggcgatgcgccaggcttgggtacaagcgctctcggtcgaggccgagaccgacgatggcgcgtccgctatcgctcttgatcaggtgcgcacggagacgccggtcgacgcattgccgctctcagctcgcgcacgaaacgcactcgaccgggcgggcgtctcgaccgttgcggaacttctgctgctaccgcgcaatcagctctcggtcgttcgcggcgtcggcacgcaggtcgctcgcgacatcgtcaagatcgcggacgagctgcgcgcccgcttcgaggtcgacaagcgcccggcgtttatgcccgggttcgcgcgtccgcgcttgctgctcgaggagccagaggcctgcatcgatgcgaccacggtcggccgtctcgtcgcggcgggcatcaagactactgtcgacgcggctctggcccacaccgcgcgcatcgagaagctgctcggcaaatccggcgcggacgcgctgcgtgaacggctcaccgcgcttgcggcggcggagccaacgcccggctcacttgccgactgggcgcgcgagctgatcggccgcgccagccaaagcgaggccaacaaacgcctgcgcgtgctcgtcggcctcgatccgctgcccgacgaacgccccgacaccggaatcccggcggcgcgcaccgtgtccgaggtagccggtgcgttcggtatcgatgcggcgcagatccactcgagcctccagttccagcgcaacaaacggtggacggatagtacagccgcggcttcgctgaccgaagcgctgtcgtcggccctggacgcgcttgcgcccgccgcgccattcctcgacctagcggcggcactggccaaggcgcgcaccgccggaacgccgagcggcgaagaggtgcgtatcgctgccgcgctcgtgcgggtgggcctcgagctgcgtccaaacccacctgccgtttggcgccgaatcagcggcacaccgtgggtcgctcgcgattccgaggtcctcgacgcactcgctgcgctgtcggaaacggccgacagtcttgctgctaccgagccgcttccctcctccgaggtggtgcgcagcaagctcgccgaggtcgccgagggcacgccgctcgcggctctgccggcggatcagcgccttaccctcgctgcgcgcgccagcacgaacgccgccgcctcggctcggctagagctttacccacgcaacatggatgcggcgcgcgcgctggacctgagcctagctgcgctctcgggtacaggcctgacgcccgaggttgtgatgaagcgcgtcgcggcgcgataccccgaggcggcaccgcttcctgagcgccccacgctcgacaggctgctcgcgccccacggtcttgtgttcatggcggacatcggcccgggcgagtacacgcgtccgggcgtatatgccttgacgtcgatgactgcggcggtgccttcgcgccagactacggcgcccgcgccgccgcagcggcgcagccccaatgcgcaacgcgcggcggctttccaggaccagctcgatcgcggtgtcgcagcaggccgctttcgcgtcgtgcaagtgcgcgccgatctcgcgagccgcgcgacggacgaactcgcttctgcactgagaacgacggccatctcgctggacgttgaacttttcacggcgattcgaaagaccgctgctgagctccgggtcgaatgggcaaacatcgaggcagccgaccgcgcggggccggatggccctgactggccgctgcttctggagctcgtgcgtcaggcaagcgacgtcgccatcgacactctcttaagccgccgcgagccaacactcgtcctggcatggcccggggcactcgcgcgctatgggctgtccggcgcactcgcgcgcatcgtcaacgaggcggagcgcggaaatgcccccgccatcctgcttgtggttccatcgcacgccgacggcgccgcgccttccattaatggtcgactgcccgtccccgcgccgctaccgagccaacggctcgtcatgcctgacgcgtggcttaggaatgagcacaaagctgcggagacgctctggggatga

SEQ ID NO: 604 - DNA, 4203 bp, Burkholderia thailandensis; identical to SEQ ID NO: 208

SEQ ID NO: 605 - DNA, 4218 bp, Planctomyces maris
atggccgaggcagacaactggacaaccgttactgaatcaaagttttcctgggaaagggaagcccttgactatgtgcgtagtcagtttcctaaatttgcgccctaccgcgcctggtctaatttcgaattcatcgccgatgatggaagtatcaatgaggtcgatctgcttgtcttctcgccccagggattttttctcatcgagatcaaaagcagtcccggcagactccagggcgatgcaggcacctggacctgggaacgggacggcaagcgatacccggtcgataatccgctcatcgccaccaacctcaaagccaaaaaactcagttcgctgctgcagaaacagaaggcgctcaaaaacagaggccgcctcccgttcatcgagcccctcgttttctgctcagccgccggtctgcagtgtgaattgaaaggcaatgcccgcgccaaggtctgcctccgcgatcgggaagaaccgaaacgtcccggcatcatggctgccatctcgcgccgtgaatgccccggactcgattcccatctcaaaggcacccacgatacccccatgtccaatgccgtgggacaggccctcaaccaggccggcattcgcccctcgcagaaaagtcgaaaggtcggcgactatctgctgaaacagatcatcggcgaaggtcccggctatcaggactggagtgccgaacataccgcgctggaaaattccaaacgccgcgtccgcctctatctcgttagaaatgaagcgaccccggaggatcgcgacacggttcagagagcggccctccgcgaataccagatccttgagactctcgaacatccgggcatcctgcgcgtgaataacttcaccgagcacgaactcggcccggcacttctcttcgaacacgatccgctcagcatgcgcctcgatcactttctcgccaggcagaaagatcagcttgatatcgcaactcaactcgatctcatcaggcaactcgcagaagccatgcagtacgcgcacgagaaaaaagtcgtccatcgcggcctctgtccgcaaagcatcctcgtcacatccatcaattctgagcaccctcgcctcaaggtcttcaactggcagctcagctatcgtgaaagcagtacatccacaaaagtctcccgcgccgtcagcgcgacttcccacgtcgatcgactggtagaagacgccgccaccgcttacatggctccagagatactcaccgattcccagaccagtaccggagaacacctcgatgtcttctcgctgggaaccatcgcctatcagatcttttccgggttacccccagccgccaatgccctcgaactcagcgagaaacttcgtgaaaccaaggggctgcagatcagttcggtcctgaatggcgccagtgaatggctgcaggaaatgatccgctcggctaccaacccggtcgtccctgatcgcaccggctccatcgttgatttcctggaaatgctcgacgaagtcgagaacgaactcacctcacccgatcatgaacaactcgaggacccgacccgcgcgaagattgatgatatcctccccggcggttacaaaatcctgcgcaggctcggtcacggcgcctgttccgtcgccttcctcgtcgaactcgatcagcaggactttatcctcaaagtcgccagcgaaaccaggcacaacgatcgactccgcgccgaagccgaactgctcagtcgacaggaaatgcgacacaccaacatcgtcgattttgtcgatgcggtccagctcggcaaccactttggtttcctcatgcgtcccgtctatacagaacggggcaaacgactgattgaaaccctcggccagcggctgcgtaaagatggacgactccacatcgacctgctccagcggttcggcgacgacctgctccaggtggtcaaccatcttgaagaacagggcatcccgcaccgcgatatcaaacccgataacatcgctgtcggcatggtcgggcgcggcagtaaactgcatctggttctcttcgatttctcactttcgaaaactcccgcggaaaatatccgcgccggtacgaccggctacctcgaaccactgctccccctgcgcgaaccggccccgccccgctgggacctgcacgccgaacgttatgccgccgctgtcacactctacgaactcgcgacaggcacgctccccgtctggggggatggagtcaccaccgccatctatctgccgactgacaccgaaatcaccatcgatgccgaactcttcgatctcgcgctccgcgaatccctcactgagttcttcacacaggccttccgccgcaatatcgaccagcggttcgacaacgctgaagaaatgctccgcgcctggcgcaactgctttgaaggcatcgatgaacccggagccctctccgatcacgccgatgaaaccaggctccaggaactcctcgccgacgccgaattcgaaacgcagattcccgaactcggactcggttcccgctcggcgaatgccctcgaccgcgcgaacattctgaccgtcgaagatctgctcaccgtacccatgcggcggctcatgcgtctccgcggcgtcggaaataaaacacgccgcgaaatcacgtcagccgtcaaaattctccgcgatcgtctgggcaaacccgatcgagatcccagctccctcagcgatccggaatctactcaaactgaaccggtggccgtcgaacatctcagtctcgacctgctcgtcagtcgcctcctgaataccggtgcccgcgatggtgagaatttccagcgcggcgtgcgactgctgctcggactcgatcccgcactccaggatccctggcccagccaggccgagattgcgcgagagctggacgtcacccgcgcccgtgccggtcagattgtaaccagactgcaggaccgctggagcaaagacgccgcactcacgcggctccgcgccgatctggcggaaatgctcgctgttcaatccggcgtcatgtcaatccgggaactggccgaagccctgatcgtcgcccgcggctcctcggaagaactcttgcagaaaaccgcgcacgcctgcgccgtcatccgcgcggctgtagaagttgaacgcaccatgaccgaaccccggttcctggtgcggcgtgaaaatcagagcatcctcatcgccgctcataccgagttcgctacctgggcccgcaaactgggcgtcatcgccgatcagctggccgacgaagacccgctgctcgcccccgcccgcatcctcgaacgcctgcaggaagtcacaccccccgacgatctgctcattcccgatgcccgcctcgtccgcctggcagcggaagtctctgatcacgcggccctctccagtcggcaggaactctatccgcgcaacatggatcccgtccgcgcactcaagctctcacagggcgcactgctgggacagcgaaaactgaccgtcgcccagatccaggaacgggtcgccgggcgttacccagatgccagccccctccccgatcggccgctgctcaacaacctgctcgatcaggccggcttcgatctcaaatgggaacccagcgacgaagatccccccggctgttatttcagccgacaacccaaccagatcacactcaccagcagcaatacctcccggcagcggcgctcctcgctccccagcgatccgggtgagatcactcccgaactggccgacgcccgtcagtttgaagaacgcctgcagcgcaatctgcaggaaggttcgtttctgacactgctcgtcgggccccgcgagttcgagaccgccctcgccgaactcacccgtcgcttcccgctggaactggtcgacctcgaaggcctgctcatcgaggccctcagggaaaccgcctcccaggccggcgtcaactgggaactggtcctgcagaccgatgcccgcccgcagagcggcgactgggacaaactcaagctgctcgtcaaccgggctgtgcctgtggtggaacagaaacttaaacacgccgacaaaaccatgctgatgatctaccccggcctgctcgcccgctacgatcagatggaactgctcagccagctctcacaacaggtcggtcggcccaacggcatccacggactctggctcctgctccccggcgacagccaggccctcatcgacggcaaaccggtccctttaatcggccccggtcaacgtacccgtatcccccgcagctggttaaagaatattcaccgggaggacgcatcatga

SEQ ID NO: 606 - DNA, 4674 bp, Streptomyces gancidicus
atgcgggaaggccggtgggtcacggtcaccgagtccgagttcgagcacgaacgccgcggcctggaggcgatccgggagaagctgccggactccgacccctggcgtgcctggtcgaacttcaccttcactgccaacaccggccacgtccgcgaggtagacctgctggtcgtcgcccccggcggcctgtgcatgatcgagctcaaggactggcacggctcggtcacctccgagaacggcacctgggtccagaccacgcccagcgggcaccgccgcacgcacggcaacccgctccacctggtcaaccgcaaggccaaggagctggccggcctgctcgcccagaccggcgccaagcgggtctgggtcgccgaggccgtctgcttcaccgacaacagcctccgcgtccggctgcccgcccacgaccagaacggcgtctacaccgtcgacgagctggtcgagatgctcaagcagcccccgcgcgacgagcgccgccgcgtcaccgcgatcggctcgcgcgaggtcgcggcggcactgaagaacatcggcatccgcaagagcgacgcccagtacaaagtcggcccgtacgaactggaacggaagtccttcgactccggccccacctgggcggactacctggcccgccacagcgacctgcccgaggccgcgcgcgtgcggatctacctcagcgagcgcggctccgacgcatccctgcgccagtccgtggagaacgccgcccggcgcgaggccgcggtactgggccgcttcaagcatcccggcgtcgtccagctcaagcagtacttcccctccgggcacgccgccggccccgcgctgatcttcgactaccacccggacaccctgaagctggacgagtacctggtccggtacggcgagaagctggacatcctcggccggatggcactggtgcgccagctcgccgagacgatgcgctccgcgcacgccagccgcatccaccaccgcgcgctcgccgcccgctccgtccacgtcgtcccccgcccgcgcggccggaaggggcaggccgtcggggaggaggccgcctggctgaccccgcagctgcagatctccgactggcagatcgccacccagcgcagcggcgactcctcgcagggccagggcatgacccggttcgcgccgaccgccctgtccgccatgcacctgagcgacgacgccgacgcctacctcgcgccggagctcaccgccctcagccccgacccggtctacctcgacgtgtacgggctcggcgtcctcacctacctgctggtcaccggcaaggccccggccgccagccaggccgagctgctggcccgcctggaggcgggtgagggcctgcgccccagctccctggtggacggcctctccgaggacgtggacgagctggtgcaggccgccaccgcctaccgccccggccagcgcctctccagcgtcgacgagttcttggaactgctggaggtcgtcgaggactccctcaccgcccccgccgcggccctcgacgggcacgccgaggaggagaccggggagaacgccgacaaggaccccctggaggccgtcgccggtgacgtgctcgccggccggtgggaggtccgccgccgtctcggcaccggctccaccagccgcgccttcctcgtccgggacctggaggcggagacccgcaggacgcgcccgctggccgtgctgaaggtcgccctctccgacagccgcggcgagatcctcgtccacgaggccgaggccatgcgccgcctgcgcccccactccggcatcatccgcctcgtcgagcccgagccgctacacatcgccggccgcaccgtcctggcactggagtacgtcggcgacgagcgcgacgacgccggccagagcgccgagggcgcatcccgcccgcgccgccgcgaggagaccgtcgcccgccagctccgcgagcacggccgcctcccggtcgaccagctcgaggcgtacggcgactacctcttcggcgccgtcgacttccttgagggcgagggcgtctggcaccgcgacatcaagccggacaacatcgccgtccgcatccgccccaaccgcacccgcgagctggtcctcatcgacttctcgctggccggctacccggcgaagaacaccgacgcgggcaccgagggctacctcgaccccttcgtcgacgtcatcacacgcggctcttacgactcgcacgccgagcggtacgccgtcgccgtcaccctgcaccagatggcctccggtgagctgccgaaatggggcgacggcagcgtcctgccgcgcatgaccgacccgaaggagtggccgtacccgaccatcgcggccgaggccttcgacccggccgtgcgggacgggctcgtcgccttcttccagaaggccctgcaccgcgacgcgggcaagcggttccccgagctgaagccgatgcgggacgcctggcgcaaggtcttcctcgacgcctcgcagaccgtcccctccagccaccgcacccgccccacggccccctccgaggggaccgcccccgccgagggcgccgccgccgggatcgcggacgccgagccggagaccgccgagcagcagcgcgaccgcctcgccgccgaggtcacccgcgacaccccgctgaccgtctccggcctcacgcccgccgcccagtccttcctctacggcctgggcctcaccacggtcggcgaactcctcgactacagccgccgcaagctcgtcaacgcccccggcctcggcgccaagacccgcaacgaggtccagcagcggcagcgggaatggggcgagcggctgcgtgagatccccgtctcgccgctcacgccgaagggccgggcggaggcgaaggaggagctggaacagctcaccgctgccgagtccgccctcgtcgggcagctcgcgacgggcgagtcggcgggcgcactgtccgcccgcacgctgcgctcggtcagcctcgacaccctcgccaccgtcttcgtgccagccgtcaacaacaacggctccaaccgcaacaaggcggagatggtgcggctcctgctgcgcctgcccgacgagcacggtgttctgccggacatcggagtctggccgaagcagaaggacgtcgccgacgcgctcggcctcagccacggccgcatcccgcagatgctcaaggacgagcgcaagcgctggaaggcggagcccgccgtccaggcactgcgcgacgagatcatcgacctgctggagagcatgggccgcgtcgcctccgccgtggagatcgccgacgccctcgccgtccggcgcggcacgcacctcgccgggcgcgagcagcggcgcgcgatggccctggcggcggtgcgggccgtcgtcgaggtcgagcaactggtaccgcaggaggccgagttccagcaccagccgaaccgcaaggcgaccgacgagtcgctgggcgccggcctgctcgccctcgatgtccgcgagaacgaggccccggacaccccgaccgcgcccggcctgctcgactacgcgacccgcctcggcaggaccgccgaccggctcgcccggctggacaccctgccgacggccgcgaccgtcctggccgaactgggcgcgctgacggtcccgcccggcgccgtcgactgggacgagcggcgcatggtggaactggccgccgccgcttcggtgaacgccgccgccaccccacgcctggagatctacccgcgcgacctgtccctcgtccgggcgctgcggctcacccaggccggactcgtccgctggatcccgggggtcccggagggccggcagcccggcctgatcggcgaggacgtgcacgagcgggttcgggtccgcttccccgagctggtcgtcccggacgggcgcggcggcacgacccacgaactgccgaccggtggcccgcttaccaaggcgctgcgcgacgcgggcttcgagctctcgctgagcatgcgcgaggacacgggcacgctccgctacctgccgacccgggtggaggacgcctccagctacctcacgacgggcgcgtggcggcagtcgacgcgcacgggcacggtgacgcggtacgcggacgacccgcagctcgcgggcgcggtgcgcgcggaggaacggctgctcgcctcggcctgccgggacgggtaccgggtgctgaccgtgcggcagcagctggtgcgggacgcggtacgggaactgagtgccgaacggctgggcgcgcgggcggtgtcggtgaccgagctgttcctggaggccctgcacgggcaggtcacgccgggcaccaagccgacctgggagaccctgctcaaggcagacgccgccgagccgggctcgaagggcgcggtgcggttcgcggagtacgcgcgcacggcgtgggggtcggtcgagccccggatcgccgagctgctgggcaacggtggcggcggtgcggggccggtcctgctgacggaggccggggtgttcgcccggtacgacgcgatgggcgtcctggaccggctggcgtcggcggcccggcggggcgggcgggggctgtggctcctggtcccgcagaacgacccctcgcgcgagccccggctcgggcaggtggccgtgccgtaccaggccggcctgggggagtggatccagcttccggacacatgggtgggcaacgcccaccgcgggtccggcgaggttgtggcaagtggtgtcaagggagacgcgaagtga

SEQ ID NO: 607 - DNA, 4110 bp, Gordonia amicalis
gtggcacagggtgaggaccgttggattgaggtctcgaagtccgctttctcccacgaagccgagggactgaagtttcttcacgatcttgtaccgaatgcttcgccctaccgtgcgtggacgaacttcgagttcatggacaaccatggacagtggcatgagattgacgccctgatccttggccgccgccggctacacctggttgagctgaaggcgtacaccggcgtcctccaggggtcagagacgagctgggtgatcacatcgctcggtggccgctcgcgtacccagcgttcgccgctgctggtcactcgccgcaaagcgcagcgcctggcgtcaagaatcgaggaagaggctcgcaaagtcgcgttgagtgcggggcttgatgctgagaaagttcgccgagcccttccgttcgtgcaggaatccgtgttcctccacggagaccagtttcacgccgatatgccggacttggccaagtccagcctcttcgggatggatggccgcgaagaccagaccggccttcctggcatttcaacccgcctactcgaacccccgagcgacagtcgccgcgtcgatgaagacctcagtgtcatcatcgccctcgccttgcagaacctggggatcgcgcggcgtaccgagcgcgacgccggttcgtggaccatcaccggaaagcccctggcgaacggaatcgactggcaggagtggtccgccaagcacaaggcgaccgggacagaaggccgcgcccgcatagtgtcgctccgtcctggcactccggcgcaggcccgcgccgcagcgcatcggcggatgcaacgagagttctctctactgagctctctgcgccacgaatcgatcgtcgcgccgcgagacctggtacaggacgacgacggcaacactgtcctgatcttccccgacctgcccgaatacgaacagctcgacctcgcactcgccacgcgcgaactcaccgccgagcagcaaatccaggtcctcacggaagtctccgaggcgctcgcgtacgcccaccgcaaccaggtggcgcaccgcggcctgagtcccagcacggtgctgatcaatacgcatgctctcgacgagggcggcacggttcgcatcaggctggccgactggtcatgggcaggtcgcgtccactcccctggcacccagtcatcgaccatgctcggaacgcccgaccagcccggtacggcggtcgaagacgtctatcaagcccccgaggacagatgggcgtccgacgccgaccgcctggcgttggacgtgttctccctcggagctctcgcgtactacctcctctctggtgggcaggcgccggccagcaaccgggcagagttgctggaacgactgcgacaggaacaaggtctcgaccttgcagcgtctggcggccggtttgtcgacgagaatcttcgggctttggtgctccgttccacatgtccatcggtctccaagcgggtggccgctgacagaaagaccggtgtcccgagtttcggcgcgcatcagttcgcggccgaattatccgactaccgtcgcgaccggctcgagccggccacgcagcatgttgatccactcaaccccgcacccggctcgctgatcgcggaccgcttcgaggtaatccgggtacttggcgtcgggtccactgcccgcggggtgctggtcaccgacaggaacgacgacgacgccgttcgggtgttgaaggtgggtctcgacgatagcgcggcggcgcgtctccacgatgaagcccaggtgttgaccgaactcgcccggcacactccacgggtgcccggagttgtggaactgatcgacggaccactcgacttgtctggacgcaaggcgttgctgctcaccaattgtggcgagcagacgttgtctgacctggttcgacacacgccactgaccgaatcgcgtttgcggacctgggggctcgagttactggacatcgtggtggcgctcgactcgatcggtatctcgcaccgtgacatcaaaccagccaatctgggtctggcccgcgttgacggccggactaaggcagcgcggagaacacggctcgccctattcgacttctcgttgtcacgagcagatgtttcgcagatcgaggccggaacgccgccgtatcgggatccgttcttaggcataggcattcgaaccacattcgactcggcggccgaaaggtattcggcggccgtggtgctttacgaaatggccacctcgtccactcccgtgtatggcgacggaatgagcgacccacgggtactcaacgacgacgtcaccgtgaccgccgaagacttcaccgccgccggattgagtcggagtcgcgccgaagcattggtcgcgttcttccggacggcgcttacacggaatgcaaaagaccgtttcgataccgccgccgcgatgcgcgcggcctgggcgtctgcattccaggttaaagccgccggcgagcacccctcagctcctgcaccgattgaccccattgcgaaacctgctgcgccacagcccgtagcgcgcacctacgactcactggacactctcgcaaccgagtttgcaaaagccgctggcaacaagccgtccgtgatgcgtcgacaggtcgttgaactggtactcggcacccacgagcgcagtcccgccgacccgttcattacctatccagcactggctgcgctcgcgggggtcacatctggtcgcattgcacagatcttcggagagttttctgatctctgggcgaagaatgaccgattggcagctaccgccgccgacctctaccggcgcggactcaccctgctcgaggcatcaggcggtgcttcgacacccgaactcctggcacgcgaactcgcaggatccctgaacaccgagtccgtggcggatccacagcgcaccgcgcttggtgttttgcgcttgctgctgtcctccaggccaggtaccgagtatcaagaccgttcctcgaccgacaccgcagtgcagatggtgcgccgccacggctcgggcacggttgccatgatcgcgaccgtcgctgtcccccgtcgactgccggccgtgctcgcatccgctgccgagacattggtcgattccgctctcgcgcaaggcacgctgctggtcatgccggacgacgccaagaatcaattgcgatcggccgcagctgccgttctcgatctcgacggcgccgatgtcgagataccggggcacgcgctgctccgcatagcagcggtcgcgtccaccgaagttgcgctgtcatcgcgtgacgagcttcatgcagcatcactacctgtcgatggggctttacgaatactcctgcgtggtctttcaactgccgattcgttcggccgctccgagttggaatcgcgttggtctgcacgattccccgcgctcacgcaactgctgccgcgcagacccgatctcgacgggttgatcgaatcggtggtcccaggcatgacatgggacgacgcgtctgcgcggtatcgattcgccgacgcaccacgtacaggaacgaacatccccacccgtacgaccctgaccaccgctcacccggtgccaaccaccggcacgtccgacgtcgaatacatactcgcagcaagtgcacgcgagcgtacgttccgtgcacttggtgtgccactcgggtattccgacgtggtcgcccaagcgctcgtcgaacacttcggtgctacgcacatcgatgtcaccgagcttctgctcggcgagctgaagcagcgtgcctcctccgcaggattagcttgggaggccatccttgctgccgatgccggtgccgccgcagaccgcgatggcctcaaagggttcgttgcccaggcgctcccaacgctggtctccgccgtcgatcacgccggtggccccgtggtgctcaccgatctgtccactctcgccgcatatggccagttgagcgtcctccataagtggctggatctcacggccccaccgaaatatgcagtgtgggcactggttccacagcctgaagaggccggcggcccgcccggggcgagagtcgacggcacggcacttctcccgaacagcccagaacaatttgtgcaagtgaacaaggacgagatcaaggctctgattgccgcagtccgttccaacgaccaagtgaaggaacacatctga

SEQ ID NO: 608 - DNA, 4158 bp, Mycobacterium intracellulare
atgcaacctaatggtgagcgctggcacgtcgtcaccgactcggagcatccacatgagaaagaagggctcgaacacgttcgcgaacttctccctgaccgcagtcccttccacgcgtggagcaacttcgagttcgtcgacagcaatggcacgtggtctgaggtcgacctgctcgttctaggcgagggtgcgctctacctcgtcgaattaaagcattatcagggtgacatcagcggcaacgcctaccgctggcaactctctcaccgctcggaagactcaccgctcaagaagaccgcgatgaaagcgcgacgccttgccggagtgttgaagaacgccgcggtcaacatgggacttgatgcgaggaccatcccgttcgtgaagcccgcggtcttcctccattctcagacgacccgatgcctgctctcgggcgccgataagaatgatctctacggcctcgacggccgcgagcagcagaccaacctgccgagcatcgctgagctgcttctcgaaccgccgaggcgagaatccgtcaacgagcgagacttcctacgcgttatcgagcacgcgggatttgctcttcgacgcgaacgggagatcggttcttggcgcctgatcggccaagcgctcgatgaagatgacgactggcaggactggcccgccgaacatcgcgtcacccgcaaactggctcgcattcgcttcttcactaccccgcagggtgcatcaaaggcacaagtagcgggtgcgcggcggcttgctgaacgggagtatgggctgacttcacgattgcatcatccgggcatactggcgccgcaggacattgttgaggacgagctaggtcgtggcctcgtctttccatatgaccccgatgaccaacggcttgatctctggctcgcggacaatggagagaagctcgaccttcgagcacaaatggacctcgtgcgccaactcgctgaatcagtccagtacgcccacagcaacggcatcgtccaccggggcctaaacccatcagccgtcgtcgtccacgacgatgggccaccgcggacacttatcggcgggtggagcgttgccggcgccgccgagggcgctagccctagcgtgatcgagacacaaggcagtgcgacccgcatctttggtctgctcgaagcgcgcaaaggtgaaacgaatcgagtggccggcgcttatgtggcacccgaaggacagtggcgacccgatgctaaccggtcccgcctcgatgttttcgcacttggctcactgacctatctactggtcgcgggtcacgaccctgcgaccagcgccgtcgagctgaagcagaggctagagcgcgagcacgggctggatctcgccgcagaccttccgcaagtccctgagtcactccgtgggctcgtactcgcggctacaaatccggtggtaagcgaccggcttcgcgatgtcaacgccttcctggagatgttgagccgcgtcgagcgcgagttgggaaccagcaacgaggacacggacattgacccgctcgacgcgccgcccggcacattgatcggtggcaggtttgaactggtacgacgactcggttccggttcaacggctgttgggctcctggtgcgagacgccgaagcagacggtgaagcgcgagtcctcaaagttgctatagatgacaacgccgccaagcgactcgatgcagaagttcaggtgttggccgctctgaccggtcgcaagcacccacgcatcattcgcatcgtcgagacggttcccgtcaaagttggagaccggaaggccctcctccttgagtccgcgggagaggaaaccctcgctgacgtactgcgcgaccgcagacggctttcgctggatcttcttgaccggtggggtacggatcttctggaagcgctggtatccctcgacgaggcaggcgtcgaccaccgcgacatcaagccgtcgaacttgggagtccgtgaacagaagagtgaccgcgccaagcacctggttctgttcgacttctctctcgcaaaggcgagcgcagccacgatcagcgccggcacccctccgtacctcgacccattcctgggttctggcacacggctccattgggactccgccgcagagcgatacgccgccgcagtgaccctgttcgagatggctaccgggcacgccccgatctacggcgacggcgagaccgctcctcagttcgtcgagcgggccacgatcgagcctggggacttcgacccagcaatcgccgacgcaatggtccaattcttcgagagggcgctggccaaggaagtcaagcatcgccatgacaccgcatccgacatgttgacggagtggcgcagtgccctcgcaggatcagttgcgaccacgccagcggttgccgacgaagcggcggaacgagcaacgccggagactcctctgcaggagtcgggtctcaccccacgcgcgcttagcgcactcgaaccattccgacttaagactgtcggcgacctcgcggctattgacacaagcagactgagcaggttcacagggatcgttgacgcaaccaagcgagagattcgcggccgggccaaacaatggcgcgagaagttcggaagccaattgctcccgagcccggtgcccgcggaagacattaaccccgccgacccatttacatcgccccagacggccgcggccttgctcgtcgaatccgcgggaacgccccgggctcaggcgcggcgaactgccgccgcggtgcttctcggcttggaaggcgatgtcgctccgtttgcagtccttgccgatcacgcaaatgctctggggcttggcggccaggcacaggcatcgatggcactcgccagcctccgcgatgcctgggcaaagtcgccgcaagccgcgggattactcgacggcgtcttcgatcgtgtgctcggggtcctggaaggcctcgatggagccgcttggacggagtcgattgtggatgcgcttgcgccgacgagcgcgagcgtatccgaccgacggcttatcgccggcatggttcgcgcggccttagaccgggctgaagataaggcaaagggtgcggacgaagagtcaccgattgcgcgacgtcggcgtcggaaggacaaccgactgttgctcgcgcgaactacggaggtcgcggatttggcccaaactctcggtgctcgcgcgactcagctagtcaacgaatctgcgagcgcaggcgagttcgtggtaccccgtggcaggtccgtcccggcctttcgccaactatggaccagtaatcttcccgcactggacgacacacggcttgtacgcctagcagcgcgcctctccgatggcgtagcggcgtctgcgagcggagagctctactcgacgagtatgccggtggtgattgccgtgcggcttgcgcttggttcgaccatgccgtcgcagcgcttctccgctgaggaagtcagacggttagttcaggttcgtttgcctggagtagccgacgtgccgggcaggcccggcctcgaccgggtattggcagaagcgggcactggtctcacgtgggatggggaggcttactcggtgccctcggcgcattcagacacgacgttcttgacacagacgtcgttgccggtaatcccaattcgacttgaaagccaaagccatccgacggaccggctcctgcgtgaaagcatctcggctcgttcgttcctcgcactgggtatccccgcgaagcatgctccttggatcgccgccgggctcattaccgccttccatgcttttgaggtcaatatcacggacgtgcttcttcagtccctcaaggagagcggagaggcggcggggctgccgtgggacgcggttcttgcagccgatgccgcagctccagaatcagtcgatgcccgcggcttggctgcgctcgtggaacagagcattcccggcattgacgccgcgatcgccggcgcactctcaggggcgccgggactagaccgccctgtcgtgatcaccgaggctgcgccgttggctcgctacggacacatgtccgtactgagcaagttggctgacatagccacgaagcgagaccaggcagtttggctcgtggttcctgaggagggaggcggtggaccgctccttgatcgagttcctataccactgacttactcgtcccagtttgttcgcgttgacgatttgttcgtcgccagtgaaggagatcagcgatga

SEQ ID NO: 609 - DNA, 4149 bp, Phaeospirillum molischianum
atggttatgtcggcgcaacgctggtcggctatcgccgaatcggaattcaaatgggagcaagacgcgctggcgtttctgcgcgaccatcttccagatattgatccttggcacgtttggtcgaatttcgagttcatcgacgaccaggggcgggtcaatgaagttgatgccttggtcctctcgccgagaggactgttcctggttgaaatcaagagccgtccaggccgggttgaaggagatgcccatagctggacctgggtgcaagatggccgtaccagtacgtatgacaatccttatttactcgccaaccgaaaggctaaacgtctaaagagccttctcgatcgccaagacgcgttccgacgggcgcggttgcccgttccttttgtcactgctgctatcttcttgtcatcgccgactaacgatatttccgcgctaccactcttcgttgccaccaatgtgttcaatcgcggacggccggggactgtgcatgatgagggcatcatcgctgcgttgaccggcttggtcggtcccggtcgggagcgcaatcctaacggtgaccccgcagtcaggcgaacgatgaaatcggccatggagacagcggggatccgccgttcgctccgccaacgccgcattggcgattacgagttggagcggctgatcgaggaaggggacgattttcaggatttccaaggccatcatgtcgcagccgatgttcgccgccgcatccgcattttccaaacgcctccgggacgctcgcgcgacgacgtgttcaaggcggtggcgcgcgagtttcaaattctagaggggatcagtcaccccggcatcctgcgcgccagcgattttaaggataccgagcgcggtcccgcactggtctttgatttcgaccccaaggcagttcgcctggatttcgtcctgaaagagaaggctctggttgatcggctggacgttgatcaacgcctgcatcttgtccgccaactagccgagacgatccgttacgcccacgataagcggctcacccaccgcgccctagtgccgcagaatgtcctggtccgcgatgtcgcggagcggtttcctcggttacaggtgatgaactggcagttggcaacccgcgaagccggcagcaccggcggcacgctgcaacagaccctgggtacgatccatccgggagaccatgttgatgatccggccaaggtctacatggcaccggaagcgcttcagcatgccagcccaccgattctggccgacattttttcgctgggcgcgatcgcctatcacattttctccggccagccgccggccggttcgacagtggaattggtcaacaagctgcgccaggggcagggtcttatggtggccgacgtcatggacggcgcttcggctgcgctggtcgaccttatccgccaagccacccatcccgacgtcagccgccgtctcgattctgtcgaagagtttctggccatgctggccaaggttgaggatgccgccgccggacaagccgacgagcaagtcatcgatccggcgcaggccaaggccggggatcggctcgacgggggcttcaccgtcattcgccgcctggggcggggaagttccgccgacgcgttgctggtcaatagcgacgggtccgacgagcaactggtgctgaaagtggcgatcgactccgcctacgccgacaggctgggggccgagggcgagatcattgctcgcctgaatcaccagagcatcgtgcgtcaccgccaaactttgagcatttcgggtcgcacagccttgctgatggaattggctggagacgaaacattggctgtccggttgcgccggggcgagcggccttccctcgatctcgcccgtcgctggggtgaggatctcatttccgccatcgattacctcgatgagcagggcatcgcccaccgcgacatcaagcccgacaacatcggcatccgctcgaaccgcaagaacaccctgcatcttgtgctgttcgatttttccctgtcgaaaggatcgctcgacaacatccgcgccggaacccgaccctatctggacccctttctcagcctgcggcgtccgccacgctgggatctgcacgccgagcgctttgccgtggccatcaccctctacgagatgctgaccggcagcatccccatctggggcgacggcgcttccgaaccggcggtgctcgattgtgaagcgaccctggagcccgagcgcttcgatccacaagtgcgcgatggcatggtggcgttcttcgcccgtgcgctccgccgttcgccgctcgagcgttttgataatgccgaggaaatgctgaaggtctggcgccaagtgttcgaggacatgcgcacgcccgtggtcagcgatgagtcctttgataccattgcccggcgggtcactgtccagacaccggtggcggaacttgggctaggtgtggaggcgctcgatgtgctcacccgcatgggagtcgaaaccgtccgccagcttctgggggtgtctcgcctcaagctccgttatctcagcggcgtcggcgatcgcatccgcaaggaaattcgcctcaaggccaagcggttggcccatctacggccggagctggttcccggtggaaccaccagccaggacgaagcgccctcgctggctggcagcatcgaccatctggccgcctcgctgctgccgaagcggccggccggagaggaccgcgccgaggatcaagcggtctccacttatctcgggctcgaagaagcgtccgagccgtggcttggcgtcggcgcggtggccggccggaccggattgtcacgggtggcgttggccgagagtctgcgtcaggcccgcagtcggtggcgggacaaggcccctctggccaaagtccgagacgatttgctccgcctgctcgagcaagagggcaaagccgtcacagctatcgaggccgcccgcgccctgttgctccagcgaggctctttgataaccgacgacagggagcgcatgcgattggcccaagccgtcgtgcgggcggcggtcgatgccgaagagatgggagccgaaccgcgattccgctgggtttccactcctacggtgccgctgatcgccagtgacaccgtcatcgcgtccgctgccgtggccttgggagaggccgccgatgaactcgccagcctcgatcccttggcctcgccacaacgcgtgcgcgagcgtttggttgagggtgccggccccgatctgctggccgtcgcggcgccgcagcgcttggtgcgtctggccgtcgccctgtcggcgcgcgccgcactatcgacgcggcaggaaatctacccacgcggcatgcccgcggatcaggcgattcgtcttgccctgagttcgttggtcgggcccgccatgttgacgagggaccagatctgggagcgtgtccacagccgctatccggaatcccaacccctgccggaccggcccgccctggattccttgttgcgcgcggccggagccgagttggactggcgtgaggcgagtgccaacggccccgccggttattggcggcgaaccatgggctttgatccgtccggttctgcccagacccaatcgcgtctgggcaccttcgccccaccggatgaagagagtccggacttggcagacgcccgtaaattcgaggaaaagctggtgcgcgtcgtggcggacggcggattcctggccctggccctggcgccacgccgggcgctggcggtggcgcgggaactggagcagcgattcggcatgatccgcttcagcatcgatgccctgctgttgagggcaatgaaggcgaccgctgaaaccaacgaggtcgattggctgatcgtgcgcgaaaccgatgccgccggtcccaccacggccgaatggcagcacctcaaaacgctcgccgacatggcttggccccaggttgaagccgttctccgtgccgcatcaggtccggtgctgctgaccgatgccggcctgatcgggcgctacgatcttgtttcccgcctggacgtccttcgcggagattgcgccacagccacaggaccgaccggcatggtggtgctggtgccgatgatgcagcccggcatgccggccatcgagggcaagccggtgccggtgatgccggcgcaatgggcgatggtgccggaggcgtgggtggagaatcgtcatcgggcggggcgggccgcgtga

SEQ ID NO: 610 - DNA, 624 bp, Nitrococcus mobilis
gtgcatccgtctgcgtttccgcacgagcaggaggcgctggacaccttgcgtgcgcaattgcccgagacgccgccgtttcgggcctggtccaacttcgagtttatcgccgcggacggcagcatcaacgaagtcgatgcgctggtggtgtccaccgaccgcgtctatctgatcgagatcaaaagctggcgcgggcagattacgggcaaccagaacacctggctggtcacccaggccgatggccgccagcgttacgaggaaaacccgctgctgctggccaaccgtaaagccaagaagctgaagtcgctactcgcccgccagctccccttcaagaaagccgcggtgccctatcccaagtttaacgtccccaaaaataacttcgcgatactcagagagttaagatcggccgcggcggcgagtggcactacattacgttcattttataaatcagcgggctcacacgattgttttctgcacgccgcccggggcgggatcggccccgagggcctgatagattcgcgcctgatcgggctcggcgcgggtggccttgcgcacgtgcagggtgcggccatcgccgcggttgaacgtggcggtgacccggcactggccggcgagggtatcgcgtag

SEQ ID NO: 611 - DNA, 3852 bp, Nitrococcus mobilis
atgggctatgttcaggcggcggtgttcctgtccttacccgagtgcagcctggcgctggacgagatcgccggtcagcacgtctatttgcgtccggatgccgaccgcaaaggtcagttcagtgttgctgatttgattcgcggccgggccaccgaggccgaaggccgcccaccgttaagccgcgccgtcgagcgcgcattgagtcgtgcaatggagcagctcggcttgcgcaagcgcacccgcgccgccgcgcacgccggcgactacctgctcacccgcctgatccacgaaaacgatcgctatcaggactgggaagcccgccatgcgcgggtcgagagcgatcgcaaacgcgtccgcatcttcccgtacgcgaaacaggcacccgctgcggaccaacgcgaacgcaaggacatcgccgcacgcgagtacgagttgctgcgcgaggtgcgccacgaccacatccttgcacccattcagctcacgcaaagcgatatcggtccggcgctgatctaccattatcaacccgacgcacagcgtctggaccacctgctggaagccgccagtacttcgctcgatgtgggccagcggttggatctggtgcgtcagattgccgaagcgctgggctacgcgcatcagcgcggcgtttaccaccgcgcgctcagcccgtgggcggtcgaagtgattgcgcgccccgatggccagctagcgccgcggttgcgcgactggcaaagcggtgcctccgatcggcaaacccagaccgctacccgcatgacggtgcatatcggcgagctcagcggggtcatcggcagcgcccaggccaccgtgtacgcgccgcccgaggtcatcagcggtcacggctacgacgcggctagcatcgacatgttctcgctgggcgcgttgagctacgccatcttcagcggccagcacccggccaccgattccgagtacatgctggacaagtgccgtagcggaccgggcctgctgatctccgaggtgctcgacggcgccccggacagtctgcagatgttgatccagtgcgccaccgatcccgacccggcgggtcgccccgccgacgtccgcgagtttctgacgctgctcgacgatgtcgagaacgagctgactacacccgataccgaaaccggtgtgccagccgccgatgccagcgccgacgactggctcagccgtgggttgaccggtggttttaaggtcctcacccggctgggcagcggctccacatgttacgcgctggcggtggaacgcgatgacggccagcgtggcgtgctcaaggtggccaaagagccctcgctcaacgagcgcctgcgcagcgaagccgacgccctgcgcgagctgcgccatcccaacatcgtcaaatacctgggcctggaggagatcgacggttgcaccgcgatcttcatggagcaggccggtgaacagaccctgggtcagcgcttgcgccgctacggtgtgctgtcgctggatctgctggagcgcttcggcgaggaactcctcaacacgctggtgtatctggagcgcagcggcatcaaccaccgcgacatcaagcccgagaacatcggcatcggcaccaaccgcaagcgcgcgctgactctgaagctgttcgatttttcgctctcgcgcgcaccgctcgacaacatccgcgccggcacgccaccttatctcgacccgtttctgtgccagcgccggccgccgcgctgggatctgcatgccgagcgcttcgccgccggcataaccttgcacgagctggccaccggcgcgctgcccacctggggcagcgccgggcaagatccggccagcaccgaccacgaactccgcctcgaagtcgaagcgctcgacccggcgatccgcgatgccctcgcggccttcttccgcaaggttctgcatcgcgactaccgcaaacgcttcgacaatgccgacgagatgtacctggcgtggcgcaatgtatttcggcacatcgaccggaccacccacgacgacaccgacgacggcagcaccactatcgatttgaccgccatcgaggagctgggccatgccaccgagctggcgcggctcggcctgagcgcgcggttgctcaacgcggccgaacgcatcggcgccactacggtgggcgagctgctcgacctgcccggcatgcgcatgtaccgcaaccgcggcatcggccagcagctcacccggcgcctgcgcgagctgcgcgagcaattggcccgacatctcggcagtccggtccccgggccgatggatgacgcgccggaccactacagcatcgaccgcctgctaaagagcctggaagcgatcaagctcgacgagcaccaggccgacatcgtcggcgcctggctggggcacaacggggacagcggcgcgccggccgccgagctgcccagcctgcgcgaagtggccgaggcctgcggcgccagccgaggtgcggtgcaggacaccatcgacaaggcggtcgagaagtggtccaggaatgcctggatgaccgccctgcgggacgaggcggccgagttcctgctgcgccgtgaaggtatcgtcaccgtgccggagctggccaagcatttgctcagcaagcacggctccaccgccaccggtgacccacgtctgcgccaaaccgctgcggtggtccaggccctgctggaagccgaggcccagcgcgagtcggcgcgcttcgtgctatcacgcagccatgcaccgctgctgatcatcgcgaccagtagactcggtcaggccttcgccgccgcaaccggcgaacgcgccgaatacgtcaaggcgctggccgcccaggcgcatcggttggcgcacgaagagccactgcccaccgaacgccgtatccatgcaacgctggccgcgctcgccgcacccgcggcagaccaaccgctgtcgccggatcgccgcctgcgccttgccgtggccgccgcccccgctgttgcgctctccggccgtctggaactttatcccgagggcatggccgccgagcgcgccctgcgcctgggtaccaacagcctgctgggcgcatcgcgcctgagcgtggcgcagctgcacgagcgcatccgcagccgcttcggcaaggccgaacccctgccccagcgaccggagctcgatcacttgctacagagcatcgagttcccgctgttatggcacgaagcaaccgatgaactacccgccggctacgccatgccggtgcacggcagcggcctgacccggcacaccagcaccctgcgccgccgcaccaccgcccagcaggcggattccgacagcccgcaggcgcggcaggcgcagcgcttcgaggacaccgtccagcgtgcggtggccgagcgccgcgtgctgatcgtcacctgtccgctgcgccacatcgggcaggccgccgacgagctggcgcgcacgctcgccctcgaccggctcagcctggagcgcctgctgatcgacagcctgcgtacccaggcgcggcaggtcggcgccgactggcgcgtggtgctgcaggccgacgccgccgcgcgcgaatcggttgactggcgccgcctcaacacgctggtgcaacgcgccatacccaaggtcaagcaacagttgttggaccacccgcgcccgctgctggtgcagcacctgggcttgctggtgcgctacggccagattggcttgatccaggcgctgcgcgacacggcactgacctcgcccatgccggcgcgcctgctgctggtgccgggcgatgcgcaccaggcgccgctgctggacggccgcacgctgccggttattaccccggccgactggacccacctgccgcgcccctggctggagaaccgccaccgcgccgcaaaaccatcaccgatagagaagaaccacgcgtga

SEQ ID NO: 612 - DNA, 4827 bp, Frankia sp.
atgcgtgacgggctgggccggtgggagacggtcacgccgtcgcagttccctcatgagcgggaggcactggagcacgtccggctcctgctgccggacgccgaaccgttccgcgcctggtcgaacttcaccttcaccgcgaccaccgggcacatccgcgaggtcgacctgctggtcgtcgcccgcggtggtgtctacctcatcgagatcaagagcctcgtcgggcggctgaccgcgtcgggttcgacctggacccagcaccgggcgtccgggtccacccgcatcttcgacaacccgctgcacctggcgaaccagaagtccagggagctgcgctccctgctccaggtggccgcccaggcgagccggacgaagattcccttcattcagccggcggtcttcctgtcgaatccgacgctgcgggtcgaccttcccgaccaccacctcccctgggtcttcggccccgagcgggccgccgcggtcaaccccggtggcgctggtggggccggtggtggcgctggtggcgcgggcatcgtcggaaacgccggcggtgccggcggagcgggcgggcgcggcacgatgctgccgtcactctggaccgggctgctggacgtcccgctgcgtgacgagcggcagcggatcaccccggcgctgtcgaaggagctggccaggctgctgcccgcggtcggcatcgcgcgcagccggcgccatcagcaggtgggctcgtggcagctggagttcccggccttcgactccggcctgacctggcaggaccaccacgctgcccatgcccaggtcgcgtcggagcggcggcgggtgcggatctacctcgtcgagcgggccgccggcgaggcggagcgggcgcgccgggaggcggtcgcccgccgcgagttcctggtgctgaacgggatcagccaccccgggatcgtccaggtcgacggcctggagagccatgaggccggcccggcgctgatcttccggcaccgcccggacgagatgcgcctcgaccactacctcgaccagttcggtgacagcctcgacgccggcacccgggtctccatgatccgtgagctggcggagacggtcgcctacgcgcacggacggcacctctaccaccgggcgctggccgcgcgcagcgtcctggtggtgccgcgcgccggccggggctggctcgcgcccaggctgatgatcagcgactggcaggccgcggcccgcgacaccatcctcggcagcggcacgccggtgaacgggctgtcgacgacgtcacgcgcgctggcggtggagcccgcagcccagctgctgccgcatctggagctggccgccggcggctacctggcgcccgagatcggcgcgccgtatccggacccggtcggcatggacatcttcggcctgggcgcgctggcctatctgatcctcaccggccaggcgcccgcggacagcccgaacgcgctgaagacacggctggagcagtccggcgccctgtacccggcggaggttgtcgactcgctgtcggagacggcgaacgagctggtggcgggggcgacccgcccgctgccggaggagcgtttcgacaccgtccgggacctgctcgactggctgcagctcatcgaggaggagctgacccggccggacgccccggctgcgacccccggctcggccccggcgggcggcgccggcggcacgcccgcggatccgtccgcgctggatccgaacgccacactccagtccgtcacgtccgtctccgtcgcggggcgggccggccaggaggcggccgagggggagtatgacgcggatccgctggaggcacagcggggcgacctcgtcgggggcgagtggcggatcagggagcggctcggcaccggttcgacgagccgtgccttcctggcgcacaacgagaagaccaaccgcgatgaggtcctcaagatcgcgctctccgatgagcgggccccgcggctggggcacgaggcggcggtgttgggccgcctgaacgactcgcgggtgatccggctggcccggcctgacaccctggtcgtcggcgggcgcacggtgctcgtcctcgaccatgccggcgagcagaccgtcgcccgcaagctgcgcgagggccggctctccgtcgacgagctggagacctacagcgactacctgttcggcgcggtcgactacctcgacggcgaaggcgtcgtccaccgcgacctcaaaccggacaacatcgtcatccgccggcggccgaaccggacgtaccagctggtcctcatcgacttctcgctggccaacctctccgtgcacgagaccggcgcgggaacgccccgctacctcgacccgttcgtcggcgccggcacccgtaccacctacgacgaccacgccgagcgctacgccctggcggtcaccctgcatgagatggcgtcgggggagctgccgctgtggggggacggatccgccgaggcgcggttcacctccggccctccgaaggtggtcaccgaggcgttcgacccggcgatccgctccgggctcaccgtgttcttcctccgcgcgctcgaccgggacgccgcccgcaggttcgcgtcgctgaaggacatgcgcgacgcctggcaggccgtcttccgcgccgccgactccaccccgccggccccgagcatccacccggcgacggccggctcggcggcggtggcgcggccgcacggctcggccggcggcgccgacgaggcagccgccgagcgggcccgcgaccttgccgccgcggcggccaccgccgacacgccgctggaggccgcgggcctgtccccgcgcgccgtctcggccgcgcaccggctcaacgcgacgaccgtcgccgcgctgctgtcgctcggctcgaaggagatcatcggcctgccgggtaccggcgcgaagacccgcctggagctgcagtcccggatccggcagtggcgccgtgccctcgccgccgcacggcccgctgcgatcgttccgcccgcggtcatggcgacgccggcagggaagcaggacgacggcgcgtcggcggcagcggcgcaggactacccccgcatgccggtcgaggtcctcgccgaccggctgcttccccgcgctccccgggcggcgccggccgatcgcaacgccaccgaacgcgaggcgacccggctgctgctgggactgcccgacgctgacggcacgctgccggacctgccgctgtgggccccgcagcagcagatcgccgaacgggtgggggtgacggcgggccggatcgcgcaggtgctgatcgcgcggcgcaaggcctggcacgccgacccggccgtgcgctcggtgcacgatgagctgatcgagatcctcggcgacgccggccgggtgatgggcttcgacgaactggtcaccgccgttctggcccggcacggcagcgcctggcgctccccggccgagcgccggtcctcgggtgagcgccgggcgttcgccggcgcagtggtccgcgccgcgctggagaccgtcgacctcgactccgagccgcggctcgcgcgccgccggttccacgaccgcatgctggtcgcgctcgaagccgccgaggacgacggcccgctcaccccggccgcgccggcgttgttcgactacgccatcgccctgggcaaggccgcggaccggctcgcgcgcgccgaggagctgcccgccccggcgaccgtgctgcgggagctcgccggtgtcgcggcctccgccggcgccccggccgcgggtgccgatgccggttccgaaagtgttgacagctcgggagggttgccggtgctcgaccagcggcgcctcgtcgggcttgccgccgccgcctcccgcaccgccgccgcgaacgcccgcctggagatctacccgcgcgacctggacctcgtccgcgctctgcgtctcgcccaggccggggtgcagcccacccgccccaccgccgccgtggcaccgccgggcagcggcgacgagcggcctgaccggctgttgctggacgtcccgaccatccacgagcgggtacacaaccgcttcccgggcctgaccaccgacctgccgacccatccggagctcgaccgcccgctggtcgccgccggcttcgccctcgaatgggacgcggcccgcgccggctacgtgcccccgcacggcctgctctcctccgccgggttcggctcgtgggccactccggtcgcccgccagcccaccggcctgggcggcgggtcagcacgcgcgctgctcagcgaccgccccgacgagacgacggcggccctcgccgagcggcgcctcgagaccgccgccgaaaccggcggcttccgggcgctgaccgtccggcgcaaccactaccgggccgcctgcgcggagctggccaaaccacaccggttcgccgccgaaccggtcgacgtcgccgccgtcttcctcgacgccctgcacgccgaggtcgacccgcggcccaagccgacctgggcgacgattctgcgcgccgacgccgccgaaccgggcagccgggcggccaccaagctcgccgagtacgtccgaacagcctggcaacgcgctgccggccagctcgccgcccacgtcgacgccgcgcggccggcaccgctgctgctccacgacgccggagtgttcgggcactacaacggccgcgggctggacgtcctgttcgcgctcgccgaccgtgcccgcgccggcgggcggcccgtctgggtgctgtgcccgacgaccgaaccgacccggccaccccggctcgacggcgccctcgtccagctcgtcaccgaaagcgaatgggtgaccctgccggacgcctggatcgccaactggcaccgcgccagtgccgagcagacgcccgcgggcggaagggcgtcctga

SEQ ID NO: 613 - DNA, 4182 bp, Pseudomonas stutzeri
atggacaaactctggaagcagatcacccaatccgattacacatgggagcgggaagcgctggagtttgccaagcagctgctccctgaccacgatccttatcgtgcgtgggccaattttgagttcattgcccaagacggctccatcaacgaagttgatctcatggtgctcacccccaaggggatgtacctcattgagatcaaatcccatcctggaaccattagtggtgacgctgccaactgggtttgggaaagacctttgcctaagggtgggcagaagatcttcgataatccgcgcttgcttgctcggcgcaaagcgcaaaagctggcgtctctgcttaagctgcagccttcatttcatcgaagcaaggaaaccgtgccttttattgatgctttggtgttcctctctgcagaggacctggtcatcaagctggaaggtaatgcgcgccaaggtgtggtcaatcggcaagagctgctccgcgaaatcaccctaatcgatgagaactggaggcatcggcagattaccgcttatgcagccaaagtcatctcacgagctgtagaggaagcgggcattaaagagtccgtgcgcatgcgtcgtgtgggcagctatgagcttcagagcctactcgacgaatctgatacctatcaggattggctcgctttgcacccggatattggggtgcagcgcaaggttcgtatttatctgacccagggtaagccaaaggaagaggtttctcggctcgaaaaagcggccaagcttgagttccgcctgcttgagggtattgagcatccaggaattctgcgagcgcacgaatttcagaatcatgacagcggccccgcactggtctatgagcacgatcccaaggcatttcgtctcgaccatctactcatgcatctgggtaaggatcggcgcctggatacagttcaggccacctacctgcttcgtctaattgctgaggctgtgcagtacgcgcatgggcaaaagctttatcaccgtggcctaagtcctcagtgcatctgggtcaagccactgggcgatgagaagtacagtgtcaaaatcagcaactgggccactgccgagcggatatttgagagtgagtcgcgcaatatcagcgcgctgacccgtttgattaacctcgtgcatgaagaggcagggccttatgtcgcgctggaagcgcacactggcgctgcagacggcgtgcacttagatgttttctccctgggtgcgatcgcctaccacttatttacaggcaaaaagcccgcgcaaaccgacatcgagttactggacaagctgcgcagaggcagcggtctgcaggttaccgatgaggtcaacggtgcaagcgaggctatgcagtacctggtgcagtacgccacgcaccctgatgtcggcagccgcttggaatcggtcagtgagttcatcaaacggctggatgaccttgaagatgaggttagccagccgaacacgcttcgatctaacccaactgaagcccgtaaaggtgacttcctgccgggaggcttccaggttgttcagccacttggcaaaggtgcgtgctcagtcgtattcctggtcgattaccaggggcagtctcgcgttctgaagatcgcttcgacacctgaccacaatagccgtcttacgaaagagggtgaggtgctggccagattgcgtcaccaggccattgttccttactacaaaactctggatatggttggccataccgccctgctgctcgactacgcgaccgagggcaccctggctcagcgtctccgccatgtcggcgctgtgcagcttgagttgcttgagcgcttcggtgacgacttgctcagtgcggttgtgcatctagaagaccaggcgttggtgcatcgtgatatcaagccagagaacatcggcttggtgatgcaaggcagcgttcttcacctcatgctttttgacttctccttgtccagtgtcggtgctgacaatatcagtgccggtacgctggcctacatggatccgttcatccgtgatcctggccgccgtcgttgggacgaccatgccgagcgcttctctgttgcgctgaccctttacgagatggccgcaggggctttgcccgggtggacgtcttctgaaggactgccacatcaactcgaaggtgagctggaggtcgaccgaaccgtcttcgacccgagcatccgcgatcgcatggttgagttcttcaaacgggccttggttcgtgatgtgcgcaagcgctttgccagtgccggcgagatgctgcgtgagtggcgcaagacattccatgatgcgcgcagtgagtctctgcacacgacccagcagccacaggagcgtacgtgccccatcagcgaggctcagttggatacgcagatcggcctgttggctctgagcccacaagcgctggataccctcagtcgccggaatatcaatagcgttgctgacctcatcaagctgaaccgctcccgcgttcgagtctggactggggtgggggtaaagacccgtaatgagctatcagatgtcatcggtcagcttcaggcgcgccttctggacggtcagcaagttcagcaattggatagcggtgacaccagcattgtgagtgtcgaccgactgttccagcaggttctgccgaagtccactgatcagaatcggttgagctttcttaacgaatacctgggtcgattggacgaggatgcgccaaagggctctcacaacgttcattggcctacgccggcagccatcagcggccacctcggcattgagactctgctggtgcgcgaactggtcgacaaggttctgacccagtggggcaagaccaaagcgattacggacttgagagaggacattgtcggcctgttggacgacaacggcggcgtgatgacagcggtcgaagtggctgacgcaatcctgcttcggcgcggctcggtacaagacagcccactgcgtgagcgctgggcctatgccgttgtgcgggcagccgtagaaacggaattgagtaagcaggagcctcgttggcttttgcgccgctccggtaaccgcttcctgattgccgataatcgtcaggggcgaggggaggaactggccgattacgcttgcgacctgggcagcctggcagatgagtgtgctcgccagctgccactgcttgctcctgttcgtacgctggagaagatccgtgctgtgccagcgccggagtcatttgccgggctgagtaaccaccgccttctgcgtttggctgcagccgcatccgagagtgcagccctatctagccgtgtggagttctatccgcgagggatgtccgccaagcttgctttggagttggcccaaggcgcgctattgggcagcaaggcgctcactgtcaaagatgttcaaacccgtgtagccggccgctatcccgcagcgcaggagctaccaggccgtcctgagctggatgagctggtgcgctcgcttgatatcggtttccaatggaatggcagctttgagtttgccaacggcgataggggcggttactgcctgccaagcgcagggatgaccagcttcgcatcagccgggtcaactcactacagccagactcaacaaggcgaagacgacaccaccacactcaagtcggttaaagagctgggcttgatgcttgagaaggcagtgactgcctcccacttcctcgcgctaaccgtcaggccgcgtcagtggtggcaagcgcaggaaaaactctgccgagactatccgtttaagcgcatcagctttgatgagctgcttcttcgccatgtgcaggctgtgtgcgcgagcatgcccaaagctccggattggcaagtggtgctcaaggcagatgcctgtgagcacagttctcgtgattggcagaacctgcagcgtctggtgcagcgtgcgttgccgagcatggctaaggagattctgcaggccggtcaaccagtgcttttgacagagcctggactgctggcgcgctatgagctggtgacaacatggctcaatgatctgcgccaacagttgatgagcgtgagtggtcgcagtggcattgcgttgcctgggttggttctgctgatagccgtggatgcgcagcgttccgcggccatgatcgatgacgtattggtgcctacaggcgccggtagcaaagagtttgctcatattcccagtagctggctggacgatgctcagctactacctgaggcagttaaaaccactgcctaa

SEQ ID NO: 614 - protein, 1108 aa, Thermomicrobium roseum
MSTGTLGQRFLRSVQIERDWQSRDVIAHYVPTLQVRQVLRRLGDALANGATDRAWTLTGPYGTGKSVFAAFTLQLLSAVDAAQSEAWRILRLHDSELAFFLQERLNGRRLFPIPVVGRRTSLPGCLIKSLAGQLAILPATAERERLQAYAAEILNTETDRPLDPADILNLLDDVKMLVKHSGYHGIVVVIDELGRILEYAASDPVRGDISLLQELAEFASHSGQDPVLVLGILHQAFDQYARYVDTAMRREWAKVQGRFVDIAFIEPPEQLMRLAVDALAESHAVPRPDTEAIAAVAEIAAGEDLGLRPRLLETALFRDLVQRAAPLHPVSLVVLPYLFRRLAQNERSLFTYLFAHEPFGFQDKVRQHPGAWVRLPDLFDYVAVNLGNSLSRHPLFQRWLEVVQKMDEHPELSCVEVGILKTIGVLDVLAEGSHLRPTPELISFALADTPGDAEIRTSLEGLHRRSLIVFRRFNRSYRVWEGSDVDIPMRLEEARRRTAGQYRLGATLGRYLKARAQVARRHSFETGTLRFFEVRYLDEPLPAEQLRPQSGDGIIACCLPRNDVEAQAFREWACGQEIASRSDLIVALPEQISTLLEAAAELVALHWVRENTPNLRDDRVARRELDTRTAEVEQEIKRLLDRLLDPRPAPVGSRCSWYWLGEKQPIDHPRGVAALLSRAMDQHYSLSPRIWNELINRRVLSTAAAAARRNLIERMLTAGNQPRLGLTGFPPERAIYESVLFATGLHRPNEHGEWGFHPPRPDKDPARLTPLWETMEREILAATEQRIGLQQLFNELAEPPFGAAEGVLPILFCAFFLVYRKEVSLYRNGVFVPEPSVADFEILLRRPDRFEVGGARVVGGRKLVIERLARWLGTEPALLPVVRALLAAVRALPEHAWRTQRLPRAVIELRETCARASSPERLLFFDLPTALGEMPFGTEEVDPARIDRFLERLSEALTALGQATPRVIEEARDRLLEACGLPHGMEGWKALRALAQRLERAAFPPDLAGLLVRLRQEQDDEASVESVLAYLATRPPRLWTDDDVERACTQARIIGKRLRTVAATWDCLTPQDEALSEEIARRVREILPVNVPRHVLRAALLRLLQETD

SEQ ID NO: 615 - protein, 1172 aa, Rhodobacter sphaeroides
MTIAVREIFEKPVDRAIDGVIKADDEASLRVELDEYVITGEIGQRLEQFLDAYNNYKTANGVWISGFFGSGKSHLLKMLALLLENREVDGIKAFDIFAEKLKDEPMLLGALRKAVSIPSKSILFNIDQKADVISKNDVDALLSVFQKVFDEMCGYYGKQPPHRTVRTTTRRAWSVRGVQGGILGVLREALGDAWPRRGSAGGAQHRCGIRAGNDSDLADAKDILSQYRKDTRVSIEDFANTVKTWIDRQVPNFRLNFFVDEVGQYIADNVKLMTNLQTIAESLNTKCKGQAWIIVTAQQAITEVVGDMTARQENDFSKIQARFANRMPLNSADVAEVIQRRLLSKTDAAQIMLGNLHDKEENNLKTLFDFADGSIRLKNYRDREHFVASYPFPPYQYTLFQMAITSLSQHNAFEGKHSSVGERSMLGVFQEVAKTLADRPVGGLATFDLMFEGIRTALKSSVQQSVQIAERNLDDPFAVRVLKALFLVKYVKEFKPTVRNISILLLSEFEADQAGQRRKIEEALARLERETYIQRNGEVYEFLTNEEKDVEAEIKALDVDPTEISKELETLAFDTILRHRKIKHLTTGYEYSFSRKLDDHLLGREYELSINIISPFNDDAAAPDAVRMRNMGREELAIVLQPDVRFIRDLTLFRQTDKFIRQSRSGSPQPGRDRIILEKGEQNSRRAKDLELRLRKLMAAARLFVRGDELDIGGDDPQDRIVKAFQALVDKVYVNLPMLRGVNYVEADIAKAASPTSTLFGEAGTGLTEAEQDVLNHIQSQARNGVKVSAKYLTERFGAKPYGWPTVATLCLTASLSGKGKCEARSDGTPLEGAELARALNNSHMLGNILLTPQLEFTSSQIRAAKDLYKELFGLPSDGSDARVLGGEWAESVRKLADELNRLVTNNYKYPFMAALEPLRDQVNAMIGKPAAWYITEPVKQEDALLKAKEDILDKIRSFMGGAQREIYDDVRDFLQAQEANISYVDAAAGEKLRAALSDPDCYKGTAIQALKSDLYALKDKVELDVLKERKAVIAAVDECAEKVAQTAEFQALTPEQQDKICRSVASHKAGLDAVTMIPILRDRANGARSSLMQQILADIASMAAPAPAPSTPGLSDRASPPPTPPSYINASEIRPKYAKPYLAEESDVETYVEEMKQSLLAHIRSGKRVIV

SEQ ID NO: 616 - protein, 1226 aa, Pelotomaculum thermopropionicum
MKYADLIHFEPVETIVQLREADAKSRAGELVKTYVISERMAEQITEVVFPQLQYDHPQDNKGLLIVGNYGTGKSHLMSVLSAIAEYPDLATEIRHPAVAKKSEVIAGKFKVIRTEIGSTTMSLRNIICAELEEQLANLGVQYRFPEADKVTNNKDPFIEVMTAFQEVYPDHGLLLVVDELLDYLRTRKDQELILDLNFLREIGEVCRLTRFRFMAGVQEAIFDSPRFQFVAETLRRVKDRFEQIRIVREDIAYVVAQRLLRKDDRQKALIREHLQRFTRLYGTLAERMDEFVALFPVHPAYLETFERVYVAEKREVLKTISAAMKKLLDKEVPETAPGLIAYDSYWQNLKDNPSFRSDPDIREVIEKSQVLENRVQQAFTRPQYKPVAFRIIHALSVHRLTTGDIYAPIGVTAQELRDDLCLYLPLPEEDAEFLKTTIESILREILRTVSGQFISFNQDNGQYYLDLKKDIDFDSLIEQKAETLTPNQLDRYYFKALARAMECPEATYVPNFQIWEHEIEWREKKATRLGYLFFGAPNERSTAHPPRDFYLYFLQPFDPPAFEDEKKPDEVFFRLVQRDEDFDRALKLFASASEMASTASKGTRQVYENKANDQLKKIVEWLRNNIATAYEVTYRGATKKFVEWVKHSANPHASVRDLVNLVGSSCLAPYFRELAPEYPIFAILVTIKNRPQAAQEAIKWILGSIRTRPGAAVLDALELLDGDKLRPQNSRYAKHILGQLDKKGPGQVLNRGEIIADFRGVEFEPRFRLEPEWVVVILASLIYSGDVTLSMPGKKIDASNLEELGKVPLEELIKFKHIERPKDLPLGPLQALFEFLGLPPGLIVNQSTREEGVRQLQEAVDKLLERTAQAQQAIQQELSLWGISLFDQKKKTGLRDELASFKGFLESLRVFNTPGKLKNFRYSERDINKQKAYLATLKRVEELAGLAKEIMPLLSYLSTAEAVLPADAGWTTKARERREELKGKLSGLDEASVPDLRRELVQVLLELKNSYIEAYLEAHTKARLNASLDQKKSGLLKDERLSKLSRLAGIELMPRAQLTDFQNRLAELKTCFSLTRENLGKTPICPHCNYRPAQEQIKLSAEAALRQLEEDLERLYQDWEKTLVANLEDPTVKENIYLLKPEQQKALEQVIKEQQLPYTVDASFVKAVQEALSGMEKVSVTAADLKKALAQGGTPCTVSELKQRFEDYIQSLTRGRDPQKVRIVLE

SEQ ID NO: 617 - protein, 1180 aa, Acidiphilium multivorum
MANEPIKSLFANDIHRRIEEVIKVDQTSDDILRDEINEYVVTDAIRSHYTSIFDAYSETPNKPHEGIAIWVSGFFGSGKSSFAKMLGLSIENRPVAGIPAGDRFGQRTGDNKLQVLLKAINEKIPTHAVIFDVSTDRGIRSGNQSLTEIMYGLFLQSLGYAKDLDLSELEIALEEKGQLEGFEAEYERLFKKEWSVEKGKVAFALSEASRVLHSFDPETYPMADSWVKAVKNKADISPGKLAERANELMKRRRPGQALMFVVDEVGQFVARDVQKMLDLQAVVQSLGVKGRGKHWIVVTSQEKLGELVSGLDDKKIELARLMDRFPLQVHLEPSDISEVTSRRVLSKNAPAQKALGELFDQHRGRFTEHTRLTADIKLPELTRDSFIDLYPLLPYQIDLIIQVVSGLRTQGGASKHVGGANRTIIKLAQQLLINPAVNLADQPIGSVARLDQVYDLVEGNIGSEVRAKISAISKELDHPLAQPVAKVICLLQYVKSVHRTAENISAALHPGVGGDSQLAAVKDALRQLEAANKVRLGDDGYRIPTPAEDDWERIRNGINPKPGDAHRIYSEVLAGFWQPQPTHTLFDTKTFKAGLAIHGREIVDGDMMFHVHLAEDGAAFQALAAELRARSQQERKSVFWAVALNDAIDRETVELFRSKEMLARKEREAKTADETALIGEEKIRQRRHQDELRRLVRAACLAGSVSFRGNDRSPGDRAVDMGKSAAEILSDVLPEVFDRFREAAAKPADVKKGLDALFTAENLQGLPSVFGSLGLLRDEKGKTVFRVESGALAEVLSRIEERANYGDTASGRYLADELAKEPFGWDFEVVRLLVLSLLRAGKIQATSKGQTIDSATGIEARDTFSNNNFFRQASFRPKKGIEFEELVKASEAFRDTFGSEVKELNAGAIVSELRKEIARHEDPVSSAHAQLIAYRLPGAAVLDGAIGQMKAVLRGSEDNAIATFNASHRAIKDAIKRATELEQALSEPKLRDLDRAREALRSAWPFLSGEADVADDLRADATELEDLLARETFYRELPLIEQHASAIDAEYARRFDEALDARIDAYTHALERLAQTPGWDGIDQDQQEKLAAPLLRGKTRDQVRVPIPQLRSELDACEARLQDAIAELHRIVDGDRVATVRLGGYFSGGVETEEQLDAALAGIREECSRLIGTGKKVIVQ

SEQ ID NO: 618 - protein, 1179 aa, Acidithiobacillus ferrivorans
MKLNGIFKSPVSRPIEGVIKADDESSLYNELSEYVLTDEVAKRLEHFLDAYTDYHGANGVWVSGFFGSGKSHLLKMLALMLENRQIDGSSALDIFLPKIREDDELLRAELKKAVAIPSKSILFNIDQKADIISKTQADALLSVFVKVFNEMCGYYGKQGYIAQFERDLDSRKLFQPFKEAYQHIAKKPWERGREQAVLESGNIARAYAEITGEDSTLARNILDRYHAQYSVSIEDFSKQVKDWLDLQPAHFRLNFFVDEAGQYIADNTKLMTNLQTVAESLATKCQGRAWIIVTAQEDMSSVIGDMSKQQGNDFTKIQARFANRLKLTSADVAEVIQKRLLTKNDGGAELLKTVYDQQVNNFKTLFDFADGGQHYQNFRDLEHFTYCYPFVPYQFPLFQSAIRGLSLHNGFEGKANSVGERSMLGVFREVAMAIDNEPVGQLATFDRMFEGIRGALKSAIQSAINNAERHLGDPYAVRVLKALFLVKYVKEFKATPRNLSILMLEHFGDDAATQRQKLETALHLLEQQTYIQRNGDLYEYLTDEEKDIEEEIKNTDVESSAVMEELEKLIFDGVIKQRKIRYDNGQDYPYTRKMDDRAFSRESELAIHLITPLSDNFDNLMLQRMQSMGRDELRVVLPADARFMQDLTMYKRTEKYIRQNSNTQQEAVKRILDAKGFQNTERMGELQERAKQLLGQAQLIINGGDVDLDKGDGQTRIIKGFFQLIEHTYPNLRMLRDISYSENDVGKYLRKAQDSLLGNEATSLTEPEQELLAFIQNNSRSGVRTTVKSLLERFERKSYGWYYAAILCNLALLYARGKVEVRQDSNTLEGDALERSLRNTSAHATLVLEPQIEFSASQVRTLKDFFADFFDRPPGSNEARALAQETISALKELEMELTDLHRQKTQYPFLSVLDGVLATLKELSGKQIPWFLTDLSRADDTLLDTKEQTIDALRRFMSSPQKAIYDQARQLLEEEEDNFAYVTAAEVDALMALLADSKPWQGNRLQQTRPQLEALQQAIATQLAQEKNTASHNLDELQQRLQNYAGYSHLDDAQKAPFSKAFIEARQSLQGQKRIAMIRDHLRRFEDDQYPQLLLKLEQLAQPANPIPAYAPTQPATGNAPEPVTPPSWVAEPRIVPARSIRVSYPRPWLANEAELDDYLQKQREAWLKEIQAGNRVQI

SEQ ID NO: 619 - protein, 1229 aa, Acinetobacter baumannii
MIEMNIKELFYKPLDRAINGVVKADQNDNTTVYQELDEYVVTNELEKHFRDFFQSYGTDLSDPSIANRVGVWISGFFGSGKSHFLKTLSYILANKVARDAQGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRILFLVDEVGQFIGSDTRLMLTLQTITENLGTICKGRAWIVVTSQADIDAVLGEMSSSKANDFSKIAGRFKTRLSLSSSNTDEVIQKRLLRKTPEAEALLRSVFEQKGDILKNQITFDRSGPTLNNYEGPDSFIHNYPFAPYHFQLVQKVFEEIRKVGATGAHLAYGERSMLDAFQMAANAIATDEVGALVPFHRFYTSVEGFLDTAVKRTIDQAGQNQTLDSFDVQMLRTLFMIRYVDIIKGTLDNLVTLSIEKIDEDKLALRKRIEESLLRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQDEGQVLFKLADDKQFFNELRTWLKTNKFIRLNDDGTQSDISRILADRGRENQERKKRLRARVEEMLLDAESYALGQHLQLSSSSPSTKLDEACRYLLENTYTKLSYLQVYQQDAWRELNAVLTVDDMAQLGLSLDGGQTNPKALQEVEQYISLRATGTERILVSDVVDRFAKRPYGWPDAEILLLVGQLAAMGRISLQLNGGSLQLKDAFEPLQNSRRRRDVSIIKKRQTDDQVLKQARQLTQDLFSAMGPATEKELFEFYTQHFKNWLANFKSYKSKTDVGQFPGKKVIEKLILTLERLLANSDSFDFFKAVVDHKDDYLDLEEDYRDIHEFFSNQMPSWQQLQQALRHFEKNKQALGSDEFAKKALSELHHISTLESPYGLLNKIADLVRTVESVNERLLSEKRSHAVEQIDDKIKQLEAEIKNSGIATAELSNKLLRPLQLLKTDIEVETSLSTIYMLQTQTAVERFDEALYELESEVQAEIQRQAKAAQLAQSKAESVTNTATTSSPVTSTPAASPVQPVTAVVPPKPVVEVDVASIYSKSSSSVYLETEESVDQFVDALKAELKKIVSDKKRVRIR

SEQ ID NO: 620 - protein, 1157 aa, Alteromonas macleodii
MLNKDIFVNNPVESRLANNGVAQVKDDTSQGALETLEYELRTFVCDGAYAKGMDRILSNYLSALKTKSEQPGVWISGFFGSGKSHLAKMLRTLWTNQTLNDGSHARSVADLPQDIAALFDELTTQSVSNGGLHAASGTLGAGAGDKVRLAFLGIIFKSTGLPEQYHLARFVMWLKSEGVFEKVKAFVESKAKAKEGIDTWTKELKNLHVSPIMADAILQSIPGIGADIKEVREMLRAQYKIVDDVTNDEMVTAIVDAISNDGELPLTLVVLDEVQQYIGDNVQKAFDVQEVVETCSGAGALKSKLLFVATGQSALSGMANLQRLMGRFQVPVQLEDTDVDSVIRKVILQKKETAKPLVKTVVDDNLGEISRHLRGSTIEHNQDDEKWMVPDYPLLPVRRRFWERILPALDRTGTGSQLRNQLRVVHEALKTTAEKELGYVVPADYLYDQISTNLLQTGVISKDIYETISRKRGGNEDEQLQGRLLALILLISKLPAEMEYGIHATVDSLSDLLLEDLQNDKDKLRALVPKMLAMLEDEHLIMARDSENGREFSLQTVESQAWYDEFRRQENDLMGNPQTLESFRAKEIQSFIRKQVAQARITQGEVAEPRPITVYFEPELPAEAKNRISAWAPEVTEKQFNDQSRGDDPDNATIYIYVPSSHRSELQKAIVEYKAAENTLEVRGRATTEAGKDAMQAMETRLNEAERARKNLLNDIFSGIQVRLAGGQEVEGDTLAEQIQNGGELACQRLFHKFKMADNRGWAKVYDAASRIADPNALEKVEYNGEADKHPVCAEIHRYIGAMKLGKDIRDNFKGAPYGWSNDVIDGALYAMLAAGVLKASDTQERAIDAKSLDRSSVTQTKFRPEKVTLSKVQLIKVRGVISTLLEDACNSGEEVTKLPLAIINAKQIANLAGGSAPLPIAPSTKLLSELEMYTGNDQLQKAFENKDQLLADFESWKRLADKAQHRSKLWQKLLSAIDYCRGLAVFNDLEREQEAILSNRSLLDDPCPVEPLIKKATNALRDGITAHRANYEEEYQVCMSELLDDENWQLLDEAKRDAFLANRNLADIPSINVSELDEVLNSLDEISFNQWNDKTAALPGIFSQVLKDAISELQPKTQYCRLNKPIIKTEQDLQDWLKYVESELRTQMENGPVMPS

SEQ ID NO: 621 - protein, 1153 aa, Anaeromyxobacter dehalogenans
MKIKDVLQRDPSTYPLVNQGQARIADRSNEKVLDELRGELSTFVCEGQYAEGIIKILKSFLANLTSTSQKAAWVSGFFGSGKSHLLKMACHLWQDTKFPDGATARSLVPSMPDELRELLRELDTAGKRGGGLLAAAGALPSGTTDHVRLTILAVLLRGVGLPDQYPQAQFCLWLHDQGWFDKVKGAIEGAGKQWQSELNNLYVSKNIANALLACDPGFASTEAEARNTLKAQFPPRNTDITTEEFLTAVKRVLKLVGRDGRTPLMLLVLDEVQQYIGDSNDRSTLVTEVTEALSKQLDSNVLVVASGQSALTSVPRLHKLMDRYTIRVQLSDQDVEAVVRKVLLQKKAASISTVKGVLEKHGGEISRQLQGTRIGESAQDREVMVDDYPLLPVRRRFWEHCFRAVDAEGTHSQLRSQLRIIHDAVAKISDRALGATVPGDELFEALAPEMVNTGVLLRELNERIINLSKDGTERGKLARRICGLVFLITKLPEKDKPGYLGVQASKEHIADLLVEDLLADNGKLRSAVETVLEELTSSGALMRVGDEYRLQTKEGAEWDAEFRRRQGKLANDDADIQIRRDQQIYAEADRVIRTVKVVQGAAKEARQVVVSRDQTPPAGNGESVPLWIRDGWSASEKELLDAARAAGTDSPTVFIFLPRQAADELRKLIVDAEAAQQTIDAKGTPTTREGEEAKHSMESRRNAAIRQRDELIKQIVANAKVFQGGGSELLQATLEDRVREAINAALVRLFPRFKEADHAAWETVIKRAKEGADQPLQPVGHTVATEEHAVCKAVLSTIGSGKVGVEVRKALRASPYGWPQDAIDAALLALHRTQHVSATLNGMALAPGQLDQNRISKAEFRVEKITLSVTEKLAIRKVFQALGVGCKAGEELAKAPAFLEQLAALGRSTGGDAPLPAPPSVIDIEDIRARVGNDQLAGIRDNAQLFGKRITEWTNTKKVVDARLPTWALVERLALHAHGLAAAEDLLKQVEAVRAQRLLLEPTDPVAPLRSGLADALRKALLAAHGAYETEFGKGMASLEASSLWRKLPSSDRSSILASVGLAPAAPLSVPSDEALASALDAKSLSSRSAEADAVSGRVQKALEHAAKLLEPKVRPVTLERSTLTTEADVDAWLERQKKSLVAAIKDGPVLVS

SEQ ID NO: 622 - protein, 1203 aa, Aromatoleum aromaticum
MQIRELFTKAIDRPINGVIKADQKDAESIWQELDEYVVTKQLTDHFRRFFDAYLAAADNPNDPVLGARMGVWVSGFFGSGKSHFIKILSYLLESLQATNPATGERKRAAAFFDERKIKDPMLLADIQRAVRGSADVILFNIDAKADSKDERDVILQVFLRVFNEKLGFSADAPHIAHMERYLVEKDAYDTFKSAFAQSNGSTWEAERDAVDFLRDDVVHALAVALKQSDESAGQWFDRARDEYRINIESFARLVRDYLDTRPAGHRIIFLVDEVGQFIGDNTQLMLTLQTITEQLGTATQGRAWVIVTSQEDIDAALGEANKAKSQDFSKIQGRFHTRLSLASSNTDEVIGERLLAKTEAAHGALRDTFEKSGDIINNQLAFVGNSVNLRSYKDAAEFVGVYPYAPYQFTLLQKVFESIRKVGATGKHLSRGERSLLDAFQSAAVRNADHPVGLLIPLYDFYPSIESFIDTVAKRSIDEAPQNGALEAYDVLLLKALFLIRYIGDIVKPNVDNLATLCVDRIDTDKLALKRKIQESLARLEAQRLVSRNGDLWFFLTNEERDVAREIGNVEVPSAEKARLLCELLFDDILQGATRIRHRDTKGDYDFNRLLDGVPYKNATHELSVEIVSPLGDDYETLSDARAVLRSSEGHGRALIKLAEGERFDIELNLYRQIEKYIDSPKASNATPSLRTILLNRKDENRERRTRLREQLSAMLLEGDCYALGQRVELKAGNASSLLDELGNYLITNTYTKLGYLKHRNPDPTAEIKAVLLADDISQKKLALGGDEGNPLALAEMREYLQLKASASRVMLDEVVARFTGIPWGWKPEWEVVLLVARLFMAGEIKLVMDSADLVPRAAIEPLTKSARFKQVSILKRKVADVESIKKARKLHQELFSSLPPEDEDGFVAAMRTRLAGWHSELKGYAPLAATKHHPGKTIIDTVVARIGKQLAIADSFEFVESLVKDRDAWLDLADDAHDVTSFYKTQRPTWQRLLDALERYADNHDALDKNIHAAAALGTLESLRDNSAPWGMVSQIEPLIATVDAINEELAQGRREHALLSVDAKIAEVEQALDAVHADAALRNRALLKLQELKTKVAGLTSIPMIFYCQDQAGDALDAAMAMIEAATPKTAPGTAAEHGNQNTATKTGPTVAPPKPSKVVRVADLAGKTYLETEAEVDAYLVRLKSELLKIIQAGQRARLQ

SEQ ID NO: 623 - protein, 1166 aa, Arthrobacter sp.
MQLNEIFAKDVQRPIEGVVKADDVVNLGVEVDEYVLTNDAAKGVAPLLEEYTNYTNANGVWISGFFGSGKSHLLKLLAHLLGDVEGQDFQRDQVTASFVGKTDDAMLKASLTKAASIPATSLLFNIDQKATLIAKDQRDALLRVFAKVFDESRGYFGDQGHVARFERQLDEEGQWQAFQDAFKDLAGNDWKTRRSSFGLPKVREQVNRAYAQVAGVDIESVGDILSTYQATYKLSIEDFADEVKAWLDTKGPNYRLSFFVDEVGQFIADNEQLMLDLQTIAETLDTKCRGRSWVFVTSQEDMEKVIGDQTKRQGNDFSKIQARFKTRVKLTSADVEEVIRKRLLEKNDAGDAELQSIYATEHANFKTLFDFADGAKTYRNFVDESHFVGSYPFVSYQFPMFQAAIEGLSDHNVFEGRNSSVGERSMLGVVQQVAKDIGNVEVGRLATFDHMFAGISASLKAAAQSAILRAERDLPDPDSDLTKLAVRLLKALFLVKYVDNFTATPRNLTVLVYDHFGIDLPALSKRVDEALALLEAQTYIQRNGTAYEYLTNEEQEIEKEIKNVDLDASELSNRLFKILNGDILKATKLKYAKNGQDFPFGYKLDDQAHGQQKDLTIHFISPSTAYSSEEIRMQSAGKDELRVVLEADDRVIGDLRLLLQTEKYTKQKQTTALTSSVSSILQSKAIQNSEREKELIERVKRAVGHSKLIINAADIPSASHDAVTRVTDGFQELVARTYTSLSLLGGMRYSESQIAGAANPEGGMFDAGGLSAFATPGMEILNWVTLRTNQGEQVTVKKISDAFQSKSYGWDLASIEVIIAWLVGSSKLALTLDSNLVKRSEIAMVLRNTQKHQHQVVSPQKSYDAGKVTAFRTFCIDFFDEGNPPTDALELARHGSDKLKGKLDELKALQTATAYPFIAQLEQPIDLLEQVVGKPDEWYLAEFALADELIEAKTDVVDPIHAFLNGQQRWIYDGAAALLATNLGNIAYLPQDSDATVKGLLGDENGFRGNKMNQLKQATNALANQIDLVVASNRTNASRAVDGRKEEILASAYFASATDDARASVLSKVDQHLAKINAEPQIAMIRELAHSFEETIYPALIDQLASSSKKSDDEDAPPPKQTVAVSTIKADGAPNILETAGDVEKYLAALQVALVATIDDGKRISI

SEQ ID NO: 624 - protein, 1148 aa, Azospirillum lipoferum
MKLKDVLLRDPGQTRLANNGQARLVDDRDTEKAMLELREELKSFVCEGQYADGMIKILRAFLNGGTSLPGAWVSGFYGSGKSHLLKMLCHLWQNTAFPDGATARALVPSLPDEVKELLKELDTQGKRAGGLLAAAGAMPNGGTDAVRLTILSVILRAVGLPEQYAPARFCLWLEEQGKLDHIRDAVKAAGKDFNAELNSLYVSPLIANALMSAIPDLATGPGQVRLLLREQFPQKLTDITTTEFLDAARAALRLRGHDGQIPLTLLVLDEVQQYIGTVHDRSVLVSEVAEAVSKQMNGRVMIVGAGQSALSSAPHLQRLMDRFTVRVPLSDIDVETVTRKVLLQKKPAALGNVRSTLDTHAGEVSRQLSGTRIQEGPEDRAVIVDDYPILPVRRRFFEECFRQLDAGGTQSQLRSQLRIVHDALHKRADRNLGTLIPADELYEALAPELVNTGILLREINERILQVRKDVGDLAARICGVVFLINRLKREAGMDTGIRSTKEHIADLLVDDLTADNGRLRADVDEMLKRLVDRGDLMPVDEEYRLQTREGTEWDREFRAQQNRAAADTSTVYFRREQLIGAEFESAIKGVQLLQGDAKELRKLAIHRGDTPPPAETSVIQVWMRDGWTSTEKQAQDAARAAGNESPTIFVFIPRAHPDALRDGIRDMIAAKATLDAKGIPSTKEGEEAKLSMDSRLSIATKAVQTLVKEIVGQTKVYQGGGNEVMRLTVADQIEAAAEDSLVRLFPRFKEADSGHWETVFKRAREGADNPFQVVGHAGALETHPVCQQVLTTIGAGRSGSDIRKELQAPPLGWPKEAIDAALVALHSAGVVTAVANGEVIAPKHLDHNRIPKADFRKEGFTLSATQKLALRKLYQLLGVPNAAEQLAANAPEFLSKLKGLGAEAGGAAPLPASPDTKDIADIEHLAGNERLNAIHAKAADFTARIEAWTALKELKDKRLPAWTVLDRLSGHARGLDGAKDPLEQVETIRDKRLLLDGTDHVTPVRAALAALLREEVGTLHAAHLKAHRAAEAELAGNVLWGRLAADQQASILADVGLTAPADPNLSSDETLLQHLDRKPLPTARAEIDAVAGRVQRALEKAAKLLEPKVRMVMLERTTLKTPEEVEAWLAKARATLTDALGDGPVMVS

SEQ ID NO: 625 - protein, 1212 aa, Bifidobacterium animalis
MDDTIALKGIFAKDIDRRINGVIKAHDDRVLGQEIDEYVLTNEIQRNLEKFLDAYDDPDNHVDNGAWISGFFGSGKSHLLKMLSFILGTVPHALIDKNGVPSIPSRERIVRTMMDKAHDQDNLELEGLLDRSLRIPATSMLFNIDQKADKSKQAPLLFTFIDVFNAACGYSGGNRSVARFERDLDANGKYKAFKQAFEARAGKSWQEGRDEAILWDPEIGQAYADVTGGEPQADIIGRYENGFSASVDSFTNDVVDWLDRQSPDHRVLFMVDEVGQFIGDDTHRMLDLQSIAEDLNAKTNGRAWIVVTSQENLDTIISNQSHRQGNDFSKIQGRFSIKLKLDSADTMEVIQKRLLAKKPEYVPELEDLWELKHDDMRTLFEFNADTHVQDNKAGTEPDFVASYPFLNYEFGLLQSAFHAMSDFGMFSGRHSSVGERSMLSAWSATLQATADERLGYLVPFDRLFDGIKDILQSTQTHRITEADQRLDPDVHDLGVRLLKVLLMVKHVRDFKATPHNLRILLTDGFDVDITDLERRIRDTLTVLENHTYVQRIDNVYTYLTNEEQDIEQEIKNTDIDDGAVTKYLRETFVDTVKTLRIVYGKQQTPFSYTLSIDGIAQGRAEPIGLDLRTHADDVSDLMLQTSGDRSTISLLLDQSDANLFNDIRMIVKTDTFLKRNLDATDRTSTRQTIIMAKQARKEAQEHAVRDRVRQAIAKGSFYYDGAAADVPGSDAATRITTAMSDVIRNHYSNYAMLGDLVYHDNEIDAYRAAGADEEGRKLVGIDSQIQRIAPITGDIVDTLTLKTNQRTTVSVKDLIGIYHEAPYGWPDDIMLCMLAYLYGAHRVELGIDAHPITNTQLVALLRNARKRESIIVTLPKRVDPTHVKRLEEFASTFLDGLRRGPGVDAQQFAQQVFEGIENRLDEIRDLRTSHREDKAIVDQLDGPVTMLYYVVRQQSPWLLEGFTDADSDYGYEAVLEADEDVIRPILEFFSGKQFRMFRDSRRWLQDNHPNITVCATDETGQLQAQAQALLDDPDVYRGSKTRRLKELVDRLRAIVDEQVNHERTMALTKLDAIVSELKDSPQYREATEDAQHMAERRLEGERTWFENASDISAMHVRVEQVSVKLRPSLYNELAAHPRTPAVQEPAHAETTPAPDHAPAVIKPTRRHVITMDSVSKPSGFSSLRTKDDVDEYLDEYRRHLIEAIENGNEILL

SEQ ID NO: 626 - protein, 1194 aa, Bordetella parapertussis
MNEGSVMTLKTIFNKPVDRPIEGVIKADDEASLRLEIEEYVLTNEVEKRLESFLDAYNNYEGANGVWVSGFFGSGKSHLLKMLALLLENRQIDGASALDLFLPKCGDNEILRGDLKRAVAIPSKSILFNIDQKADVISKTQIDALLAVFVKVFDEMCGYYGKQGHIAQFERDLDSRGLYDQFKSAYESSAGRTWQKGREQALLEAKNIAKAYAQVTGGDEASAMGILDKYRSQYRVSIEDFAEQVHAFIERQSPDFRLNFFVDEVGQYIAENVKLMTNLQTIAESMATKCRGRAWVIVTAQEDMGTVVGEMGKQQGNDFSKIQARFANRMKLTSADVAEVIQKRLLMKTEEGVRLLSDTYHAQSNNFKTLFDFADGSQTYRNYQDRDHFIHSYPFIPYQFALFQSAIQNLSQHNAFEGKHSSVGERSMLGVFQQVAIQIGDHEIGQLATFDLMFEGIRTALKSNIQRAIIQAENHLDGPFAIRLLKTLFLVKYVKEFKPTLRNLCVLMLDGFNQDLPALRKRVEEALSLLEQQTYVQRNGELYEYLTDEEKDVEQEIKNTEVESSDVAAELEKIVFDHVIKHRKIRYDASSSKDQGQDYPFSRKLDDRLHGREHELAIHVISPFHEHAENEQMLRTSSTYKSDELFLILPADERLIRDILMYKRTEKYIRQNISITQQEAVKRILTDKGFQNRERYAELQQRVQSLMSKAKLFVAGADIEIGSEDAQTRVLRGFHELISRAYPNLRMLRGISYTEEMIKTILSNKDGTLFGSGATSLAESEQELLAFIQSNNRGGVRTTLKNLLEKFERKPYGWYYAAVLCTLANLCARGKVEVRTDGNLLEEDELERALRNSHGHGNVVLEPQVEFSASQVRTLKEFFEDFFDTPPGAGEAKALGKETGTAFQELTHQLTPLAAQASQYPFLNALTPVLEKLKELTGKPYTWYLTELTRQEDALLDMKESVIDPVRKFMSGPQKGIFDNARKFVQNQEPNFAYIEGDETARVVASLTDPECFKGNRMQQVKTQVETLQEKVTAQIEAEIAKAKETVAALKGRLCGMTEFSALNGEQQEQITRPFNEFNAAIERQKLIAVIRDTLRRFEESDYQRLLSQMTSWAQPAPTPEPAPKPGQTATPDEGTKPTSPAKPEPRIEYVPSRSVKVSFDKAWLADEADVERYLESMREALLDEIRKGKRIQI

SEQ ID NO: 627 - protein, 1153 aa, Burkholderia sp.
MLNRDIYSKPPKENRLVNNGVAEVSEDHSDAARAILRYELETFVCDGQYEKGLETILDKFLLNLDAGTEQPGVWISGFYGSGKSHLAKMLRTLWTDYEFADGATARSLASVPTGVFDQLKELSTQGKRYGSLHAAAGKLGAGAGDKVRLALLGIVFKSKGLPEQYNQAQLVLWMQREGVLPTVEAELQAAGRSLAQELPHMYVSGHLAKALLKARPDLAHTEADARKLLKEQFPQVTDVTSEQMTTAIADALSVEGKFPLTLVVLDEVQQYIGTDAEKAFQVQEVTETLSKHFNGKLLFVGTGQSALSSMPNLQRLMGRFPVQVMLGDWDVENVTRQIILAKKPTAQPEVENVWRANLGEISRHLRGTKLEYVTDDEDVMTSDYPLLPVRRRFWERVLRTIDTTGTVSQLRSQLRVVHEAVLASADAPLGHVVSGDFLYDQIAANLVSTAQLPKEVFENVQRFATGDADSQLKARLLKVVYLINKLPADAALDIGLKATEDALADLLVTDLAAGSAELRKKLPALLDELQNKDRLVMALVGSSGTEYRLQTRESSAWYDEFRAQEAELKAAPQRVEQKRSTLLKERFGEVLKKVRVVQGKDNVERRLTPTYDDTLPKDHAQNIYLWIQDGWQAEEKSVIAEAKAKPADNPTLFAFLPAQHKTELANAIVALEAARTTLQKKGSPATEEGRDAQRSMESRQRTAEKELSELLDQLLGGVRVFQAGGQEAQDGNDLADRINRAAKASAIRLYSQFDAADHDQWSKVLDEARKGNLEALKAVGHSQEADKHPVCQKLLAYIGPGKKGAEIRDNFDASPYGWPRDAIDGALYALLAAGHIKATDASSKAVDAKSLDRAKLTQTTFQRESVNITPPQLIKIRSLFSTVGVPCQPKEELAKVPPLLARLREQAAKAGGSAPAPQTPKPAFIETIEGQTGNAQLLALFEGFDEIVGQFKSWVQTDDAIAKRLPVWHQLTELLHHAKGLGPYAELKAETDAIETQRSLLAEPDPVRPLLDKAVDLLRQALGAKLNAFEHVFAQQQAQLQADADWAKLTDAQRSELTQAHHLNTPTTIALGTPDQLQDALDECDLDHWVTRTQALTSRFEAARQAAVQLLKPNVVHVTIPRRTLNDEAELKTWLAEVEALLAEKLKQGPVAL

SEQ ID NO: 628 - protein, 1223 aa, Burkholderia gladioli
MKIRELFVKPIDRPINGVVKADQRDDESIWQELDEYVATKEVTEYLRRFFDAYLATVDHPNDPTISARMGVWVSGFFGSGKSHFIKILSYLLSNLEATQPKDGAKRHAVEFFNSKVKDPLLLGDIRRAVTSNTDVVLFNIDAKADSKSGRDAILQVFLRVFNEMQGLSGDAPHVAEMERYLISKGAYETFKHAFKAANGNDWERERDAVDFLRDDVIAGLSQALDMSPDSAAKWFDNARDAYKINIEGFATLVRKYLDAKGPRHRIVFLVDEVGQFIGKNTQLMLNLQTITEELGTQCKGRAWVIVTSQEDIDATLGEVNQARTNDFSKITGRFHTRLSLSSSNTDEVISHRLLEKTPAARDALESLWASKGDIINNQLSFADHAIAFRRYRDAADFVAHYPFAPYQFQLLQKVFESIRKVGATGRHLARGERSMLDAFQTAAKHNGKEDVNALVPLYDFYPAIESFLDSSVKRAIDQAATNPALEEWDLQLLRALFLIRYADAVKGTIDNLATLCLDQVDADKLALKKKIEAALLRLERQNLVSRNGELWFFLTNEERDVSQEVKSVSISEGEISRLVAELVFDEILGGQTKVRHRETKRDYEFNRLLDGVPYKQANQALTFEVLSPVGPEYEMMHEARCIGRSAEGTAGRALLKMANDARVYVELKTYLQIEKYIAPKVDTASPSLKRILYDRKDENRDRRTRIVSQLTEMISAGDFYAMGQRLTCKPQSPPALLDEMLNYLVTNTYFKLGYLKVRQADPIAEIRAVLSADTIGQQSIALEGEAGNALALGEMRQFLDMSAQNSRVLLSDVVERFAGVPWGWRPEWESVLLVARLFMAGEIKLVMDGADLDPLAAIEPLTKAARLKSVSILKRKTSDAQTRAKVRELHRDMFSTMPPDEEDPLVAEFRANLTRLKADLERARGKAELKDYPGSSEIAEALGAIDRQLARRDAFEFLEALANQRNEWRSRADDVHDVLSFYQNQAPVWARLLEALGSFADNREPLLNDATAAAALAELERIRTNPAPYGQVNRIEQLVATVERVNDALAGERRERALRSVDAKIAEATHALDGANADADLRNRALKPLQDLKAQLASLVSIPRILFLQGRAGDLLDAAMDQIARAARSRATTAPAANPGASASKSTAPSPSPGAAGAPSDGGSAAPAAAASAPTARPVKVIRTSDLSAKTYLDTAQDVDDYLAKLREELIAAIESGHRARLQ

SEQ ID NO: 629 - protein, 1210 aa, Burkholderia vietnamiensis
MKIQELFVKPINRPINGVIKADQRDDASVWQELDEYVTTKEVTEYLRSFFDAYLATAAHPNDPSIIARMGVWVSGFFGSGKSHFIKILSYLLSNLEASRPGDETTRRAVEFFDSKIKDPMLVSDIRRAVTGDTDVILFNIDAKADSKGDRDAILQVFLRVFNEMQGLSGDAPHVAEMERYLISKGAYDVFKQAFKAANGNDWEHERDAVDFLRDDVIAGLSQALDMSPESAAKWFDNARESYKINIEGFAALVRKYLDAKGPKHRIVFLVDEVGQFIGKNTQLMLNLQTIVEELGTECKGRAWVIVTSQEDIDATLGEANQARTNDFSKITGRFHTRLSLSSSNTDEVISHRLLEKKPEARAELEALWKEKGDIINNQVSFADHAVAFRRFRDATDFATHYPFAPYQFQLLQKVFESIRKVGATGRHLARGERSMLDAFQTAANRNSDRDTDALVPLYDFYPAIESFLDSSVKRAIDQAESNPALEKFDGQLLRTLFLIRYADAVKGTIDNLATLCLNRVDADKLALKQDIEASLLRLERQNLVSRNGDLWFFLTNEERDVSQEVKSVNVSEAEISRLVAELVFDEILAGQTKVRHRETKSDYEFNRLLDSVPYKLANAALTFEVISPIGADYEMMSEARCIGRSAEGSGRAMLRMSNDPRVYIELKTYLQIEKYIAPKADTATASLKRILYDRKDENRDRRSRLVGQLTEMMSAGDFYALGQRLSVKPQSPPAVLDEMLNYLVSNTYSKLGYIKVRQADPIAELRAILTADTVGQQRMALGGEDGNALALAEMRQYLDVVAKSSRVLLSDVIDRFTGVPWGWKPEWEIVLLVARLFMAGEIKLVMDGADLDPLGAVEPLTKPTRFKTVSILKRKTSDAPTRTAARELHRDMFATMPPEEEDALVTEFRSHLTQLKTDLERAKGKAEHKDYPGGTQIVRALIAIDRQLALRDSFEFLDALVQGRNDWRDLADDVHDVLGFYKNQVPVWSRLLDALTSFSDNKEALLNVQEAANALAELEMIHHNPEPYGMINRIEGLVAAVEKVNDAIAGERRERALRSIDERIDEAQQALDAAQADPSLRNAALSPLQALKAQLAGLVSIPRILFLQGRAGDLLDEAMDKIARAAKLSESSKAAVKPQADGTGAGGSDQTNGANGANATVSLRPIKVVRPSELSGKTYLESTDDVEKFIDTLRHELLAAIAAGHRARLQ

SEQ ID NO: 630 - protein, 1161 aa, Calditerrivibrio nitroreducens
MIIKNIFEKDIERPINGVVKVGQDDLNIIKTEVEEYIVTSEIKKYLDDFFTHYVETLGMQTDKIGIWISGFFGSGKSHLLKMLAYIIENPTIGDNLTAGEIIREKVKDDALLSANIKKAYQTPSDVILFNIDSMSDTADGGEESIPKVFRRVFYDKLGYFGRFPFIAEIERNLDKKGCYEKFKDKFKELTGFNWIDERKNFALHEKKIFEALAYCNNVTIEEAENYYNKTEDYFKSISISDFAEMVKEYVDQKNKELKTNNYRLLFMVDEVGQFIAQDTNKMLNLQTIVEELGVKCKGSVWVVVTSQEDVESIIGDLPKTSKNEFSKILGRFKRFSLSGSNTDEVIKKRILAKNVEAAEELKKLYDKYSSILKNQFTFTADTATFEKYKDENDFINTYPFIPYQFKLLQKVFEAIRTKGIAGKHLSHGERSMLNAFQEACKNIKDSELGYISPFYLFYDTIEGFMDSYVLLTIKNAETNSSLNSFDVNLLKLLFLIRYVGQIKSNIDNIVILMLEKIDQDKQSLKEKIKESLSKLEHEVLINKSGDTYNFLTNEERDIRQEIKRIPIDSDARSNFIYEIVFNEIYLDTKHKYTHYNNNYDLIRTVDNISKGNGKLEIKVVTQHYYETSDSNLAMESQQRRIVIRLNSSNDLERELKAYLQTDEYIRKHQVSTKESFSNIIRDTQKENDERRKRIKSIIENLLENADYFGLGNKLNLLKPVNFRNVLRDQLDEIVGHIYHKMYLITQNSIKTASEIKEALNKKRSIVIDITTNDSAENEIINFIRDISHLEGNVTLKKIYDRFTEEPYGWKLLDIQYVIAILVANEKIHLLYQNEKISSQFHSKLEELITKSSYQSVVYVTLPQTANEDEINKAKQIFQEVSDNIPEENSDDFLKQFKKYINDLVEDIKANLGSLSSDFIPKVIAEEYLEELVKIAKQSDKVDIIKGIINNEKNLPTWIEYLGKVKNFLSNQIDRYKEIREFINTYKDGIVHYDHKTANDLLSKCNEYIKSESPFHLTIALANEIDNVSNELKKKLESKKEACIDEIRKRYEYALQISKENNEKIDEKLDPLDKMIEQIKNELKIENVIAKHSTFTQKIDKIIEIIKNKPKDKNTPKRVKISSIIYPKIISSKEEIDSFVNELKEKLYKELQNNEKIEISGD

SEQ ID NO: 631 - protein, 1187 aa, Carboxydothermus hydrogenoformans
MRIRDMFYKKIDRDIKGVIKIGQEDEENAYQELEEYVVTRELKKYFSEFFEAYKKGIIGYTDKMGVWISGFFGSGKSHFLKILSYLLENRVVKGKKAVEYFRDKIDDPMVLADIEMAGNISADVILFNIESKADADSKTQKDAIVKVFNRVFNDMQGFCGSIPWLADLERQMSKDGTYEDFKKEFERISGRKWEEAREDFYYEEDAIVKALASATKMSEQAARNWYNKAEENYTLTVDKFAKRVREYIESKGGNHHVVFCVDEIGQYIGDNSGLMLNLQTLVEDLGTECGGKAWVIVTSQEDIDSITRVKGNDFSKIQGRFNTRISLSSANVDEVIKKRLLKKTQVATDTLKLLYENKSSILKNLITFSADTPEKKFYTDSNDFAEVYPFIPYQFNLLQQVFTSIRIHGASGKHLSEGERSMISSFQEAAIRYADCEEGTLIPFSAFYDTIETFLDSNIRTVIIHAQENSNLNDFDVELLKVLFMIKYLTKEIPPNIENLATLMVSHIDEDKIALKKKIEESLKRLIKENLVQKDGDWYIFLTHEEQDINREIKNIQIDTAEIIQKVSEIIFEDIYPDKKFKYSTRYHFPFNQIVDDRFFRGNQGSEIGVKIITPYYDSGSEMTQLEFKEMSQRENNLIVKLPPDTTFLEEMEEVLKIEAYLRKNGGIASTPTMEEIKNRKRNEASKRKERVKSLIIDALKAAELYVNAQKLDIREKDPVERINEGLRVLIDSLYTKLGYIKAFIDSPSDINNILTQEAVQMSLAEDPNKLALEEVSSYIERNTARNIPVTMRTVINVFQKAPYGWNEEDIEGLIAKLFKAQEVKLQLNGEYLDINDRDLVKYLTKRDYAEKLLIEKRIKISPVLINTAKEIVKEVFGRTALPNDEDGLMRKIKEYMQDECNHIDQLLQNYKYAKYPGKDVLEEGKKLFTALLKIRDAKEFFEEIQNKKEELLDYGDYAHDVKKFFDPEGKQKEIFDKGMRMVELYEKNKTYVLDKAAIELYEQIARIINSKEPYSEIYRLPDLIDKFTKRFAELLEEEAKPIKQVVESDKKKVLDELSSYDFKDKYYEKFRKGFDDLLYRLDHANNFYEVIAMKEESDRLKQRYFEEIANEVEKQKYSHGGASIVAETPEGVIKPPKQKKIVNISLSHLLHGIRNIESKEDIEKLLDEIRAKLESELDENTIIKIV

SEQ ID NO: 632 - protein, 1203 aa, Chlorobium phaeobacteroides
MTLKTIFNKPVDRPIEGVIKADDEASLRLEIEEYVLTNEVEKRLESFLDAYNNYEGANGVWVSGFFGSGKSHLLKMLALLLENRQIDGASSLDLFLPKCGDNEILRGDLKRAVAIPSKSILFNIDQKADVISKTQIDALLAVFVKVFDEMCGYYGKQGHIAQFERDLDSRGLYEQFKSAYESMAGRTWQKGREQALLEAKNIAKAYAQATGGDEPSAMGILDKYRSQYRVSIEDFAEQINAYIERQSTQENQKEFRLNFFVDEVGQYIAENVKLMTNLQTIAESLATKCRGRAWVVVTAQEDMGTVVGEMGKQQGNDFSKIQARFANRMKLTSADVAEVIQKRLLTKNEEGVRLLSDIYHAQSNNFKTLFDFADGSQTYRNFQDRDHFIHSYPFTPYQFSLFQSAIQNLSQHNAFEGKHSSVGERSMLGVFQQVAIQIGDHEIGQLATFDLMFEGIRTALKSNIQRAIIQAENHLDGPFAIRLLKTLFLVKYVKEFKPTLRNLCVLMLDGFNQDLPALRKRVEEALSLLEQQTYVQRNGEIYEYLTDEEKDVEQEIKNTEVESSDVSAELEKLVFDHVIKHRKIRYDENGQDYPFSRKLDDRLHGREYELAIHVISPFHENAESESILRMQSMGRDELLVLMPADERLVRDILMYKRTEKYIRQNISITQQEAVKRILTDKDFQNRERYAELQQRVQSLMGKSKLFMAGADIEIGSEDAQTRVLRGFHELVSRAYSNLRMLRGITYTENDIAKCLKHSQQGLFGNDATSLAESEQELLAFIQSNNRGGVRTTLKNLLEKFERKPYGWYYAAVLCTLANLCARGKVEVRTDGNLLEEDELERTLRNTHGHGNVVLEPQVEFTASQVRALKEFFEDFFDAPPRASEAKALGKETGTALQDLTHQLTPLAAQASQYPFLNALTPVLEKLKELTGKPYTWYLTELTRQEVALLDMKESVIDPVRKFMSGPQKGIFDNARKFVQTQEPNFAYIEEEVGSGKWEVREGDPDDVSSGVLIAILTDPECFKGNRMQQVKTQVETLQEKVNAQIEAEIAKAKETVAALKGRLCGMDEFGALNGDQQEQITRPFNEFNTAIERQKLIAVIRDTLRRFEESDYQRQLSQMTTWAQPAPTPEPAPEPGETGTPDEGTKPTPPVKLEPRIEYVPSRSVKVSFDKAWLADETDVERYLESMREALLEEIRKGKRIQI

SEQ ID NO: 633 - protein, 1186 aa, Clostridium clariflavum
MLIKDMFKKPIDRDIKGVIKVGQDDDSNVQQELEEYVVTRELAKHFDTFFEAYKKGIVGTTDKMGVWISGFFGSGKSHFLKILSYLLENREVEGKRAIEYFNDKIQDKVVLADMKLAGDTSADVILFNIDSKSDSDSKANKDAIVKVFNKVFNEMQGFCGSMPWIADLERQMVIDGVYEDFKKTFKDISGREWVDAREDFYYEEDAIVEALSKSTKMSPEAARNWYAKAEESYTLSVEKFARRVREYIERKGKNHHVIFLVDEIGQYIGDNSQLMLNLQTVVEDLGTECGGKAWVIVTSQQDIDSVTRVKGNDFSKIQGRFNTRLSLSSANVDEVIRKRILLKDDVVKDTLKLLYENKNSILKNLITFSADTPEKKVYKDSEDFAECYPFIPYQFNLLQQVLTSIRIHGASGKHLAEGERSMISSFQESAIKYMNSEEGTLIPFSAFYDTIEAFLDSNIRTVIIHAQENGNLNDFDVELLKVLFMIKYVKEIPANIENLATLMVSHIDEDKIDLKKKIEESLKRLVKETLVQKNGDQYIFLTHEEQDINREIKNISVDLGEVIQKISEIVFEEIYPDKKYKYSSRYNFSFNQVVDDRFFRGNQGNDIGLKIITPYYDTGVELTDNELKLMTMRENNLIVKLPNDTTFLDEMEEVLKIETFLRRKGGTSLTQKIEEIKDRKRRELVERKERVKFLLTEAIKNADMYANSQRLEIKSKHPVDRINDGFKVLIEGIYTKLGYITHFTTTKDLYDIFADNEQITLNGVEAPNKLALDEMAGYIERNTTRSIPVTMKTILGIYGKAPYGWLEEDIEWLVAKLFKAQEIKLQLNSQYLDVQDREIVKYLTKRDYADRLLIEKRIKVPAHQISNARELCKELFNITAVPSDEDGLMRRFKELARDEIAKINELLVYYKQSKYPGQDILEEGKKTLEKVCKINDAKEFYDELQREKDILLDYADDSVDVKRFFDSNQKDFFDKAVHKINVYNSNKTYVLDKEVIDLVAQMQKIVESREPYSDIHKLPGLIDKFVSRFTELLEEECKPVRQVIESDYSKVLEELDKYELKPVLFDRFKARFDDLLNRLERANNFYEAIAMKEESDRLKLRCFDEIAEELAKRKPVEPPTTPEEPDKPTVKNDPPRKYKKTVNISIANILHGAKSIESEADIEDVVNEIRNRLKRELKDDVIIKLV

SEQ ID NO: 634 - protein, 1186 aa, Clostridium clariflavum
MFIKDMFKKPIDRDIKGVIKVGQDDDSNVKQELDEYVVTRELSKHFDSFFEAYRKGIAGTTDKMGVWISGFFGSGKSHFLKILSYLLENREVEGKRAIEYFNDKIQDSMVWANMKLAGDTSADVILFNIDSKSDSDSKANKDSIVKVFNKVFNEMQGFCGSMPWIAELERQMVVDGVYEDFKKTFKDISGREWTEAREDFYYEEDAIVEALARSTKMSHEAARNWYAKAEENYTLSVDRFAKRVREYIERKGNNHHVVFLVDEIGQYIGDNSQLMLNLQTVVEDLGTECGGKAWVIVTSQQDIDSVTKVKGNDFSKIQGRFNTRLSLSSANVDEVIRKRILLKDDVARDTLKLLYEDKSAILKNLITFSADTPEKKVYKDGEDFAECYPFIPYQFNLLQQVLTSIRIHGASGKHLAEGERSMISSFQESAIKYMNCEEGTLIPFSAFYDTVEAFLDSNIRTVIIHAQENENLNDFDVELLKVLFMIKYVKEIPANIENLATLMVSHIDEDKIDLKKKIEDSLRRLVKETLVQKNGDQYIFLTHEEQDINREIKSISVDLGEVIQKVSEIVFEEIYPDKKYRYSSKYNFSFNQVVDDRFFRGNQGNDIGLKIITPYYDTGEELTDNELKLMSMRENNLIVKLPNDTTFLDEMEEVLKIETFLRRKGGTSLTQKIEEIKDRKRRELVERKDRVKRLLTEAIENADMYANSQRLEINKKDPVEKINDGFKVLIEGIYTKLGYINFFTSAKDLYDIFSDNEQITLTGVEAPNKLAVEEMAGYIERNTARNIPVTMKTILGIYEKAPYGWLEEDIEWVIGKLFKAQEIKLQLNSQYLDVQDRDIVKYLTKRDYADRLLVEKRIKVPAHQISSAKELCKELFNITAVPSDEDGLMKKFKELAKDEISKIDKLLVYYKQIKYPGKDILEEGKNTLEKVCKIQDPKEFYEELQKEKDILLDYADDSIDVKKFFDSNQREFFDKAVHKINVYNSNKTYVLDKEVIDLVEQMKKIVESREPYSDIHKLPSLVDRFVVRFTELLEVECKPVRQVIENDYRKVIDELNKYEFKDVLYNKFKGRFDDLLDRLDHANNFYEAIAMKEESDRLKLRCFDDISAEIAKIKAPTQPTEHQDLGSPEIVNNPPKIYKKTINISIANILHGAKTIESEADIENVVNEIKNRLKSELKDDIIIKLV

SEQ ID NO: 635 - protein, 1188 aa, Clostridium ljungdahlii
MELKKMFLKDIERDIKGVIKVGQDDDSDIFQELDEYVVTNELLGHFGDFFEAYKKGILDHTDKMGVWISGFFGSGKSHFLKILSYLLENRVVNGKKSIEYFDNKVYDPMVVADMKQAGDITADVILFNIDSKSESDSKADKDSILKVFNKVFNEMQGFCGSIPWVADLERQMVKDEVYEDFKAEFEKISGSSWEDSREDFFYEEDSIVEALSKTTKMSEETARDWYNKAEENYSLSIEKFAQRVKEYIETKGKNHHVLFLVDEIGQYIGSDSQLMLNLQTVVEDLGTYCGGKAWVIVTSQQDIDSVTKVKGNDFSKIQGRFNTRLSLSSANVDEVIKKRILQKKPGAADSLKLLYEDKCSILKNLITFSNDTAEMKVYENENDFAEVYPFIPYQFNLLQSVFTGIRIHGASGKHLAEGERSLLSAFQESSIKYENEEMGVLIPFSAFYDTIESFLDANIKTVIIHAKNNSKLNEEDVEVLKLLFMIKYVKEIPSNLENISTLLVKHIDDDKLEIKKKVEESLKKLVRQTLIQKNGEEYIFLTHEEQDVNREIKSITIDMGEVIQKVGGTIFEEIYTEKKYRYSSKYDFPYNAMIDDIPRGQQNNEIGLKVITPYFETGIDLTHQELKLMSARENNVIIKLPNDTTFLEEMEEILKIQAYLRVKSGTASTQVIEDIKTRKSREVSERKDRVKNLLIEGLKTAEMFANSELLDIKEKNPVERINDAFKTLIDTLYSKLNYIKEYIDSSRELQDILLNNNVQGSFIEEKNKLAIDEVNSYIERNTSRNIPMTMKGIIGLYSKAPYGWVELDIAAIIIKLFKAQEIKIEYNSQYLTTDDRDVVKYLTKRDYLDKVLVKKRAKTPVKYITNVKELCKELFNYSAVPADEDGLMSRFKDLTQGEIASIRELLVYYKQANYPGKDILEEGKRIFDEVISIKDTMEFYEKCYELKDDFLDYADYSEDVKKFFKNQKKFFDDALEKIEIYNKNKTYVLDEQAIDLIQKINEIVRSKEPYSKIPQLPGLIEEFSNRFTDLLEVECEPVRKVIQLDCEKVLNELSLYEFKDELSAKFQKRFDDLISRLDRANNFYEAIAMKEESDRLKMRSFEEISKEVERRKPPVVPNPEPVVGGGADIIRGEKPPVYKIKKTKNISIANILHGAKTIETEADIDELLKDIKAKLKQELNEDTRIKLV

SEQ ID NO: 636 - protein, 1207 aa, Clostridium saccharolyticum
MYVKNMFAKAIDRDIKGVIKVGQGDDENVRQELEEYVVTRELQKHFADFFSSYKKGITGNTDKMGVWISGFFGSGKSHFLKILSYLLENRVVDGKTALDYFIEDRKIKDEMVLADMKLAANVSSDIILFNIDSKSGMADAQNNKEAILSVFLKVFNQHLGFYGANPFLADLERHLSDEGKYVEFKSVFAEIRGKEWEASRHQFRFVQDQVCKTLVHIGYMSMEAAKNWCESSTGAYNIDVATFANMVKHYIDKKGNNHHVVFLVDEIGQYIGEDSKLMLNLQTVTEDLGSACGGKAWVVVTSQQDIDSITKTKGNDFSKIQGRFDTRLSLSSANVDEVIRKRILEKTESGRQTLGLLYDEKDTIIKNLIIFNDGIEKKLYSDRVNFSAVYPFVPYQFNLLASVLTSIRTHGASGKHLAEGERSMLALFKESAVRIMDKSEGTIVPFNMFYDALEQFLDHSHKGVIIRAYDNEYLNPDKAEDCFDVNVLKTLFMIKYVKEVVANLENITSLMVSSIDEDRIALKSKVEEALKRLVRQTLIQKNGEIYVFLTDEEQEINREIESQNVEISEVVGKVSELIFDGLYDEKKYRYPAFNGRYTFGFNQLVDDRPYKANQNFDISLKILTPNYEMGTDETTLRLMSGQSKSVLVVLPDDKAFIDEIRSALKIEKYLRLNTSNTVSKYEQIKEAKRVEMRERSGNARIFLEQSLRSADIYTNGDKLTIGAKDITARINEAMGKLVNTTFHKLSYIDAAMGEANVRAVLKGTNNSQISLEGTVQTPNRLALNDVLDFISMNSIRHAKTSMKAIMERFTKPPYGFIEDDVQWLVAKLFKDGDVAFFVNNDVVTLITKTEDEVYRYLSRKEYLEKLLTEKRERANDKQKKAVRDVMKELFNITPSSDEDDAILKSFQQYASHLKNDLEKLEIHYKNEPTYPGKNVVKEGKSLLLNLLDIQYSSEFFKTVDEKQDVLLDFAEDYEPIKGFFKGDQIDIWNRSLKLIKIYDDSKTFIVNAEIESVVEEVKSIMKKSTPFGEIRKIPELLDRYTDLYSSMLTEMEKPIFASIKEARQRVIEDLDSKECKESFSKKVAERFDELYKKAESCNNVATLQNIKVEADALKVRLLNEIGEEEARLIAARKPITLVVPPTGGVSDPPGTYDLPKVKKQKTVSIKTINTEATWRIETEADVERYVDALKAKLKQRIQDDIILNVEF

SEQ ID NO: 637 - protein, 1217 aa, Clostridium saccharolyticum
MQIKDMFRKKIDREIQGVIIVGQGEETNVAQELEEYVVTRELQRHFADFFAAYKKGIQGTTPKMGVWISGFFGSGKSHFLKILSYLLQNKQVGDKHAIDYFIEDQKITNQMVLADMQLAANTPSDVILFNIDSKSDSNGKENKDAIVNVFLKVFNEMQGFCGSMPHLADLERRLSEEGRFEEFKEKFEEEYGDPWESSRQDFDFIQDSVVDVLSDMDFMSESAARNWCEKATESYQISIEDFAKRVKSYIDKKGNNHHVVFLVDEIGQYIGDDSKLMLNLQTVTEELGKECMGKAWVIVTSQQDIDSITKVKGNDFSKIQGRFDTRLSLSSANVDAVIKKRILDKTETAAQSLRLLYDQKATIIKNLIVFNDGVEKKLYANAEDFAEVYPFVPYQFNLLASVLTSIRTHGASGKHLSEGERSMLALFKESAMQLMDDEMGAIVPFYRFYDALENFLDHSHSSVIIRAYDNSYINPEKKEKDVFAINVLKTLFLIKYVLEIEANVDNIVSLMIISIDDDRISLKAQVEDALKVLMRQMLIQKNGSIYVFLTDEEQEINNEIEKENVEMPEVITKIAEMIYEDIFSSKKYQYPSFGGRYAFSFNQTVDDRPYKANQNYDIGLRVLTPWYEGGTDDGTLRLLSGQGKEVLVVLPNDDAFLTEMRAYLKIERFLRKNTSVQLAKYETIKEAKRVEMRERNGNAKLYLTEALKEATIYVNGDVLHTSGKEVTSRINEAIGRLVQTVYHKLSYIDAAMGEADIRKMFKTSNQLSLALGDTGESNVHALDDVLQFVAGNSRMHMKTSMKTIKDRFMKAPYGFVEDDIHWLVARLFKRGDLSFTVNGESINLNNRSEEEIIGYITKKQFVDKLLTEVRVRVPENQKKAVRTVMKELFKVAPPADDEDTIMKNFQHYCENRITEIERLEPKYENYAYPGKEILEKGKKRLSALVQIQAPLEFFKTVFDEQDDLMDFGEDYEPIRDFFGSEQLTIFTRALDMLNIYEDSKTYIVDAELEDVVAKMRTIVRMPKPYKEIPKLPELREKFMNCYMRILEEQAEPVKDSINQDRNRVFEVLNTKSYKDAKFNRYLELFKEIMDGAEHCNNVSTLRSYADKAEALKLRLLNEMNAEDIRLAKEAAAKAEAERKRQEEEAKKRGETVKPAEKVAEPQPVYKVRTTKNVSIKTVAKTASWRLESKDDVDKYLAALRENLLKEMDEDTIVNIEL

SEQ ID NO: 638 - protein, 1212 aa, Clostridium sticklandii
MYIKNMFAKDIDRDIKGVIKVGQKDDENIKQELEEYVVTKELQKHFADFFASYTKSISGQTDKMGVWISGFFGSGKSHFLKILSYLLENKVVDNKPALDYFLDDNKIVDEFVIANMKKAANISTDVILFNIDSKSGMADSQNNKEAILSVFLKVFNQKLGYYGANPFLADLERHLSDEGKYEEFKQAFAKIRGKEWIDTRHMFRFIQDSVCQALVDIGYMSMDAAKNWCDTSTGVYNIDVTTFASMVNSYIEKKGANHHVIFLVDEIGQYIGDDSKLMLNLQTVTEDLSTHCHGKAWVVVTSQQDIDSITKTKGNDFSKIQGRFDTRLSLSSANVDEVIRKRILEKTETANDTLGLLYDEKETIIKNLIIFNDGIEKKLYSNRYNFAEVYPFVPYQFDLLGSVLTSIRTHGASGKHLAEGERSMLALFKESAVKLMDKSEGAIVPFNMFYDALEQFLDHSHKGVIIRAYNNELINPDKSEDCFDVDVLKTLFMIKYVKEVVANLENITSLMVSHIDDDRIELKTKVEEALKKLVRQTLVQKTGDIYVFLTDEEQEINREIDSQAVEISEVIGKVSEMIFDGIYDEKKYKYPAFGGRYTFGFNQLVDDRPYKANQNNDISLRILTPNYENGTDETTMRMQSGQSKSVLVVLPDDKAFLDEIRNALKIEKYLRLSNSNTVTKYEQIKDAKRSEMRERSNNARIFLEQSLKNASIYANGDKIQSSAKEISSKINEALGKLVATTYHKITYINKAMGEADIKAVLKGSSSSQISLDETSSVPNHLALADVLDFISLNSQRHAKTSMKTIMDRFTKAPYGFIEYDVQWIVAKLFKDGDIAFYVNNDVVSLITKSEDEIYKYITRKEYLEKLLTEKREKANDKQKKIVREVMKELFNAMPPSDEDDTMLASFHQFAGKLKSELEKLEIHYASSPLHKYPGQTIVKEGKNQLINILSIKATPEFFKTIEKSQDDLLDMAEDYEPVKAFFGSEQKTIWDKTIDKLKIYQESKTFIAKKEIEEIVADIQTIIDKPKPYQDIKKLPELLQSYLDMYGDLLEEMEGPVYTVISECKARVLEELKDEELNQKFLAKINAKFSALEEKTKTCNNVATLQNIKIEADTLKVRLLEEIREEYQKILAKRLKEQNETGLVVDAGGNSTPPTYVAPPKTKKHHIISIKDINSESTWILESEADIDKYIDTLRQKLKQNLKEDLILNIEF

SEQ ID NO: 639 - protein, 1214 aa, Clostridium sp.
MLVKDMFAKKIDREIQGVIIVGQGEETNVSQELDEYVVTRELQKHFADFFSAYKKGILGTTPKMGVWISGFFGSGKSHFLKILSYLLENKQVGDKKALDFFVDDKKIVDPMVLADMKLAAETPTDVVLFNIDSKSDTGSKQNKDAIVNVFLRVFNEMQGFCGSLPHLADLEQQLTEAGRMDEFKEVFADEYGKPWEENRHKFDFIQDTVVDVLVDMDFMSESAARNWCEKASEPYQISIEDFAKRVKAYINAKGNNHHVVFLVDEIGQYIGEDSKLMLNLQTVTEELGKECQGKAWVIVTSQQDIDSVIKVKGNDFSKIQGRFDTRLSLSSANVDAVIKKRILDKTDTAAQTLRLLYDQKATIIKNLIVFNDGVEKKLYANGSDFSEVYPFVPYQFNLLASVLTSIRTHGASGKHLSEGERSMLALFKESAAKLKDEEMGVIVPFHLFYDALENFLDHSHRGVIIRAYDNTKINPEHKESGVFAINVLKTLFMIKYVLEIEANIDNITSLMISNIDDDRIELKGKVEEALKILMQQMLVQKNGSLYVFLTDEEQEINRAIDSQNVEMAEVINKVSEMIFEDIFTDKKYRYPSFNGRYSFSFNQAVDDRPYKANQNYDIGLRILTPWYEGGNDDATLRMMSGQGKEVLVVLPNDAAFLDEIRQYLKIEKFLRLNTSTQLTKYETIKEAKRVEMRERNANAKLYLTEGLKDATIYVNADTVKTNAKEVTSRINEAIGRLVQTVYHKLSYIDAVFGEADICKMFRTSNQMTLGLEGGTDANQHALDDVLAFIAGNSHMHMKTSMKTVKDRFMKAPYGFVEDDVHWLVARLFKRGDLAFTVNGASVNLNNKSDEEIISFITKKAFVEKLLMEERIRVADKDKKEVRDVMKEVFGTGSVAEDEDTIMKNFQRYAENTIHEIQRLEPQYQRFAYPGKKVMESGKKLMQSVIQIQSPLEFFQYVSKMRETFYDFAEDYEPVKSFFGSEQQEIFTRALEMLAIYDDSKTYIVDTELEEIVHEMRSITRQDKPYGNIPKLPNLREQFMTSYMKVLDKEEKPVLDAIEQARARVIEVLEPKEYKDTYLGRYNTLFKEIRDGAEHCNNVSSLRSYADKAEALKIRLLNEMDTRDEQILKIKAEEARRAAEEAARIAKEQGKPACRIAEPPAPYHTKKTKNVTIKHVTHTSSWRLESKDDVDKYLNALRKSLLAELDENDIVNVEF

SEQ ID NO: 640 - protein, 1214 aa, Cupriavidus necator
MTIRSLFDPSKDIYRTIEKVITYGVSQEGRLKAEISEYVVTESIEEQFRKLLDRMQLAMESGGENEVGVWVSGFYGSGKSSFTKYLGLAFDDQRTIDGTPFIKYLQDRLHKPQTKALLNTVAQRFPAAVVMLDLASEMLAGATMEDVSTVLYFKVLQWAGYSRNLKVAAFERMVEKDGRTPELHDRIAQALPGATWARVQNNPLAIDGLIPKIAHEMYLGLFPEAKSFSSSTEGFFQFEDQRVQEMIDIVREKSGKQNIIFIVDEVGQYVASRDNLILNLDGLAKNLKRLGDGKAWIVSTAQQTLTEDDPRAALNSDKLYKLKDRFPIQIDLESSDIKEICYRRLLGKSPAGETELGKLFDAHGQALRHNTKLQDAKYYDADFSKESFTNLYPFLPAHFDILLHLLGALAKSTGGIGLRSAIKVIQDVLKGEGGGSKAMADQPVGWLATTVTLYDELEKDIRRAFPSIHQAVGKVQIRFSDSTLHQDIAKTVAVLQILGNLPVSVQNVASLMHPLVTASSQLDTVKKAVEDMLSDVHVPLGEKDGSLGFLSEKLRDIAQERGAIALRTVDVKRIFNDALRESFDPLPRVSLHGTMAVATGLKVQAGSAITSLAADQSTIQTVVELVPASEYETAKNRILDDSRSRAGRNVIGLLARSNTELDDLANEIYRCQRIAELHRNEPDQEVKDYCTGQLERAAKLATQLQSKIKQSLQAGSFVFRGQATAVSALDADLLEAAKKLLADVADQVFDRYVEAPVRAGTDTAEKFLKVANPAAIGSSLDPLGLVQTVAGRASFKTDHKAMISIRDYIDKRGTVDGKRLLDDFSSDPFGWSPDTTRYIVAAMLMAGEIKLKVSGREVTAAGQQAIDALKTNNSFKQIGVALRDERPSIETLGRAAERLTELVGDMVFPLEQEISKAAAKYFPRFQHDYGSLAEKLAGLGLAGAERVRTLNQDIADVLFTDASDAPQRLGAETSAIYDNLKWALDVKRALDNGLDVTLRDLQAHRRDIESLPDTGVPGELRRELAEDLGALAERLGKEDFYKHTADFNSQLTHLKGRVRDAVISLSDQQKLRLKEGVEDLQRFPEWEELTQEERGNAVNQLDGLILATTQDLAGLKKLLARDYDINSTLEDLKRSIQRQGQERLRQRIEEERAKTGEKGPAKLTKSIAVPVKMTSAADIDALIQQLHEIKAQLGLYAEIEVSFVVGAQPGTDGA

SEQ ID NO: 641 - protein, 1168 aa, Cyanothece sp.
MQLHEIFKKQVDRPIEGVIKADANDEVSLHVELEEYVLTHEVEKRLEEFLSAYNNYTGVNGVWISGFFGSGKSHLLKILALLLEDRRVENSQVIDKFLPKCQNNEILKGDLRRAVTIPSKSILFNIDQKADVTSKTEFDALLSVFVKVFNEARGYYGKQGYIAQFEKELDERGLYVAFKTEYESVAGKPWERGREQVILEKRNIAIAYEKVTGASVEDSMNILDLYRQDYKLSIDDFSQDVKAFIEQQSSNFRLNFFVDEVGQYIADNVKLMTNLQTITESLATKCQGRSWVIVTAQEDMEMVLGEMGNHQTKDFSKIQDRFANRMKLTSRDVAEVIQKRLLMKNEAGVRHLADIFEQQQHNLPTLLRFSDGSKEYSNFQDQDHFIQCYPFIPYQFTLFQSAIRGLSQHNAFEGKHSSVGERSMLAVFQKVAMEIQTQEIGCLATFDLMFQGICSTLKSNIQSGIILAEDNLNNPFAVRLLKALFLVKYVDGFKANLHNLSILMLEEFEQDISDLRNRVQESLNLLEQQTYIQRTGDLYEYLTDKEKDVEQEIKNTEVEVAKVLEALNTLIFDEIIKTAKIRNGEGTQDYPYSRKIDGTLYKREYELGIQVITPFSGQHEQEKALQMENMGRDELLIIIPSDDRLVSDLMMYKRTEKYVQQNISVTQQEAVKSILTQKNQSNQQRYGEIKNRVKSLLGKAKLFVAGTELEISSNDAQNRIILGFQELITRVYPHFKMLAGVNYKAEQVQHFLEQSQDSLFSNDVTVVSEPEKEVLSFAQMNQKRGLRTSMKSLSDNFQRKPYGWSEGAILCMVAKLCARGKLEVQTEGNLLEGEALVEAISNSRNHSNVLLQPQQEFTPSQVRKLKDFYGEFFAQPCGDNEPKAIYQKTKEGFKELSQFIKERLLEREKYPFLSALESVLQTLNDVFNKPYDWYLTDLTDQEDELLDLKEYVIDPIRSFMQGGQKQIYDQAKQLLESQKPNFSYINGDNVSQMRTVLADPQCFKGNQMQQVKGLVESITAEISSQVKTEVEQAQGEIKGLQARMSNMAEFSQLSAAQQQEILQFFQHCYDSIAQEHLIAVIRSTRQQFETDTYPQLLSKMTNLTGVYGVSSGGKSRVKESETQYVPSQGIKVNFGKAWLADEADVEDYLVAMREALMAEIKQGKRIQI

SEQ ID NO: 642 - protein, 1228 aa, Dehalococcoides sp.
MSETIRQLFSPRRPIDRTIEKVIDYYAQEDDRLAREVAEYEVTDNIESCFRKFLDVFSEGVQGGQVTEVGIWVSGFYGSGKSSFTKYLGASLDPTRTVQGKPFFELLCDRFPRNEIPAALRTVSKKHPAAVVFLDLGAEQLAESAAAPVSTVLYWKVLQWAGFSKEKKTAQLEFTLDRRGKYDEFKKKYGVRYKGKWEDIHNDPLIGVARASEIVPEVLPDDFPTPDSFRGLRFEEARDIRDLTREIIDICRRKTGHENIVLLIDEAGQYVALRGELILNLDGLARNLKELGRGKVWIAATGQQTLSEIVEKAAHNSAELTKLRDRFPISIHLDASDIREITHRRLLDKSEEGRKILDALFKEHGQSAVTHTRLSGTALFKGDPDSQTFTRLYPFLPQHFDLLLELIHALARSTGGIGLRSAIRVIQDVLVDKSRVLGADTVKLADREIGTLACVDDFYDTLRADIAKVLPHVIVDVDKTIKIFGANSLETRVAKAVAALQPVENFPRTPENIAALLYRKIGSPPLLDQVRESLRTLISEKECGLIEDPQAGGYVFLSDAVKPIRDKRNGYVPTSGECARAMIDVLKQGTADHAMFRVQPTARLENIKEVRSSVKLGRTLVVGGSEDVELRLEFVDPGLWDGRRSEFLVSTNTQIELKNTVVLLVRNDDTVDELLPEIVRSEKVLGEVDERGADQVVAQYLRAERRAAERSRERVATAMEKAMLGSIFIFRGKPTPVRETGETLDSSVRAVLSGAVKEIFPHFHLAPVRPSTDEAANFLGVERMDRITKDLDPLGLVVKSKGAPRVDTEAPVLAEVLRVFRSKATESGSGRLQGGYLQDLFSAPPYGWTKDTIRYLFAALLRAGEIEFHVPGAGGAVRTAGPQAVEAVKSTVSFNRIGVSSRDAKLPPEALDRAARRLETLFGDEVLPLEDHISRSVRSHVPDLLERIGALPDRLRLLGLPGESRSQRLLADAADLLKGDAGGAAAVLGGVECVLPAEITWAKAIFDALQSGAEADVRNARSVLDSTSDLEQLFPGSTNELLNPMDRAVAEDVLSSDRFHERLPELRGVIRATLDRTENRYATDLAEYRDDLNQALTLLEAEPDWIRLLDEDRADIAAKLACDLPTTVENGDCVRQLQTLLVRRRTLPGLVEDLKTEIKHRRPAEPEPEPEPGKKGKKSPVDEIVEAGSLMQPAVIASAEELDSWLAGIREKLVALLKSNKRIRIKGR

SEQ ID NO: 643 - protein, 1208 aa, Dehalogenimonas lykanthroporepellens
MSIQIKELFDPAKDIYRTIEKVITYSASQEARLKSEITEYIVTDSIEEQFERLLTRMQAAMEMGGENEVGVWVSGFYGSGKSSFTKYLGLALDESVAIEGTPFLKYLQDRLNKSQTRAQLAALASRHSAAVVLLDLASEMLAGATMEDVSTVLYYKVLQWAGYSRNLKVAAFERRLQKDSRYEEFTNRIQNELETPWKEVQNDPLVIDSLIPEIAHEMYPQLFKSSTAFSTETTDFVRFENERVKEMLDIVRETTGKEFVVFIIDEVGQYVGSRQNLILNLDGLAKNLKAIGEGNAWIIGTAQQTLTEDDPRAALNSPELYKLKDRFPIQIDLESSDIKEICYRRLLGKSPGGQQELEGLFDKFGQALRHNTKLQDARYYDSDFDKTTFVNLYPFLPAHFDILLHLLGALAKSTGGIGLRSAIKVIQDILVEGPDDQEPVANRPVGWLATTVTLYDALEKDIRRAFPSVHKAVGKVKIRFTGSQLHLEVAKTVAVLQVLGNMPVTAQNVASLMHAGIDAPSQRDKVDAAIAELINDAIVPFGEKDGNLCFFSEKLNDIDQERAQIPLRSIETRRIHNEALRDAFSPLPSTRLHGSLAVTTGLKAMVGSMVSPLAGERETIQTLVEFVAPQDYDTARTRLIEESRQRSAQNTIYLLGRTSSDIDDKIAEIYRCREIHQRYRNDPDAEVKEYCAAQTDRATKLTGELEHLLKRCLSQGSFVFRGQTTAVDSVNPDVIDATKKHLSNVAEQVFDRYGEAPVRAETALAEKFLRVGNLKAVSSAVDPLGLVQVSGGTPHIKTDHKAVVSIRDYIDRLGTVEGKRMLEHFTDAPFGWSQDTLRYLVAAMLVAGEIKIKVSGREVTVNGQQAIDALRTNNSFKVVGVSLRDERPSNEVLARAATRLTDLVGDTVIPLEDEISKTATKQFPKFQHQFGPLAEKLDALGLPGGDVIRSLNQDLADVLLTDASDAPQRLGSEESPLYDGLKWATEVDRALKNGLEQTVRELQQHRRDIEALPDTGVPGKLRQDLADELTQVGERLSRDDFHSHLADLSTSLTAIKGCARDAAIEMAKTQRTAIKDAADELQRLPQWSELGRDEQSQVLNQIDGITVESTEDLAGIKKLLNQSFVVRSQIDDIRDGIIKTAHERQMSRLEEERKEAKKAGQTKLSRSVNIPATISSAADLEELIRSLQALKAELAVYSDIEVTIKIES

SEQ ID NO: 644 - protein, 1172 aa, Desulfitobacterium hafniense
MKIQNMFQKDINRDINGVIKVAQDDEQSLVQELGEYIITKELRRHFNTFFDNYSKAIDHPTDKIGVWISGFFGSGKSHFLKMLSYLLSNAKVGDRTAVDFFKDKFDDPMMYATVVRCTNIPTESILFNIDIEGPINKDKTAVLRVFAKVFYNHLGFYGEDLKIAKLERFVDKQGKTEAFRRAFEEVNSATWLESRSSYAFFEDDIVSVLQSVLGMSEIAARNWFNGEENTDMSIKQLVEEIKSYVDGKGKDFRLLFCVDEVGQYIGDDGDLMINLQSIVEEVGSKCRGKVWVMVTSQEAIDSVVKISGDDFSKIQGRFNTRLSLSSASVDEVIKKRILEKTEDADRLLRLVYDKEHAVLKNLFTFNNSVMDIKGYADSAEFSSTYPFVPYQFIIIQKVLAEIRKHGNAGKHLSGGERSMLSGFQEAAQKVQGQDENTIVPFAQFYDTVHTFLESPIRRVIDRSQTAADKHDGLEQRDVSVLKLLYLVRYIDDIKANIDNIAILMVDDIRTDKINLRREIASSLERLVAQNYVARHGDTYSFLTDEEQDIAIDIRNTAVDSGTIVASIGQTIFSEIYPAKKYKYNKYDFPYDQYIDETLVGAATGGVRLRFVTVASDYYNAPEAKLIMDSQANNEAIVLLSSAVQYFEELETAAKIRKYIKQKNVSQLSESIQDIIRKRQAQARILEESAKKQIEKAIVDGIFFVYGEKVDIKYGEARSKLDEALKQLIESVYSKLNLVNVFRESDADILQVLNGEMEQVGFAGHGANNEFALNEVSQWLEERYISHVPVSMGDVQRRYQAIPYGWREVDIAAIIARLIVSQKIEIRYGGAVVSKDDRNLVGYLRKKSEIDKANVSRRIAPSEELMRKSITFLRNWLGQMGIPEDEDGLINFVKDTLEPKLAHYEKLIDEYNHDRYPQKDVVTTARDLIRDILSQKRDNVALLTRLMARQDDLYDSSEDMEEVETFFKSQRVIFDAARQLERDLQNEGEYFVTDADATEKIKEISSILEMAKPYARIKDLTDLMQGVKTAYGMLLAQKKEEVLGIITQCMGDVHTLAGVKANAEVRKSDDRFVEYKKKVANATSLTVLDAMITQLLNYKDQVCKRIETILHETPAPYGAGGEQPKPQKIAQIRRYDVFPVRRLTSREDVEQYLDGIRKKLYATLEANDGIQIN

SEQ ID NO: 645 - protein, 1193 aa, Desulfobacula toluolica
MALKTIFEKPVDRSIEGVIKADDQASLRLEVEEYVLTNEVEKRLESFLDAYNNYDGANGVWISGFFGSGKSHLLKILALLMENREVEGAKVLDIILPKCGDNQILKGDLKKAVSIPSKSILFNIDQKADVISKTQIDALVAVFVKVFDESCGYYGKQAYIAQFERELDRDNLLDKFKDAFKTASSKDWEWGRMRAKRVAAHIDEAYQCVTGQEVTAILDKYRSDYSLSIEDFAEQVNSYIETQETNFRLNFFVDEVGQYVADNVKLMTNLQTIAESLATKSRGRAWIIVTAQEDMNTLVGEMNKQQSNDFSKIQARFENRMKLTSADVAEVIRKRLLQKNDTGIHKLSKVYDDQVNNLKTLFDFADGAQLYRNFKDQDHFIHTYPFIPYQFILFQTAIQNLSMHNAFEGKHRSVGERSMLGVFQQVAVHISDYEVGRLATFDLMFEGIRSALKAQIQRSIQLAERHLDNKFAVQVLKALFLVKYIKEFRATQRNLTVLMLDEFNKDMGHLNKNLTEALNLLEQQTYIRRNGQVFEFLTDEEKDVEEEIKNTDIEASAVDDHLYKIVFDTIIKLRKIRYDQNGQDYPFSRKMDDKLFGREHELSVHVISPFNENADNEQVLKMQSAGRDELLVIMPPDERMMRDLLMNERTNKYIRQNISTTQQESIKRILTDKTLQNQERYNDLKQHIENLLGKAKLFINANLVDIGGTDPQARIIKGFHDLIVRTYPNLKMLKDFTYTESYVSKCLKDSGNLFGDDVTLLSEAEQEMLSFVKANKKNGIRTTVKSLIERFEKKSYGWYYAAVLCIAAKLCAAGKVELNFDSNILEDDQLEKALLNTHVHSNLIIEPLNDFTAAQIRSLKQFYEEFFDSPTSSTEAKALGKETTEAIKEKIESLSGLVAKSHKYPFLAGLEKITAILKELKAKPYTFFLTDLHKIEDSLLDMKEDVVDPIQRFMNGPLKTIYDDAVNFLKRQEHNFSYIDGDESGQILAILKDSSCYKNNKMSRVKSLVETVSDKLDEKLKTTRQVAIDKINSLLNKMIGMEDFIRLSASLQDELKKPFETQLETLQDQTLIAMISDALRRFEDDEYNNILSKLSYLGRPKPASPDSKPSKSDQTDYETSIEDSCLGKGKIKEGLAKPKEKENEPVKEVVGIKKIEVNYSKAWIENEFEVEDYLSVLKKAIIREINAGKRVQV

SEQ ID NO: 646 - protein, 1142 aa, Desulfomicrobium baculatum
MLNKYIFLKDPVSRKLANQGVASVNESDESILRYELETFVCSGQYEKGLVHILRTYLENLKHPQQPGVWISGFFGSGKSHLVKILAALWLDYIFSDGATARGITTLPPEVQELFLELKTAGQRHGGLHSVSGTLKANDDSNSARAAILAMIFKSVGLPAKYHFASFVMWLQEEGILDQIRQHVENAGKIWDQEVLRLHVSTVLREALVKIRPQIFFDEKTCADILRNQFPSGKDVSSDDMIKAIKQALSKDGKLPLTLIVLDEVQQYIGEDSQRSIDVQEVVEACSKNIGGKLLFVGTGQTAVTGTSNLKKLEGRFTVRVELSDADVDAVIRQVILAKKPEAMAPISSMVQANLGEISRHLTGTTIAHRQADLEYIVHDYPILPVRRRLWENALRVLDQSGTDSQLRNQLSLIHKVIQTNAEQPIGHVAPADFIFFDLAENLLRTRILPRKVYEKTVGWKSGSTDEQLMSRACALVFLITKLAAANTEIGLKTTVDTLADLLVEDLSQGSSVLRSKLPGLLNSCELLMKVGDEYRIQTEESAAWNDEFLSQRTSLASTAHRIETERDDRIRRKVSESLRKISIQHGMSKTPRDISTIFDSQLPSDASGKICVWIRDGWSTDENSVLADARHAGNQSPTIFVFIPKRSADDLRHQLMDYKAASATLEKRGVPSTPEGTEARAAMETAKFNAEARIAALLDDAFSGARVFQGGGNEILGNELQDKVTEAAKNSLARLFPQFDLADNNGWTKVLERAQKGAPDALKAVGYEGEPGANVVCKAILGFIAGGKKGVDIRSHFEGPVYGWPRDAVDGALLVMVNAGLVRALDDMGKALDAKTLDRRNFGKTSFKVEATTISAAQKIQIRKVLQKIGIAAKQGEESASIPEFVQSMKNLAERAGGDAPKPAIPDTACLEDIRLTTGNEQLLAVYNLRDELAALIDSWTEVADQISKRGPAWTTLVRLKKHAATLSQAKLLFDQISIIEQERQLLNDPDLVSPLVSSLAQILRAELNRLDREYSTKHEEGMARLKQDDNWQQLEPEQRHQLLSGQMLHESARPKVEVQATEDVLRTLEAFSLSMFEDRIAAMPGRFDAVLQAAAELMEPEAKFVHLPRRTIKSADELDAWLVEVKKQLVTALNSGPVVIQ

SEQ ID NO: 647 - protein, 1203 aa, Desulfosporosinus meridiei
MNIKDMFAKKIDRDIKGVIKVGQGDDANIKQELEEYVVTKELQKHFADFFASYKKGINGHTDKMGVWISGFFGSGKSHFLKILSYLLANKEVEGKKALEYFIEDDKIIDPMVLADMQLAASVPTDVVLFNIDSKSEMTGKQTKDAIVSVFLKVFNEMQGFCGSIPFLADLERRLQEVGRYKEFIELFEEDFGQPWEATRHKFDFIQDSIVEVLDDMGFMSEAAARNWCEKATEPYNISIENFAQLVKEYLKRQDRNHHIVFLVDEIGQYIGDDSKLMLNLQTVTEDLGTACQGKVWIIVTSQQDIDSVTKTKGNDFSKIQGRFDTRLSLSSANVDEVIKKRILAKTTTAEQTLRLLYEQKTTIIKNLIVFNDGVEKKLYTDDSDFAAVYPFVTYQFNLLASVLTSIRTHGASGKHLSEGERSMIALFKESAVKLMDRPAGTLIPFNVFYDALHQFLDHSHKGVIIRAMDNSYINPDKLEECFAVSVLKTLFMIKYVKEITANIDNITSLMISDIETDRIELKKQVEEALKVLVRQMLVQKNGDIFVFLTDEEQEINREIDSQNVETGEVINKVSELIFEDIFSYKKYSYPKFNGRYNFALNQIVDDHPYKANQNHDIGIRVLTPNSEYGDQEATLRMMSGQGKEVLVALPTDSAFLSEIRSALKIEKYLRLTTSSTLTKFEQIKEAKRVEMRERSGNAKLFLIESMKNAVIYVNGDKAQIGAKDVAARINDAFGRLVATVYHKLTYIDAPMSEAHIRALFKVSNQLNLTLEDGSEPNIHALNDMLSFIAGNSAMHMKTSMKSLMDRFMKAPYGFVEDDVEWLVAKLFKNGDIAFTVNGTSVTLLNKTDEEIIRYITKKEYVEKLLTEKREKPNDKQKKAVREVMKELFGVSSVNEDEDAMMCSFQSYSNNIVYELEKFEIMYQSKPLPGQKIVTSGKTLLRAVVQIQSPSEFFKKISTDRDDYLDFAEDYEPVKAFFGGDQKTIFEKALHLMGIYDDSKTFIVDEQVETVVGEIKAILKKDSPYSDIPKLPELLSRFNDLYIKLLTDMEAPVIAAIEDAKTRVFDVLEAKEYKSELVERFRKLFAEILEKAKTCNNVATLQNVKVEADALKVRLLNEMTKKDEQIARSKTEEEKKKTGAGGVKETGAKFQPKVKRRKSISIKSVNLAASWQIETAQDVDKYMAALKERILKELDEDTIINIEF

SEQ ID NO: 648 - protein, 1188 aa, Desulfovibrio magneticus
MQIRNLFCKDLFRPINGVVKADQRDEAIVWQELDEYVVTKELDQHFRKFFETYINAIVNKHDPNLNSRIGVWVSGFFGSGKSHFIKILSYLLNNREAHESKSKQIKKAVEFFDSKIKDPLLLADIKKITVGNTDVVLFNIDSRADSKDGRGTLLSVFWNVFNEIQGFSNVFPHVAELERHLTFQGKYDLFCNIYKEVSGENWTEQRDDYRFYRDHVVAAFAKCLEQSEKAAEDWFDKAEDDQGITIQNFAKRVKEYLDRQGKDHRIIFLVDEVGQFIGSDGQLMLNLQTITEDLGRVCQGRAWVVVTSQEDIDAILGDLKSAKANDFSKIQGRFNTRLSLSSSNTDEVIQARLLEKKPEVAEQLANLFESKGDILKSQLSFSYDSASLKTFKDKQDFIANYPFVPYHFQLVQKIFESIRKAGATGLHLSRGERSMLDAFQSAAKNISEKEIGALVPLYQFYPAIESFLDTAVKRTIDQAHENDGLKKPFDIQLLQTLFLIRYVDIIKPNVDNLVTLFIDEVDADRLTLKRNIEEALQRLEKQTLISRNGDLYFFLTNEERNVTREIKNVEISSSEEVKLLAEIIYVEILKDQKQHRYKPNRRDYPFNRLLDGHPYGAKLDQEIGIEVVTPLSDEYSSFDALRCITYSSEHYGRAVIKLKDSKELGREVRIWIQTDKYIKQKGTSANTHSFEKILEDRQRENRDRRSRIIMLMEKMVLDADFYAMGQTLSFKAATPRIAAEETLDYIVQNLYNKFCYVKTLSDDPSKEIRAVLLSNDVSQLELEKGLTEVNTDAIREVREFISLLILKNHPVLLSELVEHFGCKPYGWPEFEIVLLVARLFMAGEINLLSDGSNLEPKDAVESMLKVGKWKSVKIMKRKVPSKEQIEKARKLCQDLFGKIGPETLDDLERTIRGELGRWQKELNKYQQLALTGSYPGGKEITRGLAVIQKVLGIRDTFEFISRFNEKRNELLDTCEDIHELLDFYTNQRPTWEKLIKSLGEFGKNQAALYKDINAGPALKQLHTIAEVPAPYGMLKDVDGLVSTISAINEKLVEERRAKALLELDAKIVNVTKGLDAMRADVDFRNHVLLPLQKVKLHVAEETSIPDISYQLEEFDQAVEDALDQIERMKSSPDPENPKKPSKTTKVIKPSAIAANSYLESPEDVNAFVEALRKTLLAELTGDVRIKLQ

SEQ ID NO: 649 - protein, 1183 aa, Desulfovibrio vulgaris
MMTLKTIFNKPVDRPIEGVIKADDEASLRLEIEEYVLTNEVEKRLESFLDAYNNYEGANGVWVSGFFGSGKSHLLKMLALLLENRQIDGASALDLFLPKCGDNEILRGDLKRAVAIPSKSILFNIDQKADVISKTQIDALLAVFVKVFDEMCGYYGKQGHIAQFERDLDSRGLYDKFKSAYESTAGRTWQKGREQALLEGKSIAKAYAHATGGDEASAMGILDKYRSQYRVSIEDFAEQVHAYIERQSPDFRLNFFVDEVGQYIAENIKLMTNLQTIAESMATKCRGRAWVIVTAQEDMGTVVGEMGKQQGNDFSKIQARFANRMKLTSADVAEVIQKRLLMKTEEGVRLLSDIYYAQSNNFKTLFDFADGSQTYRNYQDRDHFIHSYPFIPYQFALFQSAIQNLSQHNAFEGKHSSVGERSMLGVFQQVAIQIGGHEIGQLATFDLMFEGIRSALKSNIQRAIIQAENHLDGPFAIRLLKTLFLVKYVKEFKPTVRNLCVLMLDGFNQDLPALRKRVEEALSLLEQQTYVQRNGDLYEYLTDEEKDVEQEIKNTEVESSDVAAELEKIVFDHVIKHRKIRYDENGQDYPFSRKLDDRLHGREYELAIHVISPFHENAESESILQLQNTGRDELLVLLPADERLVRDILMYKRTEKYIRQNISITQQEAVKRILTDKGFQNRQRYAELLQRVHSLMGKAKLFVAGADIEIGSEDAQTRVLRGFHELISRAYPNLRMLRGITYTENDIAKCLKHSQHGLFGNDVTHLAESEQELLAFIQSNNRGGVRSTLKNLLEKFERKPYGWYYAAVLCTLANLCARGKVEVRADGNLLEEDELERVLRNTHGHGNVVLEPQVEFTASQVRALKEFFEDFFDAPPRASEAKALGKETGTALQDLMHQLSPLAAQASQYPFLNTLTPVIEKLKALSGKPYTWYLTELTRQEDALLTMKESVIDPVRKFMNGPQKDIFDNARKFVQTQEPNFAYLEGDEAAQVVACLTDPECFKGNCMQQVKTQVETLQGKVAAQIEAEIAKAKEAVAALKARLCGMAEFGALNGEQQEQITRPFNEFDSGIERQKLIAVIRDTLRRFEESDYQRLLSQMTSWAQPAPAPEPAPEPGKTATPDAGLSPTPPVKPEPRIEYVPSRSVKVSFDKAWLADETDVERYLESMREALLDEIRKGKRIQI

SEQ ID NO: 650 - protein, 1182 aa, Desulfovibrio vulgaris
MTLKTIFNKPVDRPIEGVIKADDEASLRLEIEEYVLTNEVEKRLESFLDAYNNYEGANGVWVSGFFGSGKSHLLKMLALLLENRQIDGASALDLFLPKCGDNEILRGDLKRAVAIPSKSILFNIDQKADVISKTQIDALLAVFVKVFDEMCGYYGKQGHIAQFERDLDSRGLYDKFKSAYESTAGRTWQKGREQALLEGKSIAKAYAHATGGDEASAMGILDKYRSQYRVSIEDFAEQVHAYIERQSPDFRLNFFVDEVGQYIAENIKLMTNLQTIAESMATKCRGRAWVIVTAQEDMGTVVGEMGKQQGNDFSKIQARFANRMKLTSADVAEVIQKRLLMKTEEGVRLLSDIYYAQSNNFKTLFDFADGSQTYRNYQDRDHFIHSYPFIPYQFALFQSAIQNLSQHNAFEGKHSSVGERSMLGVFQQVAIQIGGHEIGQLATFDLMFEGIRSALKSNIQRAIIQAENHLDGPFAIRLLKTLFLVKYVKEFKPTVRNLCVLMLDGFNQDLPALRKRVEEALSLLEQQTYVQRNGDLYEYLTDEEKDVEQEIKNTEVESSDVAAELEKIVFDHVIKHRKIRYDENGQDYPFSRKLDDRLHGREYELAIHVISPFHENAESESILQLQNTGRDELLVLLPADERLVRDILMYKRTEKYIRQNISITQQEAVKRILTDKGFQNRQRYAELLQRVHSLMGKAKLFVAGADIEIGSEDAQTRVLRGFHELISRAYPNLRMLRGITYTENDIAKCLKHSQHGLFGNDVTHLAESEQELLAFIQSNNRGGVRSTLKNLLEKFERKPYGWYYAAVLCTLANLCARGKVEVRADGNLLEEDELERVLRNTHGHGNVVLEPQVEFTASQVRALKEFFEDFFDAPPRASEAKALGKETGTALQDLMHQLSPLAAQASQYPFLNTLTPVIEKLKALSGKPYTWYLTELTRQEDALLTMKESVIDPVRKFMNGPQKDIFDNARKFVQTQEPNFAYLEGDEAAQVVACLTDPECFKGNCMQQVKTQVETLQGKVAAQIEAEIAKAKEAVAALKARLCGMAEFGALNGEQQEQITRPFNEFDSGIERQKLIAVIRDTLRRFEESDYQRLLSQMTSWAQPAPAPEPAPEPGKTATPDAGLSPTPPVKPEPRIEYVPSRSVKVSFDKAWLADETDVERYLESMREALLDEIRKGKRIQI

SEQ ID NO: 651 - protein, 1145 aa, Desulfurivibrio alkaliphilus
MKNRDIYQQDPTTRKLVNEGVAMVNDEQTSQALEVLRYELETFVCDGQYEKGLSHILETYLKNIDQAQQPAVWVSGFYGSGKSHLVKMLRALWVDTVFADGATARGIANLPQHIRDQLKELSTQAKRHGGLRAASGTLGAGASGSVRLALLRVVFRSVGLPEQYPVARFVMWLQHEGVHQQVRDLVEQHGLDWEEELDNFYVAEGLHQALAQAKPQLFTTPAACVETLNNLYPFVQDVGSSEMIKAIRQALTLGDKFPLTLIVLDEVQQFIGEDPDRSLAVQEMVESITKEIGGKLLFIGTGQTAVTGTSNLARLQGRFTIRVELSDTDVDAVIRQVVLAKKPAAKAPIEEIMTANLGEISRHLAGTSIAHRQSDLPFFPQDYPILPVRRRFWENTLRVLDQTGTDSQLRNQLSMVHKVIQTNLERPLGHMVPADYLYFESADKLLRTRILPREVYEQTVVWSRGNEDQQILARACGLVFLINKLAGSNKEIGIHATVDTVADLLLEDLAAGSGSLRRRLPALLDGCKLLMKIGNEYRIQTAESTAWNDEFLSQCSSLASEAHRIDAERNDRMRKKFGEMVRKLSLGQGTSRVGREIFPIFDAQLPNDADHRVYVWVRDGWSSDENSIRADARQAGNQSSTVFVFIPKRSADDLRRFLIDCKAAAATLEKKGVPGNPEGAEARAAMETTRQTAEGRISELLAEAFSGARVFQAGGSETLGNDLQEMITEAAANALQRLYHQFSLADHGGWGKVYDKAKSGAPDALKAVGDDGEPARNPVCKAILAFIAGGKKGADIRVHFGGPPYGWSRDAVDGGLHVLLIAGLVRAQDERGQAIDPRELDRNALGKVIFKVESTTVSTAQRIQIRKLLQQAGINARQGEELPQVQQFLQKMLDLAAEAGGDPPRPPQPDTTALHEIRLTAGNEQLLALYNRRDEFAQNFAAWTDLAARIAKRQPNWLTLKRLLEHAAGLPDAEVIMAQVQTIEHQRQLLAEPDPVAPLLAALTQLLRTELNRLDAEYVSRHRQGMERLRSDSNWQQLEPEQRHQLLATELLHDAARPKVQLQSTADILAALDNCSLAMFADRVAAMPARFDNVAAAAAELCEPEVQFVTIPRPTLKTEAEIDAWLVEVKQQLQKALPQGPIIIR

SEQ ID NO: 652 - protein, 1233 aa, Enterobacter cloacae
MQIRELFTKQLDRPINGVVKAEQLDEQIIWTELDEYVVTRELDRHLRHFFETYLPGVSHPDDPSVAGKIGIWVSGYFGSGKSHFIKILSYLLGNKKAVNNGQTKAAIEFFKEKISDPLLYGDIHAAVNRNTEVILFNIDSRADTEDKEDAILKVFLRVFNERLGYCADHPHIAHLERELDSRGQYEPFKAKFAELTGSSWEEQRDAYGFCRDEMAKAWAYATGQSDASSVQSMENLESMFTLDIANFCKWVREYLDRSDPSGDSKRMVFLVDEVGQFIGNNTQMMLKLQTITENIGTACGGRAWVIVTSQEDIDAVLGDLSAKKGQDFSKIQGRFHTRISLSSSNTNEVIQKRLLEKSEDAKNCLAELFSQKGDILRNQLTFDTSTTAELANYSDNVEFVDHYPFIPYQYLLVQKVFEAIRKVGATGKHLSRGERSLLDAFQNAARQQMNKDIGVLVPFYAFYPAIESFLDTNVKRIFEQAAEKASLDPYDINILKSLFLIRYVDLVKSTIDNLVTLSIEEIDTDKVALKSRIEASLQRLENQLLIVRNGDEYVFLTNEEKEVEQEIKHTQVEATEENRQLARLVFEEVMGNRRQYRYPVNKQDYPLTRFCNGHSIDGSQQTDLVLKVISPLDANFDSYNEQSYKALSQEGNGCILVRLSSEKRIWAEFDTWLKTEKFLAGIRGKRPEQEKLLAEKALENTQRRSRLKLLFDDLVKQAQIFALGNELQSKSASVSNMLDEACAYVIENSFQKLSLLQSCGNNPVQELKSVIMADDMAQLNVNLGEQDPNAAAKKEIELFLNVADEKNQPVYLKELLERFSARPFGWNRDEVMLQVTHLVLLGKAALSTPNGDLPLKRSYEHFTSVRSHSTLRIRRVRQHTEQQVAKAAKLAKDIFNKPFESSEKELANKLLDVLGEWQRLIKEFDFKAKDGNCPGKSTLLTGSRLIASLLELGNNSYALIDGLCQQSNEWQDFAEDFEEVEEFFTRQFDIWQQLRRALNDQFKSNRHALEQNPEAAKALSALQAIYDDKSPYSKLRQVGSLIDQLIAINLQLVEQKRAAALEAINATQQGVAPLVTDLPAELQNQAMRPFNLLKERVSNSLSLHEIVSLQQEADDEEDKVLELINRYSAELQARLEAEQAAARKKAAEPPNSDAGTLREPDPSGSPTTIANNSAATVVSHKPIPKPIELVSPAELLGASHIFIETEQDIDTYLATLRSRLQQAIGQGKRVRIK

SEQ ID NO: 653 - protein, 1214 aa, Erwinia sp.
MNIEQIFDKRLDRNINGVVKAEQTDDASAWIEMDEYVITRELEGHLRHFFESYVPATGPERIRMENKIGVWVSGFFGSGKSHFIKILSYLLSNRKVSHNGTERHAYTFFEEKIKKDALFLADINKAVHHPTEVILFNIDSRANVDDKEDAILKVFLKVFNDRVSYCADFPHIAHLERELAKRGQYETFKTAFSSITEKNWEKERDSYYFISDEMAEALSQATGQSVEASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSANTSEVIQKRLLVKNDAAKPALAKVWQEKGDILRNQLAFDPTTSASLRPYTSEEEFIDNYPFVPWHYQILQKVFESIRTKGAAGKQLAMGERSQLEAFQTAAQQIAPQGLDSLVPFWRFYAAIESFLEPAVSRTITQACQNGILDEFDGNLLKTLFLIRYVDVLKSTLDNLVTLSIDKIDTDKVELRRCVEKSLNKLEREMLIARVEDKHVFLTNEEKEIENEIRNVEVDFSAINKKLASIIFDDILKNRKYRYPANKQDFDISRFLNGHPLDGAMLNDLVVKILTPKDPTYDFYNNDAACRPYTSEGDGCILIRLPADARTWTDIDLVVQTEKFLRDNAGQRPEQASLLSEKARENSVREKMLRVQLESLLAEADIWAIGERLPKKSSTPSSIVDEACRYVIENTFGKLKKLRPYNGEIAREIHQQLTLENDTELDLGDTEESNPDAMREVETWVSMNIEYNKPVYLRDILNHFARRPYGWPEEEVKLLVARLARKGKFSFSQQNNNIERKQAWDLFNNSRRHSELRLHKIRRHDESQIRKAAQTMAQIAQQPFSEREEPALVEHIRQVFDDWKQELNVFRAKAEGGNNPGKNEIESGLRLLNSILSEKEDFALIERVTTLANELLEFSEDREDLVDFYRKQFATWQKLGAALNGSFKSNRSALEKDTVTVKALGELESIWQMPEPYKHLNRITPLIEQVQNVNHQLVEQHRQHALERIDARIEESRQRLQEAHATAELQNSVLLPMQKARKRAEVSQSIPEILAEQQETMALQTDAEKKINQWIDELRKKQEAQLRAVKETKQATEPQQSYVAAEKPVIQPVPKKTHLVNVASEMRKAAGSEVLETTEQVEKALDTLRAALLAAIEAGDRIRLQ

SEQ ID NO: 654 - protein, 1214 aa, Erwinia pyrifoliae
MNIEQIFDKRLDRNINGVVKAEQTDDASAWIEMDEYVITRELEGHLRHFFESYVPATGPERIRMENKIGVWVSGFFGSGKSHFIKILSYLLSNRKVSHNGTERHAYAFFEEKIKKDALFLADIKKAVHHPTEVILFNIDSRANVDDKEDAILKVFLKVFNDRVGYCADFPHIAHLERELAKRGQYETFKTAFSSITEKNWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKNDAAKPALAKVWQEKGDILRNQLAFDPTTSASLRPYTSEEEFIDNYPFVPWHYQILQKVFESIRTKGAAGKQLAMGERSQLEAFQTAAQQIAPQGLDSLVPFWRFYAAIESFLEPAVSRTITQACQNGILDEFDGNLLKTLFLIRYVDVLKSTLDNLVTLSIDKIDTDKVELRRCVEKSLNKLEREMLITHVEDKHVFLTNEEKEIENEIRNVEVDFSAINKKLASIIFDDILKNRKYRYPANKQDFDISRFLNGHPLDGAMLNDLVVKILTPKDPTYDFYNNDAACRPYTSEGDGCILIRLPADARTWTDIDLVVQTEKFLRDNAGQRPEQASLLSEKARENSVREKMLRVQLESLLAEADIWAIGERLPKKSSTPSSIVDEACRYVIENTFGKLKKLRPYNGEIAREIHQQLTLENDTELDLGDTEESNPDAMREVETWVSMNIEYNKPVYLRDILNHFARRPYGWPEEEVKLLVARLARKGKFSFSQQNNNIERNQAWDLFNNSRRHSELRLHKIRRHDESQIRKAAQTMAQIAQQPFSEREEPALVEHIRQVFDDWKQELNVFRAKAEGGNNPGKDEIESGLRLLNSILSEKEDFALIERVTTLANELLEFSEDREDLVDFYRKQFATWQKLGAALNGSFKSNRSALEKNTVTVKALGELESIWQMPEPYKHLNRITPLIEQVQNVNHQLVEQHRQHALERIDARIEESRQRLQEAHATAELQNSVLQPMQKARKRAEVSQSIPEILAEQQETMALQTDAEKKINQWIDELRKKQEAQLRAVKETKQATEPRQSYVAAEKPVIQPVPKKTHLVNVASEMRKAAGSEVLETTEQVEKALDTLRAALLAAIEAGDRIRLQ

SEQ ID NO: 655 - protein, 1214 aa, Erwinia pyrifoliae; identical to SEQ ID NO: 654

SEQ ID NO: 656 - protein, 1172 aa, Erythrobacter litoralis
MAQLLKDIFEKPVDRAIDGVIKADDEASLRVELDEYVITGEIGQRLEQFLEAYNNYDTSNGVWISGFFGSGKSHLLKMLALLLENREVDGKTAHEIFAAKLKDEPMLAGALNKAVSIPSKSILFNIDQKADVISKTDVDALLSVFQKVFDEACGFYGKQPHIAQFERDLQSRGQFEAFKETFRSAAGKDWEHGREQALLEAKNIATAFAAATGGDPWGAKDILSQYRKDTRVSIEDFADTVKAWIDDQPKGFRLNFFVDEVGQYIADNVKLMTNLQTIAESLNTKCEGQAWIIVTAQQDMASVIGDMTQRQENDFSKIQARFGNRMPLNSADVAEVIQRRLLAKTSEGQVTLGNLHDREENNLKTLFDFADGSQKLKNYRDRDHFISSYPFPPYQYDLFQMAITSLSEHNAFEGKHSSVGERSMLGVFQEVAKKLKDQEVGGLATFDLMFEGIRTALKSSVQQSIQIAERNLDDPFAVRVLKSLFLVKYVKGFKPSVRNIAILLLSEFEADQTAMRRKIEEALSRLERETYIQRNGEVYEFLTNEEKDVEAEIKALDIDPSELSKELETLAFDTILRHRKIKHLATNNEYPFTRKLDDHALGREYELAINLVSPLSDEVESSDGIRMKTMSREELAVAMNPDATFVRDLILFKQTDKFIRQSRSGSPQPGRDRIVAGKGEQNSRRLKDIEMQLRKLMGSARLFVRGDELEIGGEDAQERIAKAFQSLVDKVYTNLPMLRGVSYTEADINKAVQAESGLFGSDGTRINEAEQDVLSFINAQARNGVKVSVKYLADRFTSKPYGWPINAVLCLASSLVARGKIEARLDSAVKEGLDLAKALNNSHALPNILLTPQTEFTASEIRRAKELYQELFAHPSSGTDARSLGAEWTASIDVLEAEVDELVRQSHRYPFLTSLEPLNELLRTMKSKPANWYISEAPKREDDLLNAKEDILDKVKSFMGGAQKDIYDDARDMLAGQSANIDYVDPDAGAKLRAALEDPNCFKGSTIQNLKSDLFDLKNKVELKVLEERKAVIAEVEDVSAKIAQMPDFQALDADQQTRITARIDSHKEGLDTVTLIPVLRDRANGARTNLLSDVVTELDSLARPVPATQPQPGQSDGPAPAPQAPTTILASQLKVAAPKTLLTDEADVDEYLDAMKSALLNEIRAGKKVIV

SEQ ID NO: 657 - protein, 1213 aa, Escherichia coli
MNIEQIFEKPLKRNINGVVKAEQTDDASAYIELDEYVITRELENHLRHFFESYVPATGPERILMENKIGVWVSGFFGSGKSHFIKILSYLLSNRKVTHNGTERNAYSFFEEKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPDNKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 658 - protein, 1213 aa, Escherichia coli; identical to SEQ ID NO: 657

SEQ ID NO: 659 - protein, 1213 aa, Escherichia coli
MNIEQIFKKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEEKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDTTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITLLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 660 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNTDAMREVETWISMNIEYNKPVYLRDILNHFARRPYGWPEDEVKLLVARLACKSKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 661 - protein, 1225 aa, Escherichia fergusonii
MKIEQIFSKKLTRDINGVVKAEQKDNDSVYVELDEYVVTRELDRHFRAFFEAYVPSVEKSHGDMSGKIGVWISGFFGSGKSHFLKILSYLLENKSVEKDGQGRQAFEFFKDKINDAMLLADIQKAVTKDTDVILFNIDSRANTDDRENAILKVFLKVFNERVGYCADFPHIAHLERELDKRNQYASFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTHLIDVFAEKGDILRNQLTFDKTTTASLKGYTDAPSFVDNYPFVPYHYTLVQKVFESIRTKGATGKHLAMGERSLLDAFQSAAKQMKDSGLDVLIPFYSFYAPIESFLEPAVKRTIDQACELDSLTEFDGKILKTLFLIRYVDVVKSTLDNLVTLSIDRIDADKIALRKQIEESLNRLERQLLIARNGDEFIFLTNEEKEIENEIRHTDVEMSEVSSKLSAIVFDGILKGNRAYRYPINKQDFAVSRFCNGHPKDGTTLEDLVIKVISPLDSHFENYAHDQACINHTLEADGCVLVKLGEHKRLWDELTTFIKTDRFLKQNSGQRPEQEHLLREKQMENMEREKRLRTDFEALFAEADVYAIGTKLPKKSATPSAIVEEAYKYVIENTFAKLNMLKATPGEVLRELQAVLVADDIAQIGRDLQADECNPEATREVEQYVTLKVERNEPVYLRDIVAHFGKRPYGWPDNEILLLTARLGLAGKLSFSTQGTDLALKKAYEPFTSVRKRGEIRVHKIRQHDERQIKKAAGLVKEIFSKTFTGSGEKELYELVRDELLAWNEKLKSFRTKSQTGHFPGKSQIDDGLALVAGILEQTSSFALITRFLEDADALEEFAEDFEDLDDFYNSQFQTWQALAGALNEKFKANRPALEKDSEALKALTELERIYNMPSPYEQLRHINPLIEQVAKVNSTLVEEKRTHALERVDLRIGRVKEALAEAHAPSELQNQALRPLQMCRQRIEETSSIPQIISEQTEAEGYEDEAYELLNGFIEDQRKKAEAEQRRRELEQQTREEEAAKAGKAAPAPEPASEPVQPQPVAKRTVTINSTDAMAKSVTTGFIESEAEVDAYLAALREQLIAAVKAGDRVRIK

SEQ ID NO: 662 - protein, 1192 aa, Exiguobacterium sibiricum
MLLKEMFLKDIERDIRGVIKVAQTNEKDIYQELDEYVVTQELHKHFSKFYDNYQKGINGKTDKMGVWISGFFGSGKSHFLKILAYLLENQSVKGKHPIDFFENKVQDTLVYSNMKRTADVDTEVILFNIDSKSSLGSKSKEDAILRVFMKVFYDHRGYYGDIPGVAEMEKYLDKRGFYETFKQEFYTLAGEMWDERRNSFYFDADYIIGALTKATDMSEETARDWFNEGVNNFEISIEKFSRDVKEYIDEKGPKFHLVFLVDEIGQYIGDSRDLMLNLQTLTEDLGTHAQGKVWIMVTSQESIDSIVKVKGDDFSRIQGRFDTRLSLSSISVDEVIKKRILEKHKHVNDKLKVLYPEKSAILKNLISFTGSTADLRGYNNEQEFAEVYPFVPYQFKLLQNVFEQVRKHGSSGKHLSEGERSMLSAFKEAGLRYKDEEEGSLIPFYAFYDTIKEFLNPSISRVIEGATENSVLKDDRFNQDLLKVLFMIKYIKELPASIDNIATLMVAHIDEDKLQLKEKIKASLRKLIGQTLIQKNGDHYLFLTDDEQDINREIKQMNIDEDIIKRELANYIFQDLYEDKRFTYNKFHSFSFNQKMDEKNYGAQTSSIGLHILSPLSDNYQKSDQEMMMITSDSSEMIIKLGGSEAYIEEIEEALKIEEFRKKKNITQLPENIQNILNNKQAEVRERRRRVRELLDDAIKNGSFFVNGDKMDSKGSSVKEKINFAFKQLIDNVYFKLGYIKEHIENEQQLIVILASINDQLSLDDSIVTKPNELAKREVYEFIDMQNQAQKQNYVKAIYERFQDKPFGWKQLDIAGLLVELLKEQRIRIRYHSEYLEPEVDTDKLIKVLGKASELGKGLIFKRVKVDGALIQTAKRVCREVFNTTDLADDEDGLVKDIRVLIGKQIDEINLYKVRYEGRKYPGMSLLDKGLEYFTQFEQKIDNATFFTKLTELEEELIDWEEDIFYVKSFFDTNQKEIFDQGLAGLNKYEENKAYLTDSIVTVAMTSLESIIQNPIPYRKIKEIPELIYKLEKQMTSLLSEKKNNVQEKLKADNDELSLHARQYGVSNETTQQIEERYTSFQTNLDAFTDIYKVDATIAQSTSFKERSILSIKREIAEWQRKKEEEHQGGHGDEVVDPPISPLEIRTESVKVKNLVDINTLKTEQDVDKYINALSHKLKQIIKSNKEIKFID

SEQ ID NO: 663 - protein, 1199 aa, Flavobacterium branchiophilum
MITIKDILKLNLQEDIKNVIDLEDQSENEIQSELESYIITDGLGEHLSTFVKQYTSNIKETGVWLSGFYGSGKSYFGKILGYLIENPTINGTPARDRFMPRLAGVKNESFIKNDILSLNSKKSNVVFLDIAQQNTDNGLSFTLFSAFLKKLGLRNDVYGYMEYDLFIEDKLDFVNQLSLKLFDKNWVDIKFSNREIAKAFRAIYKELGYSDKEFDETKEVYIKAIENFESDIFKIELEKYIKKYNDENIVFIFDETSEAISQGKFKILDLQAISQSLSSISQKVWTIAIAQEKLDNVIINANINKSQLTKVTDRFKTKMNLESTEVDVIMKNRLLLKKEEAYQKLVDYYKKNEGLISDSTNLKSSFPTKTTSSDEFATYYPFHKYQFDLLQKFLFSSNALVTTQVGARGMIITTFDVLKKTLANLELYKFTTAHDLCTQAQTAPPADLDNKYKNATRILDNSNIDINGEKLLKTIHFINEAESIASPSIENITKLYNPDIEKYYEVKPLVEEALNLLVEAKIVLVSNNKYKITSNLEGKLLEEMKDFDVELFIKKRELVNYLKKSNIFRPIATINESKVAYNFNVLTDLDDEIIGSNNKKLKLKAYSLFNINGDRQDFIEAIRLETQYTKDAITLIPDNAAFNTIDKLLEEVKRYGFMEEKYSGTDDEKIKPIIRDFSIIKNEKEKDVINLITEAYEKGSLIYLFDENLLNKDNFKNTINEVQKKLIKNIYTQRLSKQLEESKGVKILTESNPLKLNLYNAGDEFKFFDTNGNFVGDHLKIVEQLRTKINERYIDGRSLEETFGLDPWGYSYGTISTTLAVLFRAGKLVVKTNDTDYFSYSDRAVQEVFASGSKFKTASFKSISKTLSTQQKSEIINQLIALEFEKHKERKISDTSSDFDVADAVSVLAEHFVTIVKALENTVPDFNKTFKHCLEQRNFLQGFVSKTTEANYIDKAEDFLKDSNSYATAIKTVIKTENFVKKNLDKIKGFSNFTKAVENELQKANSQNQIIENQTKVFDEAVAKDVIEKFGDIQNAVQAIKDEYYNLMKDSATKMATAYNRLKTEIEKAQADLDTNYPAELNIENKNKLKILLDNCNNKTSDDIEIIYKVHCQITGFSLSDILNYIDLVPTRETDLQIIKGNFLKEAPPTPTPGTPKKVQLNIKNNVMTAKEYRGILASQLQSLAGLDNDEMIEITINN

SEQ ID NO: 664 - protein, 1207 aa, Gallionella capsiferriformans
MKIRELFTKPIDRPINGVIKADQRDAESIWQELDEYVVTKQLTEYFRRFFDAFLAAADSPKDPVVTSRMGVWVSGFFGSGKSHFIKILSYLLENIEAIDPATGIPKRAAAFFDEHKIKDALLLADIQRAVKGSSDVILFNIDAKADSKSDRDVILQVFLRVFNEKLGYSGDAPHIADMERHLVSKGDFEAFKVAFQEKNGSNWDKERDAVDFLRDDVVYALAKSLNMTEESAGLWFDNSRDDYKINIEGLAKIIRDYLATKPAGHRVIFLVDEVGQFIGDNTQMMLTLQTIIEQLGGLCQGRAWVIVTSQEDIDAAIGETNKAKSQDFSKIQGRFHTRLSLASSNTDDVISERLLSKTEAAHVELRDCFAQKGDIINNQLAFVGNSVSMRSYKDAAEFVACYPFAPYQFTLLQKVFESIRKVGATGKHLSKGERSLLDAFQSAAVRNADRNIDALVPMYDFYPSIESFIDTSAKRSIDEAPSNPSLETYDVLLLKALFLIRYIPDIVKPNVDNLATLCVDQIDADKLALKRKIQESLTRLEQQRLVSRNGDLWFFLTNEERDVAREIGHVDVSSVEKSRLLGELIFEEILGGMTKIRHRDTKGDYEINRLLDGAPWKNASHQLSFEIVTPLSDDYESLSDAKAILRSADRALIRMAESNRLDIELNLYQQIEKYIDSPKASSAAAPLKRILADRKDENRERKARLIEQLSTALVNGDCYALGQKLPSKAAAPSTQVDELVNYLISNTYTKLKYLKIRQLDPIAEIKAVLMADSIGQHALSLGGEEGNPLALNEMREYLQLKASQSRVMLSDVVDRFSGAPWGWKPEWEIVLLIARLFMAGEIKLVSDNSDLEPGSAVDALTKSVRFKQVSILKRKTADAVQLKRARELHKDLFSKLGRDDEDGLVADFRESLTQWQSKLKEYSHLSTTRHHPGKAVIEQNVLSISKQLAIRDSFEFVEAILANKDEWLDAADDIHDLISFYTTQIATWRRMLDALQRFEPNRPALLKEVAAATALQQLEAIRDNSMPYQQINQIETLIQSVDAVNVKLVDAKREHALLLLEKKIAEVGGALDQAHAQPELRNRALSSLQKIKLDIAAQSSIPQIHYLQDQSGSALDGAMDMIAAALSAVPKAQPLAVKSPGDHATVINVGSVPITQTVTPKPARVIRAADYSSKSYLETEDEVDDYLGKLKAELLAAIRAGQRARIQ

SEQ ID NO: 665 - protein, 1161 aa, Gallionella capsiferriformans
MNNMKNREIFDKDVDAFSLENQGVAKVDEALDDQQRQTLRFELETFVCKGHYEEGLRRILESFVETLRKGQEAPAAWVSGFFGSGKSHLVKMARALWTNEPFDDGRTPRDIAHLPVSVADALKELDTLARQRKTTMRAASGTLSQGEGDSIRKAVLGIVFKAMGLPAKYDEARTLLWLRNEGIEQAVRDTLHGKGRGLERELQDLYVSSHLHDAILTAKPSLARDAFDLGDKLENQFSSKGDIDQNHFLKYFREAICGNDEFPVFLLVLDELQQYIGTDAAGNDRALRVQEVLQSLSANVNGRVLVIATGQSALSGLNTLSKLLGRFPIPVQLSDSDVEEVLRETVLKKKASASAPLSALFSSGGCLGEVSAHLHSSLFAHRREDEAILASSYPLLPTRQRLWERVLATTDTTGTGVQLRSQLRLAFDAVRKSKDAPLGHIVGGDFIYDEIRMRLRQSSQISTETANAIDNLDGKNAPHAKLKARVLKAVFLLTRITNNSAQDTGLLTDAQTVADVLVDNLTTPSSTLRSDVRTALDELVEKDHLLMRISTGAIQEFRLQTKESADWFAYQRGEEDALRSDPSAYESKIREQLMQLASEQVRKQPIPQGVSREIRRLKLHTDPITAPKEDDGVPVWLRSDLDGTQAKEVLTDAARAGLDSAIVFGHVALPKKDELVRAIISREAAERTLGHFGEPQTPEGQEARNALLKQKNDADGRVNDLIKEALSQAQIIQGGGQIIEDGAGLDDRLRKAGSDGAARLYRNFNLADFTGWDKAYIAADKGLVNALESIGHSGAAENHPAAQEIMTRIGSATLNGSKIRTEFMGAPYGWSKDAVDTLLAVLFACGQLRVVNAGGSLWPAGKFISRDVSTSNFSRENAPISNEEKRAIARLVKCRPDEAEIRAPEFVSKLKDTQVRATGAAPRPEAKPNALIDELSTISGRDLVKRLAEEETAASELLNALEAQAAKITKREPAWLQLNDLIRHLPGMPEHSVIATERDAIRDARLLLDDPDKVEPLVNRAADVLRGALNTAYAVYHSEYTACTKEIENAAEWARLAPEDRAAILREAQLSTPEQAPRVGTLFELLESLNKCSPQRWAERRDASRGQLSRALTLAAQKLEPTVQPIAAPRRILRSEADLDTWLAEVRKSVLEKLPGGPVQI

SEQ ID NO: 666 - protein, 1183 aa, Geobacillus sp.
MLQNTFTIQELFKKPIDREINGVVQAGQYDEKVVHSELEEYVMTKEISENMKYFFKNYTNSFDHPTTKIGVWISGFFGSGKSHFLKILSYLLNNETVYGKRAVDFFTEKTDDQELLEMMQRSATYDSHAILFNVDSKSAGGKKEKATIVEVFLKVFNEYLGYSPTPWIAHIERQLADEGVYEEFVRHFEEIEGKPWKEERARILLKRKPFIQALARLGYDEETSAGFLDAAKKTFEISSEEFAKIVAKHVKEKGDNYRLTFLVDEIGQYIGDDPNLMLNLQTVVEDLGNYCQGKVWVIVTSQEQIDAVTKIKGADNFSKIQGRFATRIHLTSSNTDEVIKRRLLEKWPAAADHLKVEFEQIGQSLNNTLTFEKDTCVLQSGFKNEEEYAAIYPFVPYQVELLQRVFDKVRRQGEAGAHLAHGERSLLNAFQEVALQLKDKDTNQLARFSQFYETVKRFLSTSVSATIASAAKREGITEFDVEVLKVLFMIKGIEQIKATVENITTLLVDSVDCIKNDLEKEVRRSLNRLRRNMLIAENADKTFVFLSDDEQEMNREIEHEHINEANVIDELGKIFFEDIVQMKSYRYQKTHDFEFNKIFDTYTRGGRTNELTLQVYTGDVTEEQARAEANSGILVMYIPQEFTEKFFEPMEYALKIRSYANKKISTSLTERQRKILDEKRQQITEFEKKAKEALAEAALYATYYVQGQEYRFNGSLENQLQSAFEILVRNTYSYLSYMEEPVPVKNANDTIYEWATKGLPAKLDGTFANHLAYDTVFRFLEQSRNRQMVTMKLLVEKFKSAPYGWSENDIAGLVAALMHDGKIKLTYLGESFDTSHPQFISRITKASEREKVMIEAQIAIPSHKRKIVVEMMRELFNFYDVGETYDEIAKNIRMQMQKHFLEPITEMLKIKEYEDPQYPYPGGIQLAKLKNSIEELLSYSKSENLVEEFIELDEDLEEWLEDIQTLSAFYTKTAIRYFDESVRLLKERADDLDIAKNQTEVQKIKNQIVSILTMDHPYREIPNLPILNEKLRTELTNFVKKELGAQLEQMEEIRRKMEELKERYSIEVIKAMVQHELEELQARIEQLKDMDSISRVYSYTQMATNDLRRLEEKVYELYVQYQSETSDGDDRQVEVPISRFIQVMIPSGQVEIRTEDDVDRLLEKMKQELLKEIQNGKVVVIKK

SEQ ID NO: 667 - protein, 1214 aa, Geobacter sulfurreducens
MNRIADVFERPIDRTIEEVIKVDQANEATVQNELEEYIATDSIKDQFAEVYREIAAGPSTPREGIGVWVSGFFGSGKSSFAKILGYTVAQQKVGATTATELFKKRLRDARVVDLLDLVTMRIPFHAVIFDVSMDRGVRATNDRLTEIMYRALLRELGYAEDFDLAELEITLEGDGRLEAFERKFLELHGSEWKKRRQLGLAINEAGAALHDLDPRTYPTADSYAQGIGAGRADVDPNKLARRAFELCARRHPGKALIFIIDEVGQYVSRSVDKMLDLQAIIQAFGVEGKNRTERQEAVSPFWIVVTSQEKLNEVVTALDSKKIELARLQDRFRITVDLKQSDITEVTSERVLKKKAGAVDLIGKRFDADEPRIKQCCTLERTHRNLEINRSSFVRLYPYLPYQIDLCIDIVAGLRLKRGAHRHVGGSNRTIIKQAQQMMINDRTRLAEQPIGTLVTLDKVYELLEVGNLLPTEVSREVANVAQRLPGNPLAHKVVKAIALLESVKDLPRTPHNIAVVLHPSIEANPLTKDVVAALKELEEAQFIRQSEEGYKLLTVQEKNWETQRNGRDPREADRNRIHRELIREIFSEPKLRTYRYKDLRGFRTSLLVNGEWVESEGEIPLNILLTAREEHQDTLVDAREASVSKTTELFWVATLTDEINSLVTELFRSREMIGEYDRLAAQQRLTVEETGCLADEKSRRDRTQRNLRSKLLACIEGGNAFFSGVSYDAPVLGSSLSESLGTLLERAVPVLYPKLEVGVLRLNGDEPVKFLTSANLNGLPQIFYHDKAERSLVIKQADRFVPNLGCELCRELLDYLKREHAYGNRITGKMLESHFSGLGYAWERESIRLGLAILFRGGAIEVTHQGRKYRNYTEPTSRVPFVNNPAFRSASFSPREALDLKVLANAARMYEEISGRDVDIEEGAIAQAFKQIVVSDREKLLPLAARLGALSLPGAKIVQEQLNWVEGILEMPADDCVKTLAGDGKAYLEGRRQSFALDKAATDENIQAIARARRVLMEQWPVLVLNNDDPELKDAAEKLGETLQSEDALARIDNLRFYSESLSNAYRTLYENLFEKRKAAYTAALDQIKGRPEWLAVAEDPDIAQEQLDLILQPLTLKAEAVLDLPHGATVCQRTGATLAQLESDLAAVEAVGRDVLRRILELAAPEEKIERVAVARLYPGRITSKDELEDFITNLRERLSKVLAQGGTIILE

SEQ ID NO: 668 - protein, 1144 aa, Haliscomenobacter hydrossis
MLNKELFTLNPEQVNLKNEGVAKIRALNEQEDLSVAEYELKTFVCEGEYHDGLRKILDYYLQNYQSAEQAAFWVSGFYGSGKSHLVKMASYLWDDFEFPNGKTARSLKPLPQDIQDLFVEIDRKQKIQGKLSIAGTLRDFPSRDIRYSFLQIFLSALGLPQQYHHFKFVFWAKKEGIYDNLQALVEAAGRDFRKEIENLFVSPVLAKSVLELMPELAENEMKLKDLFKAQFPRIETISREDFVKTIRDEILPLFFGSKIPCTIIILDEVQQFIGDDSNLSFDVQLLAEDLCSRFDGKFLLVGTGQNALTETANLQRLMARFRVPIQLSNTDIQTVIRKTILEKKPASVAPLQTKLEASLGEISRNLEGSVFGYLTEDKNTLVADYPLLPSTRKLWNKVLREIDVAGTSGQLRNQLRIVDDSLKSIASLELGQIVPADYIFNQNQTQLIQAGLLLNDTSNLIQERKAKGGDSAIEGRILSAVFLLDLLTSNVPDTGLKANENTIADLLIDNLNVNSDTFRTKVKALVKNLVEAKVLMPINEEYKLQTKIGAEWEQEFTKQHIKLNNSGDDQIQTLRRGKIVAHLKDKTRAISVAQGASRTVRDFELWDKDALPNTEHKLNLWIRDGWFENETQVLNEIRAAGSNAPLAYAFVKKFRDPDLRSAIIKFLAAGLAIDAKGLPSTPEGEQAKKSMETRKSLAEKEIQDLIEKICAETLVYLAGGNLVQSGGLNENIREALHSIADRQFPEFKSKADFLNWGQALTKAQAGNPDALTAIQYSGDVEKHPVAMEILRFIGNTTKTGKDIRNQFMKAPYGWPQDAVDTLLILLKNNQHLSSNEPDLKQGKINPATFKKEVHILGAKEKITLRKLLQDAGITCPPNQEIFPFSNEYLAKLKALAAQASGEAPRPAPFDLAFIRDIENKEGNERLLDMLQQKEDLLATFLDWSAKAATVSKREPLWQTLRELASHAPDEAQMEQLKTDVAAIRDNRLLLQEPDLIQPSLNALAERLLDVLNGKKLRYNQLYDQAMAALQANEYVKKLSPEQKHGIWAKHQLLSKQEIKTLDAQGLLYQLQKTSLYNWDTKIAALPGQFQAALEDAILLAAPQAQTYALPRKTISSPADIEAYVTDLKAQLETLLETASSIILK

SEQ ID NO: 669 - protein, 1188 aa, Halobacillus halophilus
MMQIKDLFEKDIFRPINNVVQAEQVEEDVVETELDEYVLTEESEHYLERFYKNYLAVYNQPSTKVGVWISGFFGSGKSHFLKILSYLLHNQTIAGKTPADYFENKSENQELLNMMQQVSEKKSDALLFNIDSRSTSSSKDSEKERIIEVFLRVFNNHLGYSDTLWVAEMERQLDSDGKYEEFKQTIFDQNGKSWEELRLKILLRKRKVIKALETVGYDQDTAETFFDMSREWFSIDAQRVAELVADYCKSQGPDYRIVFLADEIGQYIGNNTSLMLNLQTITEKLGDLCHGQAWIIVTSQEKLESTVSDLDSTKDFSKIQGRFETKINLSSANTDEVIKKRLLEKEPVGADTLNTIHDQEGKLIHNRLAFDTNNTQLRSGYRNIEEFVSFYPFVPYQIELLQLVFTKIRNLGEGGQHTSRGERSLLKAFQEAAQLNAEENVDNMVTMAEFYPSIRDYLESSITGTIARAQDRARNQEGLEEYDVKVLEVLYLIKGIDEIKSTPSNIATLMIETVYDERQPLEYKIKESLNRLQTIMFIEQHADGSYSFLSDEEQEINREIRVEDYNGSAVKERLGNLFFNAMYLHPKYEYKYNGQTKHFNFNKRFDSYVKGQMNHELTIQVFSEGMTDSEAISKANSGYLIVLLNKDLVAEAERALAYIQQVDSYVRRKQTSTTSQQQKRIYELKLGEVDEFAEKAEELLAKACDNASFYIQGQRRDFSGKFENKIDQAMNMLVRSTFEKLDYIEKPISFKDNKKEWEQVVKDLGQQSLFSDTNKNAMDEMKYFIEELERFHDQRTLKQVVQKYKTIPYGWEEKDTIGILMGLMNAGKVRFMYAGEPFTPKSNQFYDRLEKLSERDRIVVLPIVEMDNKLKQELIALVRDFFSITQPYDTYDSYDELIREKVEEEFVRPIEKVRERRRQQDTTSEYPYPGESDIRTVVNGTQKLLANRDPEQFCRTFIQYEDDIEEWYDILEKLQGFYEGNPIVKFDEAVKALVEHEQDIEVIHNDELGEIVRRMKQILLQEEPTKDISQLPKLVDNLKNLIQDETNNQKQAVLVQSNKSMNELETLNDQYSEYETITEYIQLRTNKASQLYEKIKESERISSARINQQQLRELIDCTKVKTRQMLKELREESDAVKREPKVITERELYDSFFNQVDSIDSEEDLERAIESLKRNLIRELQTYYFVKS

SEQ ID NO: 670 - protein, 1197 aa, Halobacteroides halobius
MNLKEMFYKDIDRDIKGVIKVGQADEENMKQELEEYVVTNELADHFSEFYNNYEQGINSLTDKMGVWVSGFFGSGKSHFIKILSYLLENRQVDNKPAVEFFNDKHVEQELLAQMKEAGQVPTDVVLFNIDSKSSSDSKANKDAIVKVFMKVFNEMQGFCGSIPWLADMERKLVDNGFYEDFKAEFESNVGFSWEEKRQDAYFEADAIIEALVATTDMSQKAAENWYYNAEDNYSLSVEQFAQYVNQYIEEQAGDHHVVFLVDEIGQYIGDDTGLMLNLQTVVEDLGTYCGGKAWVLVTSQQDMDSITEVKGSDFSKIQGRFDTRLSLSSANVDEVIKKRILRKTDSARESLELLYNENESILKNLITFSSDTAEMKNYSNAQDFAQVYPFIPYQFDLLQKVFEEVRLHGASGKHLSEGERSLLSAFQESAQKYGTDELGRLVPFSAFYNSIETFLDSTISRVITKAKQNSRLTEEDVEVLKLLFMIRYIDEVPSDLENIATLMISNIDEDKLALQERIAESLDRLVSETLIQKNGPEYMFLTNEEQDVNREIKGTSIDVKKTIEKVGEILFEDIYPDKRYSYSTEYNFSFNKLVDDQARGRQKNEIGVQVLTPYSQFNSEEELKLKTSADDKVIIKLPSESNLMSEIEQSLKLSTYLKKKSGTAKNESMEDILTAKSRELRERQKRIKKLLMSDLKKADFYVKGEKMNLQTSDPVENINQSFERLIDTIYNKLNLIEEFVKSKQGLLDKLDSQEVQINFSGQQANSIALEEVRTYIERQNERNLKVTMKKLVDRFSSKPYGWKEFDIAALVIDLLKAQEIDLLYSSQNVNSQTNKLIKYLTRSRHKERLIVRKRRKVEQRLINKAKKLGREVFYESGLPTDEDGLKEELQDRLIYNERNVIRDLLDNYKSNPANEYETYPGQDTLEEGDSLLEELMEINDSFEFYNTLADKEDQLLDYEEEVSKIKDFFNSQQQKYYDRALKALDIYEQDKNYVNDKELISIVEELQEILTMETPYSRIHELSILRNEFQDGLTALLEKETTPIAETINNCQYRVIKVLEGYNLQDEFEAEVKEKFAALLEELNHANDFTEIFSMETKAKKLEEKFIAQIDSKVEELRRKREEQENNSPEEDTTDTGQTKKIAEETDTYKETVDVKLSDIIKDRVFVKSEEEVEEVVAEIKDELKRHIKDNKQVRLG

SEQ ID NO: 671 - protein, 1213 aa, Klebsiella oxytoca
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERHAYAFFEDKIKDALFLADINKAVHHPTEVILFNIDSRANVDDKEDAILKVFLKVFNERVGYCADFPHIAHLERELAKRGQYEAFKTAFSTITESSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWLEKGDILRNQLAFDPTTTASLRTYTCEEEFIDNYPFVPWHYQILQKVFESIRTKGAAGKQLAMGERSQLEAFQTAAKQIAQQGLDSLVPFWRFYAAIESFLEPAVSRTITQACQNGILDEFDGNLLKTLFLIRYVDLLKSTPENLVTLSIDKIDADKVELRHRVEKSLNTLERLMLIARVEDKYVFLTNEEKEIENEIRNVEVDFSAINKKLASIIFDDILKNRKYRYPANKQDFDISRFLNGHPLDGAMLNDLVVKILTPKDPSYTFYNSDAACRPYTSEGDGCILIRLPDEGRTWTDIDLVVQTEKFLRDNAGQRPEQASLLSEKARENSVREKMLRVQLESLIAEADVWAIGERLPKKSSTPSSMVDEACRYVIENTFAKLKMLRPFNGDIAREIHALLTVENDAELDLGELEESNPDAMREVETWVSMNIEFNKPVYLRDILNHFARRPYGWPEEEVKLLVARLARKGKFSFSQQNNNIERKQVWELFNNSRRHSELRLHKIRRHDESQIRKAAQTMAEIAQQPFSEREEPALVEHIRQVFDDWKQELNVFRAKAEGGNNPGKNEIESGLRLLNSILNEKEDFALIEKVTSQANELLDFSEDREDLVDFYRKQFATWQKLGAALNGSFKSNRSALEKDAVAVKALGELESIWQMPEPYKHLNRITPLIEQVQNVNHQLVEQHRQRALERIDARIEESRQRLQEAHATSELQNSVLLPMQKARKRAEVSHSIPEILAEQQETKALQTDAEKKINQWIDELRKKQEAQLRAANEATRAAESQQTYVVAEKPVIQPVPKKTHLVNVASEMRKATGGEVLETAEQVEKALDTLRAALLAAIEAGDRIRLQ

SEQ ID NO: 672 - protein, 1233 aa, Lactobacillus amylovorus
MIQIKDIFAKDINRDIRGVIKIGQDSDDIKQQELEEYVVTDELKRNFTRFFDAYDKSINNPTDEMGAWISGFFGSGKSHFLKILSYLLENDTVKGRQAIDYFLQDGKFDDDHLADAINKATSVPTEVALFNIDSKADSNAANNDNSILDVFLKVFNEQLGYSPIAVVADMERWLDSVGKYEAFKQAFADLATTDHSSWVELRKNYALMSTKIKTALVNCGALDETDANNYVQTLLTKKFSIDATAFAKLVKDYLDKKGNDAHFVFLADEVGQFIGDNNSRMLNLQTIVEQLGVQCQGRAWVVVTSQQQMDEVASNFSKYERDFSKIQGRFNTLINMSSANADEVIRKRLLTKKPLVSDQLADIYSQEQYSINNKINFSDAIKRQKFDNAQEFVENYPFIPYQFSLLKEVLTAVRQHGANGSHMSDGERSMLGTFQEATKRYENDELGRLVPFSAFFIGMKEFLSHDHQVVFDRAQTDRYVNKNNEDYCFNIQVLAVLFMVRYVDNYPSTLENIVTLLLDSVDQDRQALTAEVKDALNVLMRQNYIQKKLDTYQFLTDSEREVNEAINAIEVDDRKVAQKIGSYLLTSNLIDAKYTYPHMKNQYIFEFNEYIDEMGLNRLSNNLNIQIISPLIADNYREIDFKQKAMDGKNIIIVLKDDDRYIENYRHIEKISAYLQKPESRSDDKKQEIAFNRKAESKQVEEATQKMIKDDLIDADIYVLDDVLPKGSNFESRLEQAKKEIIDSNYRNLHYLTAVKTDQDILDTLKGKNKDDLFSDDEQAIKEIINYINVQASSMNNVSLANVIKRFGEIPYGYKPTDIAWMVAKAFVNGKVKFYFNNEQISLTSAQEDPKGTQRYLIGRNNITKLTIKPVKEISMRQKRDAKDFVEDILNKRLSVDENTTSEQMADDIINKTKGFVACLNALMRKKYNFDTPYPGHKLLAEGVNDLNAIVNVKDSDRVFQIISDHLDDYEDWHEELEDKAILEFYGDVEQTSNQQTIWNKAHRYLDRYNYAKSMISDQDLIGIAQKIKGCLNDDNFNITIPKLKELNTQFADKYNDVIQEAYDKIEAQIQISLDVIKKRIAESDFPEDKDRELNDMAENIFNTLLQKAKEYSNSASEDAYVSLVGLKTNIDGQTNEQKENIARVSSELAEQARIEQNETSDKEEPSSVTHITDKSKPIVRVKSNKSKDITELVHEDSWKITNEEDLDKYLDELRKNIEQELQHTDILNVDFK

SEQ ID NO: 673 - protein, 1212 aa, Lactobacillus casei
MEIKELFKRPIDRNIQGVIKVDQDDEANVKQELDEYVVTSELRDHFEAFFNAFDNSLQTPTDDMGVWISGFFGSGKSHFLKIISYILANKVVDGKNAVDYFDDKIDDQMILNEMHAAASAKNDVILFNIDAKAKDTVGSDKQSILKVFMRVFNEMQGFTDADFWIADLERQLTEAGKLDAFKEQITAIDANHKSWEDLRDAYYLNKGTIKAAMINSGFSDEANAQGFIDTLSTEYQISIDDFAELVKQYIDKTGHRVVFLADEVGQFIGDSVQRMLNLQTIVEQLGTMTRGKAWVVVTSQQAIDKVTDIASGQDFSKIQGRFKTRLSMSSANVDEVIRKRLLEKTDVAEKMLEDQYSANAAAINNSFDFDDDVERPKYESPKDFAQNYPFVPYQFNLLQFVLTAIRENGSDGKHLSEGERSMLSLFQESAEAMMSESTETLAPFSRFFDGLDQFLDHTHHIVLVRAHDNPAVNPNKEKNPFALQLLKVLFMVKYVSNFTASLNNLITLMISSVDADRIALKKQVQDALDVLVTQGYVEKTVKGYDFLTDAEQDITREISKQEVTDNGVAKEIGDYLFNAKPGVATSLTYPKLNGRYVFAFNRKTDNIFGAQRNKLSVHIITPVNDDFLEDNDYLRASAGSWNHDVLIALPRSSNFVGEIRNALRIQKFVVNSNVSTDPRYQAMVSTRQAQQNEEFAHAHEQLIAALDSAEIYENGQSVSSEAGFDSRLEKAMKLLVDNTYRSLQYITVAKSEKDIRELFENISSLALDEKDNQAAVDAVLDYMRRESQNNAHITMESVLSKFNDIPYGYTDEDIQWLVAKLVAIGKLKMFYNGKLIDPLDDEYTTRDLAGFFTKKQAIRNLAFQIKEEIAPSKIKAMQTVASEVFGKKSFEADNDEQKASELKKTVKNKYDALITFEARPQEYPGHAVLQQGIQMLRQLLIASDSGAFYDYIGKHKDDLLDWNDDFLDDGIRDFYYSDSMQKIWDKGLNALRVYRDSNDFLSDSKLQNIVDEMGKLLRLQKLQGDTAVKISELNNDFDTLFTAAFDKKAAEYLAQIDEFKDLGLTRILESGISDEKVQDQLRHDFENKIQVIRDAAKNAVTLNQVVAKPAQADAQLEQLSKRIKQEVERIVVVSPATGDKHKNVDDVTKSVTPANTGKIKPKDKKFIKVDQVLRRGDYKLEDSADVAELTAEFKRLLEAQLSDNTIVTLQVD

SEQ ID NO: 674 - protein, 1238 aa, Lactobacillus helveticus
MIQIKDIFAKDINRDIRGVIKIGQDSDDIKQQELEEYVVTDELKRNFTRFFDAYDKSINNPTDEMGAWISGFFGSGKSHFLKILSYLLENDTVKGRQAIDYFLQDGKFDDDHLADAINKATSVPTEVALFNIDSKADSNAANNDNSILDVFLKVFNEQLGYSPISVVADMERWLDSIGKYEAFKQAFADLATTDHSSWVELRKNYALMSTKIKTALVNCDALDEIDADNYVKTLLTKKFSIDATAFAKLVKDYLDKQGNDAHFVFLADEVGQFIGDNNSRMLNLQTIVEQLGIQCQGRAWVVVTSQQQMDEVASNFSKYERDFSKIQGRFNTLINMSSANADEVIRKRLLTKKPLVSDQLADIYSQEQYSINNKINFSDAIKRQKFDSAQEFVENYPFIPYQFSLLKEVLTAVRQHGANGSHMSDGERSMLGTFQEATKRYENDELGRLVPFSAFFIGMKEFLSHDHQVVFDRAQTDRYVNKNHEDYCFNIQVLAVLFMVRYVDNYPSTLENIVTLLLDSVDQDRQALTAEVKDALNVLMRQNYIQKKLDTYQFLTDSEREVNEAINAIEVDDRKVAQKIGSYLLTSNLIDAKYTYPHMKNQYIFEFNEYIDEMGLNRLSNNLNIQIISPLIADDYREIDFKQKAMDGKNIIIVLKDDDRYIENYRHIEKINAYLQKPESCSDAKKQEIAFNRKAESKQVEESTQKMIKDDLIDADIYVLDDVLPKGSNFESRLEQAKKEIIDSNYRNLHYLTAVKTDQDILDTLKGKNKDDLFSDDEQAIKEIINYINVQASSMNNVSLANVIKRFGEIPYGYKPTDIAWMVAKAFVNGKVKFYFNNEQISLTSAQEDPKGTQRYLIGRNNITKLTIKPVKEISMRQKRDAKDFVEDILNKRLSVDENATSEQMADDINNKTKSFVDCLNALMRKKYNFDTPYPGHKLLAKGVIDLKAIVKVKDSDRVFQIISDHLDDYEDWHDELEDKAILEFYGDTSSQQAIWNKAHRYLDRYNYAKSMISDQDLIGIAQKIKGCLNDDNFNITIPKLKELNTQFADKYNDVIQEAYDKIESQIQISLDIIKKRIAESDFPEDKDRELNDMAENVFNTLLQKAKEYSNSASEDAYVSLVGLKTNIDGQTNKQKENIARVSSELAEQARKEQELREKKTAAEENEKKEPVSVAPISNKTKPIIRVKSNKSKDITELVHEDSWKITNEEDLDKYLDELRKNIEQELQHTDILNVDFK

SEQ ID NO: 675 - protein, 1244 aa, Lactobacillus helveticus
MIQIKDIFAKDINRDIRGVIKIGQDSDDIKQQELEEYVVTDELKRNFTRFFDAYDKSINNPTDEMGAWISGFFGSGKSHFLKILSYLLENDTVKGRQAIDYFLQDGKFDDDHLADAINKATSVPTEVALFNIDSKADSNAANNDNSILDVFLKVFNEQLGYSPIAVVADMERWLDSIGKYEAFKQAFADLATTDHSSWVELRKNYALMSTKIKTALVNCDALDETDADNYVKTLLTKKFSIDATAFTKLVKDYLDKQGNDAHFVFLADEVGQFIGDNNSRMLNLQTIVEQLGVQCQGRAWVVVTSQQQMDEVASNFSKYERDFSKIQGRFNTLINMSSANADEVIRKRLLTKKPLVSDQLADIYSQEQYSINNKINFSDAIKRQKFDNAQEFVENYPFIPYQFSLLKEVLTAVRQHGANGSHMSDGERSMLGTFQEATKRYEDDKLGRLVPFSAFFIGMKEFLSHDHQVVFDRAQTDRYVNKNNEDYCFNIQVLAVLFMVRYVDNYPSTLENIVTLLLDSVDQDRQALTAEVKDALNVLMRQNYIQKKLDTYQFLTDSEREVNEAINAIEVDDRKVARKIGSYLLTSNLIDAKYTYPHMKNQYIFEFNEYIDEMGLNRLSNNLNIQIISPLIADDYREIDFQQKASDGKNIIIVLKDDDRYIENYRHIEKINAYLQKPESRSDDKKQEIAFNRKAESKQVEEATQKMIKDDLIDADIYVLDDVLPKGSNFESRLEQAKKEIIDSNYRNLHYLTAVKTDQDILDTLKGKNKNDLFSDDEQAIKEIINYINVQASSMNNVSLANVIKRFGEIPYGYKPTDIAWMVAKAFVNGKVKLYFNNEQISLTSAQEDPKGTQRYLIGKNNIAKLTIKPVKEISMRQKRDAKDFVNDILDMRLTVDENTTSEQMATDIKEKTDYFVGRLKALMRKKYNFDTPYPGHKLLAEGVNDLNAIVNVKDSDRVFQIISDHLDDYEDWHEELEDKAILEFYGDVEQTSNQQAIWNKAHRYLDRYNYAKSIIEDQDLIGIAQKIKGCLENDNFNNTIPKLKELNTQFADKYNDIIQEAYDKIEAQIQISLDVIKKRIAESDFPEDKDRELNDMAENVFNTLLQKAKEYSNSASEDAYVSLVGLKTNIDGQTNEQKENIARVSSELAEQARREQELREKKTVVEENETNNEGASTSAASVPDKSKPIVRVKSNKSKDITELVHEDSWKITNEEDLDKYLAELRKNIEQELQHTDILNVDFK

SEQ ID NO: 676 - protein, 1243 aa, Lactobacillus johnsonii
MKIKDIFAKDINRDIRGVIKIGQDSDDIKQKELEEYVVTDELKRNFTRFFDAYDKSINNPTDEMGAWISGFFGSGKSHFLKILSYLLENDTVKGRQAIDYFLQDGKFDDDHLADAINKATSVPTEVALFNIDSKADSNAANNDNSILDVFLKVFNEQLGYSPIAVVADMERWLDSVGKYEAFKQAFADLATTDHSSWVELRKNYALMSTKIKTALVNCGALDETDTNNYVQTLLTKKFSIDATAFAKLVKDYLDKKGNDAHFVFLADEVGQFIGDNNSRMLNLQTIVEQLGVQCQGRAWVVVTSQQQMDEVASNFSKYERDFSKIQGRFNTLINMSSANADEVIRKRLLTKKPLVSDQLADIYSQEQYSINNKINFSDAIKRQKFDNDQEFVENYPFIPYQFSLLKEVLTAVRQHGANGSHMSDGERSMLGTFQEATKRYEDDKLGRLVPFSAFFIGMKEFLSHDHQVVFDRAQTDRYVNKNNEDYCFNIQVLAVLFMVRYVDNYPSTLENIVTLLLDNVDQDRQALTAEVKDALNVLMRQDYIQKKLDTYQFLTDSEREVNEAINAIEVDDRKVAQKIGSYLLTSNLIDAKYTYPHMKNQYIFEFNEYIDEMGLNRLSNNLNIQIISPLIADNYREIDFKQKAMDGKNIIILLKDDDRYIENYRHIEKINAYLQKPESRSDDKKQEIAFNRKAESKQVEESTQKMIKDDLIDADIYVLDDVLPKGSNFASRLEQAKKEIIDSNYRNLHYLTAVKTDQDILDTLKGKNKNDLFSDDEQAIKEIINYINVQASSMNNVSLANVIKRFGEIPYGYKPTDISWMVAKAFVNGKVKFYFNNEQISLTSAQEDPKGTQRYLIGKNNIAKLTIKPVKEISMRQKRDAKDFVEDILNKRLSVDENTTSEQMADDIKEKTDYFVGRLKALMRKTYNFDTPYPGHKLLAEGVNDLKAIVNVKDSDRVFQIISDHLDDYEDWHEELEDKAILEFYGDVEQTSNQQTIWNKAHRYLDRYNYSKSMISDQDLIGIAQKIKGCLNDDNFNIAIPKLKELNTQFADKYNDVIQEAYDKIESQIQISLDVIKKRIAESDFPEDKDRELNDMAENVFNTLLQKAKEYSNSASEDAYVSLVGLKTNIDGQTNKQKENIARVSSELAEQARREQELRKKKTAAEENENSNEDASVSSAPVPNNPKPIVRVKSNKSKDITELVHEDSWKITNEEDLDKYLAELRKNIEQELQHTDILNVDFK

SEQ ID NO: 677 - protein, 1221 aa, Lactobacillus reuteri
MIIKDIFAKDINRNIRGVIKIGQEAETIKKQELEEYVVTDELQSHFKRFFSAYVNSINRPTDATGVWISGFFGSGKSHFLKILSYLLDNSMVAGKRPIDYFRDDSKIKDPDTIQLIEQSEQVPTDVVLFNIDAKADANAAADKSAILTVFLRVFNEKLGYDSNPSVANLERWLDDHGQYQAFKDAFYKASGSHWVDVRNSFSFIKNSVKEALVQSGSMTEGNAADYLSNMGNFTINPEEFAGMVKKYLDKKGNNHHIIFLADEVGQFIGDNGDRMLNLQTIVEQLQTQCAGQAWVVVTSQQQIDEVTANFTNQKREDLSKIQGRFNTMINMSSANANEVIQKRLLAKKPMASDQLAAIFEENHYNINNKINFSDQVSRKKYADDNDFITNYPFIPYQFDLLKDVLGAVRKHGAEGKHMSDGERSLLATFQAATVTYEDDKVGRLVPFSAFFRGMYEFLSHDHQVVFTNAEGNDAVCPNGNHDTLAMQVLEVLFMVKYLDNFPATLENITTLLIDGIFTDREDLTSKVKKALELLISQKYVQLNVETYEFLTDKEQDVNEAINSYEVDDTYIINKIGGYLIGDKYLSDRYVPKHMGNQYVFNFNIYIDGSAYGRSNNNQSLRIVTPLNPAGEEQYRMTAQSGSTVVLVLPDNNSYISNFRRAGQIEQYIQKSAGNFDNQEGAIRLGKMDERKKLEKAADRALLNDLNNSTIYVMNDILDDNTDITSRLSNAYQEVIDSSYRNLSYLTAIKDEKDVLHLLKGTGEEANTIIDDNQQAVQAVIDYLMMKTNQGMQALSMENIRDHFNEIPFGYNDEDIAWLVAKAFKDGKLKLAFNNAPISISDAANNAQLITGYLTKKQQVRKLTLQIVREVPGKQRKAARDFVKDILHKRSILADNDSTEQLAAKIVTTTKEKINELNGFDAFPQGPGKALIDQGVELLKPIANSGNNSERIYGLIDKHLDELEDWLEDMDDNGISDFYHSDTQKSVWRRSLDYMDRYNLAKGFIDSDNAVHKTAQTIKESLKKQNISRVIPQLEALNQDFATQFNNLVDKLYRQYQDKSENYLQLLEQRLADANFPEQTANKLQQRIQDTISRDNQIAEQKSNDGKYTELNDQIQLLKRDADQLQREIDETSQQIARDLRRKQELAEQATKHDSSERPHPIENISREVVHTKRVKTIKISDLEGQAWRITSDSDLDSYINQLKQSLQREIDLNDIVNVDFK

SEQ ID NO: 678 - protein, 1210 aa, Lactobacillus rhamnosus
MKIKDLFKRSIDRNIQGVIKVDQDDEANVKQELDEYVVTRELRDHFAAFFSAFDNSLQTPTDDMGVWISGFFGSGKSHFLKIVSYILANKIVDGKPAVDYFDDKIDDQMILNEMHAAAAANNDVILFNIDAKAKDTVGSDKQSILKVFMRVFNEMQGFTDADFWIADLERRLTEAGKMDAFKEQIKAINANHQSWIELRDAYYLNKGTIKEAMVKSGFSDEANAQGFIETLSTEYQISIDDFAALVKRYIDKTGRRVIFLADEVGQFIGDSVQRMLNLQTIVEQLGTMTRGKSWVVVTSQQAIDKVTDIASGQDFSKIQGRFKTRLSMSSANVDEVIRKRLLEKTDVAEQMLEDQYSANAAAINNSIDFDDGVERPKYKSPKDFAQNYPFIPYQFNLLQQVLTAIRENGSDGKHLSEGERSMLSLFQESAEAMMDADTETLAPFSRFFDGLEQFLDHTHHIVLVRAHDNPAVNPNDEKNPFALQLLKVLFMVKYVTDFNASLNNLITLMISSVDADRIALKKKVSDALEVLVGQGYVEKTVKGYDFLTDAEQDITREISKQEVIDNEVAKEIGDYLFNAKPGIATSLTYPKLNGRYVFAFNRKTDNIFGAQRNKLSVHIITPVNDEFQSDNDYLQVSTGAWNHDVLIALPRSSNFVDEIRNALRIQKFVVNSSASSDSRYQGMVLARQSQQNEEFQHAHEQLIASLDNAAIYENGQLINGEAGFDSRLEQAMKLLVDNTYRSLQYITVAKSEKDIRELFESISSLALDEQDNQAAVDAVLDYMRRESQNNTHITMESILSKFNDIPYGYTDEDIQWLVAKLVAIGKLKMFYNGTVIDPLSGERTPREIAGFFTKKQAIRNLAFQIKEEVAPSKIKAMQTVASEVFGKKSFEADNDEQRAAELRKLIVTKYQTLKGFEDKTQDYPGHVLLQKGLQLLRPLTEMSDSGAFYDYISKHKDDLLDWNDDFLDDGIRDFYYSQSMQDIWDKGLNALRVYGESSDFLSDNQLQDTVDKMAKLLHLQKLQGDTAVKISELNKQFDELFSAAFDKTAAGYLADIDDFRERGLTRIEESAIPDQNVKDKLAHDFENRIKAISEAATDATTLNEVVAKPAQASAQLDQLTDRINHAKAQLIPAGDHSGESKTDDKHKDPDKPVGPTVVSPQEKIVKLEEVLHKGDYKITASADIDKLTAQFKRSLEAQLSDNTVVTLQID

SEQ ID NO: 679 - protein, 1210 aa, Lactobacillus rhamnosus; identical to SEQ ID NO: 678

SEQ ID NO: 680 - protein, 1194 aa, Leuconostoc kimchii
MKIQDIFEKDITRDIQGVIKVGQDDVQTIKQDLDEYVVTSELQRYFADFFDAYQKGINGTTDKMGVWISGFFGSGKSHFLKILSYLLNSKVQVDGMSAVEFFKQQNKVADPMTIANMDLAASVPSDVILFNIDSESKSGNKSSENAIRNVFLQVFNKMQGFTDKNFWLADMEQMLVADGLYDDFKAAYKELNPKHDDWEKGRDRYAFEEKIAIEPALKQVGYQYDMPNFHADYELNIKDFAERVATYINAKGDNHHVVFLVDEVGQFIGDDIKRMLNLQTIVEELGVATGGKAWVMVTSQQAIDEVTTNLSGTDFSKIQGRFDTKISMSSADVAEVIKKRLLAKTNDAAGFLEGDFENNKQAILNKFNFGSERKWRKYKSAQDYADVYPFVPYQFELLQSVLTAVREHGSDGKHLSEGERSMLAIFKESAEKVGEDDTSTLIPFSSFYDGLEGFIDHEHRIVISNAEKNEAVNPNEEKNPFALRVLQTLFMVKHVDSFEKNIDGITTLLISSNDEDVIELRKRVEDALNVLIKQGFVEKTTKGYEFLTNTEQDIKRQIDKQMVNDSDVDKSLGDFLFAEMATTFTPDGMGKNYNFKFNTFVDEYLQGSNRNALNMKVITPLNDMNNVDVKLEMESTESNTLVIDLPNNAEYIDELRQAIRIAQYLSRSSSLDSKASQLISVQSEERKSLMDAAKKHALDALSEARVFVNGNQIEGSVIKTRLESGMKNVVGNTFRKLNDLVQTHTDRDIVSLFASDDDMVLDAADVNQNALEDVKNKISKELTKNPKVSLETIISQFQAIPYGFSPIDTQWLVAKLFVDGKIDIESDGEKILVKDEHYSNKQKADLFLKNQKRLALTIKQDIPMKQRKTLKNLAKEVFGKRAFQDETDDGMVLELRDATIKYEYDRLSDYEGRDSKFPGHVELQKGIQLLKRLLGVKDTAEFYAQMSSMEEELLDWHEAMEDKDVKDFYGNKSSQAIWEQGIKNVDIYHRSEGFITNVELNELVDNLESLIKSGTAKKVQDVKAKNEEFSNLFNSVLDDEQQRVILRVQDYQERGETLISETDLSDSTKSLLTSDYISEMENIRSQATEAVDLETLNGKLPLASSKLNQLMAKVQSEVAKRQVLPVTHEDGDEVQSKPAGPVKIPRFESLRDYTGATSWHITSESDLDVQLAELKQRILAQLNDGKTSFIDLNI

SEQ ID NO: 681 - protein, 1194 aa, Methanobrevibacter smithii
MQIKNMFEKDIDRDIKGVIKVGQNDDENIYQELDEYVVTNELLKHFTKFFSSYNKGIQSPTDDIGVWISGFFGSGKSHFLKILSYILDSNLKVHGRRPIDFFKEDGKIKDSMVIGDMEAATNVSSDVVLFNIDSKSSSQSSSNKDDILNVFVKVFNEMQGYCGGMPFLADFEKKLDAKNKFEEFKTEFENINGMDWEESRDEFYFISDDIIQSVVNIGFMSENEANNWASKAEENFKYSIEDFANEVNEYCINKGNNHHVIFLVDEVGQYIADDTKLMLNLQTIVEELGIKCHGKAWVVVTSQQNIDDITRDIKGMDFSKIQGRFKTRLSLSSSNVDEVIRRRILAKTDVAQQTLEAEYPSFEPILKNILTFEKSAEMKTYENARDFANIYPFVPYQFNRVQDVLTSIREHSSSGKHMADGERSMLALFQESAIEIKNGSEGQLVPFNIFYNAIEQFIDHTNSQVINKARDNKELYPFDVEVLKVLFMIKYVKEIKSTSKNLTTLLISNINEDRLELQNKVDKSLSRLLEQTLIQKNGEVYSFLTNEEQDINREIKNQIVDNGEVLDNAANRIFQEIYPKNKYRYSNRYNFQFNQSIDNKKINNREFDIGMRIITPFYTSDLSDCSQATFEESNMHNILKGLSESNNEVVVHLLSDLTVFDEIKEALQIQKYLTKKSAEMKVELRSRKQEEYNDKIERIKLFLESSIKDAIIYIKGDKVDIAEKNVESRLDESMGKLVDKVYNKLSYMDFAPDKSDIKKELTNEYQQTLIASETKAMNAVNDMDSYISDQSKLHNTLTLKSLINRYSKAPYGFVNLDVQWLLASLFAQKRIVLTINSDEISLRNTDASKILDYLTKNEYLEKLLVSEKEVIDSSKIRKVKEVLKEVYSLNLTHDNDERIMDEFKRVNTSKIEEIDKCLLEFRISNKYPGKSILEESKELFNDANNKKNTLQFYNYVSDNDEEFLDLADDLDPVLAFFNGSQKAIFDESCEVYKVYEENINLINDSDLSDVASEIYRIISMPNPYSNIRKLPELNNKFTTHFDEILEDKKTIILNGIKEDYESIKLRLNTDELKAKFENKFISEFDSLKNKLDSEKNIAIIDGITMESENLKNNCIHEIDLFINSITPIYPPEGAINKPVSPQPIPVEVDVDIKTITLSPKVKIESEDQIDEFLQKVKTELKNKLENADIINLKL

SEQ ID NO: 682 - protein, 1155 aa, Methanoculleus bourgensis
MASHDVILNKDVFHRDPLGYTIPNDGVTEVGPIATEQEWAVARYELENFICKGSYHRGLKNILESFLDNLDKSVQPPVWVSGFFGSGKSHLVRVLEFLWSDLVFPDGANAREICQLPDDVKDALRNLSSEGRRHGGIWSAAGKLRSGCSGDPRIAVLQVVLRSAGLPDDIDIARVHLWLAEFGILDAMWEKLREQGRDRDMNRPFVSRKFTEALIELHPDFRGMTVEQVREDLRRQFETNFQITDSFMVEMLKDIFAMKSTVPGKMPLVLIVLDEVQSYLTLGEGSEGLDTFEDVVEACSKRFSSKILFVATGQDALEANKILQRLQGRFSLDVPLESKDVDVVLRQTILRKKESMKEPLEEVLELASGEISRHLDGSNLASQVEDEEVLLLDYPLLPTRKRFWERILQSVDRGGMSTQLRNQLRLTFDGARTFAADPVGTVIPADFIFTQQSTYLIRNNILSPKIYESISKEDDGTPEGQLRSRIAALLFLIQQVDESFGIRATPDTLADLLVTDLVAGSEDLRREVPILLNDLHDRGVIAKVGDEYRIQTEEGSVWEGDYQKRKADARASDTSIMFRRDEILKTFANKHLERLTLAQGESKTPRGIESTYFTSQKPEIRSNVPVWIRHEWEVTEGAVKSEAAAEGSESPMVMVFLPRIDHDAFKDEIGGLLAAEGVIRDRPAPTTPEGGQARSNIEAKLSGHMQRIDSIAAEIFKHARVYLGGGILVENDSFAGAVRKAADRAIQRMYYRFSDADAVGWDRVINRVKGGDKTPMKQIGFEREPEEHPVCKEILKRLNTPKTGKEVRKALDAPPFGWPRDAVDGALMVLVATGHLKARFNNKPVSAPELDKTKIGKATFEAENIVLSPMEKVAARELYTKFDLPSEPGREVEEAVQFLDCLHSLVKATGGDPPLPPRVSPQYLAELRAYSGNQLVRELVARRVDIKQDIDRWIAVKAKIEERVPAWDALQHLISHAEGFLDLPDIKTEVTAIRENRSLLNDPDPVEPLLADLRRGLRESLKAGTVRLEETRQEVLFALDADPDWHRLDEKQRASLVRAHYLNEPLPLRTGTDDEIVEHLRKTPLTSFDGRILLVRGALDRIRVKVAKILEPETVVVSLGAPVTVKTRDDLDAYLEEVRGRAVAELEKGNPVVLR

SEQ ID NO: 683 - protein, 1185 aa, Methanolobus psychrophilus
MTSAIKIQDLFQKDIKREINGVIKVDQEDDENVYTELDEYVVTKESLKHLDLFFERYFNALENPTDKVGVWVSGFFGSGKSHFIKMLSYLLENRVVRGKSALEFFREKIDDAQLFSSIEKAVIHGTKDVILFNIDSKANTLNRSDELIVNILMRVFNEKRGFFGDVLWLAEMEEDLVNKGLYGEFKEEFRQISGAPWEEKRDAYIFEQDEIIEALVNCDYQSRESLERLFHSDGSSSHFSVEKFAEKVKRYCDSKGKDHQVIFLIDEIGQYIGENSELMLNLQTVVEALGTKLTGKAWIVVTSQADIDSITKDAKGYDFSKIQGRFDTRLSLSSANVDEVIKKRILAKKAVYVETLTSYYTDKKTIMKNILTFSPGGAEMKLYKGDEDFVNVYPFVPYHFFVLQKVFDKIRQTGFTGKHLAKGERSMLNAFKEASEEYAEEELGVLVPFSTFYNTIESFLDPIIKRTIEQAKGNDCLVDGDCEILKILFMIRHVNVLQPSLDNLVVLSISHVDEDKRKLKERISASLQRLEAQTLIHKSGDRYYFLTNEEQEINREIKNIDVEKHKILDEMFAYVFDEVCPAKHKDYKFHKSIDDKVKSTAGADLTIKFLTPLSDDVQRGSGQRSLSGENLSNVDSTDTLLFVFQHDAVFVNQIRDYIRISKYLLQNTSNMNIGEVKDILSSKRNDEVKLREAAKKSMEEGISEARIFVDGKEVTSIEKKNPKERIKDGLDLLFQNVYKKAGYVTREFTSDNEILRILQADDLEKFGAGESEENQLALREMLDYLNVRHQKNDVVVLQDIKERFRRKPYGWNEVTISGLVATLFARDEIKVRYQKTYLILKRPTAEEIVRYLTRKDFADKVVLEIREKANVEVIRTVKSVLRDVFEKTNIPEKENELFELTYSLFKAEYTNLEQIEGRYKEEPRFPGKEKIRAYADFLNNVLNVTDPSSFLQAIADGKDEFVRARAEVEPVLSFFGSTKVDIFRRVLKKMDNFKRDLQFMDEDTKFKVQEVKAILDSKEPYSDIKSLPPLEASIESSLSTALANLKEAAFTEIGSIKIELQKYMASYVELDSDYRYLMLKPFDQLKETIAQASDCVFVQAQSTTLKFLDETTYGEIKNQLQTIREKTEGKDKDKITPVRSTRVIRDVSLFKTKDTIKSKEELDKYLEDLKTALLEMLKTDNFKVQ

SEQ ID NO: 684 - protein, 1187 aa, Methanomethylovorans hollandica
MTAAIKIHDLFQKDIRREINGVIKVDQYDEDSVYTELDEYVVTKETLKHLDTFFDRYLHAMSEPTDKTGVWVSGFFGSGKSHFIKMLSYLLENQVVKGKSALDFFREKIDDPQLLNTIEQAITFGTKDVILFNIDSKANTLNRSDELIVNILMRVLNEKRGFYGDVLWIADMEEDLVNKGLYDKFKDEFRQLNGESWEEKRDTYVFEQDHIIEALVNCGYQSKESLERLFQSDGSTYHFSVEKFAEKVKKYCDSKGKDHQVIFLIDEIGQYIGENSDLMLNLQTIVEELGTKLAGKAWVVVTSQADIDAVTKEKVKGYDFSKIQGRFDTRLSLSSANVDEVIKKRILAKKQVYEETLSLYHEEKKTILKNLLTFSPGGAEMKLYKGNDDFVDVYPYVPYQFFILQKVFDKIRQTGFTGKHLAKGERSMLSAFKEATEQYAEDDMGILVPFYTFYSTIESFLDPIITRTIEQAKDNDCLEDGDCDVLKILFMIRHVKELQPSLDNLVVLSVSHVDEDKRALKNRIAGSLQRLESQTLIHKSGDRFYFLTNEEQEINREIKNIDIEKHKILDEIFEYVFESNEICPTKHKDYKFNKAIDDKTKPVAGADLTIKFLTPLSDDVLRGSSQRSLYGDNLSNIDSTDTLLFITHADSEFVDQIRNYLKIDKYLKQNTSNTNIGEVKEILSKKRSDEENLRLDAKKSMESGISEARVFVDGKEVTSIEKKKPKERITCGLDLLYENVYKKAGYVTKDFESDSEILKVLQADDLEKFGFERSDTNKLALKEVLDHLSLKHQRNDSVVMQDIKDKFRRKPYGWKELTVSGLVATLFASDEIKLRYQKTYLVLKKPNAEEVVRYLTRKDYADKLVVEIREKANAEVMRIVRSILREVFDKTNIPEKENDLFDFTHSLLNDEFIKIEQISGKYEEEKRFPGNDEVKAYAGFLKQILNTTDPSAFLQKISDEKEELVKLRYDVEPVISFFGGQQVEIFRRLLKKIDNYTRDRQFMDDETKSKVRDVEAILGSKEPYFEIKSLPPLEASIESALSTALSDLKEAAFKEIDSIVADLQKEMGHHTLFNQEFKDSVMKPFTDLKLRISQAEDCTYVQAQSPRLNSLQSEAYDKISKQLQIIKEPKSGSGEVSVHVRSVKFIKDTSLFKSKDKIASEEELDRYLKDLRTYLAKLLETDDIRLF

SEQ ID NO: 685 - protein, 1201 aa, Methanosarcina acetivorans
MLHMTATEIKIEDLFEKDIRRDINGVIKVDQEDERSVYTELDEYVVTGESRKHFDTFFRNYAAALDEPTDKIGVWISGFFGSGKSHFLKILSYLLANREVQEKKALEFFRDKITDPAIFANIEKAVTTGTKDVILFNIDSKANTANKGDEQIVNIFMRAFNDMRGYLGDVFWIADLEEDLEEKGLYEAFKTEFESINGEPWEERRVTYGFEQDDIIEALENCGHMSREAATRLFENDGAGYTFSVEKFAKKLDKYCKSKGKDHQVIFLVDEVGQYIGENSELMLNLQTIVEELGTKLRGKAWVAVTSQADIDTVTKEHVKGYDFSKIQGRFNTRLGLTSANVDEVIKKRILSKKEEYREVLASYYAEKQTILRNLLAFSNRAEIKVYKNEDDFVNVYPFVPYQFNLVQKVFDRIRETGFTGKHLAKGERSMLSAFKESTENYCENNVGMLIPFHAFYETIEGFLDPIIARTISHARKNDFLNDNDCELLEILFMIRSIPEIEPNLDNLIVLSISSVDEDKIKLKQRIVESLRKLEDQTLINKSEDKYYFLTNEEQEINKDIKRVEIEEHQMLEEIHGMLYEQKQGICPASHKEYRFNKAIDDRVKTFTGADLTIKFLTPLSDQYYSKKGNQQSLSGDTLSNIDSTDTLLFILPEDELIDQIRSYLKIEKYLKQNSSNRNNVEIQNILSTKQQNANSARAKALELVQKGVSDSRVFVDNKEVIPEKSSPKERIKEGLDLLIQNVYNKAGYVTKDYENDSEVLRVLRSDDLERFGVEGSDINRLALKEMLDYIRLKYGRSGRVLLSDLKERFTKKPYGWKEMTISGLVATLYLREEIKLRYQSEYLFKDPEATAKHLTRRDETDKVVIEIREKTGEEDLKAVRLILNNLFDKLNLKEKEGELYEEIKCIFREELLSLQEIEGRYEEEKSFPGRIQIEAYRKFLKKLTENSDPSAFFRAIASQKTEFEELHANADPVKSFFGGSQVEIFRSLAHKYRDYSRNIQFLSDEIKADIEEVYRILNLEEPYSQIRQLPILEKKIDASIKEALFAQKEKVRESLDTVTKELEDDLSDEKYSDDFKESVLRLFNVIKMTTENAEDCIFVQSQLPIIDSLRVDAYRLRDAENLRIREEQQKLASEKIIDTPEKPDDQPDSPQVTSRNTEVISDITFFKSGKILENELDIEEYVTQLKGKLMKMVREENIKI

SEQ ID NO: 686 - protein, 1212 aa, Methanosarcina mazei
MTATEIKIEDLFEKDIRRDINGVIKVDQEDERSVYTELDEYVVTGESRKHFDTFFRNYAAALEEPTDRIGVWISGFFGSGKSHFLKILSYLLANREVHGKTALEFFREKITDPAIFANIEKAVTTGAKDVILFNIDSKANTANKGDEQIVNIFMRAFNDMRGYLGDVFWIADLEEDLEEKGLYEAFKTQFELINGDPWEERRVTYSFEQDDIIEALENCGHMSKEAATRLFENDGAGYTFSVEKFANKLDKYCKSKGKDHQIIFLVDEVGQYIGENSELMLNLQTIVEELGTKLRGKAWVAVTSQADIDTVTKEHVKSYDFSKIQGRFNTRLGLTSANVDEVIKKRILHKKEEYRDVLASYYAEKQTILRNLLAFSNRAEIKVYKNEDDFVNVYPFVPYQFNLVQKVFDRIRETGFTGKHLAKGERSMLSAFKESTENYCENNVGMLIPFHAFYETIEGFLDPIIARTISHARKNDFLNDKDCELLEILFMIRSIPEIEPNLDNLIVLSISSVDENKLKLKERIVESLRKLEDQNLINKSEDKYYFLTNEEQEINKDIKRVEIEEHQILEEIHTMLYEQKQGICPASHKDYKFNRAIDNREKTVTGADLTIKFLTPLSDQYNSKKGNQQSLSGENLSNIDSTDTLLFILPEDELIDQIRSYLKIEKYLKQNSSNRNNVEIQNILSTKQQNANSARAKALELVQKGVSDSRVFVDNKEVIPEKSSPKERIKEGLDLLIQNVYNKAGYVTKDYENDSEVLRVLRSDDLEKFGVEGSDINRLALKEMLDYIQLKSGRSGRVLLSDLKERFTKKPYGWKEMTISGLVAILYLREEIKLRYQSEYMFNDANATAKHLTRRDEADKLVIEIREKTGEEDLRAVKNILNDLFEKLSLPEKEGELYETAEKIFREELSALQVIEGRYEEEGSFPGRARIEAYRKFLKELTENSDPSSFFRAAALRKTEFEELHADAEPVKNFFNGSQVEIFRRLAHKYRDYSRNIQFLSKETRADIEEVNRILNMEEPYSQIRQLPVLKKRIEVAIQDALSARKKEIRDNLDAVTKELERELSDEIFSDDFKETVLRLFNVIERTIEDAEDCALVQSQVQIINSQRVEAYRQMDRERQTIREEQKKNEYKTRPEALDNPGTPATKSVDHDTGAETKIVPPAAPQRNTEVISNIAFFRCGKMLETEEDVEEYITQLREKLMGILKEKNIRV

SEQ ID NO: 687 - protein, 1166 aa, Methanospirillum hungatei
MKTSKRDMILNKDVFQNDPTAYEIPNDGYTKVAPITTEQEWEVARWELQHFVCEGSYYTGLKKILDSFLDHLDQPKQPAVWVSGFFGSGKSHLVRILDFLWADITFSDGATARTLARLPDDIQDSLKRLDTETRRAGGIWSAAGTLSGGDSHDPREAVLQVILRAAGYPDHDLQLARIHLWLAQQGILDTIRSDLKSMGKEDDLQYCLISPAFAQVALKYLPDLGATPQDLFTRLDRQFPEETNMTTDLMVSLIDEILKTKIQNKKKPGLVLIVLDEVQQYLAVEQDSTKLVLFQEIVEALTSKFESRCLLVATGQEALHANPYLQKLMGKFSLYVPLESKDVDTVLRQTILRKKESEKPKLSALLESVHGEITRQIEGSKIAHSQDDNESLVPDYPLLPSRKRLWDHILRSIDRGGLSTQLRNQLRLTFSGIKTYAESPLGYVIPVDYIYSQQRPYLINNGILPQETDEMIRGEDDSSSSGQLKSRICALLFLIQQVDTSLGVRATPETITDLLLSGLEYEGVDLRREVPLLIDDLKDRGIISDAGDGTLRIQTREGKRWDQEYRKNLNAWKDDINRISFDRDQALMKSVQALLKQISYKDGDTKTVREIDARIFTEDKPPVSKKIPVWVRNGWGSSEEEVRKTSLEEGPESPLIQIFLPKHHHQDLIDHIAGSIAAQQTMDSIGVPNTNEGIQAKKNIETKKVAHDTKVQAYLDDIISQAVVYLGGGDKKEGGSPKEVLLNAVKIASEKKFYRFKDADNPRWADVFTRIKSGHANPLSVIGHSGNTEEHNVCKEILRFLNANSKKGSEIVKYYEDAPFGWPKDAIEGAIIALCASGHLHATNDSHKTVSLSDLDNRRTLEKSFFTCESESPPTAEEKLKAKAVYQKVGIQAKAGSEGEDASLCIEKLRELLEKTGGDPPLPEVMIPSYLAEMDGLSGVSLLKRIAAQKDIIISDIEKWKSIVDVIAVRQQEWSRLCKLLDHGEGLSGLDVIIHEAAAIKEHRSLLSDPDPVTDLLFKVQERLREEISHGISQVSEAYQNLISSLEGDPNWHELESHEQEKILSSHHIREIPQMPLGTDEEIIHALKRYPLSDYQKALELINLSRGPIVSDAAHLYAAKHKKVLTSVSLKRGVKITNEEELEIYIDDIRKRVNELLQQKQEVLIQ

SEQ ID NO: 688 - protein, 1178 aa, Methanospirillum hungatei
MEPKIQDLFINDITREINGVIKVDQEDDQNVFTELDEYVVTKESLKYIDTFFQRYASALDSPTDKTGVWISGDFGSGKSHFLKILSYLLENRKVFGKSALEFFQSKISDSDILTTIEKSVRTGTKDVILFNIDSKSGETGERIVDILMRVFNEKRGYFPDVFWIAELEERLEEKGLYQKFKDAIAEISGEPWEEVRTRYSFEQDVIIEALDRCLFQSKESSERMFESDGQNYILTPEKFAQKVKTYCEARGRDHQVVFLIDEIGQYIGDNSQLMLNLQTVAEELGTILKGKAWIIVTSQADIETALKAMKGKEVKQDFSKIQARFDTRVSLSSANVDEVIKKRILKKKEEYTEMLSLFYEEKKTILKNLISFSGGAEMKNYRDGDDFTSVYPFVPYQFIVLQKVFEKIRTTGFTGKHLAKGERSMLNAYKEAAERYGSSDLGTLVPFYSFYDTIESFLDPIIKRTITQAGDNEHLEEFDCLLLKTLFMIRHVQELPKNLDNIIVLSLSSVDEDKLQLRERVIASLNRLERETLISKSGDNFYFLTNEEQEINREIKQIDIDRHLIVQEIFDQVFTSNSICQKSYGEYKFNKSVDDKVSSSSDADLTIRFLTPLADEYVRGSGQQSLGGENLSNIDSKDTLLFIFPEESGFVGQIQGYLQIEKFLKQTRSNRNDELMKKYLIEKQQEAASLKESSISAIHEGVKDARVFVDGIEVSLSSGSPKELVRDGFERLIKAVYHKSHYVNQEFASDSDVLRVLKSADLTQFGVSTSEVNHLALQEMHDYISVKDEKKVPVVMSELISHFSRKPYGWKVMTISGLLAMLYKGDDIRLRYQRAYLAHNPEDIARYITRKENFDKIVIELKKKTSAEIIQNVKALLRDVYDISALPEKEQEISDLIRSTLDEKKGELAADLARYSEEPRYPGRKRIEPYLTMIKEILSISDPTAFLEKLSEDKDTLADMAHEAGVAVQFFEGNQKDIFKRVLDKIDGYHRNSQFLDDSAQESLQELDRIIKADNPYSDIKKLPQLESVIEGSLAVSRERLQEELKNSADQFKQKIDRKFSYSDEYKESIAPLVRETFDGSVSRALNSNDCSHLKLAASNLSNLYIRACKTTEEKIKKIIENEPDINPVPVRSNHVINSTDFFRTNTVIENEEDLERYLAGIRVKLREILKDKNIEVI

SEQ ID NO: 689 - protein, 1176 aa, Microlunatus phosphovorus
MTVMQLTEIFAKDVQRPIEGVIKADDVAHLGTEVDEYVLTNEAAKGLELLLESYTNYTNANGVWISGFFGSGKSHLLKMLAHLLGEVEGDDFPRERVSESFRAKATDAFLPPLLNKADRIPAKSLLFNIDQKATLISKDQTDALLRVFVKVFDESRGYYGDQGHIARFERQLDDEGQLDAFKQAFRAVSGRDWMERRPSFGLPTVRRQVNAAYAQITGIDSATAGDILKTYQDTYAVSIEDFADEVRVWLDQQPAGYRLNFFVDEVGQFIGSNTHLMLNLQTIAESLNTKCGGRAWVFVTSQEDMDKVVGDRTKQQGNDFSKIQARFKTRVKLTSADVEEVIRKRLLEKNDKGTQVLEAVYAQESANFKTLFDFVDGGKTYRNFTDETKFIGTYPFVTYQFPLFQAAIEGISDHNVFEGRNSSVGERSMLGVVQQVAKDIGDVEIGSLATFDAMFSGIRASLKSAAQRSIDRAERDLPDSGSPVTKLAVRLLKALFLVKYVENFQATPRNLTVLVYDRFGLDLPALSKQVQEALTLLETQTYVQRNGNVYEYLTNEEQVIEEEIKNVEIDSSEVSTRLNRILSGDVVKTSKLRYTKNGQDFPFGYKLDDQAFGQQRELSLHFITPEYPYGPEEIRMHSAGKDELRVILAPDDRVLADLRLLIKTEKYTKRKQTSSLSPVEEQILRAKATHNAQREKELVERIRRAVGRADLVINAADLAPGSQDALIRITDGFQDLISRTYTQLSLLGGRTYTEQQVAGFANPDQSTLLDGSSIHALAAPSDEVLSYLLQRDRLREQVTVKKIVDHFQAKPYGWDLASIECVSAWLVGTSKITLTVDSNILKRSEVATTLCKTPKHSHAVVAPQKTFDPRKVTVLRAFSTDFFDEPTAPKDPLELARHASERLRAKCEELKARVSGSKYPFVTQLEGPIALLESVVGKPDDWYLTDFATADDLLDAKTDVIDPIQIFLGGAQRQIFDEAADLLAANASNLNYLPSGSSQEVSRLLADPQAFRGNRMTKLKAAAVELQSSIDDALVANRDGALLEIDSRWAPLQTSTIYLKATDEAQHSVTRKVNTILDRIGRERQIAVVREIANTFEERTYPAMLDQLAVSHRSSDADGSGEPDPAPIKKQTVSVKSISPTGIHGVLESEEDVDRYLDALRKALVRALNDNKRIAL

SEQ ID NO: 690 - protein, 1148 aa, Moorella thermoacetica
MKNRDIFQRDPVVSKLLNDGVATVTEAATSKEIETLRYELEHFVCEGQYKDGLIRILESYLSNADATSQPAVWVSGFFGSGKSHLLKMLRHLWVNTKFESDGATARELARLPVEVKDLLKELDILGKRCGGLHAAGGTLPSGGRKSLRLAVLSIIFRSKGLPESLPQAQFCLWLQKNGIYTRVKKVVEDSGKVFQQELRHLYASPVLARALLEADPDFASDLKQVRATIQAQFPDVDDVSTSEFIQIICDVLSVNRQLPCTAIVLDEVQLFIGDSTARSYEVQEVAEALCKQLDSRILLIGAGQTALSGNLPLLQRLKDRFTIPVELSDTDVETVTRRVVLAKRADKRKAIEEILTAYAGEIDRQLAGTRIAPRSEDRAIIVEDYPLLPVRRRFWEHVLRAVDIPGTSSQLRTQLRIVHDAVREIAEKPLGTVVPADFIFDQLQPDLLRTGVLLREIDETIRNLDDGTPEGLLARRICALVFLIRKLPREAVVDIGIRATAETLADLLVSDLAGDGPALRREIPRVLEKLVKEGKLIKVDEEYSLQTRESSEWDREFRNRQTRLNNDLAALASKRSALLNSACMTALGNIKLIQGKDKVPRKLAIHFGSEPPETKGHEIPVWVRDGWGENENTVVADARAAGNDSPIIFVYIPKANAEDLQRTIIEYEAAKATLEFKGTPTNPEGQEARDAMSTRMKTAEATRDEIIKEVINAARVFQGGGQERFEHSMKEKVEAAAEASLDRLFPHFRDGDDDQWPAVINRAKSGDEAALQAIGWNDAPEKHPVCAAILAEIGSGKTGKEIRDIFMKTPYGWGQDAVDAALITLFATGHLRAVYKGVQLDRGQLDQAKIPATDFRVETVTIDVHSRMKLRKLFQTAGFNCKAGEESSVAGQFLAKLMDLADRAGGDPPMPERPSKTHLETMRGLAGNEQLAAILEQFDTLAQQLQNWSALADLAAKRRPAWDRLQILLRHAHGLPEAEDLQSQAHAVRDERRLLAEPDPVPDIYQAVARVLRTAVRQAYANFEMVYNREKAALEANANWQKLSPEQQQKILTAEGIASVPRLSIEDDDALLQSLQETPLSGWKTRTDALPQQFSNAAMAAAKLLEPKTQKVKLTSSTLRTKDEVRAWVAGVERELLERIKNGPVVIS

SEQ ID NO: 691 - protein, 1171 aa, Parvularcula bermudensis
MAVMLRDIFLKPVDRPIDGVIKADDEASLRTELEEYVITGEIAQRVGHFLDAYNNYDTANGVWISGFFGSGKSHLLKMLALLLENRVVENIPAFDIFVEQLREDPMLAGALRKAVSIPSRSILFNIDQKADVISKADVDALLSVFQKVFDEMCGYYGKQPHIAQFERDLDSRGVFDAFKSAFEKHSGRSWERGREQALLEAPNIAVAFADATGGSAEAAKDILSQYRKDTRVSIEDFANSVKTWIDKQGPGFRLNFFVDEVGQYIADNVKLMTNLQTIAESLNTKCKGQAWIIVTAQQAITEVVGDMSVQQEHDFSKIQARFRNRMPLNSADVAEVIQRRLLAKSEDAQVRLGTLFAREENNLKTLFEFSDGSFRFKPFSGREHFIASYPFPSYQYDLFQRAITGLSQHNAFEGKHSSVGERSMLGVFQEVAKSLAKHELGDLATFDLMFEGIRTALKSAVQQSIQIAERNLDDPFAVRVLKALFLVKYVKEFKPTVRNVSILMLPEFEADQTELRRKVEEALALLERNTLIQRNGELYEFLTNEEKDVEAEIKSLDVDPTELTKELETLAFDGVIKHRKIRHLATNNEYSFSRKLDDHLLGREYELSINIVSPFGDDIESPEAVRMRSLSREELSVLLKPDVRFIRDLTLYKQTDKFIRQARGGTSQPSRDRIIAEKGEQNARRLRDLELRLRKHFSDARFFVRGDEIDVGGEDAQERVVKAFQTLVDKVYVNLPMLRGVSYTEADIAKAASPDSALLGDDDGGGMSEAELEVLNYVQSQARNGIKVSVKYLVERFAEKPYGWPATATLCLAAGLSGKGKIEARSDGTVLERDDLAKALRNSHMLANILLTPQAEYTAAQLRQAKDLYRELFGKPAEGADARRLGAEWAEAVRELSNELDRLINRQHDYPFLTALTPLAAKVDAMRDKPAGWYVTEPAKQEDDLLNAKEDILDKVRSFMSGAQKDIYDEARAFLRDQEGNLGYADPASVTEIREVLDAPDCYKGAAIQSLKTDLYQLKEAVELQRLDERKSASAAIEDCRSKIEALEDYASLSDGQRQTISARIERMAARIDNTPLIPVLRDLGASVRKTLLPELLSEIDRMRAPKGMGEKPATDWEGPNSNANPMIDVTQVKITFAKPYLTDESDVDAYIDTMRERLLAEIRSGKKVIV

SEQ ID NO: 692 - protein, 1213 aa, Pectobacterium carotovorum
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERNAYSFFEDKIKDALFLADINKAVHHPTEVILFNIDSRANVDDKEDAILKVFLKVFNERVGYCADFPHIAHLERELAKRGQYDAFKTAFSTITGSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKADAAKPALAKVWQEKGDILRNQLAFDPTTTASLRPYTSEEEFIDNYPFVPWHYQILQKVFESIRTKGAAGKQLAMGERSQLEAFQTAAQQIAPQGLDSLVPFWRFYAAIESFLEPAVSRTITQACQNGILDEFDGNLLKTLFLIRYVDVLKSTLDNLVTLSIDKIDADKVELRHRVEKSLNTLERLMLIARVEDKYVFLTNEEKEIENEIRNVEVDFSAINKKLASIIFDDILKNRKYRYPANKQDFDISRFLNGHPLDGAMLNDLVVKILTPKDPTYDFYDNDAACRPYTSEGDGCILIRLPADARTWTDIDLVVQTEKFLRDNAGQRPEQASLLSEKARENSVREKMLRVQLESLLAEADIWAIGERLPKKSSTPSSIVDEACRYVIENTFGKLKNLRTFNGDISREIHALLTVENDTELDLGELEESNPEAMREVETWVSMNIEFNKPVYLRDLLNHFARRPYGWPEEEVKLLVARLARKGKFSFSQQNNNIERKQVWELFNNSRRHSELRLHKIRRHDESQIRKAAQTMAEIAQQPFSEREEPALVEHIRQVFNDWKQELNVFRAKAEGGNNPGKNEIESGLRLLNSILSEKEEFALIEKVTTQANELLDFSEDREDLVDFYRKQFSTWQKLGAALNGSFKSNRSALEKDAVAVKALGELENIWQMPEPYKHLNRITPLIEQVQNVNHQLVEQHRQHALERIDARIEESRQRLQEAHATSELQNSVLLPMQKARKRAEVSQSIPEILAEQQETKALQTDAEKKINQWIDELRKKQEAQLRAANEATRAAESQQTYVVVEKPVIQPVPKKTHLVNVASEMRKATGGEVLETAEQVEKALDRLRSALLAAIEAGDRIRLQ

SEQ ID NO: 693 - protein, 1192 aa, Pelobacter propionicus
MHIKNIFAKNLFRPINGVVKADQQDESVVWQELDEYVVTRELDKHFVKFFDAYLSAMDNPNDPAVAARMAVWVSGFFGSGKSHFLKILSYLLGNYQAHNSETNQNRKAVEFFEEKIADAMLQGDIKRAVASDTDVILFNIDSKADNKDGKDAILSVFLRVFNEKLGYSGDDPHIASMERYLQSKGALEKFHQAFKEASGTDWIKERDAYSFSRDEIIKALSIALEMGIESASIWFDEAEERFKINIEGFSKLVKEYLDSKGPKHRIVFLADEVGQFIGSETHLMLNLQTITEDLGRICNGRAWVIVTSQEDIDAILGEVRGSKANDFSKIQGRFYTRLSLSSTNTDEVIQARLLEKTGDARRALEELWHQKGDILKNQISFTHSATLKNYSDAKTFEENYPFAPYHFQLVQKIFESIRKAGATGMHLSRGERSMLDAFQSAAKSVSEQEIGTLVPLYEFYPAIESFLDTIVKKTIEQADDNTGLEPFDTKLLRVLFLIRYVDILKPTVDNLVTLCIDKVDADRLTIKRQIEESLQRLEKETLITSNGDLYFFLTNEERDVSREIKNVDIASSEQTKQLAELIFEEVYKGDNKFRYQVNKRDYGYNRICDGQFFGSNAGHDLTIEVITPLNDDYQAFNPAKCIMQSASTNGGSVVIKLEDSKELGRELRTLLQTDKYIRLKNDAAAPDNLKRILKDRAEQNRERKGRLIALLDTMLLESDYYAYGQTLQIKASTARNAVTEGINYLVENIFSKLGYLKIIKEEPLKEITAILKSNDIGQYSLQVEGGDANELAVKEVKQFIYLSTTNNQKVLLHELVERFARRPYGWGEWEIILLVARLFMAGDLNLMSDGAALTPKEAVDPLTKQVKWKQVTVLKRKAVGEEELKKARAIGKDIFHVIGPDSEDQLNQFLRENITAWQDSLNSFKPLAQSGRYPGSSEITNGLKLIQKLLNIHDSFEFFDAFNKAKDDLLDLSDDMQELNGFYTTQKPTWDKLQSSMDGVFKANRQELVKDADAKKSLLRMDEILKAPRPYGMIKDVDGLINAVSAVNAKCVDKERVILLSKLEEKISLVAENLEAYKATADVRNHSLKPLQDIKKQVQEEQSIPNMHYQLNKADDAVDSAMEEMEKAVEQPPKPGGGGPISPPAKPVKNVTAASCSSKSFLETEADVNEYLEALKKELMAAVQNSMRVRIK

SEQ ID NO: 694 - protein, 1211 aa, Pelodictyon phaeoclathratiforme
MPKIKELLSLNLDIDIKNVIDLEEQVEEEIRYEIDNYIITENIGRHLSTFASKYNSSIKETGVWLSGFYGSGKSYFGKMLGYLLDNRVIMGTQAIERIIPRLSGLNDAALIENDLRKFASSNNRVISLDIAKQNTDKGLTFTLFRNFLKSLGFLDSVYGYIEYQLFLDGHYPAFVEKVKLLTGEEWQSIRASSMRVPSTIRKVLTAWKYTEQEYDETVIHLNSIIDSFSASKLKDELSRYLEKQQGETIVFIFDEASEAISQKKFTLLDLEGLSESLSAIASRVWTIAIAQEKLDDVINNNSISKSQLTKVTDRFKTKIHLESTEVDVIIRSRLLQKSDEGQQLLNTFFDQNAGKIADITNLKASIPTKSENRELFTIYYPFHHYQFQLLQNFLFASNALTASQVAARGMIITTFDVLRNKLGKLNAYNFATAFDICDEAQTAPTAALVNKYDLARQMLKESAIDGIRLLKAIHFLSVSELVATTAENITKVYISTVDDYYSVKPLIEEALTTLTTAKVLLESNNSFKITSDLETKLLDEMKDFTVEHFKRKNELVARLQKNSSIRSIGTISDKSVTYNFHVTTDLGDELMGSSNKDLQIEVCSLYSITENRLDFMESIKQQTRDIKHKITLLPDNAQFSTISHLIEEILRFAYMDDKYKNDSDATIKQIIRSFSVIRDEREKDLLNLINSAYTNAKAIYLFNTVQLSEASFKSEINTLQKKVLDNVFYKRPSRQLSEALATSIIKERQNDKLPKFNFSENGGNDFTFFDSNGNFVGDTLECIESVTAKIKSQYLSGKDLELELKSAPTGYEYGTVATLVAVLFRTGRLTARFNAKDIFSYRDDVVESIFSSSRNFQKASFKSLSKSLTTAQKSDMVTLLRALKIEEVTKERVDWNSNDFALIEAIRALSEYYINAVRTLKKTVTDFEPLFGSETTLIGKLHQFSGKVTEGNFLDTADNFLLNQAVFEATVKKIEKIEKFIKSNLQKARFIKRFVDELKIELEKANVTSREIQETITRFDEIYSSSVVEGYREILVEGQKLKDFYHTLMVDANTTASDANRELLAVATALITEINSYPETQNRDLLRQVQFVKEYAEKRINQEVKLDYTIKCASSHFSLSEMITCTALAPQKLAELEVAAMSIVKEAPPAPVPVEESNSGEVIPIPPPKALKRISLKIARTTTVGAFKQMLQLQLQQVAGMQESDQIEIDL

SEQ ID NO: 695 - protein, 1216 aa, Photorhabdus asymbiotica
MMNIEQIFTKPLTRNINGVVKAEQIDNESAYIELDEYVITRELDRHFRAFFAAYLPAVGPERGCVKNNIGVWVSGFFGSGKSHFIKILSYLLANRQVIHNGDRRSALSFFEDKVEDALLLADIRKAVQYPAEVLLFNIDSRANADDREDAILKVFLKVFNERVGYCADFPHIAHLERELDRRGQYQAFKDAFAAISGSSWETERDAYDFFRDEMAQALSIASGQSEESSRQWAEQFDANFPLDITNFCKWVEEYLDSRENGNILFMVDEVGQFIGKNTQMMLKLQTITENLGTICSGRAWVIVTSQADIDAAIGGIEHRDGLDFSKIQGRFTTRLQLSSSNTCEVIQKRLLTKTESAVEALRTIFAQKGDILRNQLGFDATTKATLKPYTQSAEFVDNYPFVPWHFQLVQKVFESIRTKGATGKHLAMGERSLLAAFQSAAQQVQSDDLNTLIPFWRFYEPIEGFLEPAVKRTIEQAEGLGLHEQDIQLLKTLFLIRYVNLLKSTLDNLVTLTIDRIDTDKITLRRQLENSLQCLENQRLIARSGDEYLFLTNEEKEIENEIRNVEVEYTTINRRLSNLIFDDLLKNRKYRYPVNKQDFPISRFCNGHPLDGANLEDLVVKILTPLDTCYNHYRDDITCIPYSAEGNGCILIRLADELLVWKDLQIMVQTDSFLNKQCGQRPEQDVLLKEKDRENQSREKTLRVRIEQLLAEATVYAIGVRLPKKSASPTAIVDEACRYVIENSFAKLKLLRPTSRDINREIHSLLTIEDSAQINLDMCSEECNPEAMREVEAWISMSVDYHKPVYLRDVLNHFGRRPFGWPEDEVKLLVARLARSGKINFTLQNNQISLKQAWDVFSNTRRHSELRLLKVRQHDEEQLRKAAHIMNKVAQESFNEREEQGLAKHIRTTLESWEREYVGYQITAQTGQFPGEKAVQEGLQLIKSLLAQKEAFSLVEKVIDESNALEDFAETRDDLSDFYGNQLQSWQQLAMVLNGSFKANRSALEKDENAHQALTKLCHIYQMAKPYSQLCCIVPLIEQVQEVNQRLLTEAREYGLQRIDTRIEEVKKQMQQSQIPDSLLNRALYPMQQSRERVVNTQSIPEIYHEQSEVQLQQGQAEQLMNGWIDEQLKKRQMIEKSVSNDGQRSPVTSIPVSDPPTVQPIPVLKKTLAIHATREMKKAVDGDVLETIEQMEKALEQLRKTLFDALKAGDRVRLQ

SEQ ID NO: 696 - protein, 1202 aa, Polaromonas sp.
MKIRDLFLKPIDRPINGVIKADQMDAASVWQELEEYVVTKQISDYLRRFFDAYLAAIDRPHDAAITDRMGVWVSGFFGSGKSHFIKILSYLLENMEATNPQTGEKRLASQFFDHQKIKDAMLLADIQRAVQGTADVILFNIDAKADSKSDRDAILQVFLRVFNEKLGYSGDSPHIADMERHLVAKGAYDAFKAAFAASNGSTWEQERDAVDFLRDDVVAALGQVLKMTPESASQWFDRARDDFRINIEGFAKVVNDYLATRAAKHKVIFLVDEVGQFIGANAQLMLSLQTITEQLGTQCKGRAWVIVTSQEDIDAAIGEANKARSQDFSKIQGRFHTRLSLASSNTDEVIGERLLAKTEAAHVLLRDDFAGRSDVINNQLGFAGNSVSLRGYKDTAEFVACYPFAPYQFTLLQKIFESIRKVGATGKHLSRGERSLLDAFQSAATRNADHSTDVLVPLYDFYPSIESFIDGVAKRSIDEAPLNPALQPYDSLLLKAMFLIRYIPDIVKPNIDNLATLCIDQIDADKLALKRKIQESLARLEQQRLVSRNGDLWFFLTNEERDVAREIGHVDVSASEKSRLLAELIFEEILGNQAKVRHQGTKADYEFNRLLDGAPWRQASHALSFEVLTPLGDEYDKLQPAKCILRSSEGAGRAIVRLAEGERLDIELALYLQIEKYIVSPKADHATPSLKRILADRKDENRERRMRLVHQLSDLMTTGDFYALGQPVEFKAGSPATVLEALLNYLITNTYSKLPYLKVRQADPIAEIKAVLSADDLGQHALGLDGDAGNALAIKEMRDYLQLAASQNRVLLSDVVDRFAGIPWGWKPEWETVLLIARLFMAGEIKLMLEGSDLDPQSAAEPLTKSVRFKQVSILKRKTADAGAIRRARELYKDLFSKLGREEEDSLVADFRDQFTEWQADLKSYAHTAATPHHPGRADIDTALTRISQQLAVRDSFAFVEALLDAKEVWLDTADDIHDLVHFYKTQITAWRKLLDGLRAFADNREALDKVPQAAAALAELTQIRDNPKPYGQINRIEPLVAAVTAVNEQLAQARREKALLSIDAKIAEVQAKLDAVGATPELSNKALRPLQDLKTRIASQTSIAQILYLQGQGGDAMDDAIALIEEAMAKLSAATGGTAKPVQAVQPNVAPPVAKPTRVVRAAELSSKTYLETEADVDAFVVKLRAELLAAIHSGQMARVQ

SEQ ID NO: 697 - protein, 1213 aa, Pseudomonas brassicacearum
MTIKKLFDPSKSINRSIEKVITYGVSQEARLKSEISEYVVTDSIDQQFENLLLKMEAAMDIGGENEVGVWVSGFYGSGKSSFTKYLGLAFDDRITIDGVPFIQHLQDRLKRQQTKSLLSNVAKRFPAAVLMLDLASEQVAGATMEEVSTVLFYKVLQWAGYSRNLKVAALERRLKKEGRYNEFLDAFKEAAGGEDWNNYRNDELVVDSLIPEIAHKLYPTLFKTSSSFTTESSEIVVFENDRVREMLEIAREASGKEYIIFIIDEVGQYVGPRPNLILNLDGLAKNLKNIGDGKVWIVGTAQQTLTADDAKAALNSPELFKLNDRFPIQIALESNDIKEICYTRLLGKSSPAEAELGGLFDQYGQQLRQNTKLVDARVYGVDFDRKTFVNLYPFLPAHFDILLHLLGALAKSTGGIGLRSAIKVVQDILIDGSEGKPAVAEQAVGWLATTVTLFDALDKDIKRAFASLHASVEKVTKIRFPHSELHQNIAKTVAVLQILGNLPITRQNVTSLMHASIAGASQGDAVAKAVEDLINDPIVPFGEQDGNLCFFSEKLNDIEQERSQVALRGVELRRIVNEALTSVYAPLPSTQLHGSYAVSTGLKAQSAGNVPASLAGERNQIQTIVELVDPKEIDSTRTRVTDESRHNSSKFNIYLVGRTTPEMDELTADIHRCREIANRYRSDPDQEIREYCNGQADRAEHLSTKLRAQIQRSLLQGSFIFRGQVVAVDTLAAELLDAARKHLSEVAEQVFDRYVEAPVRAGTELAEKFLRVGNLSGITSALDPLNLVQTQGGRHSIRTDHLAMVSIRDYIDRNGTVDGKRLTDAFADAPFGWSADTLRYLVAAMLLAGEIKLKVAGREVTVNGQQAIDAIKTNNTFKIIGISLRGGDRPTNEVLARAATRLTELTGDTVVPLEDDISKVTTKLFPQLQHQYGPLTEKLRSLNLPGVNRLQNLTHEINDVLLTDASDAPRRLGNEQSELFENLKWAAEVKLKLEQGLEQTLRDLRQHCSAIANLPNVALLATLKEELAEALSLIDERLQQADFYRFAADFSTSLTTIRARIRDTVIAMQDLLKTRIKEAEVDLKRVPEWIKLTQQEQTELLGSLERLIVEVTPDLLGLNSITNKLSELQDEVQGLKHSIERLGTKRIKEELEAEIPVPSAVNEPKPAIARSIKARTKITTMDDLDALITQLQQLRGELKYAHAFAVNLELQDE

SEQ ID NO: 698 - protein, 1188 aa, Pseudomonas stutzeri
MTLKTIFHKPVDRPIEGVIKADDEASLRLEIEEYVLTNEVEKRLESFLDAYNNYEGANGVWVSGFFGSGKSHLLKMLALLLENRQIDGASALDLFLPKCGDNEILRGDLKRAVAIPSKSILFNIDQKADVISKTQLDALLAVFVKVFDEMCGYYGKQGHIAQFERDLDSRGLYEQFKSAYESAAGRTWQKGREQALLEAKNIAKAYAQATGGDEASAMGILDKYRSQYRVSIEDFAEQVHAYIERQSPDFRLNFFVDEVGQYIAENVKLMTNLQTIAESMATKCRGRAWVIVTAQEDMGTVVGEMGKQQGNDFSKIQARFANRMKLTSADVAEVIQKRLLMKTEEGVRLLSDTYHAQSNNFKTLFDFADGSQTYRNYQDRDHFIHSYPFIPYQFALFQSAIQNLSQHNAFEGKHSSVGERSMLGVFQQVAIQIGDHEIGQLATFDLMFEGIRTALKSNIQRAIIQAENHLDGPFAIRLLKTLFLVKYVKEFKPTVRNLCVLMLDGFNQDLPALRKRVEEALSLLEQQTYVQRNGELYEYLTDEEKDVEQEIKNTEVESADVAAELEKIVFDHVIKHRKIRYDASSSKDQGQDYPFSRKLDDRLHGREHELAIHVISPFHEHAENEPMLRTSSTYKSDELFLILPADERLIRDILMYKRTEKYIRQNISITQQEAVKRILTDKGFQNRERYAELQQRVQSLMSKAKLFVAGADIEIGSEDAQTRVLRGFHELISRAYPNLRMLRGISYKEEMIKTILSNKDGTLFGSGATSLAESEQELLAFIQSNNRGGVRTTLKNLLEKFERKPYGWYYAAVLCTLANLCARGKVEVRTDGNLLEEDELERALRNSHGHGNVVLEPQVEFSASQVRTLKEFFEDFFDAPPGAGEAKALGKETGTALQELTHQLTPLSAQASQYPFLNALTPVLEKLKELTGKPYTWYLTELTRQEDALLDMKESVIDPVRKFMSGPQKGIFDNARKFVQTQEPNFAYIEGDESAQVVASLTDPECFKGNRMQQVKMQVETLQEKVTAQIEAEIAKAKETVAALKDRLCGMTEFGALNGEQQEQITRPFNEFNAAIERQKLIAVIRDTLRRFEESDYQRLLSQMTSWAQPAPTPEPAPKPGQTATPDEGTKPTSPAKPEPRIEYVPSRSVKVSFDKAWLADETDVERYLESMREALLDEIRKGKRIQI

SEQ ID NO: 699 - protein, 1201 aa, Psychrobacter cryohalolentis
MTALKTIFQKPVNRPIEGVIKADDEASLRLELEEYVLTDEVENRLISFFDAYNDYQVANGVWLSGFFGSGKSHLLKMLALLLENRQIDSTSALELFLPKCGDNDVLSSGIKNAVAIPSKSILFNIDQKADVISKTQVDALLAVFVKVFDEMCGYYGKQGHIAQFERDLDSRKLYGSFKEAYESIANKPWEKGREQAILEAKNIAQAYSQVTGEDQALAIGILDKYRSQYHVSIEDFASQVDDYIERQIKEHGYTEFRLNFFVDEVGQYIAENVKLMTNLQTIAESLATKSRGRSWIIVTAQEDMGTVVGEMGKQQSNDFSKIQARFANRMKLTSANVAEVIQKRLLVKTDEGAQLLSGIYDNQSNNFKTLFDFADGSQTYRNFKDKEHFINSYPFIPYQFSLFQSAIADLSLHNAFEGKHSSVGERSMLGVFQQVAIKVGDHDIGQLATFDLMFEGIRTALKSNIQRAVINAETHLDNKFAVQVLKALFLVKYVDGFKSTIRNICVLMLSSFGEDVAILRQRVEEALNLLEDETYVQRTGDMYEYLTDEEKDIEEEIKNTEVEAADVASELESIIFDQVIKSRKIRYSSGASGSQGQDYSFSRKLDDKLYGREYEIGINVISPFYEHAENEEMMSNKSNFSSDELFVILPADSRLMSDITMYKRTEKYVRQNYSIAQQETVKRILGEKGQQNTKRQAELLQRIKSLMSQAKLLVAGTELNVSSEDAQLRIEKGFNELVSRSYPHLRMLRDASYTEADVAKILDSTQQDMLGADISTLAEPERDVLSFIQRNASAAIRTTVKGLLEQFEKKPYGWSYAAVLSTLAKLCVNGKVEVRMDGNILEDSELARALVNSQRQSNLVLEPQVEFSSSQVRHLKEFYEDFFAKPASNNEAKALGNETIDAFKEMLQDLEGWYAQSARYPFLSALDPAIQQIKKLSKSSYAWFLTDLNEDIEDELLKIKEQLIDPIYNFMNGSQREIYDNTQNFLKDQSANFDYIEREQVRVLEASLNDTSIYKGSKIQQVKVLLGSLKDKVNDALQEARSQSIEALKQMQSRMQEMDEYKKLPDIRQAELDAPYTQLIDKVNEEKLIAVINDRLRYFEDKGYATLLQKMVVMATPKPPPTPAKVSTNNGDKSDKDQSQVSALSEPKQVSEPKNEYINSNKIRVDYDRAWIENETDVERYLEAMSEALLSEIRKGKRIYI

SEQ ID NO: 700 - protein, 1168 aa, Rhodococcus erythropolis
MKLNEIFAKDVQRPIEGVIKADDTAHLGIEVDEYVLTNEAAKGLELLLEAYTNYTNANGVWISGFFGSGKSHLLKMLAHLLGDVEGQDFSREQVAASFRSKAEGGFLPGSLTKAERIPAKSLLFNIDQKATVISKDQSDALLKVFVKVFDESRGYYGNQGHVARFERDLDNRGQYESFKSTYARIAGRDWLQGREEGVLEEINVAKAYAEISGQSEGTPSNILTKYRNEYSVSIENFADEIKTWLDRQEPGFRLNFYVDEVGQFIGSNTHLMLNLQTIAESLNTKCQGRAWVFVTSQEDMDKIVGDRTKQQGNDFSKIQARFATRVKLTSADVEEVIRKRLLEKNEVGESALQAIYAAESANFKTLFDFVDGAKTYRNYTDEMHFVGTYPFVSYQFPLFQAAIEGISDHNVFEGRNSSVGERSMLGVVQQVAKDIGNVEVGRLATFDHMFAGIRASLKSSAQRAIDRSQRDLPDPESDITKLAVRLLKAMFLVKYVEGFHATPRNLTVLVYDRFGLDLPVLSKQVQEALTLLETQTYVQRNGNVYSYLTNEEQVIEEEIKNVDIDASEVSGRLSKILSGDVIRTYKLRYAKNGQDFTFGYKLDDQVHGPQRELTVHFITPEYPFEPEEIRMHSAGKDELRVILEPDERVLPDVRLLIKTEKYTKRKQTTSLSAIEDQILRSKATHNVEREKELVERIRRAIGKAELVINAADVTSTSQDAVARVTDGFQNLVSRTYTQLKLLGGSTYSEQQVAAFANPDQQSLIDDPFLSTLSAPGDEVLSYVLQRDRLGEQVTVKTIVDAFQSKPYGWDATSIEVVTAWLVGTSKVTIIVDGNALKRAEVAAVLRNTHKRSHAVVAPQKIFDERKVTDFRKFCTDFFDEAIAPKDPLELARHGSDKLRAKFYELNARMDGSKYPFVEQLSAPIALLEQSVNKPDEWYLTEFALGDELLDAKESVIDPIQSFLSGGQHEIYDTAVALLTANANNLSYLPDGSDSDVKRLLDDPNGFRGNRMTQLKQAAGALGRQIDEALAANRATVIESIGGRKSKVLGSSYYENSSEDARQRAVYEIDQIVDRVQQETQIALVREVGNTFEEKTYPALLDQLASSTRPTGGENDPEPAPAKQTVSVKTITALGVQGVLETSADIDNYLDALRIALVSTLNDGKRIAL

SEQ ID NO: 701 - protein, 1177 aa, Rhodopseudomonas palustris
MAGEIASLFASDITRQIEEVIKVDQTSADIIASEIDEYVVTDAIKKHYVHVLERYQETRLKPHEGGAIWISGFFGSGKSSFAKVLGLAIEDRDILGTSAANRFAARAGDPKLAVVLKTINEQIPTHTVIFDVSTDRGIRSGNQMLTEIMYRLFLSSLGYAKEIDPAELEIALEGEGRLDKFKEVFQELNGKSWDTQKNLPIFALNQASAVLHKLEPATYPMADSWSKGRPKIDITPGRLADRIVELMNRRKPGQALIFVVDEVGQFVARDTQKMLDLQAIVQQLGVKGRGKYWIAVTSQERLSEVVSGLDNHRIELPKLMDRFPLQVHLEPSDISEVTSRRVLAKNAVAETVLGKLYDDNRARLDLNSKITADVSLPTLSRERFVDLYPLLPYQIDLIIDVVSGLRMQGGASKHVGGANRTIIKLAQQLLINPATKIAEAPIGALVRLDQVYDLVEGNINSDIRAKIISIPGKVEHPLAQAVAKVVCLLQFVRTVHRTPENIAAALVDRVDADSRLTEVHEALAKLESAHMVRQGDGGYRIPTPAEDDWDQARASIDPKRADERRLYASVLTGFWAPQPGFTLGDAKTFKAGLMVGGNEEMSGDVSFHLDLAENAEQAAVEAENLRRRSQMDQKDVFWSVALDQDIRREMREAFRSDEMIKRKGRGAPTADETALIAEEKVRQRNHMQELGRRLKAACLSGKVFFRGNDRSPAGTATEVGKAVTGVLEQVLPDVYNRFAEASAKKAEVTKGVDALLTAENLAGLPAVFSHLELMRDEQNKRVFRTDVVPLSEILTKIEERAAYGEQVTGKYLEDEFLKPPFGWDFDVMRLLTLSLLRAGKIEATSKGQVIDQATTTAAKDCFSGNNTFRAASFRPKKGIDFAVLAQASENYRDTFGDEVKELAAGPIAAEIRAAVERQEEGLDAVLGTMRSAQLPGIDVLDGAVNQMRAIRRSNEENAILTFNASHKSLKDAIKRGSDLAGALNESALKAIADAREAAKLVPVLEEEPDLDAAFPEQAKVLSDLLSKETFYREIGPISKAATSIKTEYKRRYEEALDARVKAYLDALEVLTKTPGWERLDEAQRDELSGHLRKCADKNWNNQTIRHLRSEAELAESRLAAAIAKMHQILDGERLATVSVGQFFSGGIETEEQLDQALGGIRDEFARLIGEGKKVIVR

SEQ ID NO: 702 - protein, 1145 aa, Saccharophagus degradans
MINQDIYLTSPSSRKLVNEGVASVNDDKTQEALNVLRYELETFVCDGQYEKGIEDILDTYLKNVDQAQQPAVWISGFYGSGKSHLVKMLRALWTDMTFPDGASSRGIAKLPQNVKDLLSELTTQGKRHGGLHAASGTLGAGASGSVRLALLRIVFKSVGLPEQYPVARFVMWLKSEGIYEQVQQHVENNGHDWNEELDNFYVAEGLHEALCVVKPNLFSSPVSCVETLNNLYPYVQDVSSDDMIKTIKAALSNNGKFPLTLIVLDEVQQYIGEDSQRSIDVQEAVEACCKNIGGKLLFIGTGQTAVTGTSNLKKLEGRFTVRIELSDADVDAVIRQVILAKKAESLPKIEQTLQQNLGEISRHLAESKIGHRQDDIQFFAQDYPILPVRRRFWENTLRVLDQTGTDSQLRNQLSMIHKCIQSNLDKPLGSVIPADYLYFDGADKLLQSRVLPRKVHEKTFSWMKGNDEQKLLARACGLAFLVGKLQSENKEIGIKANLETLADLMVEDLNQSSSALRTKLAGLLDNCELLMKVGDEYRIQTEESQAWNDAYLRHRNTLANEAHRLETERTDRIRKKFAERVKKFSVNHGQSNVPRALSALFDASLPADADSKIYVWVRDGWSIDENSVRVDARQAGNTASTIYVHIPKRSADDLRHHLIDLKAAIATLEEKGSPDTPEGKEARAAMQTAQAMAESKVNDLLADILDGVRVFQAGGNEVLGNDLQEMILEAAENSLTRLYPQFHVADHTGWSKVYDKAKAGASDALKAVGDDGEPAKNPVCKAVINFLAGGKKGADIRTQFEGAPYGWPGDAVDGALQVLVVAGVVRAQTDRGQNIEPRELERKKIGLSFFKLETAVVTTPQRIQIRKLLQQVGCQAKQNEELAVLPEFLQKLSQLAENAGGDAPRPAKPNTSHLDDIRRAAGNEQLLAIYNLRDELKQQIDDWQALSASIQQRLPAWQSLQVFANHAKSLDGAEVLQTQVDQIKEQRLLLAEPDLMAPLMASYTQLLRDELNTLQQAYDDAHAKGMQRLNEDSNWQQLEQEQKHQFLAEQKLTATDKPEIAVGSSDDIQKTLQRISIGMLAERIAAMPSRFDAISIKAAEEMEPKAQFIRTPRRTLKTEAEITAWLDEVEQQLKTALAEGPIVLQ

SEQ ID NO: 703 - protein, 1213 aa, Salmonella enterica
MNIEQIFEKRLDRNINGVVKAEQTDDASAWIELDEYVITRELEGHLRHFFESYVPATGPDRIRMENKIGVWVSGFFGSGKSHFIKILSYLLSNRKVSHNGTERHAYSFFEDKIKDALFLADINKAVHHPTEVILFNIDSRANVDDKEDAILKVFLKVFNERVGYCADFPHIAHLERELAKRGQYDAFKTAFATITDSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWQEKGDILRNQLAFDPTTTASLRPYTSEEEFIDNYPFVPWHYQILQKVFESIRTKGAAGKQLAMGERSQLEAFQTAAQQISPQGLDSLVPFWRFYAAIESFLEPAVSRTITQACQNGILDEFDGNLLKTLFLIRYVDVLKSTLDNLVTLSIDKIDTDKVELRRRVEKSLNKLEREMLIARVEDKYVFLTNEEKEIENEIRNVEVDFSAINKKLASIIFDDILKNRKYRYPANKQDFDISRFLNGHPLDGAMLNDLVVKILTPKDPTYDFYDNDAACRPYTSEGDGCILIRLPADARTWTDIDLVVQTEKFLRDNAGQRPEQASLLSEKARENSVREKMLRVQLESLIAEADVWAIGERLPKKSSTPSSIVDEACRYVIENTFAKLKMLRPFNGDIAREIHALLTVENDAELDLGELEESNPDAMREVETWVSMNIEFNKPVYLRDILNHFARRPYGWPEEEVKLLVARLARKGKFSFSQQNNNIERKQVWELFNNSRRHSELRLHKIRRHDESQIRKAAQTMAEIAQQPFSEREEPALVEHIRQVFNDWKQELNVFKAKAEGGNNPGKDEIESGLRLLNSILSEKEDFALIEKVTSQVNELLDFSEDRENLVDFYRKQFATWQKLGAALNGSFKSNRSALEKDAVAVKALGELENIWQMPEPYKHLNRITPLIEQVQNVNHQLVEQHRQHALERIDARIEESRQRLQEAHATSELQNSVLLPMQKARKRAEVSQSIPEILAEQQETMALQTDAEKKINQWIDELRKKQEAQLRAANEAKRAAESQQTYVVVEKPVIQPVPKKTHLVNVASEMRKATGGEVLETAEQVEKALDTLRTSLLAAIEAGDRIRLQ

SEQ ID NO: 704 - protein, 1213 aa, Salmonella enterica
MNIEQIFEKRLDRNINGVVKAEQTDDASAWIELDEYVITRELEGHLRHFFESYVPATGPDRIRMENKIGVWVSGFFGSGKSHFIKILSYLLSNRKVSHNGTERHAYSFFEDKIKDALFLADINKAVHHPTEVILFNIDSRANVDDKEDAILKVFLKVFNERVGYCADFPHIAHLERELAKRGQYDAFKTAFATITDSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWQEKGDILRNQLAFDPTTTASLRPYTSEEEFIDNYPFVPWHYQILQKVFESIRTKGAAGKQLAMGERSQLEAFQTAAQQISPQGLDSLVPFWRFYAAIESFLEPAVSRTITQACQNGILDEFDGNLLKTLFLIRYVDVLKSTLDNLVTLSIDKIDTDKVELRRRVEKSLNKLEREMLIARVEDKYVFLTNEEKEIENEIRNVEVDFSAINKKLASIIFDDILKNRKYRYPANKQDFDISRFLNGHPLDGAMLNDLVVKILTPKDPTYDFYDNDAACRPYTSEGDGCILIRLPADARTWTDIDLVVQTEKFLRDNAGQRPEQASLLSEKARENSVREKMLRVQLESLIAEADVWAIGERLPKKSSTPSSIVDEACRYVIENTFAKLKMLRPFNGDIAREIHALLTVENDAELDLGELEEPNPDAMREVETWVSMNIEFNKPVYLRDILNHFARRPYGWPEEEVKLLVARLARKGKFSFSQQNNNIERKQVWELFNNSRRHSELRLHKIRRHDESQIRKAAQTMAEIAQQPFSEREEPALVEHIRQVFNDWKQELNVFKAKAEGGNNPGKDEIESGLRLLNSILSEKEDFALIEKVTSQVNELLDFSEDRENLVDFYRKQFATWQKLGAALNGSFKSNRSALEKDAVAVKALGELENIWQMPEPYKHLNRITPLIEQVQNVNHQLVEQHRQHALERIDARIEESRQRLQEAHATSELQNSVLLPMQKARKRAEVSQSIPEILAEQQETMALQTDAEKKINQWIDELRKKQEAQLRAANEAKRAAESQQTYVVVEKPVIQPVPKKTHLVNVASEMRKATGGEVLETAEQVEKALDTLRTSLLAAIEAGDRIRLQ

SEQ ID NO: 705 - protein, 1213 aa, Salmonella enterica; identical to SEQ ID NO: 703

SEQ ID NO: 706 - protein, 1213 aa, Salmonella enterica; identical to SEQ ID NO: 703

SEQ ID NO: 707 - protein, 1213 aa, Salmonella enterica; identical to SEQ ID NO: 703

SEQ ID NO: 708 - protein, 1213 aa, Salmonella enterica; identical to SEQ ID NO: 703

SEQ ID NO: 709 - protein, 1213 aa, Salmonella enterica; identical to SEQ ID NO: 703

SEQ ID NO: 710 - protein, 1213 aa, Salmonella enterica; identical to SEQ ID NO: 703

SEQ ID NO: 711 - protein, 1180 aa, Selenomonas sputigena
MMIKNMFAEDIDRKINGVVKVEQDESAILVQELDEYVITKELKKHFIAFFNNYGESFEENISDIGVWISGFFGSGKSHFLKMLSYLLENKEVQGVKTVERFRKKFEDDAAAFMPIDKVTRGETHTILFNIDVQSSGQKDETAVLRVFAKMFYHYLGFYGEDLKVAKLEQFIEKQGKTAEFRRVFEEKNGASWLSSRDSFAFFEDDVVSTLTQVLGMSESAAENWFNGTQTVDISIAKLVSEIKEYSDAKPQDFRLLFMIDEVGQYVGDDRSLLLNLQSLVETIGAECKGKVWVVCTGQEAIDEVIKARENEFSRIQARFKTRLSLSSASADEVIQKRILKKTPDAQEELESLYTQNDSVLKNLFSFTESVKDIRGYNGAAEFARNFPFVPYQFILMQKVFAEIRKHGNSGKHLSGGERSMLSGFQEAAQKIEDKNEYALAPFYLFYDTVHTFLDSSIRQVIERAERAAEAGHGLEMQDVAVLKLLYLVRYVDDVKATLDNLVILMADKISLDKIAVRERVGASLERLLTQNYIGRAGEIYSFLTDEEQDIQRDIYRNTVVDTAAVVSQIGSMIFGDIYTARKYRYGGKYDFPLDGMVDNTVVGTATGGMKLKILTVAADAVEKTDLRLTAESVGQALVVLADTPYYQSLENAMKVHKYVKQKNMTQLPPSVQAIIRSHQEEARKYELEAKKELVKAIETAEFYVDGEHLLLKGGDAKGMIDQALEYLVDHVYSDLSLIRKNADSEADISSILRGTEQTLFGTGANSEAAVKVEEYLEIQHAKKLRTSMQDIQSRYKGIPYGWKELDIACVVAQLIHEQKVTVKYGGSTIQPNDPKLPQMLHKKSEIGSTIVSKRQTVSLAKIREVREFLRDYFDEMDVPEDEDGLIRHITVRFEGEKARYENLLALYAGRKYPDKLLVSSAVDAMKELLSHAKDNMALIDYVIKKQDAICDLKEQVQNVESFFSNQKALFDEAVKYEEALQHDLEYIAKDKEAEKALNTIRLITLIPDGGGFNYRRLPELNDLLAKVHAKHDAMLEEKRQELLKIVDDCLEEIRAKAKTESKARDILQQEEGYFARKKEYIAGIRVLTLMDGQMPNIWLRKDEAISRIENLCKEDDKREEEQKPSVTAGKKPKKIIKSVYRQSMFPKRTIETDADIDEYVEHIRRRMKTMLKDCDGIRLD

SEQ ID NO: 712 - protein, 1157 aa, Shewanella sp.
MLNRDIYQLDPLESKLANNGVAEVKDDLSQGALETLEYELRTFVCSGAYAKGLDDILSTFLRNVKSSGEQPGVWISGFFGSGKSHLAKMLRTLWTNQKINDGTDARSLVDLPDTISHHFDELSTLGAKLGGLHAASGTLGAGVDDKVRLALLAVIFKSVGLSEQYHLARFELWLKAEGILAQVKAYIEQHAKGKEGEDLWQKELRNLHMSPVMASAVLHAMPALSGDAVGVNQMIRAQFKIVKDVSNTEMVQAIVDALAPHGEMPLTLIVLDEVQQYIADDPDKAYAVQEAIETCCKAGKFKGRLLFVATGQSALSGLQNLQRLMGRFQVSVQLEDTDVDAVIRKVILQKKETARVSIESVIQENLGEINRHLRGSVIESNKDDEQWMVADYPLLPVRRRFWERVLPALDKTGTGSQLRNQLRVVHEATKLTALKPLGSVVPADFIYDQIAINLLQTGVIGKDIYEKIGRLKAGNDDEQLQGRLLSLILLMSKLPADINHGIASTEAFLADLLLEHLSEGKHELRARLPGLLSQLVEEGALLPMNSAAGVEYRLQTVESQKWHDTFKQQQNDLRGNPQSLETFRSQEIQHYIRRQLAAAKVNQGTVAEGRTINLCFDADLPADANKRLYAHVLECSERQFTDAVRRASADNATLFVHVPSIRRSDLLSAIVDFKAAETTLDVSGLPATDAGKDAKAAMEHRKYEAERTKKLILKEIFDGIMVQLAGGSEVMGETLTEQFENGGKKACERLYNEFKLVDVKGWGTVYDRASKSADANALAAIGFNDEADKHPVCMAIKRFIGVMKTGAEIRDNFQNAPYGWPKDTIDGALYAMLASGVLKATDGQEKPLDAKSLERAKVGQTKFRPETVSLSTVQILKVRSLINAIGVSCTNGEEQSKLSQAIAQAKQIARKAGGDAPLPLPPATPHLNEIEVLSGNAQLLAAYQSQPIILQELEQWKAQADKVSTRLYLWDEFKAALKHCQGLAGYDALDSEKRAIEQNRSLLAEPNPIEPLLKQAIEAIRLAIMKKYQDFQEEYQTCLQELEQDAIWAQLSSSQQSELLTKHHLDNLEMQPLSGNDRVIDSIENTSLTQWSDKTSALAGRFSRVRQEAVDRLVPKAKQVQLSKVVINTEAELDAWLKQVRADVMAALNDNRPASLK

SEQ ID NO: 713 - protein, 1157 aa, Shewanella sp.
MLNRDIYQLDPLESKLANNGVAEVKDDLSQGALETLEYELRTFVCSGAYAKGLDDILSTFLRNVKSSGEQPGVWISGFFGSGKSHLAKMLRTLWTNQKINDGTDARSLVDLPDTISHHFDELSTLGAKLGGLHAASGTLGAGADDKVRLALLAVIFKSVRLSEQYHLARFELWLKAEGILAQVKAYIEQHAKGKEGEDLWQKELRNLHVSPVMAKALLHAMPSFGSDDKEVRDMLRAQYKIVEDVSNTEMVQAIVDALAPHGEMPLTLIVLDEVQQYIADDPDKAYLVQEAIETCCKAGVFKSRLLFVATGQSALSGLQNLQRLMGRFQVSVQLEDTDVDAVIRKVILQKKETARVSIESVIQENLGEINRHLRGSVIESNKDDEQWMVADYPLLPVRRRFWERVLPALDKTGTGSQLRNQLRVVHEATKLTALKPLGSVVPADFIYDQIAINLLQTGVIGKDIYEKIGRLKAGNDDEQLQGRLLSLILLMSKLPADINHGIASTEAFLADLLLEHLSEGKHELRARLPGLLSQLVEEGALLPMNSAAGVEYRLQTVESQKWHDTFKQQQNDLRGNPQSLETFRSQEIQHYIRRQLAAAKVNQGTVAEGRTINLCFDADLPADANKRLYAHVLECSERQFTDAVRRASADNATLFVHVPSIRRSDLLSAIVDFKAAETTLDVSGLPATDAGKDAKAAMEHRKYEAERTKKLILKEIFDGIMVQLAGGSEVMGETLTEQFENGGKKACERLYNEFKLVDVKGWGTVYDRASKSADANALAAIGFNDEADKHPVCMAIKRFIGVMKTGAEIRDNFQNAPYGWPKDTIDGALYAMLASGVLKATDGQEKPLDAKSLERAKVGQTKFRPETVSLSTVQILKVRSLINAIGVSCTNGEEQSKLSQAIAQAKQIARKAGGDAPLPLPPATPHLNEIEVLSGNAQLLAAYQSQPIILQELEQWKAQADKVSARLYLWDEFKAALKHCQGLAGYDALDSEKRAIEQNRSLLAEPNPIEPLLKQAIEAIRLAIMKKYQDFQDEYQTCLQELEQDAIWAQLSSSQQSELLTKHHLDNLEMQPLSGNDRVIDSIENTSLTQWSDKTSALAGRFSRVRQEAVDRLVPKAKQVQLSKVVINTEAELDAWLKQVRADVMAALNDNRPASLK

SEQ ID NO: 714 - protein, 1180 aa, Slackia heliotrinireducens
MLLKDTFLKDIYRPIDPVVKANELGHLKSELEEFVITNEAKSHLQRFFDEYNDPDSAGNGAWISGFFGSGKSHLLKIMAVVMEDRQVDGRGAMDYILPKLSDTPALAAAMEQSRLRHPSESVLFNIDSFAPNAGRSEAGAILSAFIKAFNHHCGYFDGDQQHIAKLEYDLDREGHFEAFKARVEELCGKPWEQVRSSSLLYGKKITSAFDEVCGNPEGTTANVISYYQQTYKPDIRMFAQRVQAYIAEHGKGFRLNFFVDEVGQFIAQNTSLMVNLQTIAEELDNFCHGDSWVIVTSQENVEDVVGQMKQISANDFSKIKDRFKTRMVLTSSDAKEVIRDRLLAKHPGDEPFLEEMYEEYRADFDVLFDFADGAKRYKQYQGAQEFCDTYPFVPYQFEVFMTALRGLSDHNCFTGRHNSTGARSMLGVFQMVAQRICDAGASTEQGTLAPFDLMFEGLRNDLKSEVYAAISTAEDQLDDEVAVRLLKALLLVKYCQDFRATPGNLRVLLYGSFGESTSELNGKIRDALDTLEEQVYVRRNGNIYEYLTNDEKEVEKEIANTIVPEVETRKQIAELFKDVCGATRVTYRNGSFEHSYLYNLKIDGEAQGLQKNDLTVDIVTDRDDGGLFGDIVPTPPKTLTIELRNCKEFLIGVRTFKQTETYTGVHSGAGEIREAILHDKQVANGKLYARLKDELAQLLSDARYNAGGVDITGQVTGTAADAVQSATQELVRRSYTGLQQIGQKFSDNDVYTQCFSSEAAFGLPEYCETVLSRIRLTKGAVASTVAGDGSGSLTGYFIKNEYGWPEIAVRSAIARLFAANKIEVRKSGSPLEKSALADALKRKRDLDKLVVSTIDEVSPEDIAALSRAFKLFAGTQPKGVDQKTIASELAEVAASLAKGFGSTASAAHVYPFGDAYEAALAKVEECAKNASDWRWALGEFPAKAQEYADATSDLKKMASFAGGSPMSKRWLELRSFMASEAAHLTELGIVDEGVAAISAIVEDPECFKNSGIPQAAKQMEALKKEAESARASLRDAERRKLAEYRASYEGTYDIAALPQEAAEEFDGLFSEAEEQLGLIRIPYKIKSFTEDFKKDKAARLLELVTPKPAPPVTPPIDVPTPPDDDDVPPVHVPKTIPVTSLSAKGYSKPAITTEDDVDKYLAALRASIVAVVSGGDIVSI

SEQ ID NO: 715 - protein, 1186 aa, Spirosoma linguale
MLTTIKEIFEKSIDRRINPAVVVDNTDPETITTEIDEYVFTASLTEQLYKLLNTLGSKAQIKTGIWINGYYGSGKSHFLKFFSYCLSDQNQERAFRRLINEGIAPLSKERPLTDATPANAENLLSRLRGSGTEVIMFNVEAVSPDNIKSEDKFLHMLLKQFNKHRGLNSTNIPLALLLENHLQQSGLFDQFIQAVESKYRKSWRDKATDLFSLYGINIVRLAAEVDPSLDADMLFQKLKQPDAVTIEDTLIPELRAYIQTKPANYRLVFLLDEVSQYIGRNKDLLLNLQTIIEALEKACNRQVWVACTAQQTLEEVTSTAQVTKEDEIGKILGRFETRIALDNKDAEFITQKRVLDKSIDGQQDLQQRYRQHAHAILNQFQFGNNTTYRGFGDEDEFVRMYPFVPYQFPLILNVFDSFSQKGYVVREVKNNERSVLGITHATIQNFADEPIGGFVPFDAFFNDLFRNNLLQVAQQSIYRAEQVIDRSGERLSDLRFAKRVLRALFMLANLNSSESRRFPATREQLVTLLMTGLDDNRLQLANRTQDVLDVLIAENIIYLNDDAHFAFYKEEEIEVANQIRRTNVLELDRLDNWNDVFLKSLGLNKETRYTFGKNTFRLGYGVDRKDYGNTGDIQVRFFVMDGTDAATLALNQPAHELAVCISAWLNDPSNTDNDFSRDVENYIRTRKYLGLYYTASTGSMADTLRDFEKRNAALLQSLTTRLKTGFASIPMYAGQQRIDPAGLSGNQPDVRLKGAIEKLFNVVFKYQTDVNSYAHTNDGLRENARNTGQLSTDTTLTAAEQRVEDWINNRGGKATVADVVKAFEDRPFGWKDLATIDVLLGLVAKKRKEIEYQNSPLSAPTEFVEKAIKTSERTALLVRTTEDIAPQLIQHAIRAYGQVFNKTLNLAPDPTAVQGAIKTELSREIDRLAPLTTIHAALPFAPALTQLVDSLRAVGLKRDAKMLFETLVAQANELRKQCDAAKELDAFITDRLDEYVDMRQYVLTQKGNFSALPEQEARQARDLYDDLLNNPTPQEAFALNRKRFLAVKRAIGDSVTTLRQTVRKAYETAFDELDAYRVEHGHDDPHTLADRDQTLLSIDKLNNLTELDLKLARVGDFKAEQLRVLIQATNKKAAPGSLVREPVMFEYGKQMLPTQIASETELDQYLAQLRHLLKAQLDQNKVVIFN

SEQ ID NO: 716 - protein, 1163 aa, Sulfuricurvum kujiense
MIIETLFKKPITRNIEGVVKADNDDLEAIRQEVEEYVVTNELNARLDDFFRVYASSITKPTADNGVWISGFFGSGKSHLLKILSYILSNKSLENEQIAKIFEEKIAKEDFELRGNINKSLSIAAETILFNIDQKAESLTVAHQDDKLLSVFLKVFNDHRGYYGKFPFIAAFEAMLDDAGEYGRFKELFFQAKNVTWDKARETLALYKAPAAEALSAVKNIPIEDAKRYIDGLKEDYKISIEDFAIEVARYIERKGDGFHLIFCVDEIGQYIGDNTKLMLNLQTIVESLATKTNGQSWVIVTSQADIDSLLENRDDKLSNDFSKIMGRFKVKINLTSKDADEVIQKRLLDKNDEACTLLGETYTRVQNTLRSIIHFENRQYGDYKDASHFIATYPFIPYQFSLFGQSIRGLSSHGAFQGAHQSVGERSMLGVFQDVVKSVASDSTDSLVSYDKFFDGLKQTIKGEIQTSILLAENHLNDPFALRVLKVLFMVKYVKGFTPTVDSISTLMVDSFDVNIASLKEEILRALTKLTDQVYIQKIGDSYEFLTDKEKDIENEIKETQCPESEITKELADWVFDDIIRVSKLRFEANRNDYPFEKKMDGNRVKGKEENIVIHIMTPLGSADYPEDRLIHYTMANKEIVFLLEPNRQFEKDLRLYVQTKKFLPQKMSASLSETDKLLLASKQTQNTQRRTKLIESLKAMMEESRVYFNGAPIQITAKEAKNRVEAAFNQAITSIFPQITMLRKNYSEDDIKAALFNQGDLGFGDETMNEAENEIFMKLSRAKAEHKTLTITAIISLFEDRPYGWYQNAILTLLASLFTRGKIELRQNAPLERNEAFKALTNSRDHTSTTVSVTKQIDDARLRKIRSIATEIFPDIAAGASAKDLYAQTRQAAQSLVARLESFVSSYSYPFLASLSDGIVLFTQLSKVDMDDFFDFMENRQDDLLDAKEDTIEPILEFFNGSKFEIYKRIGEFLRDNTDNLKSITDPKLNDLYALMKDEKPYAGSKIQLANESLQSLHAAINAQIDAARTQTNAAIEEKISFISSREDFATLSPDEKHQVLSPLLARQKSLQNLRQIDSIRYQGSEESLGKLISDALELIPELLPPPPGGIPSAPRKQVVRLSSINPKTRSTLTTAGDVEEYVSALRAKLLEAIEAEKEVIL

SEQ ID NO: 717 - protein, 1221 aa, Synechococcus sp.
MKTIGDLLTRDLTRKIEEIIQVDQADEQSVYAEISEYVATDSIREQYHDLLKAMAEAPSEPHESIGVWISGFFGSGKSSFAKNLGYALQNRSVMSRSFADFFKQQIDDNRISDLLDLINVKTPTEVILFEVAKEVDTRKVTQRIAELIYTVLLRELSYAEDFDVAELEIELEAEGKLDQFIEICKLELKKDWETVRAGAQKISRASLILHNLDPKTYPSADSWAHSQRNRDASISVSKVVERTFDLWGRRRPGKGLVFIIDEVGQHVARSGDKIEDLRATIEEFGKASKNLLKARKITAPCWIVVTSQEKLDEVVAAIDSKRVELAKLQDRFRYRVDLAPSDIREVATKRVLAKKAEAETPLKELFKKNEGQLNTALRLERTTRRTDISESDFIHFYPYPPHYIDLCIGIMSGIRLQPGAPRHYGGSNRTIIKQAYEMLVSERTAFANKLIGAMVTLDKVFELVEGNLSNEKRTDIHQIAERFKNEPEDHGWALRVSKAICLLEFIRDLPRTEANLAAVLVDEVGKATPLAEVKAAVQRLEAAKFIRNTEEGWKLQTAQEKNWTNERSGYLDPKPRERNELTRAALQQIFNEPDFKTYRYQNRSFRIGISIDGSSIGDEGELLLSLCVSDDADELTNRIEQIRTESQQKLHENDLYWLFCLTPEIDDLVAQLHASRKMVDKYNQLSAQQKISPDEATCLQDEKNSKVIYENRLRDKLTQGMERGTGMFRGVQNDASALGKSLGEILKKLFGQIVPDLYPKLQMGSSSLKGDEAEQILKTADLKVLPKVFYEGEQGLALVVKDGAKLVIHTNAEVSKEVLDYLKSEHSYGNKDTRMGKALEKRFGGTPYGWERDMLRLVLATLFRAGEIEVTYQGNRYHNYQDPTSRTPFTNNPAFRTSLFSPRQSVGLKTLTQAVQKLEDLTGEEVDVEEGAIATAFKKVAADELEKLHPLKATAQAHQLPILTMLSEYQQTLVGIQSSTSDDCVRILTENGEDFGETRDKVRKLRESFGTETIDLLRQARQATEQVWQSLLTYAPSPELETTVAELKTLLTSEQFIDSWDEIAASTEMVLDAYRTTYCELFERRKKSYESAIDEIQNRSEWAPLKVNNPGMASSLLSQMQARVGSDEDKEAVEQGHSLGKASLSQMESDLAAVDGLKSSVLVKLQELSIGSDKKAPVRKVRVSEFFNRPIQTQDDLKTAIKLIEETLQKCIDEGAIIILE

SEQ ID NO: 718 - protein, 1199 aa, Syntrophomonas wolfei
MKIKDSLTIDLTEDIKNVIDLEDHSEAEIQAEIENYIVTDGLARDYEDFAATFTSDIVETGVWISGFYGSGKSYFGKLLGYLLSNRSIAGTPARDRILQRFTGIRDEALIKNSIARLDPENCRVVFMDVAKQDTSKGLAFTLFRVFLKSLDLPENEHGILLYQLMINDNQTNIHDYIDKRMDKDWSKIQTRMLEYTKTAKSIYINAGNSESDYDNLMTTIRRDMDQFSASRLKDELSNYLQINTGEKIIFLFDEASEAITQQKFNLLDLEGISEALSSLGAKVWTIAIAQEKLDDVINNSNINKAQLTKVTDRFKTKIHLEATEVDIIIRNRLLNKKTAAEDKLRVHYNKNSGKISDHAALTGIGIIKTDTLDSYLTYYPFYQYQFNLLQNFLFGTKGYASSKVAARGMIITTYDILKRELAEKELFATATGWQINKQAQPQPPAHLVNRYDNAERILKERSSTISGRRLLETINFLNEAEVGPTTTISNIIKSYIDDPEDYHKVYEHIVKALDDLVEAKILLSTNNTYRITSDLEQRLLEEMNRFIVQGFVKKKNAVTAYKDSSFIKTLARITDSNLPYDFYISTDNDDELTNPALKELKIKVKSVYNQGDNRSADIETLKAQSQNDKDLIWLLPDNSSFPELDRLIDEIQRITYLEENYNNPQSEEAGIIRNFSTAKGEKENRVKELIERSLHNATAIYLYNTYQLDQDNWQTTLQNLQRNVIQNVYFKRLTAQLNDEVAGRVIKEANNTRLRTYFAGSEFQFFDAQGNFIGENLKAAEEILFKIKNTFADGDTLAKELGKPPTGFAFGTVISTVAALMRGAKIIAKYNGMEKFSWRDEGVSTIFSTAREFRKASFKAVAKSLSAQQKNDMVTILQESKCEQRIDKKIDWSTNDFDLANASKELAKMFCNKADEMRKQNPDFDLLFADINEQKKTLGEFTGVVSEANYIERAENFLTRKDTFTSAVKAIEKAEKFIHGKLPKLRQWYTFADGVKDELSKSARSSEILTRFISEFDNLYAQGVVKNYAALQETAQKIKDEYYALLSSAAGDMAGKYSQLKTAAEAVIEEINRLPTGLNDEALVKAETLLHYAEQRMLANVEIDFEVQDKHSHFTYSEMLSFIELYNTKKTELEIIRAGLIKKAPPEPKPGGPVPETITHTTRLPGLRLKVGRYKKWLQQEMHKLAAVSDNDEIEIRKG

SEQ ID NO: 719 - protein, 1185 aa, Syntrophomonas wolfei
MLVREMFKKKIDREIKGVIKVAQDDEDNRYQELDEYVVTRELHKHIASFYQNYQKGIDGYTDEMGVWISGFFGSGKSHFLKILSYLLENDEVKGTKPVAFFTDKITDQVLYADIERASRVECETILFNIDSKSPLGMKTDKEAILKVFLKVFYEHLGYYGDDFKVAELEKFLNREGVLEQFKTDFAEIKGESWEERRSCFFFDEDAVVAALSKSAGMAENSARNWFNHSQNPKLSIEQFAQEVKDYVDSKGENFHLVFLADEVGQYIGDNSEMMLNLQTVAEDLGTHCKGKVWVIVTSQEDIDSVTKVKGNDFSKIQGRFKTRLSLSAASVDEVIKKRILEKSEYAADKLRLIYSEQAAALKNLIHFSEGTVADLKGYGGEEDFSATYPFVPYQFKLLQEVFTQIRKYGASGKHLSEGERSMLSAFQDAACKYADEEAGVLIPFYAFYDSVHAFLDGSIQRVIIRAGEAAYNKEGLKAGDVEVLKLLFLIRYIGDIPANLDNIATLMISGVNEDKLSLKESIKAALNRLISQNYVQKNADEYRFLTDDEQDINREIRNTVIDGNAVVEEIGNYIFNDIYEDQKYQYSKRYPIPFNRKIDESNIGSQTARMGLRILTRASDDYDADEAELKMVSAGNNDLIIRLDESSDYFEEMQAALKIERFDKIKQTNLPANLKKIMAEKQEEARERKSRAKRMLEDALLKGRHYTNGERIDPRGSSAREKMNNGLKLLAESVYNKLPYVKEFLDNDQDILDILNRKLEQFTIIGSGEELNQLALDEILSYIDLQEAKHLQITMKNLLDKFEDAPYGWREIDIAGMVATLFKQQKIRLHYQGAYLETSDKAIPAYLRKKTEVEKILIKKRVSLDEKLVKTAREIGKDLFNVVNLPSDEDGLMRELLAKITDKTGQIERDYLRHYEGRKYPGKDLVMQGLNIFQELQHYKQDHSILLSKLKEYQDDLLDWDENMKMIQNFFKHQQVIFDKGLNMVKRIENNQSYLQEKEFMDKNAELQAIIADPAPYHKISQIPDLSSWLDKQFEERLNLHKEDSRTKVQKDYEQLQKALLQYGLGNGERQKFTVGINSWYEDKYKYIDDSIGFERLDAAIQQSANYRDKMLAEIKAALEAKQGKIAGGDEGDPVNEPEIHMLELKEIALVDALRTEADVDNYVNSLGKKLKGLIKERKVIRFGR

SEQ ID NO: 720 - protein, 1165 aa, Syntrophus aciditrophicus
MKNRELFQRDPALAKLLNDGVAAVRETASAKEIETLRYELTHFVCEGQYEDGLIRILESYLGNVSSTTQPAAWVSGFYGSGKSHLLKMFRHLWVDTLFTDGATARGLVSLPQEVQDLLRELDTLGKRNGGLHAASGTLPSGGGESVRLAVLSIVLVSRGLPEVLPQAQFCMWLQKNGIIDQVKAAVESAGKEFYSELHDLYVSPILAKAVLDIDPDFAADLKQARAALRAQFPVVEDISTNEFIRLVREVLSVDGQIPCTVIVLDEIQLFIGNDPGRSTDVQEVAEALCKQLYSRVLLIGAGQTALAGSVPLLQRLNGRFTMPVELSDADVETVTRRVVLAKKVDKKKAIEEMVNAHAGEINRQLAGTRIAACAEDRDIIVDDYPLLPVRRRFWEHVLRAVDVPGTASQLRTQLKIVHEAVRQSAEENLGTVVPADFIYEQISPDLRKTGILLREIDETIRNLDHGSDDGRLAQRLCGLIFLIRKLPLEAVADIGVRATPEMLADLMVSNLANDGTELRKNIPRILKLLTDPPPESERPTWLRKAMQDKGALLIEIDGEYSLQTRESSEWDREFRNRQTRLNSDPTSLPIKRGTLISAACGEALKGIKLVQGKYKEHRKLLVHFGSETPLTGRTEIPIWVRDGWGEKESTVVNDARAAGSDSAIVYVYIPKASADDLQKAIVEYDAAKSTLEFKGTPTSPEGCEARDAMATRMAAAETSRNQILHDLIDRAKVFQGGGGERFELNLVAKVEAAAQASLDRLFPSFKDADDDRWTNVISRAKNGDEAALSAVDWTDAPEKHLVCAAVLAEVGSGKRGKEVRDAFGASPYGWPRDAVDAALIVLHATGHIRATHKGMTLSQGQLDQAKIPVTDFRAETATINAKEKIKLRKLFQTAGVDCKPNEETAKAPVFLARLSELAECAGGDPPMPVRPATVHLDTLRGFGGIEQLAGILKQHDTLGQQAGDWSKLADLANKRKPAWVTLCTLLKHAEAIPGTEEIRRQADAVKSERRLLDTSDPVPEIRKAAVDALRTTVTGAYAEYEKIYNEQMAALTGSDNWKKLKAEQQKQILADEGIDGLPLLSVGNEGDLIRSLEQTALPSWKTKTDALPQQFARAAMAAAKLLEPKTQRVHLTSSTLTTEQEVKAWLAGTEKDLLAKLTSGPVVIS

SEQ ID NO: 721 - protein, 1188 aa, Tepidanaerobacter acetatoxydans
MKIKDMFYKDITRDIKGVIKIGQNDDENIYQELEEYVVTQELSKHFDDFFKNYKKSILGYTDKMGVWISGFFGSGKSHFLKILSYLLENKEVEGKKAITYFNDKIQDPMVLADMKLAGETPTDVILFNIDSKSDSDSKANKDAIVKVFMRVFYDMQGFCGSIPWVADLERQMTLDGTYDNFKAAFKEISGREWVDAREDFYYEEDAIIEALAKSTKMSKEAARNWYNKAEENYTLSVDKFAKRVREYIESKGNNHHVVFLVDEMGQYIGDDSDLMLNLQTVVEDLGTECGGKAWVIVTSQQDIDSMTNMKGTKRNDFSKIQGRFDTRLSLSSANVDEVIKRRILLKNDVGKDTLKLLYENKSSVIKNLITFSANTPEKKIYTDAQDFTEVYPFIPYQFKLMQEVLTSVRIHGSSGKHLSEGERSMLSAFQESCIRFADEEAGALIPFYAFYDTIETFLDSGIKTVIYHAQKNERLKPFDVELLKVLFMTRYVKEIPTNIENLTTLMISHIDDDKLELKKEVENSLKRLIRETLVQKSGDEYIFLTYEEQDINREIKSINVEMAETIRKISEIIFEDIFPEKKYKYSQQYNFPFNQNVDDRLYRGSQANDIGVKIITPYYETQVELTSQALKLMSSGENNLIIKLPQDTTFLEEMEEVLRIETFLRQTGGSTSTAEIEDIKDRKRREAADGLTRVRELIEEALKSAEMYANSQKLDIREKNPIDRINEGLKILVESIYHKLHYIDNFIDSPRDIENILTHNIVQVSLEEERDNKLALNEVANHVERNTLRNIPVTMRSILNHFSKAPYGWNELDIEGLVAKLFKEQEIKLQLNSKYLNIEDKNLINYLTKRDYAERLLIEKRIKVPPFQITNAKNLCQQLFGIIALPNDEDGIMRELDKLIETESYKIERLLEEYNTAPYPGEDILKKGLTLFKKLLSIDDAKEFFDTLYQDKDDLLEYADYSPEVKNFFNKDGKQREIFDDALAKIKIYEKNKDYLTNPVIAKYIQDIKSIVNMKEPYNDIPRLPDLIEKFNTEFAKLLEKESKPIKTSIEESRDKVIEELALCDFGYKYTAKFKNSFDDLLNTLEHSNNLAEIYGLTQLSETLKIRCLNTIQKELESRKTEPTHSGPLCGGEGGTPYKVRKTVNVSLASILPRTRTIESQRDIDNLLAEIKEKLESKLDEETIIKLV

SEQ ID NO: 722 - protein, 1188 aa, Tepidanaerobacter acetatoxydans; identical to SEQ ID NO: 721

SEQ ID NO: 723 - protein, 1203 aa, Thauera sp.
MKIGDLFTKPINRPINGVIKADQKDAESVWQELDEYVVTKQLTEYFRRFFDAYLAAADNPNDPVLAARMGVWVSGFFGSGKSHFIKILSYLLENLDATNPATGEKKRAAAFFDEHKIKDSMLLADIQRAVRGSADVVLFNIDAKADSKDERDVILQVFLRVFNEKLGFSADAPHIAHMERYLVEKGAYDAFRAAFAESNGSTWEAERDAVDFLRDDVVHALSVALGQSEESAGQWFDRSRDEYRINIESFARLVNAYLETRPAGHRIIFLVDEVGQFIGDNTKLMLNLQTITEQLGTATQGRAWVIVTSQEDIDAALGEANKAKSQDFSKIQGRFHTRLSLASSNTDEVIGERLLAKREGAHDALRDTFEKSGDIINNQLAFVGNSVNLRGYKDAAEFVSVYPYAPYQFTLLQKIFESIRKVGATGKHLSRGERSLLDAFQSATVRNMDRDVGLLIPLYDFYPSIESFIDTVAKRSIDEAPNNGALEAFDVLLLKALFLIRYIADIVKPNVDNLATLCVDRIDTDKLALKRQIQESLGRLEQQRLVSRNGDLWFFLTNEERDVAREIGNVEVSSAEKARLLCELLFDDILQGSTRIRHRDTKGDYDVNRLLDGAPYKNASHELSVEVVSPLGDDWDALNDARAVLRSSEGNGRALIRLAEGERFDIELTLYRQIEKYIDSPKASNATPSLRNILINRKDENRERRARLREQLATMMLQGDFYALGQRVELKASNPGSLLDELGNYLITNTYTKLGYLKHRNADPIAEIKAVLLADDTAQRKLALGGEEGNPLALVELREFLQLKASNTRVILDEVVNRFTGIPWGWKPDWEVVLLVARLFMAGEIKLMMDSADLEPKAAIEPLTKSARFKHVSILKRKVADAASIKRARELHRDLFAEMPPEAEDGLVAATRERLAALQADLKGYAHVAATPHHPGKAVIDSAIAAIGKQLGVADSYEFIDAFVKAKDDWLDLSDDIHDVISFYKTQTPTWRRLLEALERFEPNREALDKDVKAAVALSNLEGIRDNPNPWGAVSQIEPLITTVDAVNEALAQSKREHALLSIDAKIAEVEKALDAAQASDGLRNRALLKLQELKTKVVGLTSIPMIFYSQERAGDALDAAMTMIESATPKAAPITAAEKGSTTAATKTSGPVVAPKPTKAVRAADFSPKTYLETEADIDAYLAKLKAELLAVIQSGGRARLQ

SEQ ID NO: 724 - protein, 1148 aa, Thermacetogenium phaeum
MKNREIFQRDPVVSKLPNDGVATVAEAATSKEMETLRYELEHFVCEGQYKDGLIRILESYLSNADSTSQPAVWVSGFFGSGKSHLLKMLRHLWVNTKFESDGSTARELARLPVEVKDLLKELDTLGKRCGGLHAAGGTLPSGGGKSLRLAVLSIIFRSKGLPESLPQAQFCLWLQKNGIYGQVKKAVEDSGKDFWQELRHLYASPVIATALLEADPDFASDLKQVRATIRAQFPAVDDISTSEFIQIIRDVLSLNGQLPCTAIVLDEVQLFIGDSAARSYDVQEVAEALCKQLDSRILLIGAGQTALSGNLPLLQRLKDRFTIPVELSDTDVETVTRRVVLAKKADKRKAIEEVLTAYAGEIDRHLIGTRIAPRSEDRSIIVEDYPLLPVRRRFWEHVLRAVDVSGTRSQLRTQLRIVHDAVREIAEKPVGTVVPADFIFDQLQPDLLRTGFLLREIDETIRNLDDGTPEGLLAKRICALIFLIRKLPRESIVDIGVRATADMLADLLVSDLANDGPVLRGEIPRVLEKLVEEGKLIKLDEEYSLQTRESSEWDREFRNRQTRLNNDLTALSSRRSALLNAACMDILNNIKLCQGKCTERRKLEIHFGSEPPKTQGFKVPVWIRDGWGENESTVLADARAAGNDDPTIFVYIPKESAEDLKKAIIEYEAAKATIEFKGTPTTDEGRDARDAMSTRMKAAEAARDSIIRDVINAARVFQGGGQERFEFSIKEKVLAAAEASLDRLFPNFREADDDRWPIVLDRAKNGNEDAFQAVGWNDAPEKHPVCSAILSAIGSGKTGKEIRETFEKAPYGWPRDAIDAALITLFATGHLRAVYKGAQLERGQLDQAKIPATDFRVETVTIDARSRMKLRKLFQTAGLRYKAGEESSVAGQFLARLMDLADRAGGDPPLPERPSKAHLEAMRGLAGNEQLAAILEQFDTLAQQLQRWSALADLAAKRKPVWDRLQLLLKHAHGLPEGEELQKQANAVCSERRLLEEPDPVPDIYRAAVKALRSAVRQAYNNFEAVYNREKAALEGNENWQKLSPERQQQILAAEGIASVPQLSVEDDESLLRSLQEAPLSSWKTRTDALPQQFSNAAMAAAKLLEPKTQKVKLTSSILRTENDVKAWVAEIERELLERIKSGPIVIS

SEQ ID NO: 725 - protein, 1186 aa, Thermoanaerobacterium thermosaccharolyticum
MRIKEMFYKPIDRDIKGVIKVGQGDDSNVYQELEEYVVTRELAKHFNDFFEAYKKSIVGTTDKMGVWISGFFGSGKSHFLKILSYLLENKEVNGKKAIEYFKDKIQDSMVLADMKLAGDTSADVILFNIDSKSDSDSKANKDAIVKVFNKVFNEMQGFCGSMPWIADLERQMVMDGVYEDFKKTFKEISGREWQDAREDFYYEEDAIVEALSKSTKMSIEAARNWYAKAEENYTLSVEKFARRVREYIERKGKNHHVIFLVDEIGQYIGDNSQLMLNLQTVVEDLGTECGGKAWVIVTSQQDIDSVTKVKGNDFSKIQGRFNTRLSLSSANVDEVIRKRILLKNDVAKDTLKLLYENKNAILKNLITFSADTPEKKIYKDSEDFVECYPFIPYQFNLLQQVLTSIRIHGASGKHLAEGERSMISSFQESAIKYMNHEEGALIPFSAFYDTIEAFLDSNIRTVIIHAQENGNLNDFDVELLKVLFMIKYVKEIPANIENLATLMVSHIDEDKIDLKKKIEDSLKRLIKETLVQKNGDQYIFLTHEEQDINREIKNISVDLGEVIQKVSEIIFEEIYIDKKYKYSSRYNFSFNQVVDDRFFRGNQGNDIGLKIITPYYDTGVELTDNELKLMSARENNLIVKLPNDTAFLDEMEEVLKIETFLRRKGGTSLTQKIEEIKDRKRRELVERKERVKFLLIEAIRNADMYANSQRLEIKEKHPVDRINDGFKVLIEGIYTKLGYITYFTTTKDLYDIFADNEQIALNGVESPNKLALDEMAGYIERNTTRSIPVTMKTILGIYGKAPYGWLEEDIEWLVAKLFKAQEVKLQLNSQYLDVQDREIVKYLTKRDYADRLLIEKRIKVPAHQINNARELCKELFNITAVPSDEDGLMKRFKDLARDEIAKINELLVYYKQSKYPGQDILQEGKEALEKICKIHDAREFYDELQREKDVLLDYADDSIDVKKFFGSNQKEFFDKAVHKINVYNSNKTYVLDKEVIDLIEQMKKIVESKEPYSDIHKLPSLIDKFVARFTELLEEECKPVRQVIESDYNKVLEELNKYEFKSELFDRFKGRFDDLLSRLDHANNFYEAIAMKEESDRLKLRCFDEIAAEIAKRKPVEPQITHEEPGKPTVVKDPPKQYKKTVNISIANILHGAKSIESESDIEDVVNEIRNRLKSELKDGVIIKLV

SEQ ID NO: 726 - protein, 1206 aa, Thiocystis violascens
MDIRDLFVSDVTRDIPPVVYFHEQSPEKLAAEVSEYIITGGWPEDHPNHRRVPDGIHEQYVRLLTHIVSELDKPGGPELPNVWCAGFYGSGKSSFAKLLGLSLDGVVLPDGTSLAEGWLRRDTSPRAAELRSAWQALRQRIDPIAVVFDIGGTARDNEHIHAAAVRQLQKRLGYCATEALVADFELRLERDGEWARFERAAEEVLRHPWSEVKDKALAEEDFSLVLSVLYPERYTDPMSWFTSRGGTHQRAESPEESVAAIRDMLRFRRPGATLFLVIDEVSQYVLASKDRVDRLRAFATALGATLKGQAWLMALGQQKLDEEADDSFLVWAKDRFPPKLRVHLAATNIRDVVHKRLLHKRPEVEPVLRELFERHRPDLKLYAYGCETVSADDFVECYPLLPAQIDLILQLTTALRTRSARAQGDDQAIRGLLQLLGELFRDQKLADHSVGALVTLDQIYAVQHTALDSDVQATMARILGQCSADADALLVRAAKAVALLELIQETMPTDARLVAQCLYDRLDRGNQLAKVTEALEELRRRNLLGYSEKQGYKLQSSAGEEWERERRDIGVARETLTAIVQEGLKYLLSEPERPRLQGRPFPWAAVFSDGRRADDLTLIDPRDEAALRVDCRFLASEERTESTWVRRSAESSLADRLIWVAGESEMVEQLSRELHRSRAMASKYEPRRESLSGARKLLLQQEKNRIEDIETRVREAIAVAWMAGRLYFRGRALSPMDQGGSFGTAVNGAATLILPELYPHFIATQILPAELMPLIAAELAGPSPKFLPGELGILELDSGRYVPACSGVVPLRVQERIESEGGLAGTSLLAWFGGPPYGYTVNVVKACVTGLLRAGKVRIQPEGGNEITAIRDAGVRDLFEKDRAFRRATFFPAGEDDIGFSARARICKFFEERLQHRMEREDHAIADAVGQYFPALAQQQRAVLTNLDRLPGERRDSDLLRNLGEALEQCVSVCRQTKPTVKLVKKWLDVLSDGVQQLQMLAAELTSDAIQAVSALHQVLTVQAAQLAEIGSLTPEIEAVMGRLTDQLAAERPWRDIAALEPDLETIRSAYRAERERLLQWQEQHAEQARARIKSRMGFSTLTADQSHRVLRFLTRAVTDTAAEAVAPTLSQLQDPFLLALQRAEEDADDALDEILSEGARPLFKRVDLRLRNRELTSEAEVDALLSEIRAQLLEQLHAGARVRLL

SEQ ID NO: 727 - protein, 1209 aa, Thioflavicoccus mobilis
MTIRTLFDPSRQIDRRIEKVIQYDAMAPDLLRQEIAEYQVTEKMTSELEKLLDAIDIGMGEGSPEVGVWVSGFYGSGKSSFTKYLGFALDDHNQIDGKPFLNALQDRIGSTTLRQRLATVASRHRPAVIMLDLASEMLAGASMAEISTVLYVKVMQWAGYSRDRKVAYLELMLERDGKLDAFKEKIAQVVPGMTWEQIKNQPLVANQLASQLAAELYPAVYPTPKSFHDQRLDEVIKVDDQAREMVELARRRSGRENVIFILDEVGQYVAARDALILDLDGLAKNLKAIGGGKVWLIATAQQTLTEDDPRAQINTPKLFKLQARFPVPVDLDASDIREICYLRLLGKAAAGKAQLEARYDQLGQQLRFNTQLHNTRYYQRDLDKQAFCRLYPFLPQHFDILLELLGRLAKTMGGIGLRSAIKVIQDVLISPESPAGPLADQPIGTLATTVTFYDALRRDIQTSFRQLVEAIDKVVRVFGADSAEARVAKTIAILQVLDDFPVSRENIAALLHPRDDAPSQLDAVEQAVNALMDEETIPLAEIDGNLRFMSEAVTELEQQRRGLIPILAERNRIQNDLLKELFTPPPKANLHNTRAVHCGIRTQGVAGPVSIAGDKEELQLLVEFVSEGEIESQKGTRVADSTQSAERNTLFLIGIEPKGLQQQIEEIYRGEEIFAQYRNKTVEKEIGEYLNGQQQRAENLRGELAARLRKGLEQGSFVFQGRPHAVASLGSNLEEAAKRQLEEAAKVVFHKYAEAPIQAESALAERFLKTDRLDRIESRNDPLSLVTATGQIKVTHPALKTVVDLLRHIGREEGRVLLDKLNRAPYGWSKDTLRYLVAALLVGGKIKLRVSGEDITVRGPTAIDALKTNAAFNRVGIDLRDGAVDPESLLRSAERILELTGEDVLPLEAEVSKVVTRRFPDLQRDYAYLASELRNLGLAGAETAESIQDSLSEILKGDASDAAARLGPEECPLFKDLLWARDLDKALKGHLPAIVRRASRYIEAIPKLPAVGPLAALQAEVLEDLAGLREVFAQTDFFTKAPDIQSRVSSVEKAIETAATSLVAEYNADLESEKQRLEQSPNWPRIGGDNQEAFAAQLDALQLAVEPSLDGIRACLDARYPLQQRVAEIAQAIARIVEEQTRQASQDDAEDIDTQVGGGTEGTGPKALVVADFSFPAEIASREQLEDLIQRLEALRAELTRYSKIVFKP

SEQ ID NO: 728 - protein, 1225 aa, Vibrio cholerae
MKIEQIFSKKLTRDINGVVKAEQKDNDSVYVELDEYVVTRELDRHFRAFFEAYVPSVTQSGASMSGKIGVWISGFFGSGKSHFLKILSYLLENKSVEKDGQGRQAFEFFKDKINDAMLLADIQNAVTKDTDVILFNIDSRANTDDRENAILKVFLKVFNERVGYCADFPHIAHLERELDKRNQYMSFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTHLIDVFAEKGDILRNQLTFDKTTTASLKGYTDAPSFVDNYPFVPYHYTLVQKVFESIRTKGATGKHLAMGERSLLDAFQSAAKQMKDSGLDVLIPFYSFYAPIESFLEPAVKRTIDQACELDSLTEFDGKILKTLFLIRYVDVVKSTLDNLVTLSIDRIDADKIALRKQIEESLNRLERQLLIARNGDEFIFLTNEEKEIENEIRHTDVEMSEVSNKLSAIVFDGILKGNRAYRYPINKQDFAVSRFCNGHPKDGTTLEDLVIKVISPLDSHFENYSHDQACINHTLEADGCVLVKLGEHKRLWDDLTTFIKTDRFLKQNSGQRPEQEHLLREKQMENIEREKRLRTDFEALFAEADVYAIGTKLPKKSATPSAIVEEAYKYVIENTFAKLNMLKATPGEVLRELQAVLVADDIAQIGLDLQADECNPEATREVEQYVTLKVERNEPVYLRDIVARFGKRPYGWPDNEILLLTARLGLAGKVSFSTQGTDLALKKAYEPFTSVRKRGEIRVHKIRQHDERQIKKAAGLVKEIFSKTFTGSGEKELYELVRDELLAWNEELKSFRTKSQTGHFPGKSQIDDGLALVAGILEQTSSFALIARFLEDADALEEFAEDFEDLDDFYNSQFQTWQALAGALNEKFKANRPALEKDSEALKALTELERIYNMPSPYEQLRHINPLIEQVAKVNTTLVEEKRTHALERVDLRIGRVKEALAEAHAPSELQNQALRPLQMCRQRIEATSSIPQIISEQTEAEGYEDEAYELLNGFIEDQRKKAEAEQRRRELEQKKREEEAAKAGKAAPAPEPAPEPVQPQPVAKRTVTINPTDAMAKSVTTGFIESEAEVDAYLAALREQLIAAVKAGDRVRIK

SEQ ID NO: 729 - protein, 1229 aa, Vibrio cholerae
MTIINDILTLDLKEDIKNVIDLEDRSETEIQHEIESYIVTEGIGRHLYEFTNQFTSNIKETGVWLSGFYGSGKSYFGKMLGYIIDNQIINGTPARERFIPRLKGVSDAGLIENALRNLDAINSRVVFLDVAKQNTERGLAFTLFANLLKNLGFRDDIYGYMEFDLLLDGKYDEFKSIVQKLESKDWDELKKSNRHVARVMRKVFSEMGYSESDYEDTKSVYSASIEDFSASKFKTELEKYLKFNSEETLVFVFDEASEAISQKKFTLLDLEGISESLSSISNKVWTIAIAQEKLDDVINNANVSRSSLTKVTDRFKTKIHLESTEVDVIIRSRLLQKTEQAKQDLVAYYQKNEGLISDATNLKSSFPTKTETAEDFAVYYPFHKYQFDILQKFLFSSNALVATQIAARGMIITTFDVLRKQMRDKELYSFTPGFAICDEAQTAPPVGLVNKYDTSRKILKENGSSIDGEKLLKTMHLLADSEVVAPTVENITKSYITDITSYYEVKPAIEDALKLLLEAKVLLLSNNNYKITSDLEGKLLEEMKDFDVELFSKKRELIKYLKDYKTFNAVASYNDGSDAFKFSVLSDQDDELAPVGSKHLKITAYSLFNISDDRQDFIEQLKLDTQYQKELITLVPDTSEFSQIDKLIGEVMRYAYMEEKYSNEKDADKRQIIREFEVIREEKQRTLRGLIQDAYHNASLIYMFDEHLLNVDTFKGTIADNQRKMVKNIYTKRLSSQLSDSLVSKIFSTHKESLNKLFTANDFAFFDGHGNFTGDHLKIVEEINAKIKSRYMDGKSLEADLSGAPWGYSYGTLVTTLAVLFRAGRLSVKFNGDTYFSHEQKAVHDAFTNTTKFKSASFKSITATLTAVQKNQAVQLLMELETQDHIGKKVDWNTNDFDLADSIRLMAEHFISAITNLSDTVQDFEELFPKVVGLKQDLQGFAGKVTESNYIEKVEYLLNNSDTFSDAVQAILKAQKFIKKNFPKVKEFKRFIDDVRSELIKADRSDNNIDEAYEEFERLFKQDLVKNFANLQQQVQVVKDAYYKLVKTASIGMSHEYKVLSGKIEAAFRELKNYPAAPNRLNQQKLDALKAYAEKRVVGEPVLAFSISCSNSGFSLSDILNYTAQAPLKDSELLIVQSSFITEEPQPEPVPTPQPTPNRGPDGGEPAPAPTPVQSPAPKQPRKVAFKVSSKVMTVQEYKTLLTTQLTALAAAKPDEEIELTVDINSEGL

SEQ ID NO: 730 - protein, 1179 aa, Zymomonas mobilis
MATLLRDIFAKKVDRSIDGVIKADDKASLLTELDEYVITNEIGARLEQFLDAYNNYDTANGVWISGFFGSGKSHLLKMLALLLENDEVEGQRAVGIFERKLADNPMLAGALRKAVSIPSRSVLFNIDQKADVISKTDVDALLAVFQKVFDEMCGYYGKLPHIAQFERDLDSRGKLDAFKAAFAQSSGKPWERGREQALMEGRHIAAAFAEVTGDEVKDILGQYRKDTKVSIEDFANMVKSWIDAQGPKFRLNFFVDEVGQYIADNVKLMTNLQTIAESLNTKCKGQAWIVVTAQQDMGSVIGDLTAQQENDFSKIQARFANRMPLNSQDVAEVIQRRLLAKTEAGQITLGNLYDAEENNLRTLFDFGDNSFKFRNFSGKDQFVASYPFPNYQYDLFQRAIMGLSQHNAFEGKHSSVGERSMLGVFQEVAKKLADTPVGGLATFDLMFEGIRTALKSSVQQSIQLAEKNLGDDFAVRVLKVLFLVKYVKEFKPTARNISILLLSRFEADQTEQRRNIEEALSLLERQTLIQRNGEVYEFLTNEEKDVEAEIKAIAVDPAEIERQLDELAFGAILRHGKIKHAGTGVDYAFTRKLDGHSLNREHELSVNIISPFSDDSDAPDVVRSNSMASDEMIVLLGRDVRFTRDLVLWLQTVKFARQVTSGDAQPGRDRIIAEKRDQNTRREKELVQRLRGLIADARLFVRGAELEIGGEDPQDRLVKGFQVLVDKVYTSLPVLRGATYTEADLGRAGRVDGGLFGGEGSGLTEAEQDVLNHAQAQMRLGTRVSVKALVEKFGAKPYGWPAIAVLCLTASLVARGKLEARADSALLEGDALVQGLRNSHALGNILLSPQIEFTAAQIRKSRELFQELFDLPASGNDARSLGAEWQTQLRKLLGDVEQESRAIAAYPFAAALDPLRTMLDGMRDQSATWFITGPIGQEDQLLDAKEDVFDKVRSFMRGPQKAICDEVRSFLTKQDQNLGYSEGAAADKLRQVLEDPQCYKGTAIQELKADFYALKERIEQTVLAERTAVITAIDEVAEKVAQTSEFGALPPEQQARIREELVSRKSGLAAQSLIPALRHLVTEVRSNLLADTLTRIAELTPAPAPTPAPQPEPSGGVAEAPSAPYVQPAPAKPQYIKAQSITVPFAKTYLEDEDDVTRYLDEMKKTLLAEIGAGKKVIV

SEQ ID NO: 731 - protein, 794 aa, Magnetospirillum magneticum
MGGNMLIRELFEKKIDRPINGVIKADQTDDASKWQELDEYVITRELDKHLHGFFNSYLKSIDAPGDPELAGKVGVWVSGFFGSGKSHFIKVLSYLLENKMVSMGGESRRAVEFFDGKIQDAMLAADIKRAVNADTDVILFNIDSKADTSKDDSILTVFTNVFNERLGYSPDHPHIADLERRLDAKGKFGEFKAAYREITDCDWVSERDAFHLNSDSIKTALARVLGQSEDAFEKWLDNPEAVFNLSPDNFAGWVKQYLDSKGPKHRIVFLVDEIGQFIGQDTHMMLRLQTITENLGTICGGRAWVVVTSQEDIDAVLGEMRSAKSNDFSKIQGRFKTRLSLSSADVHEVIQARLLEKTPAARDALVSVYKDKADILKNQLSFTNVGMTFKPFANDDHFAKVYPFAPYQFQLVQKIFEAIRRVGATGLHLARGERSMLDAFQTAAKDMASEKVGVLVPLHRFYPSIESFLDTAVKATIDQAGDNASLEPFDNLVLRTLFLIRYVEEIKGTVENLVTLFIDQIDADRLAIKIQMEASLQRLEGQTLVRRNGDEFFFLTDEEKEIGKGIKNVDLHGGEDVKALGEMIFDGVLGGYRKHRFEDTKKDFPFNRFCDQHPYGARGDGDLAVLVITPLSEDYPDWNEARCLMKSTEDGGQVVIKLPDDSRPGTSDSLLNRELRTLLKTEKFIARTNDGTLTPGMKNILRNRADENNKRRDNLTVHIGDLIRGADVFAAGNRVTVKGGGDGAIRQSLDYLIKNTFTKLGYLKHISQDPLAEIKAVLNAPDTADQRLKLDGED

SEQ ID NO: 732 - protein, 377 aa, Magnetospirillum magneticum
MVLLVARLVVAGELSMSMDGALLTRDKIFEQVKTPNKWRSIIVIKRQTVDAALLQQSRNLGKSVFSKMGPDGEDALYGFLREQCEKWQANLSGYLKLAETGKYPGKDAIDAGLKLLKLILAEKDSYGFIQKFVTLKAEFQNLSDDVSDLDTFYGTQQPVWELLGRKYAEFVVNRKELDHNPDAAAALHQMESILGHAAPYPLIKDISGLVSKVTAINDALVVKRRSHALEKIDQHVSEVKEALDHIAAPPDLRNRCLKELQKLRQIAETQTSIAHIHQAVTDAIEAKDDALDVIDRYVPPKPAAPTPPPVTPGTGGAEPTKTKAEPPPPIFKKPRVVRPAEMKSGYLKTQADVDAFLGKLRKELEAALAAEEPIEIR

SEQ ID NO: 733 - protein, 1193 aa, Marinobacter aquaeolei
MTLKNIFLKPVDRPIEGVIKADDEASLRLEIEEYVLTNEVEKRLEEFLDAYNNYEGANGVWVSGFFGSGKSHLLKMLALLLENREMDGATTLDLFLPKCSENEILRGDLKRAVSIPAKSILFNIDQKADVISKTQIDALLAVFVKVFDEMCGYYGKQGHIAQFERDLDGRGLYKQFKAEYEAIAGRPWQKGREQALLEGPNIAKAYAAVTGGDPQSAAGILDKYRSEYRVSIEDFADNVNAYIEKQAKEGGHKEFRLNFFVDEVGQYIADNTKLMTNLQTIAESLATKCRGRAWIIVTAQEEMKNVVGEMGKQQGNDFSKIQARFNNRMKLSSADVAEVIQKRLLTKTEEGVNQLSDVYHAQANNFKTLFDFADGSATYRNFRDRDHFIHSYPFVPYQFALFQSAIQNLSQHNAFEGKHSSVGERSMLGVFQQVAIHIGNHEVGQLATFDLMFEGIRSALKSQIQRAIIQAENHLDNAFAIRLLKALFLVKYVKEFKPTVRNLCVLMLDSFDQDLPALRTKVEEALSLLEQQTYIQRNGDQYEYLTDEEKDVEQEIKNTEVESSDVADELEKIVFDFVIKQRKIRYDAGSSQNQGQDYSYSRKLDDRLHGREYELSINVISPFHEHTDNEQMLRTASTYKADELFVLMPSDERLVRDLLMFKRTEKYIKQNISVTQQEAVKRILNDKGFQNREREARLRQQVQTLIGKSKLLIGGADVEVANEDPQTRIIRGFHELISRAYPNLRMLRGVSYTENDVSNCLNRTDDGLFGNDATALAESEQEVLAFIQSNNRGGVRTTLKSLLEKFERKPYGWYYAAILCTLANLCARGKVEVRLDGNILEDSGLERALRNTHGHGNVVLEPQIEFTASQVRALKSFYEDFFDSPPRSSEAKALGKEAGEAFQDMYHDLDRRVAQVDQYPFLNALKPALVTLKEVAGKPYTWHLTELGKQEDQLLDLKEDVIDPIRKFMGGSQKDIYNQARSFLQSQEPNFIYVSGDEIEQIRTILNDPNCYKGNRIQQLKGQLDSLQERTDEKVQQTRAQAETSLKTMQERMQSMDEYQSLPEPRQDELNKPFRDLVDYIGQECLIAVIKDRTRYFEEEGYQKLLGKMVALANQKSAPADDSQQPPGSQDENENRGQSNEVKESPADYVHTRNLRVAFDKAWLANEGDVDRYLNALREALLAEVQQGRKVQI

SEQ ID NO: 734 - protein, 1179 aa, Nostoc punctiforme
MNIAELFQKDIHRNINGVIKVGQKDDENIRQELEEYVVTNELDKHFRTFFERYTNALNNPTDKMGVWIAGFFGSGKSHFLKILSYLLANHQLENSRALDYFDEKRIPDPMLQALIAQAAHSSCDVILFNIDSKADANNKNHKESITKVFQKVFDEHLGYFGTVLPIAEFERQLDRQGKYAAFQQAFLAESGLEWKENRDAWGFHQDAIASALQTSTGMSAEAANRLLDFGEQNYTLSPEKFAGMVKQYLDSKGPQHRLIFMVDEVGQYIGEDSKLMLNLQTVVEDLGTYCLGKAWVVVTSQEAMDEITKNKIKGEDFSKIIGRFYRPLNLSSANTDEVIKLRLLSKTDAARAGLEALYSQKIAILRNQIAFTQDSADMPGYGNPQDFFTAYPFIPYQFNLLQKVFTQIRLMGSAGKHLASGERSLLDAFQVASQAVAGEPLGVLVPFHTFYMAVEGFLDSSINQVIIQAGRNPQLNSFDIDLLKTLFMVKYLKEIRANLDNLTTLSLSNIDQDKLALRQQVEAALGRLERQTLIQRNGDEYIFLTHEEQDIGREIKNTPVDSGKVKEELRKLIWESIFTDKLFRYSQRHQYKFNRKLDEQLHSQQSDITLHIVTPCAETYTAMKEDTFCIGTTGGGYEVLVRLPYEQRLVDDLETLVKTEKYIKLKSGSNLSPSIQRILRDQSDQNSKRCEDVKTILENLITRADVFACGSKLEIRSRDTKTLLNEGLSYLVGNVYQKLGYVASGFENEDQVSNALTRESQEQDINGQPVNVAAHSEMRAWLMEETRVRRLVSIKALVDKFAVRPYGWSEFDTLGVMAELANKGVIELRHAQGNVNLHDKGLVMQLRSRKEIDKYTVRLTDEINPANLKIAKDMASDLLNGNMSSDPQLLFEQYKNALTKRSQELESWLIQAEGGLPFAELLRTNLNLLAELLTKDSAAKFFDTFRQRRDDIEEFIEDVQKLQSFFSTQIKLFQQARNDLKTLEPELRHISEPDLLRRVDLVKQILAMSDPTAKIPELAMLLLPVKDKVQEALTTQIYQVESKSKAMREKLAEYVTSAHEDISAQLDLSNITQDIDKVVTSVNQVTSIDSAIARQSELESILPQLLQKVDQQANEIIQRQSNNGSNGKVTCVKPIVSVQVARVAPKPLLETLQDVDVYLEALRKTLLDEIQQNHRVRLE

SEQ ID NO: 735 - protein, 1173 aa, Runella slithyformis
MIQRELYLNDIFRTIEGVIKANDERHVRQELEEYVLTNELLGISNRNRMLPGLFEELVKSKFNSSIWISGHFGSGKSHLLKMLSLVLENREINGAKCADIFASKAAADFELERNIKKAASITTKSILFNIAAKSDGITAMGSATDPVLSIFLKVFNELLGYDPLNPEIAEVERHLESIGQYDYFKSEYQKRFHKSWEKGREAIFLNQHELAEIYAEIKSISADEANRFIDNLINNYKLDIEGFGELVSKYVKTQSAGFRLVFCVDEVGQFIAENVRLMLSLQTIAETLSFKTQGQAFMIVTSQNDIDATLGELNAQRKHDFSRIQGRFAIKIPLTSANADEVIQKRLLVKNDPAHQLLASIYEKEQNNVRTLLKFNDNSRQYQTYRDTEHFINTYPFLPYQFDLFQASIKALSDHNAFIGSQQSVGERSMLGVFQQVAKTYAVQEVEHLVSFAQMYEGIKDVLQSNIQSDILQAEKSIGSELAKEVLKALFLVKYVKGFQASINNIAILLLPKFEIDLSAFHRQLQEALNLLENQTYIQRTAGDLYEYLTNQEKDVENEIKQTEIDPTAPGELLASYLFDDILRDSKVKLETNNQPYEFGRKLDDNVIGREKDFYVNFITPLNANSVTRSNVSMFSIGRPNDLIIFLPEEKRLFDELRLFKKTEKYIQTTNSPALDATKQRILGEKAQQNQDRKRAVVNLLKEGIGEAKMYLNGSELTDIGTKDPKTKITQGVQQLIRTIYTNLKMLTVDFTETHLVNIVQGKDPLLFPLTLHEVEIEVLNRIQRNKANYERTTTKALLDTFAARPYGWYQTAVLCIIAKLFKRNKIGLKQDGTALDDRRVLEALQKNNQYANTLIEPEEEIQNAQIQKLKSFYQEYFSEPNLGTEPKEISRLFKQRLEKEVKDLTEMYILRGRFKFLEAMGEPLNRLKALAQKEHPYFFNALNHYEDELLDDKENVLDAVRKFMDGNQRTIFENVQTYLEGNRANFDYIDKSSIEKLSIVAESPAPYKGNIMQEAKAVLEVIKTEVTAQQKTERENAVEHIRQSMEKLSSFADFILLDAKQQEQIMAPFEKAVKELEHERFIGNIRTKANHTATELYQKQLELMMRLANPPQPAVPGTPEPPKPKIVFVRKDSIRINFAKPALENQQDVEDYLSALREQYLRILKEEKRISL

SEQ ID NO: 736 - protein, 1227 aa, Halopiger xanaduensis
MTDESWFAADVGSDFEESVRIDREDDGRDHRLESIDTYHVTEESEDFMSDFFSRLLGRSEDMRSGANYWLYGYYGSGKSHLLSVLRGLLDSEWLREREDVWEQLTDGRELDTLETTWSSIHDEYEVIPISVNLLKHQGQKKLSFSEIVLRSAHTSERLTGAEGGLSSQLDVAFFEDWYRTTDAWEDRTANTQTALRSTVDSPEKYDWEDVQQYNALADTVLPTLFEQETGTADGLDDLIPSDLDPQAMVERLEQLRSDREEELGRPVKLVLLLDEVSLFIGTDFDRLTELQTLAESVDETGDGDIQLVATAQAKIEDVQPQFAARGADFSIVKDRFPHRFGLPSRHVGEISTQRLLKKTVDGKEDTERVLNRTSNEPETLLVYSGIEQNTEPPLDDIDRERLIEFYPFLPYQPPLFLEILSNLRQEAHDPAKSIFSGTARAILALVHGLLQEWIEAGEETNVISLVDFYDLIEPELDDITPQDVGVIEEIEEQHKAGELEEIDVDVAKAVLLLQHIPDTIPMSERNLAVAVLSDLDGPTQFQMENRVEDSLQRLRKFIRPTHDETGPKYAFTHPEEREIIEASEENLDNPNWQSIIEAVDGYLWEDIVRDLSLPTSAEYPDTGEQYPVRYEFSIDGIELDTTVDAEDALDVEVAVEGLSPAAEDISYDGDPLEWTIGQDGLDDLRDSLIEWWSLRDAVGDHTLPQSVERDLSDRAARVQSKLVEALKSGAFDVKDRGDQIGGMVSGVEEYLDVNYPDDFHPVMLQVGDEHLQELRGLSAQDPLPTWAQQIDVATEDPETHGGSIQNNVRAFTGRQLKQRGGNLAMATIIDGIVKKKPIYEDARPALCAIIWGLCRKGDFLPVDETGDSLELDAVIDLNKLTTTRLKIAGSGGVRSILREGGFIDSTETIPDGIVRLQSANDTLAGRLGSLVEDVRLVAESDIQTRAVRNLLESFVEELEAKQQSAINRREAVKSRDTDWEDVVEATNNAQDWYDDAEEVWSLRLPALTRIDSQLTLAQQSYDWLTEECEAASQTLRESIDGYEGEWWTHDGWDRFNDAQTTSPALDEAIETAWDSFRAETEIDAFVDGLQEHPWIRPASEFGSNVRPAFESEYITPLRRAASWYEDVSDAVSTVTGGTTNTEADDFIRATNTLLDSEPLAVVAGSDIEELRDTFEELQTLVGDQSPTDITAIGVLPSDRESLDSELERLVERHDLNIERTETGVIIR

SEQ ID NO: 737 - protein, 1280 aa, Halopiger xanaduensis
MSDTHIHDIFQQSPTRELEEVQKVNARAQAENDVREFYETDSARDVLTTLGNLVDKYPHEEPRFLYISATFGSGKTHLLKLIGFAADTESEFADLGEELANRWPGFQSFRQSVANSHVDRLKPVFLNLLNRDASQEPPLPYLIYEAIGRELGYPTDPNWLLEWAWQLDMNHGDCWEQLQEVEHDGQTFEDVYDERASLRSWLYDAVPTLDDSPYASREEVKQSIDDAIEEVDPDEFDPDELVDRIEAAQESLSTPETETELLIGLDEVALFIGDGRHRYREFQETMEALTELGVGPNPPVIGTGQYPIERIHSEFDNTEVTEQPWYGAQEPLEGADTEIIVRKRWLQKDTEGGQAVESALREMPDLTLDAYSDIAGADPDAVESYPFREYDLGLLRTVIQQLMPRGRVTEEEYVQGRALLILVRSLFTRFEWGDKQVGALVTWDELYDLLVEETTYIPLWVQEMVENKLVPSAGGDEDAFSVRVAKALYLLNQVRSEVPSTPANLARLMVKSTDESFESVRDDVESALTDLLEDRKILTETNDRGDEEYLLVSEEQEDILTRAKTRAQQIPSHRLSAKLENSLREGSNLLLSEGSRHEVDLEGERKVPLRFGYSVLDPIEQAPTPEFDAVRVRLVAGRDEEISDQVDAWQSTNEGRDGGEHVLVAVELQGSTIDRLRDAMGMQEVLSEETETYPDLESDHRDEQRALESTIREQLEEADIYVRTGGTKGRYGDVFEQVVETQVRSVFSGTRFVLTNGITEVEDAKQMARFFRGVDDWPLSSEDAVTLGVDTDRAELADGWCQEFLDEYEDTQSLRAEDLLTQTVQRGGTYRGTPQESISALLITLATANKIALRRDDEYITEPDEIGRAVRNKTNLTDVQIRFESLDGIDPDQIRGTVETLIGEEPDGTDPDAWLSEMANWVDENSVLVKRVLRGVSREFSEGASLDELETALQPALGGESLETDDFASDEIARQSERFARARGLFQSIEDGDSLWEQFSQRTTEMQRLYPGAEITGEMQAIVGGDEVPDADRLRATIDEADDHRRTVVREQYERIAGESPPNEEPESVVSSLATWLYAHDGSSKETADRVAVEFDGVTIDDLYELFETAWNGDSFSEKDLVDPTVVQQAKRYERARQLLEASGSEASLWSQLRDASRRLEEERPNHPVTTDVSEMLSRSQPPSVDDVEQLLDEAENPFEVDERLEELASELQSEYPDHDLTQEVVDAVEGTSPPSEERVGELIEEAEQLLDGVDEQLRRIRETMDELEDGSVVLVEPLD

SEQ ID NO: 738 - protein, 1236 aa, Halorhabdus utahensis
MTDESWFAADVGSDFEESVRIDREEDGRDHRLESITTYHVTDEAEDFMSDFLARLLGRSEDMRSGANYWLYGYYGSGKSHLLSVLRGLMDSEWLRRREEIWSQLAEGRKLSSLRATWESIHDEYEVIPISVNLLKHQGQKELSFSEIVLQAAHTSEPLTGVEGGFSPQLDVAYFEDWYRTTGAWPDRTAHARAALRDTVANPDKYDWEDVQQYNALADVVLPTLFERETGTADGLTDLTPSDLDPEAMVSRLEQLRSDREDELGRPVKLVLLLDEVSLFIGTDFDRLTELQTLAESVDEVGDGDIQLVATAQAKIEDVQPQFAARGADFSIVKDRFPHRFGLPSRHVGEISTQRLLKKTKDGRQATERILERTSNEPETLLVYSGIEQNTEPPLDDIDRERLLDFYPFLPYQPALFLEILSNLRQEARDPAKSIFSGTARAILALVHGLLQEWMEAGEETHLVSLVDFYDLIEPELEDITPQDVAVIEEIEEQHRQGELEKIDVAVAKAVLLLQHVPETIPMSERNLAVAILSDLDGPTQFQMENRVEDSLQRLRKFIRPTHDEMGPKYAFTHPEEREIIEAAEQNLDDPDWDAIIESVDSYLWDDVVRDLSLPTSVEYADTGEQYPVRYEFSVDGIAFDTTVEADDALDVEVAIEGLSPEVSEVDYDGNPLEWTIGEDGLDDLRDNLIEWWSLRAAVGAHTLPQSVERDLSDRATRVRSKLVEALKSGSFAVKDRTGLRGLASAVEEFVDVRYPDDFHPVMLQIGDEHLQELRGLSAQDPLPAWAQQIEVATEDPETHGGSIQNNVRAFTGQQLKQSDGSLAMIKILDGIVEKEEQQREKTSELAVYGDARPALCAIIWGLCRKGDFLPVDETGDSLELDSVIDLNELTTTRLKIAGGSGVREALEAGGFIDSTETIPDGMVRLQSANDTLASRLGSLIEDVELVAESDVQTQHVQGLLDSFVDALEYRQQDANDRHEAVKSRDTDWQRVVEATNDAQEWYDDATEVWNLRLPALAQLDAQLTLARQSFDWLTDECEAASRKLRDNIAEYDDEWWTHDGWDRFNDARTVSPSLDDAIEDTWQTFQNSTDVDTLVRKLDDHPWIRPPSEFGSNVRPAFENEYITPLRRAVSWYEDISEAVGTVTGGTTGTEADAFIRATDTLVDTEPLRVVTGSEISELRATFEELQTVVGNQRPSEVTAVGVLPSDRESLDAELERLAERRDLSIERTETGVIVR

SEQ ID NO: 739 - protein, 1280 aa, Halorhabdus utahensis
MSDHRIHDIFQQSPTRELEEVQKVNARAQAENDVREFYETDSARSVLTTLGNLVDKYPQEEPRFLYISATFGSGKTHLLKLAGFAADTESKFADLGEELASRWPGFQSFRQSIADSHVDRLKPVFLNLLNRDASQEPPLPYLIYEVIGRELGYPNDPNWLLEWAWQLDMNHGDCWELLQEIEYDGRTFDEVYDERASLRSWLYGAVPTLDDTPYRSSSEVKQSIDTAIEEIDPDEFDPDELVDRVEAAQEALSTPETETELLIGLDEVALFIGDGRHRYREFQETMEALTNPATGPNPPIVGTGQYPFDRIHGEFEDSDVTDEPWWGKQEPLEGADTEIIVRKRWLQKDGDGEQAVDAAIHELPDLTLDTYADITGADPDAIESYPFREYDLGLLRTVIQQLMPRGRVTEEEYVQGRALLILVRSLFTRFEWGEKSVGALVTWDELYDLLVEETTYVPLWVQEMVENKLVPSAGGDEDAFSVRVAKALYLLNQVRSEVPSTPANLARLMVESADASLEEVQDDVESALADLVEDRKVLTETSDRGDEEYLLVSEEQEDILTRAKTRAQQISSHRLSAKLETYLQEGSDHLLSAGSRHEVDLDGERRVPLRFDYSVLDPIERAPTPEFDAIRVRLVADRPDTVADQVDAWQSTNEGQDGGEHVLVAVEISESTVERLRDVMGMQEVLSEETETYPDLESDHRDDQRALESTVRDQLNEADIYVRAGDTRGRYGDVFEQVVTNQVQSVFGRTRHALTNGITEVDDAKQMARFFRGVDDWPLSSEDAVTLGVDTNRGELADGWCQEFLDDYENTQSLRGEDLLAQTVQRGGKYRGTPRESIAALLITLATANEIALRRDDEYITEPEEIGRAVRNKTNLTGLQIRFESLDGIDPDQIRETVRTLMSESPEGSDPDAWLSELAEWVDENSVLVKRVLRGVSREFGEGASLDELENALEPALGGEALETEDFATDEVEREAERFARARGLFRPDEDDTTLWARFSERTAEMQRLHPGADVTGDMQSIAGGNEVPDAERLRTLIDEADAHRQRVVREQYERITGETPADEESESVVSSLATWLFAHDGSSKEIADRVSVEFGGVTIDDLYDLFETAWEGDSFSEEELVDPAVVQQAERYSRARELLESPEGEVSLWSKLQDASRRLEEEYPNHPVTSDVEETLSRSQPPSVDEVERLLDKAESPFEVDERLAELADELQTEYPNHEVTATVVNAVEGPSQPSDERVGELIEEAEQLLEGVDEQLRRIRETMNELDDGSVVVVESLD

SEQ ID NO: 740 - protein, 1235 aa, Halobacterium salinarum
MLTTLGNLVDKYPQEEPRFLYISATFGSGKTHLLKLIGFAADTESEFADLGEELASRWPGFQSFRQSVADSHVDRLKPVFLNLLNRDASQEPPLPYLIYEAIGRELGYPTDPNWLLEWAWQLDMNHGDCWERLQEVDHDGQTFEDVYDERASLRSWLYDAVPTLDDSPFASREEVKQSIDDAIEEVDPDEFDPDELVDRVEAAQELLSTPETETELLIGLDEVALFIGDGRHRYREFQETMEALTELGVGPNPPVIGTGQYPIERIHGEFDDTEVTAQPWYGAQEPLEGADTEIIVRKRWLQKDAEGGQAVESALQEMPDLTLDADSDIAGADPDAVGSYPFREYDLGLLRTVIQQLMPQGRVTEEEYVQGRALLILVRSLFTRFEWGDKQVGALVTWDELYDLLVEETTYIPLWVQEMVENKLIPSAGGDEDASSVRVAKALYLLNQVRSEVPSTPANLARLMVKSTDESFESVRDDVESALSGLLKDRKVLTETNDRGDEEYLLVSEEQEDILTRAKTRAQQIPSHRLSAKLENSIREGSNLLLSEGSRHEVGLEGERKVPLRFGYSVLDPIEQAPTPEFDAVRVRLVAGRDEEVSDQVDAWQSTNEGRDGGEHVLVAVELQGSTIDRLGDVMGMQEVLSEETETYPDLESDHRDEQRALESAIREQLEEAGVYVRTGGTRGRYGDVFEQVVETQVRSVFSGTRFVLTNGITEVEDAKQMAGFFRGVDDWPLSSEDAVTLGVDTDRAELADGWCQEFLDEYEDTQSLRAEDLLTRTVQRGGTYRGTPQESISALLITLATANKIALRRDDEYITEPDEIGRAVRNKTNLTDVLIRFESLDGIDPDQIRETVETLIGEEPDGTEPDAWLSELATWVDENSVLVKRVLRGVSREFGEGASLDELETALQPALGGESLETDDFASDEIARQSERFARARGLFRSTEDGDTLWEQFSQRTMEMQRLHPGADITGKMQDIVGGDEVPDADRLRATTDEADAHRRTVVREQYERITGESPADEEPESVVSSLATWLYAHDGSSKETANRVAVEFDGVTIDDLYELFETAWNGDSFSEEDLVDPTVVQQAKRYKRARGLLEASGSEASLWSQLREASERLEEEYPNHPVTTDVNEMLSRSQPPSVDEVEQLLDDAENPFEVDERLEELANDLQSEYPDHDLTQEVVDAVEGTSPTSEERVGELIEGAEQLLDGVDEQLRRIRETMDELPDGSVMMIEPLD

SEQ ID NO: 741 - protein, 1188 aa, Halobacterium salinarum
MTEESEDFMSDFFSRLLGRSEDMRSGANYWLYGYYGSGKSHLLSVLRGLLDREWLRQRDDVWEQLTDGRELETLESTWSSIHDEYEVIPISVNLLKHQGQKKLSFSEIVLRSAHTSERLTGSKGGLSSQLDVAFFEDWYRTTDAWDDRTANTQTALRSTVDSPEKYDWEDVQQYNALADAVLPTLFEQETGTVDGLDDLMPSDLDPQAMVERLEQLRSDREEELDHPVKLVLLLDEVSLFIGTDFDRLTELQTLAESVDETGDGDIQLVATAQAKIEDVQPQFAARGADFSIVKDRFPHRFGLPSRHVGEISTQRLLKKSETGKGNAERVLDQTSNEPETLLVYSGIEQNTDPPLDDIDRERLIKFYPFLPYQPPLFLEILSNLRQEAHDPAKSIFSGTARAILALVHGLLQEWIEVGNETNVISLVDFYDLIEPELDDITPQDVGVIEEIEEQYETGELEEIDVDVAKAVLLLQHIPDIIPMSERNLAVAVLSDLDGPTQFQMENRVEDSLQRLRKFIRPTHDEAGPKYAFTHPEEREIIEASEQNLDNPDWRSIIEAVDGYLWEDIVRDLSLPTSAEYPDTGEQYSVRYEFSIDGIELDTAVDVEDALGVEVAVEGISPAAADVDYNGDPLEWTIGQDGLDDLRDSLIEWWSLRAAVGDHTLPQSVERDLSDRAARVQSKLVEALKTGTFDVKDRGDQIGGMISGVEEYLDVNYPDDFHPVMLQVGDEHLQELRGLSAQDPLPTWAQQIDVATEDPETHGGSIQNNVRAFTGRQLKQRGGNLAMATILDGIVKKKPIYEDARPALCSIIWGLCRKGDFLPIDETGDSLELDAVIDLDKLTTTRLKIAGGGGVRGILRDGGFIDSTDTIPDGIVRLQSANDTLAGRIGSLVEDVRLVAESDAQTRQVRNLLESFVEELEAEQQSAIDRREAVKSRDTDWEDVVEATNDAQEWYDDAEEVWSLRLPALTRIDAQLTLAQQSYDWLTEECETASQTLRESIDGYEGEWWTHDGWDRFNDAQTTSPALNDAIETAWDSFQAESEFDAFVDELQEHPWIQPASEFGSNVRPAFESKYITPLRRAASWHEDISDAVSTVIGGTTNTEADDFIRATNTLLDSEPLAVVADSDIDGLRDTFEELQTLVGDQSPTDITAIGVLPSDRESLDSELERLVERHDLSIERTETGVIIR

SEQ ID NO: 742 - protein, 1270 aa, Halorubrum lacusprofundi
MSIRNLFRSDPTRQLEEVQKVNARERAETDVVEFYETKSAERVLTELGEVTETHPGEAARFLYLHATFGSGKTHLLKLIGLVADSESEFAHLGTELAEQWPGFDNLAQSIDASHVERLKPVFLNLLDRDASKEPPLPFLIFEAIGRELGYPTDPNWLLEWAWTVDMEYEGVWDALRTTAYDGQSFDDVLEERASLRRWLYEALPALAETTGTELDSREGVKASIERAEEEVDPGSFDPDELVERVETVTESLNEKGPNTELLLGLDEVALFVGDSRHRYREFEETMEALQHGPNPVVVTTGQYSLPATRESLIGKPSEDHWTHQQVPLEGADTEIIVRKRWLQKDSAGSSRVSSLLSSMPDLSLETYSPVGSADPDPVESYPFREYDLTLLRTVMQELITQGRATDRDYIQGRALLVLVRSLFTKFGWASAEEGDLVTWDELFDLLVEETTYVPLWVQEMLDNTLIPTFDGNEDAWEVRVSKALYLLNQTPAVPATPENLGRLMLDDVNASVDEAVADVQSALNTLVDKRKVLTETNDQGDEVYTLVSEEQESILTRAQTKAEQISPHQLSAWLETRLRENDDFFRSDSSLHEADVGDERLVPLRYEYSTLDSVDRAPTTEYDAIRIRVLADDPDTVPDQVETWQDVNDGRDGGEHILIAIDVPETTLDRIRNVIGMGQVLEAETESHDELEREQRTDKRRLESSVSDLLKNAAVHTVHDYRGERPSVLEDVVEDQVQAVFGSTRKVLSRPLVEVDDAKGLAKFFRGSGDWPLADSDAVMLGVDTSSTEIADTGWCRAFIDTYESQTAVDVETLLQQTRTANGDYRGTPQESIAALLITLATSNEKVALKQDTDYVTDPTAIGRHVRTKGGLTSLQVRFGVDTVNPKEIRKVVSTVLGHDPDGSDPDAWVAELASWVENNSVLVKRTFKGVSREFDVSLDALEGVLEPAYSGGDTTTSELVEDSVQSEAETFADARKLFAVDGGAKALWEQFTDTLDLLEELYPSATITSRMQTTAESGSVPTKTTVSSRLADATGHRVDELTSQYRRVTGERCDVSDPEEICVVLTEWIRENESVVQALLDDATATFDGISLDDLEAVFEMAWNDGEIGEGELVAAAVRQQAEAYEKVRDLLGGEKNPWEQLQSAYDGLQAEQPDSPTTESVETVLGSSRLPSIQRVRQLIEEAKNPKLPGADDDAWAELQRVAEELRRELPNADVTDDVTAAVDADDRPTDERATELLGEAEKLLSRIRAVRDALDDVDEGSIVLIEE

SEQ ID NO: 743 - protein, 1239 aa, Halorubrum lacusprofundi
MVDTSWFDDLPEDFEESVRIDRDEQDHRQRAIRSYHMTADSRRFIEDFVDRMLGQSDDMRTGSNYWLYGYYGSGKSHLLTVLDGLLDTDWLDGQQDAVWSDLVQISGDSEFEQLGDHWRTIHDEYYVIPISVNLLKYQGQKQRSFSEIVLRHAHQDADLTGVDDGISEGLSSQLDVAYFEKWFRTTDAWSDRQARAEAALDGVTTEASDYEWQSDGLWKDIQKYGALADVVLPKLFEEVNETRDGYTDLQPSDIDPEEVVGRLEELRTEREEELGKPVKLVLLLDEVSLFIGTDFERLTELQTLAENVDDIGDGDIQLVATAQAKIEDVQPKFAAHGADFSIVKDRFPHRYQLPSKHVGDIAKRRLFEKSEKGDVAVREVLDEASVKPTESLVYNEIKQNTKPPLDSIDDEELVEFYPFLPYHAPLFLEILFNLRQEASDPAKSIFSGTARAILALMHNLLQTWVDEGEADQVITLVEFYELVKPELREILTQDMRVIEGSEANRGIADEVEDGDLEEFDLDVAKAVLLLQHVHDIVPLNEGNIAVSVMSDLNGRSWISTQNRVEESLGRLQKFIRPMADETGARYRFATQEERIIYDDTEANEDDPDWDAVLHALDEHLWGRITQDLSLPESVPYGDSGDEYPVMYGFGLDGTGFETTVDVEGGLDVPIEVQGVRPDHTSENSDEETLYWSIDTDGLDDLRKHLVKWWALRDAISTHNAPTAVEQDLDRRADAVRSKLVSAMQSGSYTVKDRTDISGLSTAVQTAVDVGYPDDFHPMMLQVTDDRLQELVELSTEDPLPAWAHTIQVPSSDPSASQGKKSIQRNVMSLTGRQLKDRDDGLNMNTVLDGITSKKPFYDEARPALCAIIWGFCREGRLVPVDEDGNTLENSAVLDQDHLSTTRLKLLPREPIGKLLESGGFKQTTETVTDGLINLQEANQQLRSSLTGLQEDVQLVLDTDVHSGAVSGLLEAFIEELTDRTSTTTERLSVVRSQGNGLADAIEQTNDVQEWFDEVSDVWNRRLASLYRFDAQLTAGNDRFEWVDDDAQSAVTAQRDALKNFDGGWWTTDGWKALVEDTTTGLGTELQRSWEAHLDQQEISEFVERIADHPWVIPATDLPTGVQVAMEHEYITPLRELRRWYETVDGAIASLSSDDEDALLSAADDFADVEPLSEAVDYDVEELEGRLDRLAEIVGDRGPDEIDQIGVLPDDRQNIDRRLERLVESRELDIETTDSGVIIR

SEQ ID NO: 744 - protein, 1280 aa, Haloarcula hispanica
MSDTHIHDIFQQSPTRELEEVQKVNARAQAENDVREFYETDSARDVLTTLGDLVDKYPHEQPRFLYISATFGSGKTHLLKLIGFAADTESEFTDLGEELANRWPGFQSFRQSVADSHVDRLKPVFLNLLNRDAAQEPPLPYLIYEAIGRELGYPTDPNWLLEWAWQLDMNHGDCWERLQQVEHDGQTFEDVYDERASLRSWLYDAVPTLDDSPFASRAEVKQSIDDAIEEVDPGEFDSADLVERIEAAQASLSTPETETELLIGLDEVALFIGDGRHRYREFQETMEALTELGVGPNPPVIGTGQYPIERIHGEFDDTEVTEQPWYGAQEPLEGADTEIIVRKRWLQKDVEGGQAVETALREMPDLTLDAYTDIAGADPDAVESYPFREYDLGLLRTVIQQLMPRGRVTEEEYVQGRALLILVRSLFTRFEWGDKRVGALVTWDELYDLLVEETTYVPLWVQEMVENKLVPSAGGDENSFSVRVAKALYLLNQVRSAVPSTPANLARLMVTSTDESFESVRDDVESALSALLKDRKVLTETNDRGDEEYLLVSEEQEDILTRAKTRARQIPSHRLSAKLENSIREGSDRLLSAGSRHEVDFEGERKVPLRFGYSVLDPIEQAPTPEFDAVRVRLVANRDAEISDQVTAWQATNEGRDGGEHILVAVSLQQSTIDRLRDVMGMQEVLSEETDTYPDLESDHRDEQRALESTIREQLKEADVYVRTGGTRGRYEDAFEQVVQTEVQSVFSGTRFVLTNGITEVDDARRMAQFFRGVADWPLTSEDAVTLGVDTDRAELADGRCQEFLDEYADTQSLRAEDVLTQTVQRGGAYRGTPQESISALLITLATANEIALRRDDEYITEPEEIGRAVRNKTNLTEIQIRFESIGKIDPEQIRDTVETLIGDEPDGTDPDAWLSALAEWVDENSVLVKRVLRGVSREFGDGASLDELETALQPALGGESLETDAFASETVERQSERFARASGLFQPSEDGQSLWEQFSQRTVEMKRRYPGPDITGEMQAVIGGDEVPDADRLRALLEEADTHRRTVVRAQYERITGGPPTDEEPESVVSSLATWLYAHDGSSKETADRVAVEFDGVTIDDLYDLFETAWRGDSFSEEALVDPTVVQQAKRYERARRLLETSGGEASLWSQLRDASKRLAEDHPNHPVTADVSEMLSRSQPPSVDDVEQLLDAAENPFEVDERLEELASELQSEYPDHDLTQEVVNAVEGTSPPSEERVGELVEDAEQLLDGVDEQLRRIRETMDELPDGSVMVIESLD

SEQ ID NO: 745 - protein, 1227 aa, Haloarcula hispanica
MTDEGWFAADVGSDFEESVRIDREDDGRDHRLESIDTYHVTEESEEFISDFFSRLLGRSEDMRSGANYWLYGYYGSGKSHLLSVLRGLLDSEWLRQRDDVWERLPDGRSLETLESTWSSIHEEYEVIPVSVNLLKHQGQKKLSFSEIVLRSAHTSERLTGAEGGLSSQLDVAFFEDWYRTTDAWADRTANTHTALRGTVDSPEKYNWEDVQQYNALADAVLPTLFEQETGTADGLDDLMPSDLDPQAMVERLEQLRSDREAELGRPVKLVLLLDEVSLFIGTDFDRLTELQTLAESVDETGDGDIQLVATAQAKIEDVQPQFAARGADFSIVKDRFPHRFGLPSRHVGEISTQRLLKKSEAGREDTERVLDRTSNEPETLLVYSGIEQNTEPPLDNIDRERLIEFYPFLPYQPPLFLEILSNLRQEAHDPAKSIFSGTARAILALVHGLLQEWLEAGDETHVISLVDFYDLIEPELDDITPQDVGVIEEIEEQHEAGELEEIDVAVAKAVLLLQHIPDTIPMSERNLAVAVLSDLDGPTQFQMENRVEDSLQRLRKFIRPTHDETGPKYAFTHPEEREIIEAAERNLDNPDWQSIIEAVDGYLWDDIVRDLSLPTSAEYGETGEQYPVRYGFSIDGIELDTTVDAADALDVEVAVRGISPAATDVDHDGDPLEWTIGQDGLDDLRDSLIEWWSLRDAVGDHTLPQSVERDLSDRAARVQSKLVGALDSGAFDVKDRGDQIGGMGSGVEEYLDVTYPDDFHPVMLQVGDEHLQELQRLSAQDPLPAWARQIDVATEDPETHGGSIQNNVRAFTGRQLKQRGGNLAMATILDGIVKKKPIYEDARPALCAIIWGLCRKGDFLPVDETGDSLELDAVIDLNKLTTTRLKIAGSGGVRGILREGGFIDSTETIPDGIVRLQSANDTLAGRLGSLVEDVKLVAESDIQTRAVRTLLKSFAGALEAEQQSAIDRREAVKSRNTDWAAVVEATNDAQGWYDDAEEVWNLRLPALTRIDAQLTLAQQSYDWLTEECDTASQTLRGSIDGYEGEWWTHDGWDRFNDAQTTAPALNDAIGTAWDSFREETGVDAFVDELQAHPWIQPLSEFESNVRPAFESEYITPLRRAASWYADVSNAVSTVTGGTTNAEADDFIRATNALLDNDPLAVVAGSDIGDLRATFEELQTLVGEQSPADVTAIGVLPSDRESLDSELERLVEHHDLSVERTETGVIIR

SEQ ID NO: 746 - protein, 1239 aa, halophilic archaeon
MVDTSWFDDLPEDFEESVRIDRDEQDHRQRAIRSYHMTADSRRFIEDFVDRMLGQSDDMRTGSNYWLYGYYGSGKSHLLTVLDGLLDTDWLDGQQDAVWSDLVQISGDSEFEQLGDHWRTIHDEYYVIPISVNLLKYQGQKQRSFSEIVLRHAHQDADLTGVDDGISEGLSSQLDVAYFEKWFRTTDAWSDRQARAEAALDGVTTEASDYEWQSDGLWKDIQKYGALADVVLPKLFEEVNETRDGYTDLQPSDIDPEEVVGRLEELRTEREEELGKPVKLVLLLDEVSLFIGTDFERLTELQTLAENVDDIGDGDIQLVATAQAKIEDVQPKFAAHGADFSIVKDRFPHRYQLPSKHVGDIAKRRLFEKSEKGDVAVREVLDEASVKPTESLVYNEIKQNTKPPLDSIDDEELVEFYPFLPYHAPLFLEILFNLRQEASDPAKSIFSGTARAILALMHNLLQTWVDEGEADQVITLVEFYELVKPELREILTQDMRVIEGSEANRGIADEVEDGDLEEFDLDVAKAVLLLQHVHDIVPLNEGNIAVSVMSDLNGRSWISTQNRVEESLGRLQKFIRPMADETGARYRFATQEERIIYDDTEANEDDPDWDAVLQGLDEHLWGRITQDLSLPESVPYDDSGDEYPVTYGFGLDGTDFETTVDADGGLDVTIEVHGVRPDHTSESDAEETLYWSIDTDGLDDLRKHLVKWWALRDAIATHNAPPAVELDLDRRANAVRSKLVSAMQSGSYTVKDRTDISGLSTAVQTAVGVGYPDDFHPMMLQVTEDRLQELAELSTEDPLPAWAHTIQVPSSDPSASQGKKSIQRNVMALTGRQLKDRDDGLNMNTVLDGITSKKPFYDEARPALYAIIWGFCREGRLVPVDEDGNTLENSVVLDQDRLSTTRLKLLPREPIGKLLEAGGFKKTTETVTDGLINLQEANQQLRSSLTGLQEDVQLVLDTDVYSSAVSGILEAFIEELTDRISTTTERLSVVRSQGDGLGDAIEQTNEVQDWFDEVRDVWNRRLASLYRFDVQLTAGNGRFEWADDDAQSEITAQRDALVDFDGSWWTTDGWKAFVADTTSGLGTELQRSWEAYLDQQGISEFVDRIADHPWVIPAPELPTGVQVAMEREYITPLRELRRWHETVDGAIASLSSDDEDALLSAADDFADVEPLSETVEYDVDELEGRLDRLTEIVGDRGPDEIDQIGVLPDDRQNIDRRLERLVESRELDIDVTDSGVIIR

SEQ ID NO: 747 - protein, 1270 aa, halophilic archaeon
MSISNLFHSDPTRQLEEVQKVNARERAETDVAEFYETKSAERVLTELGDVIETHPGEAARFLYLHATFGSGKTHLLKLIGLVADTESEFAHLGTELAEQWPGFDNLAQSIESSHVERLKPVFLNLLDRDASKEPPLPFLIFEAIGRELGYPTDPNWLLEWAWTVDMEYDGVWDALQTTEHDGQTFEDVLEERASLRRWLYEALPALSETTGTELDSRDGVKASIERAEAEVDPESFDPAELVERVETVTAALNEEGPHTELLLGLDEVALFVGDSRHRYREFEETMEALQHGPNPVVVTTGQYSLPDTRESLIGKPSEDHWTHQQVPLEGADTEIIVRKRWLQKDSAGSSRVSSLISSMPDLSLEAYSPVGSADPDPVESYPFREYDLTLLRKVMQELITQGRATERDYIQGRALLVLVRSLFTKFGWADAEEGALVTWDELFDLLVEETTYVPLWVQEMLDNTLIPTFDGDEDAWEVCVSKALYLLNQTPAVPATPDNLGRLMLDDVNASVDQRVEETQSALNTLVDKRKVLTETNDQGDEVYTLVSEEQESVLSRAQTKAERISPHQLSAWLETRLREGDDFFRSDSSLHEAGVGDKRLVPLRYEYSILDPVGRAPTTEYDAVRIRVLADDPDTVSDQVETWQNVNDGRDGGEHILIAIDVPEPTLDRIRNAIGMGQVLEEETESHEELEREHRTDKRRLESSVSDLLENAAVHTVHDYRGERPSVLDEVVEDQVQAVFGSTRKVLSRPLVEVDDAKGLAKFFRGSGDWPLADSDAVMLGVDTSSTEIADTGWCRAFIDTYESQTAVDVETLLQQTRTANGDYRGTPQESIAALLITLATSNEKVALKQDTDYVTDPTAIGRHVRTKGGLTSLQVRFGVDTVNPKEIRKVVSTVLGHDPDGSDPDAWVAELASWVENNSVLVKRTFKGVSREFDVSLDALEGVLEPAYSGGDTTTSELVEDSVQSEAETFADARKLFAVDGGAKALWEQFTDTLDLLEELYPSATITSRMQTTAESGSVPTKTTVSSRLADATGHRVDELTSQYRRVTGERCDVSDPEEICVVLTEWIRENESVVQALLDDATATFDGISLDDLEAVFEMAWNDGEIGEGELVAAAVRQQAEAYEKVRDLLGGEKNPWEQLQSAYDGLQAEQPDSPTTESVETVLGSSRLPSIQRVRQLIEEAKNPKLPGADDDAWAELQRVAEELRRELPNADVTDDVTAAVDADDRPTDERATELLGEAEKLLSRIRAVRDALDDVDEGSIVLIEE

SEQ ID NO: 748 - protein, 1248 aa, Natrinema pellirubrum
MVDTTWFEDLPEDFEESVRIDREDQSADEKRHRKQAIESYHVTADSQRFLEDFVKRLLGEAEDMRTGSNYWLYGYYGSGKSHLLTVLDGLMDTQWLQDRSDEVWRNLVPDASASGDLDTLRTQWESVHSEYHVIPVSVNLLKYQGQKQRSFSEIVLRHAHQNPILTGVNNGVSTGLSSQLDVAYFEDWYQTTDAWPEREDRAASVVEGVTPDQPRYEWGTDGLWTDVQEYSALSDVVLPKLFEGVTGTRDGYTDLQPSDIDPEEVVSRLESLRLEREAELEQPVKLVLLLDEVSLFIGTDFERLTELQTLAENVDDIGDGDIQLVATAQAKIEDVQPKFAAHGADFSIVKDRFPHRYQLPSKHVGDIAKRRLFQKSETGEDAVRRVLDDADVKPSESLVYNEIKQNTKPALDAIDDEELVEFYPFLPYHAPLFLEILFNLRREANDPAKSIFSGTARAILALMHGLLDDWVDEGRGDHIVSLVDFFELIEPELREILPQDMRVVEGAEETTGIADEVGDDESELQEFDLDVAKAVLLLQHVHEIVPLNEGNIAVAVMDNLNGQSWISTTNRVEESLDRLQKFIRPTQDESGPRYRFATQEERLIYDETEENEADPDWDDVVNTLDEHLWNRITQDLSLPESVPYGESSDEYPVSYHFGLDGTTFESSIEAEGGLDIDVDVQGVRPDIEPEQTDEDTLYWEIDTDGLQDLRKRMIEWWALRDAIATRDAPPAVERDLEQRANAVRSKLTSAMMSGSYSVKDRTDIGGLSKAIQATVNVAYPDDFHPMMLQVDESRLRELRELDSDAPLPPWARTIQVPSSNHNGGQGKQTIQRNVMSLTGRQLKGRDEGLNMNTVLDGIVEEKPFYDEARPALCAIIWGFCREGRLLPIDEDGNTLEDEAVLDLDSLSTTRLKLLPRTNLSKLLEEGGFKETTETVADGLIHLQEANQHIRSKLTGLREDVTLVVDTDVRTDEVAGLLNAFADELAERINTTENRISTVKSQDDGIEDVIDETNEAQEWVEEVTDVWNRRLSTLQQLDAVLTIRNRQFDWVDDDAQASIESRSSAVSSFDGEWWTTDGWSTLSGELVPDLAPELERSWNAFVDERGLRELVSRIEEHPWILPATDLPAGVHVAFEGEYITPMRHLQQWYETIESAITVLSTDADSDDIVEITDDVAQLEPLAETIEYSPSELDDRLDELSSIVGDRTPDDVDQIGIVPDDRQKLNRRLERLVEQQDLDIEETDEGVIIR

SEQ ID NO: 749 - protein, 1277 aa, Natrinema pellirubrum
MTIDDLFHSDPTRQLEEVQKVNARERAETDVREFYETDSAEQVLETLGEAIQTHPGEAARFLYIHATFGSGKTHLLKLVGLLADDESEFAYLGDRLAEQWPGFDELQQSITDSHVDRLKPVFLNLLDRDASKEPPLPFLIFEAIGRDLGYPTDPNWLLEWAWTLDMEYDGVWEALRTFEHDGKTFDKVLAERASLRSWLYEALPAMEETSGTELNSRSGVKASIETAEADVDPEEFDPEDLVSRVETATAALNGGSKRTELLLGLDEVALFVGDSRHRYREFEETMEALQRGPNPVVVTTGQYSLPDTRESLIGEPPEDHWTHQQVRLEGADTEIIVRKRWLQKSDPEGRERVESLVASMPDLSLDTYSSVTSADPDPVESYPFREYDLSLLRAVMQELITQGRSTDRDYIQGRALLVLVRSLFTKFGWASKEEGSLVTWDVLFDLLVEETTYLPLWVQEMIDNTLVPTFDGDEDAWEVRLAKGLYLLNQTPAVPSTPENLGRLMVDDVTASVDDVVEQTESGLETLVDKQKALTETNDQGDEVYTLVSEEQESILSRAQDKAAKISPHQLSAWVETRLRENDAFFRSDGSRHEVDVGDERLVPLRYEYSILEPVDRAPSPEYDALRVRVLADDHDTVSEQIETWQDVNNGRDGGEHILITVDVPETMLERIRNVIGMGQVLDEETESHEELEREHRADKRRLESSVTEILKDASVYTVHEHRGARSSVLDSVVEDQVNAVFGSSRKTLSRPLVEVDDAKAMAKFFRGSGEWPLSDADAAMLGVDTVTAEVADTGWCREFIETYEAQKSVDVETILQQTQTANGDYRGTPQESIAALLITLATSNESVALKQDTEYVSDPAAIGRQVRTKGGLTSLQVRFGVEVIDPKTVRELVTTVLGEQPSGDGPDEWLDELGQWVNENSATVKRTLKGASREFDVTLSAFEATVDPALGGDELSTSDLGSEDDLETVLEEAKIFANARELFGVSEDGATLWERFSDELDTMASLYPNASITASMRATAEGETVPSVSTVESRLEDAKGHRVDETSAQYRRITGETVADSDPEAICADLSAWLRSNEDDVRGIVDGATDEFDDVVLGDLEDVFEAVWADEELSEGDVVDSAVVQQAETYDQVRDLFDDSDGSALWSQLQAAGEELREEHPDSPTTESVETTLAASRPPSKRRVRQLIERAKDPRPPGADDDAWAELQMVAEELRQELPNAEVTDDVTAAVDADERPSEERVNELLSEAKKVLKRIQGVNERLDGLEDGSIVLLED

SEQ ID NO: 750 - protein, 1208 aa, Planctomyces limnophilus
MSSPALIRHLFRQDVTRDIPPVVYFHEQSPGKVQDEVSEYIITGGWNKDHPNFKRVPDGIHEQYVRLLNAISREMEKNGGPSLPAAWISGFYGSGKSSFAKLLGLSLDGLELPNGQSLAEALLARDLSDRAQEFRDAWKKLRQLIAEPFAVVFDIGGFARDNEHIHTACVRQVQKRLGYCANLPLVANFELRLEKAGEWTRFLEVSDQIGHPWEQEKDQPFADEVFSEILHHFDKDRYTNPMSWIDSRAGTTVTDSPTEAVCAISDMMRLRKPDGTLFIVVDEVSQYVLSHEQRVDKLRAFASELGSQLKGKVWLLALGQQKIDEDAGDAFLVWAKDRFPQQLRVHLAATNIRDVVHRRLLQKTEAGAKDLRKRFEKHRPDLKLFAFGCEDVSADEFVEVYPLLPGQIDLLLQITSAMRIRSARAQGDDQAIRGLLQLLGELFRDQNLADLPVGNLITLDTIYEIQKTALDSDTQASMARILNETANRAPMLQRVAKAVALLELIQDTRPTDAKLVAQCLYDRMDRGNQVNEVTEALEELRRDNLLAFSEKLGYRIQSTAGEEWEREKREIRASREVISEIIRDALQMVMEKPEKPAFKKRPFPWAALFSDGKGMDDDKLVRAKDEAVVCVDFRFAQPDERSESVWIERSNEVNLHDRLIWVCGDTNDLTDRARALARARGMAKRYAPRRDSLSEQRKLLLQQEEVKSETLESDIQDIVESAWLAGTIYFRGKTYKPDDFGSKFAGALLKVAERVMPILYKEFDPITLQPSELDQLLIQELSGPSTRFLKDELGILELDAGKYVPTCSGLIPTRIRELIESEDGATGAHLLSKFAGPPYAYQAEVIKACVIGLLRGSKIKIEDGEGNEITAVRDAGVRDVFEKPTAFRKAQFIPVGDDDIGVRARARICKFFDEQLGTPLDREDNAIADAVEKKFHPLASDLRDVLVRFDRVPGNRETPTELTRLNSALEQCLSKIRNTKETLKRVKKHLDDLVDGVKLLKRFGAELTEDSLRLLRDAHNVATNQAAQLRELGTLTGPAQECAERIAEQLASSRPWVDALAIQPDLDVVCQAYREERTRLLEWQEQQAEQARARIRMRDGYSTLPSEKGHNVLRPINNSCSDTTAAAIAPALRDLKDPFTVRLQAAEEQANRLLDEYLSGGSKPMIVPVDLSLHNREIKSEADVDALVEEIRERLLQQLRSGQRIRLL

SEQ ID NO: 751 - protein, 1206 aa, Anaeromyxobacter dehalogenans
MKIQDLFVADVTRDIPPVVYFHEQSPEKLQAEVAEYIITGGYRDGHPQARRLKAGIHEQFVHLLRAIVSEQAKPNGPELPASWISGFYGSGKSSFAKLLGLALNDARLPGGKPLVDALIARDESPLRQEFVEAWKALRAALDPIAVVFDIGGVARDDEHIHVAALRQIQVRLGYCSKSHLVAAHELMLERDGEWDVFLAAAEKTLGRPWSKAKEDQQADDHFSHVLSVLHPERYRDPMTWIDSRAGSKTGAGTAVKEVVDSIEAMLSIRAPGKALFIVVDEVSQYVHQDDNRMLKLQSFVSELGQRLKGAVWLFATGQQKLEDTSQADNIGKLKDRFPLPLRVHLHPSNIRDVVHKRLLAKRKDREALLRELFQKHRSDLKLNAYGCEEITEEDFLEVYPMLPGQVDLLMKITSSLRTRSTRVQGDDHAIRGLLQLLGELFREQRLGEHEVGELVTLDAIFEVQHSALEADVQTTLARIFDHADVRDDALAQRAARAVALLELIQEQEPTTPELVARCLYRRLGDGSQVQAVGQALERLRESNLVAYSEKLGFKIQSSAGQEWEHEREDIPVTGEQVSEVVRTKLKELLAMPELPRYKGCSFPWAALYSDGRQLADERVQGTNANAAVTVDFRFLRVKDDRTSTTWIQRSDKEPLTDRLLWLVGDPGPIESIAREYARSDHMVKRYGVRRESLTKEKGRLLLEEEARYEELEKKVKAAVADAFLDGTMFFRGRPLEARTLGSAFATALSAAATRILPDLYPHFVDVAISDAELNQLLERHLNGPSNKFMEGRLGILSLDAGRYVATCAGAEPARILQYVENANGASGATIISHFGGPPYGYPVDVVRACLAGLLRAGKIRIRPDGEPEITSVNDPGTRDLFRRDRDLRRADVFPAREGAITARDKVAIATFFKTHLELDLERENDAFADAVYQQFPGRRERLREVEALYDRLPGRPALPAALERLGKALEDCRRSRQVEETVLALKRNLDALRDGLEQLAIIRAELTDDALHALARAAQVRDVELEQLRQVEALGGVEEDGRALAEHLSGERPWRGIADAAPAAARIHERYVEARRALLNRQNAEAEAARGRVKARSGFEKLSADQAHHVLRPVAEALFDTAADAVAPALADLQARFPQRLAAAEELAQERLDDAIAKLTESQVVKLEAGLRGREIKSRDELKTVLRELEERIGAEIDKGRRIRLV

SEQ ID NO: 752 - protein, 1207 aa, Haliangium ochraceum
MLIRDLFASDVTRDIPPVVYFHEQTPQKLADEVGEYIITGGWPESHPNHRRVPDGIHEQYLRLLTGVAAELDKPGGPELPTAWISGFYGSGKSSFAKLLGLALDGVALPDGTSLAEAWLRRDTSPRAGELRAAWDALRQKIDPLAVVFDIGGAARDGEHVHAAALRQLQRRLGYCSTEPLVADFELKLERDGVYQRFQSVAAEVLGGPWSEKKDNALAEEDFSRVMSELFPDTYTDPMSWYTSRAGTHSRSESPEEAVRAIGDMLRFRRPGATLFLVVDEVSQYVLGHQDRIDRLRAFANALGSGLKGQAWLFALGQQKIDEGAGDAFLVWAKDRFPPRLRVHLANTNIRDVVHKRLLAKTHVAQDQLRALFERHRHDLKLFAYRCDEVTPEEFIDTYPMLPGHIDLILQLTSALRTRSKRAQGDDQAIRGLLQLLGELFRDQRLAERDVGALVTLEQIYEVQHTALDSDVQASMARILERCTSDESGLLVRVAKVVALLELIQDTEPTTAALVAQCLYDRVDRGNRLSEITDALEALRRDNLLGYSQKAGYKLQSSAAEEWERERRDIPVARETISDAVKDALLHLLAGPERARLEGRPFPWAAVFSDGRRADDAALIDPRDEAVVRVDLRFLTAADEREGSVWVKRSGESALRDRLVWVVGDTGQIDSKARDLARSQAMVRRHKAARESLAPARRLLLQQEENRVEDLERELRDTAAESWLAGGLYFRGRALPPGEHGASFATALSAVAARILPELFPHFIATQVQPSELALLLASELSGPPPKFLGDELGILELDGGRYVPACSGVVARRVLEHIDSEGGLAGTSLLAHFGRPPYGYTAEVVKACVAGLLRGSKVRIQPDAGDEITAVRDAGVREVFDKDRAFRRASYFPAGDDDIGFQARARICKFFQTALDHPLDREDNAIADAVAADFPPLSERLRHVLARHRQIPHAPDPPPELAPLDDALAKCVAKARQTKPAVKLVKRHLDTLREGVQTLNAMDAELTPEAIDQVRAAFDVRDHLLAQLRELGALAPDDQAAADRLSEHLRGRKPWLDIVGLAPELERLRASYREQRQRLLSEQSTRCEQARAEVKTRAGFSTLSADQAHHVLRPIAQALSDTTAEAVAPPLSALSGAFVHRLHAAEREANERLDAILSEGDRPVIQTLRLELRNRELASEADLRALLDELEQRLRAALETGARIRLV

SEQ ID NO: 753 - protein, 1207 aa, Haliangium ochraceum
MLIRDLFVSDVTRDIPPVVYFHEQTPQKLADEVGEYIITGGWPEPHPNHRRVPDGIHEQYLRLLTGVAAELDKPGGPELPTAWISGFYGSGKSSFAKLLGLALDGVALPDGTSLAEAWLRRDTSPRAAELRAAWDALRQKIDPLAVVFDIGGAARDGEHVHAAALRQLQRRLGYCSTDPLVADFELKLERDGVYQRFQSVAAEVLGGPWSEKKDNALAEEDFSRVMSELFPDTYTDPMSWYTSRAGTHSRSESPEEAVRAIGDMLRFRRPGATLFLVVDEVSQYVLGHQDRIDRLRAFANALGSGLKGQAWLFALGQQKIDEDAGDAFLVWAKDRFPPRLRVHLANTNIRDVVHKRLLAKTHAAQDQLRALFERHRHDLKLFAYRCDEVTPEEFIDTYPMLPGHIDLILQLTSALRTRSKRAQGDDQAIRGLLQLLGELFRDQRLAERDVGALVTLEQIYEVQHTALDSDVQASMARILERCTSDESGLLVRVAKVVALLELIQDTEPTTAALVAQCLYDRVDRGNRLSEITDALEALRRDNLLGYSQKTGYKLQSSAAEEWERERRDIPVARETISDAVKDALLHLLAGPERARLEGRPFPWAAVFSDGRRADDAALIDPRDEAVVRVDLRFLTAADEREGSVWVKRSGESALRDRLVWVVGDTGQIDSKARDLARSQAMVRRHKAARESLAPARRLLLQQEENRVEDLERELRDTAAESWLAGGLYFRGRALPPGEHGASFATALSAVAARILPELFPHFIATQVQPSELALLLAPELSGPPPKFLGDELGILELDGGRYVPACSGVVARRVLEHIDSEGGLAGTSLLAHFGRPPYGYTAEVVKACVAGLLRGSKVRIQPDAGDEITAVRDAGVREVFDKDRAFRRASYFPAGDDDIGFQARARICKFFQTALDHPLDREDNAIADAVAADFPPLSERLRHVLARHRQIPHAPDPPPELAPLDDALAKCVAKARQTKPAVKLVKRHLDTLREGVQTLNAMDAELTPEAIDQVRAAFDVRDHLLAQLRELGALAPDDQAAADRLSEHLRGRKPWLDIVGLAPELERLRASYREQRQRLLSEQSTRCEQARAEVKTRAGFSTLSADQAHHVLRPIAQALSDTTAEAVAPPLSALSGAFVHRLHSAELEANERLDAILSEGDRPVIQTLRLELRNRELASEADLRALLDELEQRLRAALETGARIRLV

SEQ ID NO: 754 - protein, 1215 aa, Acetohalobium arabaticum
MQVKDLINFDEIKDVIDIDSDLENEESCKALVDKYIISERLRGYLQEIAEDLAQPKHKSCQIIGSYGSGKSHLLAFLSALLDNPDFSSYIQDEKVREAFESNLNRRFAVVQFELQAGRTDLSHYFYDRVEMKLRDKYGIEIPSVDPDQVFDHKEKVREILGKVKEVDPQMGLVVIIDEISDFLKQKVKKEKKHRDTQFMRVLAQASQTMDFMLIGSMQEDILTDPEFNDEADSFGRTSERYRIVTISKEDIKKVVSQRALNKSLEQREELEELLTDYGQQIEEVHSKIDEFIDLYPVHPYVIEVFNQLPYFEKRGVIQFTVDEVKKILDEEFPAFITYDRIFDLIASKHTVKSLDEVAEVVKAIDTLNSKIPLLRDNLQEDARRIVKALAVLKLYGQTANNGATPEELANELLIISDKFSGADRIEMVLNKLREVTDGQFIAKSENNYYYIDLEHTRDYDVIIKRKTEDLYDGATDEELVKVLKSVFELDSDSDYDRVYDDYSYWPDKKSFRYGSFIYDDGSSEVEKGDGDFNFVFVSPYRDRTTIKQDGSTAVLNLEYDDELDTLLKKAAALTSLIKNSPYPKNIMRSRLKTCKGELKEKLLDKVINTEIENGTSYAGAGGLLSQQPDTLMEYYYEIKPALFGAYFSEKYDKYPKLANQLTPENIRGEVERTIKDILGSGEQVTVSNSQNLLKALQLLDSDNYPDSNNSPYAKLILKKLNNNKGKNVKIEEIVEELAGKPYGLNRELVYLILVVLTYNGETNLKKHGGKTVTAADLKDVLSSGLDAFDEISYITLETDFPVNEVAKVLRVLDINPGLIKQKKNRKDALKQFKNEVGDIENKINEVDQQLSNLKIKAKPNEHIDLDALLAKRSGIDNIPIEKFSKVKTVPGLKKIVLDDFELEELEIGLKFLDNFIEFLADFEEKIYDPYIHLKESMDFIKEYRNFFADEDIAALEEIADKCDEIVDDLSTLLEHDERRILKGKLQQYQRKYREIYYQTHEQKVGAGVEWSKLEKIKNNQELQQLKVLKDVRGLDTADFKRLQMKINKLSRAKCDSLEEEYLSGNYKCPYCQFPEFDASSLKDIDDTLDEMWDEIYDIKDEWEAQILEEIKNYEDNIRLLDQAEKEVIEEIQSAKTLPDKIDRELVKALNNLFSELEEIEVSGAEIEEIIFANGGVLDYDDFANKLEEVKEKILTQGDRTNLRIKRPADDREEEE

SEQ ID NO: 755 - protein, 1243 aa, Acidothermus cellulolyticus
MRYADLIQFEPIESVVQLRDADEVTSARQLVCTYVISDEMAEKLTGLVIPQLQFDQPADNKGLLVVGNYGTGKSHLMSVISSIAEHADLLSALDNAQVAQAARAIAGKFKVVRTEIGYTTMSLRDILVGELEEHLAAMGVTYTFPHASQVPNNKRAFEEMMAAFHAEFPDHGLLLVVDELLDYLRGRPDQALILDLNFLREVGEVCKDLRFRFMAGVQEAIFDSPRLAFAAESIRRVKDRFEQILIARKDVKFVVAERLLRKTGEQQAKIREHLTPFAKFYGHMNERMDEFVRLFPVHPDYIDTFERITAVEKREVLKTISLAMKTLHDQEVPEDRPGLIAYDSYWTSLRENPSFRAVPDIKAVIDCSQVLESRIEQAFTRPAYKPMALRIIHALSVHRLTTGDIYAPLGATAEELRDALCLYQPGIEELGGDPADDLLSQVETVLREIHRTVSGQFISSNPDNRQYYLDLKKTDDFDALIEKRAESLDASQLDRYYYEALKRVMECTDQTYVTGYKIWQHELEWLEHKAARQGYLFFGAPNERSTAVPPRDFYLYFIQPFDPPHFKDEKKADEVFLRLTNRDDEFRIALTNYAAALELASTSSGHAKATYESKATGFLRDLVGWLQKHMTDAFEVTHQGRTKSLVEWTKGKSIRELSGIASHERINFRDLVNTIAGIVLSAHFQDQAREYPYFSVLITGQNREQAAQDALRAIAGQNRTKQAIAVLDALELLDGERLDPYRSKYAKHILDILKKKGHGQVVNRSELIQEVYGVEYFAPDKGYRLEPEWAVVVLAALVYSGDLVLSISGEKFDATRLPQLAATIIDELVPFKHIERPKDWNLPALKALFEFLGLTPGMAQLVTQGKEEPVQQLQKAISAVVEKLVLVQQSLQSGLAFWGRNLLAEEEAAQLRDRLDQTKSFLESLQAYSSPGKLKNFRYDAQEVKRHEDGLKAVSEIESLQELVSDLGRVASYLSTAEAVLPTDHEWVERMKATRDAVLAQVSDPAQRTSSAFRQQALRKLAGLKKSYVQAYLAMHARARLGVNEDRRKSALMGDERLKTLSRLSTIDLMPRQHLTDFQNRLAGLKSCFALTEQDLDASPVCPHCSFRPGTEGVGAPAATVLEHLDTELDKLLDDWTQTLLANLEDPTTRGNLDLLKPEPRKLVDAFLKERKLPDELGKDFIHALQEVLSGLVKVAVKTEDLRAALLKSGSPATPADMKKRFDEYLDELTKGHEPGKVRIVLE

SEQ ID NO: 756 - protein, 1263 aa, Anaerobaculum mobile
MKYRDLIQFEPIETVIQLRDANEFTKARQLVSTYVISDEMAEKLTNIVFPQLQFDSPSDNKALLIVGNYGTGKSHLMSVISSIAEHETLLSALNNEKVATSAQTIAGKFKVVRREIGSTKMSLRDIVTFYLEDALKDMGITYTFPDASQIPTNKQAFEEMMASFQTVFPDHGLLLVVDELLDYLRTRRDQELISDLSFLREIGEVCKYLRFRFIAGVQEAIFDNPRFANVAEQLSWVKSRFEQIVIFRKDIKFVVAERLLKKTAEQQVRIRSYLTPFAKFYGRMNERMDEFVRLFPIHPDYIDVFEQIRIIEKRQILKTLSYTIKNLIAEEVPTDRPGIIAYDSYWATIKSDPSFRAIPDVREVIDVSQTLESRVEQAFTRPQYRPLAIKIIHALSVHRLTTGDIYAPLGATAEELRDTLCLYQPGIEELGGEPADDLLTHIEMILNEIKKTVSGQFISFNKDNNQWYLDLKKSEDYDAIIERRSESIDDNALDRGYYDALKNLMEKTDNPTYVTGYKIWEHELLWPERNVARKGYLFFGAPNERSTAVPPRDFYIYFIQPFDPPYFKDEKKADEIFFRLTNVDENFKVMLARYAAALDLASISSGNAVNIYKSKALGFWKETVMWLQKNAINVFSVVYRGSTKSFDEALRYVSNASSELGARAHQVAHYLQTPDTSSFGFRDLVDVVAGTMLSAHFLDQAPEYPRFSVPITSQNRERAVQDALRAIAGQRTKQATAVLDALELLDGERLDPAKSRYAKHILDILGKKGHGQVVNRSELIQSFNDVEYFALDKGYRLEPEWVVVLLAALVHSGDIVLSIPGRKFDATALSELAAEPISELVNFKHIERPKEWNLPALRALFELLGLTPGMVQLIAQGKDDPIVEMQKKVNEYLERIVLAQQTLRQGITFWGEYILDESAQREYSSALEQMKSFLESLRAFNTSGKLKNFLYEVQEIKCYEDNLKSLLQVEFLRDLLNDLKDIVSYLSNAEKLMPKDHEWTNKAGETKTQTIASIREKWMEAAKNRLNSCDYTLLSKVQQDLAELKRSYINTYLEMHFKARLGMEGDKKKNALMNDERLKALRDLATIDLMPLSQLREFEERLANLKSCFKLTEQDLATKPECPYCSFRPAVETPLRSAVIELESLDERLDNLFNEWTVTLLTNLEDPTVQNNLDLLKPEDRKQIEKFMEERRLPDVLGKDFIRAIQEVLSGLVKIEVKIEDLHQALLAGGSPVTLDEMKKRFEAYLTELARGKEPNKVRIVLE

SEQ ID NO: 757 - protein, 1222 aa, Bacteroides vulgatus
MKYSDLIQFDPIDEIIKFGQLDNEDYREKLVKNFVCSQTFENYIIPQICGKLDLNSTTETKGIQIVGNYGTGKSHLMSLFSIIAENADYLDLVQSEKAKEWLKTIAGKYKVYRFELGNNQELWEVITFKIDAALEEWGVDYRISDDDTPRTYSEKLELMLAAFEEVYPDKGFMLVVDEMLAYLKGRSEPAKLNRDLQVLQALGQMSDRTHFRMVFGVQELIYRSPEFQFAKDMLGHVNERYVDLTIQKEDVQFIVQQRLLQKNEHQKAQIRKHLSQFTTMFPHMNNNLETYVNLFPVHPSYFENFSLIRIGKSQREVLKTLSKKFSTIINDEVPTDKPGLICYDSYWQDMLGNVDLNADPDVSKVSSITALIDQKIEENFTKGLAPKKVLAHRIVSAAAIKMLQADLSHPNGVSAETLANDLCHVDITCENFDELVDLAFTRVLDSIVSATIGQYFVKGENNEYHIRIEGGVNYEQKVKDYAAQMGDGQKDEYFYMFLSEVLPVEGETYRRNFRIWEHHIEWQSHKCSRTGYIFMGNPNERSTTQPQQHFYIFFMPIFDTSNSSRPAEKDSVYFLMNDLSEELKQKIVLYGSALSQEGSASTDEKPRYKQLREKYYKEARNMFNNEFLAKIMVEYIGDKHPMQGMPGAQADSKIDAVSAVTSYIMEKQFELENPHYPKFSALQQPLTNENRENLLRSARAKIASPTTINRNGEAILMGLGLWENGRLSSEHSEYARSIKNKLEAKGGQVLNRDEILEVFYADTHEYISIDYHIEADLEMLVLATMAALGEIEIVLQGGSRINAGNISDISKLNPQDCYTFSNVCPPKGINIPLVREICLGLLGVDRTNELDNPNSSIFADLLAKASELENIIVTLQHKIQGGYYFLNDIEIISEDDARNFDVELVRLKGICNHMQRYNTKAKMRNIDWPIDVVKTAMTETRSKVFETLDLMKELDGFRDLVSYLRIALSNVNDNDLKTEIISSIDGIKEVINKGKQARDAYKLKLEALKDRYATWYMEAYLKAHISEIDHGKKSAVMLSTEKQLCDIIKNASFINPSRYDNWLRKMNLLKVVNSSVNKNAILSVPTSVDGFNPSMQKDELPELEDLKDELKEIYAEYEQGFHDALEDPTILRNKEMLTQEERSTIQQFIDGNITLNPQYARILIDIINKLQRSFTKVEINHNEMLKIFSRPMTKQQALDALAAYIDNHSRGHKPEDIRIIVK

SEQ ID NO: 758 - protein, 1230 aa, Caldicellulosiruptor kristjanssonii
MRYKDVINFEPIETLIQLVDANEKEKAKNLVKTFVMSDSMAEVLCDIVIPQLQFEEFNDNKGIFVVGNYGTGKSHLMAVISAIAEDKDLLDYVNNEKFKKAAEKIAGKFEVVRIEIGSVTTSLRDIVLKRDIESDLKRRGIDYAFPSMNEISNNKDSIIEMMAKFEEKYPEKGYLIVIDELLDFLRTRKEHELRLDLGFLRELGEVCKNTRVRIIAGVQESLFDGPSFSHVSDKIMQVKDRFENIIIKKEDIAYVVSQRLLKKSETQKAFIREHLKKFSNLYKNMGDRLEEYVELYPIHPSYIDVFQKVLIAEQREILKTISRTISKLLDEEIPEDDTGIISYDSYWDFIKEMPAARANPDVRQVIDASSVLENIINNSFPKKVYKNYAIKIIKALSVYRLATGDIHIPLGLTIENIKDDLCFNIPDLPEKEEDFLITTIESIMKEILKTVDNKFISYNKENNQYYLDVAKVGIDYMAKIEEKAELIDDDVVNRHFYNIILRLLNWEEKAATPYVKGHRIWEYDLIWEDKNIERHGYLFLGTPNERPTAQPPRDFYIYFTRLYEFNDWEDNKRDDEVFFSFSLHDDTLITKLKMYAAAHELSEGVDTSSRNSYLKWATKFEKEILEIINNNKNTCFNVTYKGETKSMFEILQGRVPSNKTIKELVDKAASICLSQHFSNLYPEYPKFSITVTRNNLSELTKQVLNYIAGKKTDTAAKILDAFGLLENERITTKKSPYAKYFADLVAKLPPGKVINRNEIFEKWYSEEDVDKRFKFEPNFVVMILAALIYTGDIVLIGEQGKEYNAGNLDKLASTNLVNLINFKYITRPKEIPIKVLERLFELLDLPPGQIKNSSQMEQGIANMQSKVENLIKNTIQISERVSNNILIWDKEVFKESEKRKFREDLNNFKNFLDGLKRYNTIARLKTFNFSKDEIEEKFEALKVIEKVKKALDFKEQVDDVVNYLKNAELVTDSEEIKKMIQDMKDELNNILQDVDKLDDFVIKDFKNKLEMVKKAYIQAYFEKHKKCRLDINGDEKKKKILSSKEFNNLRKLKSIKDIFSIQKFEEIEKKLSSIKTCFNLIEEELKKQPVCPHCGFKPNNEEGMSASMLLEKVEDDIYTMIDETKEKILKALDDRVVSENIKLLKEQERKEIEKFIEKREFEEDISPYFITGINNLMEGFDKIEFDVNQLKNYISKKGPMTVDEFKDTIEKFIETMIKGKTKDKIRIIVN

SEQ ID NO: 759 - protein, 1242 aa, Chloroflexus aggregans
MKYGDLIQFEPIESVIQLRDADHAAAAQRLVQSYVISEEMAERLIGVVLPNLQFDQPLDNKGLLVVGNYGTGKSHLMSVISSIAEHADLCSALTNAAVQHAAARIAGRFKVVRTEIGATTMALRDILVGELEEHLAAMGVAYTFPAADQVANNKRAFEAMMAAFHQKYPDHGLLLVVDELLDYLRSRKDQELILDLNFLREVGEVCKDLRFRFIAGVQEAIFDSPRFAFVADSLRRVKDRFEQVLIARKDVKFVVAERLLKKTGAQQATIRAYLTRFAGFYSSMNERIDEFVRLFPVHPDYIDTFERVTVVEKREVLKTLSLAMKELLDAEIPTDRPGLIAYDSYWNNLRQNPSFRAIPDIKAVIDCSQVLESRIEQAFTRPAYKPMALRIIHALSVHRLTTGDIYAPIGATAKELRDTLCLYQPGVEELGGDPADDLLTQVETVMREIHKTVSGQFISTNPDNGQFYLDLKKTADFDALIERRSESLDNALLDRYYYEALKRVMECTDQTYITGYRIWQHELEWPERKAARQGYLFFGAPNERSTAVPPRDFYLYFLQPFEPPPFKDEKKADEVFFRLKHRDTGFDQKLRCYAAALDLASTASGHAKTTYTAKADGFLRELVGWLQQRITDAVEVTYRGRSRLPAEWLKEKTIREQFGSTSSAQKNVRDLVNNLAGAILAPHFHDQAPEYPSFSILITNQNRAQAAQDALRAIAGQTRTKQATAVLDALELLDGERIDPTRSRYARHILSILKKKGHGQVVNRSEVIEDIYGIEYFAAEKGYRLEPEWLVVVLAGLVYSGDIILSITGKKFDATGLSQLAATNIDDLVRFKHIEAPKDWNLPALKALFELLGLTPGLAQLVTQGKEEPVQELQAAIKQTVEHLVMAQQTLHSGLPFWGKELLTAVEAARLRDEMDKTKTFLESLHVYASPGKLKNVRYSAEEVKRHERGLQALAEFQSLQEIVNELGPLASYLATAAAVLPTDHPWVQSMRHAQSEVREWLETGRMEHQELRTHIRQKLTELQQAYIRDYLTMHTHARLGANDDKRKQALLGDQRLKTLASLATIDLMPRRQLTDIQHRLANLKSCFALTEHDLVTQPICPHCDFRPNAEMMNVPAATLLDQLDAALDTLLKDWTNTLLDNLEDPTTRSNLDLLKPEARSLVDTFLRKQTLPDDLSHDFIHALQEILSGLTKVVVKTEELRAALLRGGSPATPTELKKRFEEYLAERTKGYEAGKVRIVVE

SEQ ID NO: 760 - protein, 1243 aa, Desulfovibrio aespoeensis
MKYGDLIQFDPIESVVQLRDADKSSAAHTLVNTYVISEEMAERLTQLVIPQMQFDQPVDNKGLLVVGNYGTGKSHLMSVVSSLAADASLLEGLKNDGVRDAASQIAGRFKVIRTEIGATTMSLRDILVAELEEHLEKLGVEYVFPEAGTITSHKRAFEDMMAKFGEVFPEHGLLLVVDELLDYLRTRKDQELILDLNFLREVGEVCKDLRFRFMAGVQEAIFDSPRFAFVADSIRRVKDRFEQILIARSDVKFVVAERLLKKTTEQQAKIRDYLMPFAKYYGGLNERMDEFVRLFPVHPDYIDTFERVTVVEKREVLKTLSMGMKGILGKDVPQDEPGLIAFDSYWNTLKQNASFRAIPEIRAVIDCSQVLESRIENAITRKQYKPMALRLIHALSVHRLTTGDIYAPMGASAEELRDRLCLFDPLIAELGSDEPDKDLQTHVETVLREIHKTVSGQFISFNADNRQFYLDLKKTDDFDALIDKRAESLGQAQLDRFYYEALKRVMECQDATYVTGYKIWQHELVWQEHKAARSGYLFFGAPNERSTAVPQRDFYLYFIQPNDPPRFKDDKVNDEVFFRLKVTDEEFQTALKSYAAALDLAATSSGHAKATYESKANGFLKKLVQWLQKHMSDAFEVTYQGRAKSMTEWAKGKSIRDLSGLSPHETINFRDLVNTIAGVCLAPNFENQAPDYPFFSVLITGNNRAQAAQDTLRAIAGQNRTKQATAVLDALELLDGEKIDPYKSKYTKFILDAVKAKGHGQVVNRSEIIQDDHGLEYMNPGGGRLEPEWVAVILASLVYSGDIVLAIPGKKFDATGLQQLAATGMDELVRFKHLEQPKEWNLPALKALFELLGMTPGMAQLVTQGKDEPVQNLQQAVGKIVKRIVMTQQTLREGLSFWGLDLLAGTDLASQASGLDEAKGFFESLQAYSSPGKLKNFRYSAPEVLAHEKAVKALDELDALREFIMDHSPTASWLSTAEAVLPADHDWVDRMKTTRQDVLDALKQADLTELASQSQSIGAKLQKLKKDYTVAYIGLHTKARLGVNDDKRKAGLLNDQRLQTLLKLAGIDLMPRQQLTDYQNRLAGLKSCFALTEQNLDASPICPHCGFRPSVETGTAAGSQMIDQMDAQLDAMVTAWTSTILSNLEDPITQANMDLLKIDDREPLEAFIKSKELPVPLDSNFVHALKEVLSGLVKVTVKAQELQQALQVTDGPATPAEMKKRFEEYIDQLTKGKDPAKVRIVME

SEQ ID NO: 761 - protein, 1243 aa, Dichelobacter nodosus
MKYGDLIQFDPIESVVQLRDADKSSAAHTLVNTYVISEEMAERLIQLVIPQMQFDQPVDNKGLLVVGNYGTGKSHLMSVVSSLAADASLLEGLKGEGVRDAASQIAGRFKVIRTEIGATTMSLRDILVAELEEHLEKLGVEYVFPEAGTISSHKRAFEDMMAKFGEVFPEHGLLLVVDELLDYLRTRKDQELILDLNFLREVGEVCKDLRFRFMAGVQEAIFDSPRFAFVADSIRRVKDRFEQILIARSDVKFVVAERLLKKTTEQQAKIHDYLMPFAKYYGGLNERMDEFVRLFPVHPDYIDTFERVTVVEKREVLKTLSMGMKSILGKDVPQDEPGLIAFDSYWGTLKQNASFRAIPEIRAVIDCSQVLESRIENAITRKQYKPMALRLIHALSVHRLTTGDIYAPMGASAEELRDRLCLFDPLIAELGSDEPDKDLQTHVETVLREIHKTVSGQFISFNADNRQFYLDLKKTDDFDALIDKRAESLGQAQLDRFYYEALKRVMECQDATYVTGYKIWQHELVWQEHKAARTGYLFFGAPNERSTAVPQRDFYLYFVQPNDPPRFKDDRVNDEVFFRLKGTDEEFQTALKSYAAALDLAATSSGHAKATYESKANGFLKKLVQWLQKHMSGAFEVTYQGRTKTMTEWAKGKSIRDLSGISPHETINFRDLVNTIAGVCLAPNFENQAPDYPFFSILITSNNRAQAAQDALRAIAGQNRTKQATAVLDALELLDGEKIDPYKSKYTKFILDTVKAKGHGQVVNRSEIIQDDHGLEYMNPCGSRLEPEWVAVILASLVYSGDIVLAIPGKKFDATGLQQLAATGMDELVRFKHLEQPKEWNLPALKALFELLGMTPGMAQLVTQGKDEPVQNLQQAVGKIVKRIVMTQQTLREGLSFWGLDLLAGTDLASQASGLDEAKGFFESLQAYSSPGKLKNFRYSAPEVLAHEKAVKALDELDALREFIMDHSPTASWLSTAEAVLPAEHDWVDRMKTTRQDVLDALKQADLTELASQSQSIGAKLQKLKKDYTVAYIGLHTKARLGVNDDKRKAGLLNDQRLQTLLKLAGIDLMPRQQLTDYQNRLAGLKSCFALTEQNLDASPICPHCGFRPSVETGTAAGSQMIDQMDAQLDAMVTAWTSTILSNLEDPITQANMDLLKIDDREPLEAFIKSKELPVPLDSNFVHALKEVLSGLVKVTVKAQELQQALQVTDGPATPAEMKKRFEEYIDQLTKGKDPAKVRIVME

SEQ ID NO: 762 - protein, 1210 aa, Methanocaldococcus sp.
MVKVKELFNFQEIRPVIQVVKDDPKELVSTFVVSDKMKKDIELIVQNLNDIQHRSIFIIGDYGTGKSHFLGFIVNIAGDKSLIDYIQDEDLKKYLKENLEKDFIIVVYELNPIRQPFGLIFYLIMQMYLEKNYGIKINVPKTEEEFNSILDHKQYIIDNIIKPVKEKFPDRGIIVAFDELSDFLRQKHREDVNQDMQFIRILGELSEKEDIIFIFSMQENIFRSPLYVDQADAVSRVYQRYHIIEITKEDVEKVLAQRIVPKTPAQIAKLRELLSQYKKYYEDFEGKEDEFIELYPIHPSVLHAFRQLPYFQKRGILKFAMDKIKEILDKEFPAFVTMDSIFDEIYNNPTISNTEEVREVLDVVERLLYKIQSIPALRKDRDIAERIIKSLAVYKLMKPEEKPTPYQIAYDLMVLPRLESIEINDYILGIIKRIRRETAGQFLGYDEKEKKFYIDLERKIDYDEIINRKISIQSNDDRESYLFEFLRESLELSRDDVKLERPSIKIFRTTAFWESRKGFRNGFIIFEGKNLKNSAKEYKNFLGNDFAVVVVSPYKSESIFEPSDATILIKLKIKESEENLKRYSAIKALIGDRQYVNVMKDKLATVKRKLVDELTNDMLNSVINYNGKNIVVGDLVGEEVGDIYTIIEKIKSKLLEDYFSREYSEYPKFSIKITPENIEDVVKRVLEDILASPDPENYRKDTIKILSDLGLYSQGKLKITDNPYISKIQDLLSGKTKDFKSILEKMSQKPYGIQKEISYIFVSVLLINDEIELKKSTKDRIGPLEIRELLKKKGLSAFDIVKYIEPVSEFPVNDLQKIFDALELDSTKIRIKNQRLDALKDYKFRVSELEDVIKKLNDLQSKIDKIKNLGFTVSEDKIQSLLNIANNKELLNKLKEVNSLHDFNKIHKISPELIKEWRESIEILGRLTNDLEKIIPLLEYAKSAKDIIDACEDIFSEIYVKKLNELYEEVVKIIESDKLLDIQHRLPIPGKLEEFKRLYIEAYAEAHKRYFEKEEWKELNKLLNSETLKELKILSQVRCINGSIVEQIENEIYELLKKRCNITNPEQHLTYMPVCYCGFPRDSPIGIDLSQKVQELSKKIDELRDEWERVIIEEIKKVQDKIEFLKPNEKDAIEDIIAQNSLGEVDRELVSIINKLFEDFQVVEIRLEEFYEWLGEGGYLLTPEELKEKFEEFIKIKVPKGENVRVKIVK

SEQ ID NO: 763 - protein, 1169 aa, Methanocaldococcus sp.
MVTLEKIELKNFKSFKKLSLDIPKGFTAIVGPNGSGKSNIVDAILFVLGKTSAKKLRANRFSGLITYHNGKRADFAEVCLYFSNENNAFNVNADRVGILRRIKSSGETDYYLIWEENGKEKRKKMAKHEVIDLFRRLGLLGDNVISQGDLLKIINISPIERRKIIDEISGIAEFDEKKKKAEEELKKARELIEMIDIRISEVENNLKKLKKEKEDAERYIKLNDELKAAKYALILKKVSYLNILLENIQNDIKNLEELKDEFLGKVKEIDAEIENLKLRLNNIINELNEKGNEEVLELHKSIKELEVEIENDKKVLNNSINELNKVENEIENKKKEIEETQKKIIENRDSIIEKEQKIKEIEDKIKNLNYEKERLKEAIAESESIIKHLKKSEMEIADEIAKNQNELYKLKKELNDLENLINRKNFEIEKNNEMIKKLKEELESVEDVDTKPLYLELENLNVEIEFSKRRIKELEEKKKELQAKLDELHAEYVKENARIKALKEMEELSMDRAIREILNANLPGVIDIVGNLGKTKIEYKTAIEVAAGNRLNHIVVKRMEDAVRAIKYLKERRLGRATFLPLDRIEGREAEYLDEDGVIGRAIDLVEFDEKYRRVFEYVFGNTVVVKNIDIAKELAKKYRKVRFVTLDGDVIEPSGAMIGGTFKSKAKIKVDIDLSKLNKIADEIIAIESELRNIKDEIERLNEIIKRSSAKKMEIENTLEIIKKNEMRKREIAEKNTIKIKELELKNKEILEELEELNLKKEEILNKINEIEGRINELIERREKIINELKEYESDENLKRMNEIEDELKILEKEKAKLKNEIDKGLTLVKEILIPKIEELNKKVSELINKKAILEKNISFYKESIEKNLSILEEKKKRYEELAKNLKELTTKKEELEKEIENLERERKEILRKVRDIENKINELMVEKAKYESKLEEEERKLYLCEKVDISEELEKKDIEELEIYIGELESEIKSLEPVNMRAIEDYNYVAERYKELIEKREEYERDEKKYLQLMEELENKKKEVFMEVFNKVAKNFEEVYKEIGGIGKLSLENEKNPFEGGILIDASPRGKKLLSLDAMSGGEKSLTALAFLFAIQRLNPSPFYVLDEVDAALDVKNVSLIADMIKNASKDSQFIVISHREQMVSKADVVYGVYMENGLSRVVGIRL

SEQ ID NO: 764 - protein, 1246 aa, Methanosalsum zhilinae
MKYEDLIQFDPIESVVQLRAADKSTAAHHLVNTYVISEEMAERLTDIVIPQLQFDQPIDNKGILVVGNYGTGKSHLMSVISSLAEDDSLLDSLKHDGVKDSAKQIAGRFKVIRTEIGSTTMSLRDILVAELEEKLDKLHVDYVFPEASEVVSNKRSFEEMMTVFHQVYPDHGLLLVVDELLDYLRSRKDQELILDLNFLREVGEVCKDLRFRFIAGVQEAIFDSPRFAFVADSIRRVKDRFEQVVIARSDVKFVVSERLLKKTTEQQAQIREYLTPFAKFYGGLNERMDEFVRLFPVHPDYIDTFERVKIIEKREVLKTLSIEMKSIMDREVPEDYPGLISFDSYWDTLKQNASFRSIPEIRKVVDCSQVLESLIQRAFTRPQYKPMALRLIHALSVHRLTTGDIYSSLGATAEELRDSLLLFEPMIAEMGSDDPDKDLQTHVETVLREIHKTVSGQFISFNQENRQFYLDLKKTDDFDALIEKRTESLEESQLDRYYYEALKRVMESTDSTYVTGYKIWQHELEWREHRAARTGYLFFGSPDERSTAVPQRDFYLYFIQVFDYSNKLSRYINEKNSDEVFFRLKVTDEEFHSVLKSYAAALDLASTSSGHAKATYESKANEFLKKLVQWLQKHMTDTFEITYQGRTKLMTEWAKGKSIKGLPGLTSQETVNFRDLVNTIAGVCLEPHFADQAPDYPIFSVMITGNNRPQAAQDALRAIAGQSRTKQAVAVLDALELLDGEKIDPHKSRYADLILEEFKSKGHGQVVNRSEIILDDHGLEYMNPVGARLEPEWVVVILAALVNSGDVVLSIPGKKFDATGLQQLAATSMDELIRFKHVEQPKEWNLPALKALFELLNMSPGMAQLLTQGKDEPVQNLQDAVGKIVNRMVMAQQIMREGISFWGQNLLVGTELANQTSGIEDAKNFFESLQVYSTPGKLKNFRYSAQEVSSHEKAVQALDELESLREFVMNQSSIVSWLTTAETVLPTDHEWTDRLRATRNDVLMDLQQAKLSELSNKSQEINTKLQQLKQEYINIYSTLHSRSRLGVNDDKQKSALINDALLQNLDKLAGIDLMPKQQLTDFRNRLAGLKSCFNLMEQELISNPVCPHCQFKPSMEGEVQASTLLNQMELQLDQITDQWTTILLNNLEDPVTQENVNQLLQDDERKMVQDFIIKGELPQPLNNEFIQIVRTVLAGLQKVPVKKSELIEKMVEIGPVSPAEFKSMFNDYVDSLTRGKDPNKVRIVLE

SEQ ID NO: 765 - protein, 1243 aa, Methylacidiphilum infernorum
MRYGELIQFEPIESVVQLRDADEAARARQLVSTYVISNEMAERLTGLVIPQLQFDQPVDNKGLLVVGNYGTGKSHLMSVISSIAEHADLLSALGNAQVAQAAERIAGKFKVIRTEIGATTMSLRDIIVGELEEHLAAMGVTYPFPDASQVVSNKRAFEEMMAAFHQEYSDHGLLLVVDELLDYLRTRKDQELILDLNFLREVGEVCKDLRFRFMAGVQEAIFDSPRFAFVADSIRRVKDRFEQVLIARKDVKFVVAERLLKKTGEQQTKIREHLTPFAKFYGRMIERMDEFVRLFPVHPDYIDTFERVRTAEKREVLKTLSRACENLLDQELPEDRPGLIAYDSYWANLLDNPSFRTDPDIKAVIDCSQVLESRIKQAFTRPAYKDMALRIIHALSVHRLTTADIYAPLGATAEELRDALCLYQPGIEGLGGDPADDLLSQVETVLREIHKTVSGQFISSNPDNRQYYLDLKKTDDFDALIEKRAESIDDSQLDRYYYEALKRVMECTDQTYVTGYKIWQHELQWLERKAARQGYLFFGAPNERSTAVPPRDFYLYFIQPFDPPHFKDEKKADEVFFRLTKKDEEFRTALRNYAAALDLASTSSGHAKATYESKANGFLRDLVGWLQKHMTDAFEVTYQGRTKSLVERAKGKSIRELSGLASFERINFRDLVNTIAGDVLETHFRDQAPDYPYFSVLITGQNREQASEDALRAIAGQNRTKQATAVLDALELLDGERLDPNRSKYARHIMDILKKKGHGQVVNRSELIQEVYGVEYFAPDKGYRLEPEWAVVVLAALVYSGELVLSIPGKKFDATGLPQLAATSIDELVRFKHVERPKDWNLPVLKALFELFGLAPGMVQLVTQGKEEPVQQLQKTISEVVEKLVLVQQSLQSGLTFWGRNLLAEEKAAQQRDRLDQTKNFLESLQAYSSPGKLKNFRYDVQDVERHEYGLKVLSEIASLRELVRELGPVASYLSTAEAVLPIDHEWVEQMKKTRDAVLVQVSDPSQHTSSTFRQQTLCKLTDLKKSYVQAYLAMHTRARLGVNEDKRKSTLMGDERLKTLSKLSTIDLMPRQHLIDFQKRLDGLKSCSTLTEQDLDASPVCPHCGFRPGTEAPAAHAAAELEQMDTELDKLLEEWTQTLLDNLEDPTTRVNFNLLKPEPRKLVDVFLKERKLPDEIGQDFIHALKEVLSGLVKVAVKTEDLRIALIKGGSPATLAEMKKRFEEYLDELTKGKEPGKVRIVLE

SEQ ID NO: 766 - protein, 1203 aa, Moorella thermoacetica
MAKICELFNFERIREVVDIDAITDKKAMVENYVISPSLEEYLVHLFQDLNSSTHKAAQIIGGYGSGKSHLLAFIISLLTEPGLVRSVQNEQVRRAVEAMKRDFVVVHWELQPNDVSLSEYFYDQLEIQLKEKYGISINLPTSGVIDHKKTILQILEKVKEGHPTRGLVVVIDEISDFLKQKTKEKLNQDVQFLRVLGQAAQSCDFMFIGAMQEHIFTNPKYVDEAESFGRVAERFQVITIKREDIKRVIARRVLKKTAEQRLRLEELFREYVHYFPHLQAGLDEYIDLFPLHPYVIQVFSELPYFEKRGVIQFTIQEVEQILDRDFPFLITYDRIYDEIASKHTVKNLETVSPVVNAIQTLESKVDLLEPRHQDTARKIIKALAVLRLYGKSVNNGATAEELANTLLLLPGNRLMEAADEISLVLKNFRRVTDGQFINVTSDGYYFLDLNLTIDYDQVIRRRAENLPEDSLDEEILSILKEQLLLEEGAARYAFRDTCEWSGRRSFREGTFVYETGKGEVVRADGDYRIVFVSPFCAGNRYPPAENCAVISGSLPPEAIEQLKLAVAAHLLFRENYQRSIMEKKYASLKKKFVEMFVQAWLETGQVNIGKAQKGIKALIVREFSNFDELFTEIKPQLFEDYFNQKYPKHPKFTQRITRDNIMGEFGAAIKELLSKGNVQSVFSSTKSILNALDLLDAQGNLSTANSEIAAAILETARAAGGKVVAVEDFINRFRQTPYGYDRWMTAFVIIVLTYNGEIVLRAAGGTLISSSEVYDTFGSGLEAFENIKYLAIESDFNPQPVINLMLALGIDPGITAKMRVTAKRNEALQAFRTRYLEIKEQLDFVRKKLETLALNAGNIVDVNGLRNYHQKLADIPIDKFEQVKAPNDFKKVVYDEAAIQKIGEAYKILQDLDHFYKMYSERLEKEVEYAREVRKVVEEYPGLFLTDGLKEFLHEAFAVLADSSRLVNRSELLSLLGKLQQARQKYVTAYYRAHEKCVGERAGWNKLQELTASQTWKNLLLLKNVTVLNKYPLARVENEISVLATQRCEGFKVELIEKSPLCPRCNFPKSFRGENIGQWIANLEDELEDIFREWEETILAEVKNYQDNLDYLEAGERELILQVMKAGKLPPVVTEDLVVALNNLFRELVSVEVSPAELLEAVFAGARVMDYFTFERRLNAWKQKLVAGHDLDKVRIKLAGGEA

SEQ ID NO: 767 - protein, 1273 aa, Nitrosococcus oceani
MVRLQDRRFGHIKNIPVEENPGRAQIKYGDLIQFDPIESVVQLRDADKSSAAHTLVNTYVISKEMAERLTQLVIPQMQFDQPVDNKGLLVVGNYGTGKSHLMSVVSSLAADASLLEELNHASVRDAAAQIAGRFKVIRTEIGATTMSLRDILVAELEEHFEKLGVEYVFPEAGTIISHKRAFEDMMAKFGEVFPEHGLLLVVDELLDYLRTRKDQELILDLNFLREVGEVCKDLRFRFMAGVQEAIFDSPRFAFVADSIRRVKDRFEQILIARSDVKFVVAERLLKKTAEQQAKIRDYLMPFAKYYDGLNERMDEFVRLFPVHPDYIDTFERVTVVEKREVLKTLSMGMKGILGKDVPQDEPGLIAFDSYWNTLKQNASFRAIPEIRAVIDCSQVLESRIENALTPKNYKPMAVRLIHALSVHRLTTGDIYAPMGASAEELRDRLCLFEPLITEMGSDEPDKDLQTHVETVLRKIHTAVSGQFISENKDNRQFYLDLKKTDDFDALIDKRAESLGQAQLDRFYYEALKRAMEYQDATYVTGYKIWQHELVWQEHKAARTGYLFFGAPNERSTAVPQRDFYLYFIQPNDPPRFKDGKVSDEVFFRLKSTDEEFQTALKSYAAALDLAGTSSGHAKATYESKANGFLKKLVQWLQKHMSDAFEVTYQGRAKSMTEWAKGKSIRDLSGLLPHETINFRDLVNTIAGVCLAPNFENQAPDYPFFSVLITGNNRAQAAQDALRTIAGQNRTKQATAVLDALDLLDGEKIDPYKSKYTKFILDAVKAKGHGQVVNRSEIIQDDQGLEYMNPGGSRLEPEWVSVLVAALVYSGDIVLAIPGKKFDATGLQQLAATGMDELARFKHLEQPKEWNLPALKALFELLGMTPGMAQLVTQGKDEPVQNLQQAVGKIVKRIVMTQQTLREGLSFWGLDLLVGTDLASQTSGLDEAKGFFESLQAYSSPGKLKNFRYSAPEVLAHEKAMKALDELDALRAFIMDNGPTASWLSTAEAVLPAEHDWVDRMKTTRQDVLDAFKQANLTELTSQSQSPLSGIGAKLQKLKKDYTVAYIGLHTKARLGVNEDKRKAGLLNDPRLQTLRKLAGIDLMPRQQLTDYQNRLAGLKSCFALTEQNLDASSICPHCGFRPAVETGAAVGSQMIDQMDTQLDAMVAAWTSTILSNLEGPITQANMDLLKIDDREPLEAFIKSKELPVPLDSNFVHALKEVLSGLVRVTAKAQELQQALQVTDGPATPVEMKKRFEEYIDQLTKGKDPAKVRIVMEG

SEQ ID NO: 768 - protein, 1326 aa, Nitrosococcus watsonii
MVSLQDRKCGHIKNIPVEEDPGRAQLKYGDLIQFDPIESVVQLRDADKSSAAHTLVNTYVISEEMAERLTQLVIPQMQFDQPVDNKGLLVVGNYGTGKSHLMSVVSSLAADASLLEGLNHAGVRDTASQIAGRFKVIRTEIGATTMSLRDILVAELEEHLEKLGVEYVFPEAGTITSHKRAFEDMMAKFGEVFPEHGLLLVVDELLDYLRTRKDQELILDLNFLREVGEVCKDLRFRFMAGVQEAIFDSPRFAFVADSIRRVKDRFEQILIARNDVKFVVAERLLKKTTEQQAKIRDYLMPFAKYYGGLNERMDEFVRLFPVHPDYIDTFERVTVVEKREVLKTLSMGMKGILGKDVPQDEPGLIAFDSYWGTLKQNASFRAIPEIRAVIDCSQVLESRIENAITRKQYKPMALRLIHALSVHRLTTGDIYAPMGASAEELRDRLCLFDPLIAELGSDEPDKDLQTHVETVLREIHKTVSGQFISFNADNRQFYLDLKKTDDFDALIDKRAESLGQAQLDRFYYEALKRVMECQDATYVTGYKIWQHELVWQEHKAARSGYLFFGAPNERSTAVPQRDFYLYFIQPNDPPRFKDDKVNDEIFFRLKGTDEEFQTALKSYAAALDLAATSSGHAKATYESKANGFLKKLVQWLQKHMSDAFEVTYQGRAKSMTEWAKGKSIRDLSGLSPHETINFRDLVNTIAGVCLAPNFENQAPDYPFFSVLITGNNRAQAAQDALRAIAGQNRTKQATAVLDALELLNGDNFAGREIGRPEGARRGAAMDGGYQKIDPYKSKYTKFILDTVKAKGHGQVVNRSEIIQDDHGLEYMNPGGSRLEPEWVSVLVAALVYSGDIVLAIPGKKFDATGLQQLAATGMDELVRFKHLEQPKEWNLPALKALFELLGMTPGMAQLVTQGKDEPVQNLQQAVGKIVKRIVMTQQTLREGLSFWGQNMVLGSGLGVQGSENSEPGTQNSELENAKAFFESLQAYSSPGKLKNFRYSAPEVLAHEKAVKALDELDALREFIMDHSPTASWLATAEASASRGSEFRVTGSESKPQGLDLWVDQVKAIRGDVLDSINSELKTQNPQLARLSSEVGEKLKKLKRDYINQYISLHARARLGVNDDKRKAGLLNDQRLQTLLKLAGIDLMPRQQLTDYQNRLAGLKSCFALTEQNLETTPACPHCQFRPAAEIGVLGSGFGVSGSQQLDQMDEQLDKIIEQWTKTLLNNLDDPMTQANVNELLHEDDKQIVKAFMDSKELPDPVDGNFVQTLKTILAGLQKVSVKKADLLKIVSDLGPSTPNEIKQAVSDYVDSLTKGKDQNKVRIVLE

SEQ ID NO: 769 - protein, 1246 aa, Parvibaculum lavamentivorans
MKYKDLIQFEQIESVVQLLDADRPNEAKKLVSTFVISDDMAERIAKLMVPQLGFDESVDHKGVLIVGNYGTGKSHLMSVLSLVAEDAAYAPMIRHPKVVDAVASIAGRFKVLRIEVGGLEMPLRQIITQQIERFLKKLGVDFTFPSADQELNNKDSFEEMMAAFGEKFPDQGLLLVVDEFLEYLQSRRDHELVLDLAILRQIGEVAKHLKFRFVAGVQEAIFDSGRFQHVADSIRRVNERFTQILIDRQDVSFVVSARLLKKSADQQNKIREYLKPFAKFYGSMNERMDEYVRLFPVHPDYLKTFEQIHFTEKRGALKTIEAAMQAILDQDVPTDRPQLIAYESFWNTVKSNQVLRADPNIKEVLRVSEVLESRIQQAFTRPTYKPMALRVVNGLAVHRLTTGGDIHIPIGPTAAELRDSLCLFQPGVGDMPGEPAENLLSMVQTVMREVLKTVNGQFISKAADTEQYYLDLKKDVDYDAQIDKRAEALSDDALDRAYYSAVKTLMECSDDLRYPGFQIWQYQIEWQEHRVERLGYLFFGGPNDRPTAQPERDFYIYFIQPFDKGQRTYSQQPDEVFFRLKALDEGYRRHLSQYAASLDLGSTASGGAKAVYQSKAQDALRAMSKWLQEKQLTAFEVTYQGKAKTLQDWAKGVSLRDRARLGPEERINFRDIVNIVSGLVLSQHFADIAPEYPKFPVLVTEANRKSLIASTLRALAGGTRTKDATAVLDALEMLDGERIDPASSRYAQEVLNRLKAKGHGQVLNRNELVAGATDVEYFSPAKHRLEPDLLVVVLGALAYSGDIVLAITGDKIDSGKLSLLAERSLDELKQFKHIEAPKEINLAVLRALFELLDLPSGLAQKASQGDTEPVIALQEKISALVPRVLRAGSDLQQGKLAFWGQNLLREEEAKDWYARLDALKKFTESLSPYNTVGKLKNLRTTQEDIDIQKKNLDVLAGVERLLELIGELGGAASYLSQAEMILQPGHDWVKQAEAARKALFDKLAEDRTAERAAAILGEGRQTLAGLKKDYVTAYIASHSKARLGVAEEKTRNALRRDDRLLSLRVLAGVSLMPTSQLTGFEDALNGLKSCSALDEPTLLRTPVCPHCQFRPSAEQLELLPAASRLNKLDDDLDQLQANWQQTLLENLEDPFTQDSLGLLPAASKALIDAFLAARKLPEPVTTDFANAVQEALSGLEKITVKADELRQALLQGGSPATPDELRKRFDALISERGKGKDATKLRFVIE

SEQ ID NO: 770 - protein, 1246 aa, Parvibaculum lavamentivorans; identical to SEQ ID NO: 769

SEQ ID NO: 771 - protein, 1251 aa, Planctomyces brasiliensis
MSWSCRWAKNRQRAIDGEQMKYSELIDFEPIESIIELRDADAHDKARSLVETFVISDRMAEQLTEIVVPNLQYDKPADNKGVLIVGNYGTGKSHLMSFISALAEHEDLADASKNKDVVKAAKEVTGKFRVVRTEIGSTTMSLRDIICGELEDHLADMGVKFSFPPAEKVRNNKDALNEMMGKFHEKYPDHGLLMVVDELLDYLRSRHDQHLVLDLNFLREIGEVCDDLRFRFVAGLQEALFDNPRFQFVADSVRRVKARFAQLRIVREDVAFVVSERLLKKTPEQQARIREHLEKFTPLYDTMAERIEEFVRLFPIHPAYLEQFERITVAEKREVLKTLSVEMRQLLNKDVPTEETGLVSYDSYWRFLLDDVSLRTDPDVKEVINKSNVLESRIKQAFTRKAYTPMALRLCSGLSVHRLTTDDIHAKIGPTASELRDDLCLFHEALPEKNSDFLRTTVESCLNEIVKTMSGQFITHNKENDQYYLDLEKDIDYDTEIEKRSESLSPSELDRYYFDALKRVMECADQTYVTGYRIWEHEVEWREHKVTRRGYMFFGAPNERSTAQPPRDFYVYFIQPFQPPKYKDDSLGDEVFFFLKHPDEEFDRALRLYAGARAMASQAGSATRKNYEDKGDLHLKALTNWLRQHMLTAFEVAHQGVSKKMVEFLKGHRTGNMTVSELVNLVGSVALGPCFEEKYPEYPTFSVTITASNLDDAVSDAIRSLAGGLRTNIATAVLDGLELLDGDKIRPHESRYAKKVLEKLEGKPKGQVLNRNELLEEQYANVEVEIEYRLEPELLVVVLLGLVHSGDVTVSLVGKKKVDAASLSDSGKTPVEEFCKFRHVERPKDIPLSALVALFELVGLSEGLIRNPNTREEAIKQLHDKTSGIVKRVVVSKQHAQSGLPCWGHELIPVEKREEYRKRLDELQGFLEKLQAYNTPGKLKNFSASVEDVKAHGADLELLEELEGTSALVGELTPLTSFLTTAEAVLPSGDSWTEKSKKVRSEWQPQLLDGSKRNDPSFRQKLLQAMEKCKKDYQDHYLSLHKKTRLGINEDQKKRDLLKDARLERLNKLAGISLLHPGSLTDLRNRLAELKPCFSLVKDDLGTNPICPHCGFRPTDEKTGPSGSAALDAIDEEIDKLLDGWVETLLNDLSDPTVEKSIELLDADQKKAVKKVIKDRAFPDKISNELIQGIQNATSGLTPITVKSSDLLGSLSDSSAPCTVEQFKSRFEEFVQEMTRGKDVAKIRIIIEKTD

SEQ ID NO: 772 - protein, 1226 aa, Syntrophothermus lipocalidus
MKYADLIHFEPVETIVQLREADAKSRAGELVKSYVISERMAEQITEVVFPQLQYGHPQDNKGLLIVGNYGTGKSHLMSVLSAIAEYPDLVTEIRHPAVAAKAQAIAGKFKVVRTEIGSTTMSLRNIICAELEEQLANLGVKYRFPEADKITNNKDPFIEMMNAFQEVYPDHGLLLVVDELLDYLRTRKDQELILDLNFLREIGEVCRLTRFRFVAGVQEAIFDSPRFQFVAETLRRVKDRFEQIRIVREDIAYVVAQRLLRKDDRQKALIREHLQRFTKLYGTLAERMDEFVVLFPVHPAYLETFERVYVAEKREVLKTISFAMKKLLDKEVPENDPGLIAYDSYWQNLKDNPSFRSDPDIREVIEKSQVLEYRVQQAFTRPQYKPVALRIIHALSVHRLTTGDIYAPIGVTAEELRDDLCLYLPLPEEDAEFLKTIIESILREILRTVSGQFISFNQDNGQYYLDLKKDIDFDSLIEQKAEVLTPNQLDRYYFKALARAMECPEATYVPNFQIWEHEIEWREKKATRLGYLFFGAPNERSTAHPPRDFYLYFLQPFDPPLFEDEKKPDEVFFRLVQRDENFDRALKFYAGACEMASTASKGTRQVYENKANDQLKKIVEWLRNNITTAYEVTYRGATKKFVEWIKHSATSHASVRDLVNMVGSLCLAPYFRELAPEYPAFSILVTVKNRPQAAQEAIKWILGSIRTRQGAAVLDALELLDGDKLRPQNSRYAKHILGQLDKKGPGQVLNRGEIIAEFRGVEYETRFRLEPEWVVVILASLIYSGDVTLSIPGKKIDASNLEELGKIPLEELIKFKHIERPKDLPLGPLQALFEFLGLPPGLIVNQSTREEGVRQLQKAVDQLLERTVQAQQVIQQELSLWGISLFDEKNKAGLRDKLASFKGFLELLRVFNTPGKLKNFRYSERDINKQKTYLATLKRVEELAGLASEVQPLLSYLSTAEAVLPADAGWTVKARERREELKAKLSGLDEASDPSLRRELVQVLVELKNSYIETYLQAHARARLNATGDQKKSELLKDERLSKLNRLAGIELMPRAQLTDFQNRLAELKTCFSLTREDLEKTPVCPHCSYRPAQEQIKLPADAALRRLEEDLERLCEDWERTLIANLEDPTVKENIYLLKPEQRKALDQVVKEQQLPYTVDASFVKAVQEVLSGMEKVSVTAADLKKALTQGGTPCTVSEFQQRFEDYIRSLTRGRDPQKVRIVLE

SEQ ID NO: 773 - protein, 1193 aa, Syntrophothermus lipocalidus
MYLKRLELKGFKSFAERTEIEFMPGVNVIVGPNGCGKSNIVDAIRWALGESNVRHLRGQRNDDVIFSGTDKRRPLGLAQVDVAIDNCDRVLPLDFAEVSVTRKVHRSGESEFYINRVPARLKDVQDLFAGTGLGKKGYSIIGQGELEQILNLKPFDRRLLLEEASGLIKYRHRMEEAETKLAVIKEDMARVEKMLSDLEGRLEVLAEKASKSRRYRELAGELRNLEQNLLASAIERLYRELQDYLGERDKVKAELAKARTLIQEKEQELALLKAKTGEVKENLSFYNEERHRLQSELQRCEAELRLSAERLMNARQRREDLAGEEANYQGLLAKLEENIRLGEDKLAKEEAELKAKVESLREVESRVGQLENVLADYNRDYEDLRTELIEKLKEETEDKNQLTVLQERLKRLEDRLERCQEDLKQKEAHEKELEQAESRTREKLNEARARLDHWQRKKTDTEKAHDRALTSAKEREQDLARLQAELYKAEQELNLYFDEERDGRTYPEAVRAVMRAARDKQYGLNGILGVVGDLIEVPPGLEAAVETALGRSIQDIVVRSEKDARRAIEFLKEKKLGRATFLPLDLLRVSDLPRDKIRRAEKMPGVVGWGHELVDYPAGFEKVVKYLLGRVVVVETLQSAVKVYRESGLPVKLVTLEGEVLTYTGAITGGTVSNRSVQHFRRKNWAKQQALVLAEKQKECELLLAQLENLRSTAAELERGLQEIRQQEEELKLEEKMLMLELENACGERERLIQAIDDLRYENKGYSAEIDSLRESMKDVEAQYQAAADQARRLSDRVEEIKQGHEEMLREYEVLKERTKSYREFVAGKEHEIESLKQNLVQLEKIKASYLQALDKCAQEKKALAVEMDRQESLQLELKTRCDGFQEKMGQLRGEMETLVRAITGLEEDSRGIEKKLTEERQCCRQLEEQSRVVELRIARREADMENQIKLWVDSYGEEYVPGSGIILDGEKEREARQRKEVLTKQLAELEPVDHGAEAEYEEIRARYDFLNNQYQDITEAKNAIYALLKETRAVLSSQFVEFLKGVSQSFHHTFLAMFGGGSAFLNSNGAIEDLDSGVEIAVKMPGKRKQLLELLSGGERALTCIAFVFALLALRPSPFCLLDEIDAALDDVNLARFAGFLKRLSQDIQFIVITHRQGTIEIGQALYGITMPEEGVSRVLSVTMEEAEALAG

SEQ ID NO: 774 - protein, 1221 aa, Tepidanaerobacter acetatoxydans
MKYRELVSFDPVESVIKLVEADQPQEAMRLVKTYVMSDSMAKTLKDIVIPQLQFENSFDNKGIFIVGNYGTGKSHLMSVLSAVAEDKKMLELVNNQIFQEAAQSIAGKFEVLRFEIGTSKMDLRDLVIGHLEKDLAKRGIDYRFPSMEEASNTKDYLLEMMALFQEKYPDKGYLIVADEFLDYLRGLTEQKVVLALNFLREIGEISKSCRLRFIAGVQESLFDSGQFAFVADSLRRVRDRYEQVVIRKQDISFVVSERILKKDERQKAWIREHLTKFSHLYSNMADRLEDYVNLYPIHPAYIEIFEKVYIAEKREVLKTITHTIKKILDKDVPENETGIISYDSYWEYIKENISVRSDPDLREVVEKSSVLEDLILKSYTRPQYRPIALRIIHALSVHRLTTGDINAPIGITVDNMKDDLCIYTPMPEVEESFLKTTVETAVREILKTVSGQFISYNRDNEQYYLDLKKDIDYDAKIQAKADFMDDDMLNKYYYDALLKVLNWERPEHKTGRRIWQYEIIWEEKKVERYGYLFFGAPNERTTAQPPRDFYIYFLRPYGNNVYQGEIEKDEVIFEFINRDEKVDEYIKLYAASMELAMVSSADSKQTYFKKSRRLSKAIVQWIKEHVKECFIVKTAGEQQTIQYWLKGKAAEEHTVKEFVDMTASACLSTYFNDKYPYYPRFYTQVTRENMKELFKAGLNYLAGRKNELGAKVLDSLGLLEGDMIAPEKSIYARRYIKLLENLPEKHVLNREDILEYLSEVTLDKEFQLEDVWVTLILCALVYSGHATLTISGHTFDATKMEEIAAANPADLILFKYCQVPEGVPVKILKKLFEGLGLPPGQITNPNTREAAIEKMLVRAEELTKRVIETQQFLIGDLALWDKPAIDEDTKENYKESLKTLKDFLDAIKQYNTPAKLKNFRFSEDEVASSLANIEIMQEILNIRDFKLKVDPYVSYLTRTCMILKDDKWNQKVQKVRGEALDKVQKPQELTDTYIKEYVGKLQALKKEYISIYIKLHKKYRLDLNGDKQKQKLLESRLKHNLDMLTCVGDLIYPKPYEKMCNRLLKLKTCFSLIEDDINMSPLCPHCGYTPDEDEQPVFGVVEAIEKSMEELFFQWEKIVLEILEDEKVKENIALLDKPQRQALESITQNQRLPDKIDSQLVSTINILMKGLDKVEITTEDLVRAIFKGGPVTVSDMKQRLNDYIDEMVKGMDVDRVRIMLK

SEQ ID NO: 775 - protein, 1221 aa, Tepidanaerobacter acetatoxydans
MKYRELVSFDPVESVIKLVEADQPQEAMRLVKTYVMSDSMAKTLKDIVIPQLQFENSFDNKGIFIVGNYGTGKSHLMSVLSAVAEDKKMLELVNNQIFQEAAQSIAGKFEVLRFEIGTSKMDLRDLVIGHLEKDLAKRGIDYRFPSMEEASNTKDYLLEMMALFQEKYPDKGYLIVADEFLDYLRGLTEQKVVLALNFLREIGEISKSCRLRFIAGVQESLFDSGQFAFVADSLRRVRDRYEQVVIRKQDISFVVSERILKKDERQKAWIREHLTKFSHLYSNMADRLEDYVNLYPIHPAYIEIFEKVYIAEKREVLKTITHTIKKILDKDVPENETGIISYDSYWEYIKENISVRSDPDLREVVEKSSVLEDLILKSYTRPQYRPIALRIIHALSVHRLTTGDINAPIGITVDNMKDDLCIYTPMPEVEESFLKTTVETAVREILKTVSGQFISYNRDNEQYYLDLKKDIDYDAKIQAKADFMDDDMLNKYYYDALLKVLNWERPEHKTGRRIWQYEIIWEEKKVERYGYLFFGAPNERTTAQPPRDFYIYFLRPYGNNVYQGEIEKDEVIFEFINRDEKVDEYIKLYAASMELAMVSSADSKQTYFKKAEGYLKAIVQWIKEHVKECFIVKTAGEQQTIQYWLKGKAAEEHTVKEFVDMTASACLSTYFNDKYPYYPRFYTQVTRENMKELFKAGLNYLAGRKNELGAKVLDSLGLLEGDMIAPEKSIYARRYIKLLENLPEKHVLNREDILEYLSEVTLDKEFQLEDVWVTLILCALVYSGHATLTISGHTFDATKMEEIAAANPADLILFKYCQVPEGVPVKILKKLFEGLGLPPGQITNPNTREAAIEKMLVRAEELTKRVIETQQFLIGDLALWDKPAIDEDTKENYKESLKTLKDFLDAIKQYNTPAKLKNFRFSEDEVASSLANIEIMQEILNIRDFKLKVDPYVSYLTRTCMILKDDKWNQKVQKVRGEALDKVQKPQELTDTYIKEYVGKLQALKKEYISIYIKLHKKYRLDLNGDKQKQKLLESRLKHNLDMLTCVGDLIYPKPYEKMCNRLLKLKTCFSLIEDDINMSPLCPHCGYTPDEDEQPVFGVVEAIEKSMEELFFQWEKIVLEILEDEKVKENIALLDKPQRQALESITQNQRLPDKIDSQLVSTINILMKGLDKVEITTEDLVRAIFKGGPVTVSDMKQRLNDYIDEMVKGMDVDRVRIMLK

SEQ ID NO: 776 - protein, 1272 aa, Thermanaerovibrio acidaminovorans
MRYGDLIQFEPIESVVQLRDADEAASARQLVSTYVISDEMAEKLTGLVIPQLQFDQPVDNKGLLVVGNYGTGKSHLMSVISSIAEHADLLSALGNAQVAQAAERIAGKFKVVRTEIGATTMSLRDILVGELEEHLAVMGVTYTFPDAGQVPNNKRAFEEMMAAFHREYPDHGLLLVVDELLDYLRTRKDQELILDLNFLREVGEVCKDLRFRFMAGVQEAIFDSPRFAFVADSIRRVKDRFEQILIARRDVKFVVAERLLKKTGEQQAKIREYLTPFAKFYGHMNERMDEFVRLFPVHPDYIDTFERVTAVEKREVLKTLSLAMKKLLDQEVPEDRPGLIAYDSYWTNLRENPSFRAVPDIKAVIDCSQVLESRIEQAFTRPVYKPMAIRIIHALSVHRLTTGDIYAPLGATAEELRDALCLYQPGIEDLGGDPADDLLSQVETVLREIHKTVSGQFISSNPDNRQYYLDLKKTDDFDALIEKRAESLDASQLDRYYYEALKRVMECTDQTYVTGYKIWQHELEWLEHKAARQGYLFFGAPNERSTAVPPRDFYLYFIQPFDPPHFKDEKKADEVFLRLTNTDEEFRTALTNYAAALDLASTSSGHAKATYESKATGFLRDLVGWLQEHMTDAFEVTYQGRTKSLVEWAKGKSIRELSGIASHERINFRDLVNTIAGIVLSAHFQDQAPEYPYFSVLITGQNREQAAQDALRAIAGQNRTKQATAVLDALELLDGERLDPYRSKYAKHVLNILKKKGHGQVVNRSELIQEVYGVEYFAPDKGYRLEPEWAVVVLAALVYSGDLVLSIPGKKFDAAGLPQLAATPIDELVHFKHIERPKDWNLPALKALFELLGLTPGMAQLVTHGKDEPVQELQAKVSKYVEEIVRTQQALKDGLHFWGQRLYSDSELATRNSQLETTKSFLESLQAYTTTGKLKNFRYDASEVTAQRSGLESLAEIKSLEELVADLGSTASYLSTAEAVLPTGHEWIDKMSAVRTEVLTAVMSHGFRVSGQKDAGLSTRDPRPELQRKLTDLKKSYVQAYLAMHTRARLGVNEDKRKSALMGDERLKTLSRLSTIDLMPRQHLTDFQNRLAGLKSCFALTEQDLDASPVCPHCGFRPAAEAVAGHVSGVAGQDSRLGTRDSRLINAAAVLQQLDEQLDKMLAEWTAALITNLEDPTTRGNLDLLKPEPRKLVDAFLKERKLPEELGQDFIHALKEVLSGLVKVAIRPEDLRAALLKGGSPATPAEMKKRFEEYLDELTKGNEPGKVRIVLE

SEQ ID NO: 777 - protein, 1227 aa, Thermoanaerobacter brockii
MRYGELIQYEPIETVIKLKDADKIDEAKRLVKSFVVSEGMADSIINICIPQLQFDETIDNKGIFIVGNYGTGKSHLMSVISAVAENKEMLDYISHEELKKEMGKIAGKFKVLRFDIGAVNTPLRNIITKEIEKDLARYGIEFYFPPIDKVTNNKEAFMEMMSKFEDKFPDKGYLIVVDELLDFLKARKEQELIRDLTFLREIGEITKSTRLRFMTGVQETLFDNPAFNAVAQTVLKMKDRFEQLIIKREDISYVVSQRLLKKNDRQKAWIRSHLEKFSPLYKSISSRIEEFVELYPIHPMFIEVFEKMFIVEKREVLKTISHLMRELLDKDVPEDEPGIISYDSYWKFLRDNPSLRAEPDIKRVVDKSVVVEDLIEHSFTRPQYKDAALRIVHALSVHRFTTGDIHTSVGITVENIKDDLCLYIKMPEIEEDFLITTIETIMKEIMKTLSWQYISYNPDNQQYYLDMVREGINYDAKIQEKAELLSDDTFNRYYFDLLIKVLDWNATLKQKNMRIWEYSLIWNEKNVKRYGYLFMGYPDERSTAQPPRDFYIYFLPPFVEANYNKKYILNGKEDEVFFEFINADEEIIEKIKKYAAAMELSELSSSDQKKIYEDKANGFQKDITKWIRDNVSKCFNVSYKGETQSIIYWLKGKTANYDTIKSYIDEAASSCLSLYFSEKYSEYPTFYTKITEANLNEVFKSAMNYLAGKKTETGKKVLQSFDLILGDDIVPENSKYANYFLNELYKLPPGKVLNREDIIENVNGEDIDKRFKLEVQWVVLLLCALVYSGDIILRIKNKVYDATTIDSLANMNVGELVDFDSFERPRDIPVRELKTLFTLLGLPSGLVNASLSKPEEAIRQMVSRSEELAKKVVTVNQFVVSNKTIWSKPVFDEFEIKNYKDLLNNFRDFLDSLKAFNTPGKLRNFKYAEEELKEKFKTLETVKKIEKIIDFKNEVEELVKYLSSAEQQLPEEIELKQNINAMKNEVERFTKEIDNKESEDIKRLTRELEELKIEYIDLYLEYHKKHRLDYNGDERKKKIMASDLFNNLKKLKDVGIFPVNKFDEIEKVLASLKTCYNFGKENIKTEVLCPNCGYSIKSGEVPVFGKLDEIEDKIENLYKEWTKILLDNIEDPMIQERMEILNKDQQKVIRDFLNKKELPEKVDNLFVSAVKDLIAGLEKVEIEINEFISAITYDGPVTVDEFKKRFLENVDFLIKGKDKDKVRIIIK

SEQ ID NO: 778 - protein, 1227 aa, Thermoanaerobacter italicus
MKYGDLIQYEPIETVIKLKDADKIDEAKRLVKSYVVSEGMADSIINICIPQLQFDETLDNKGIFIVGNYGTGKSHLMSVISAVAENKEMLDYVSHEELKKEMGKIAGKFKVLRFDIGAVNTPLRNIITKEIEKDLARYGIEFYFPPIDEVTNNKDAFMEMMSKFEDKFPDKGYLIVVDELLDFLKARKEQELIRDLTFLREIGEITKSTRLRFMTGVQETLFDNPAFNAVAQTVLKMKDRFEQLIIKREDISYVVSQRLLKKNDRQKAWIRSHLEKFSPLYKSISSRIEEFVELYPIHPMFIEVFEKMFIVEKREVLKTISHLMRELLDKDVPEDEPGIISYDSYWKFLRDNPSLRAEPDIKRVVDKSIVVEDLIEHSFTRPQYKHAALRIVHALSVHRFTTGDIHTSVGITVENIKDDLCLYIKMPEIEEDFLITTIETIIKEIMKTLSWQYISYNPDNQQYYLDMVREGINYDAKIQEKAELLSEDIFNRHYFELLIKVLDWNAPEKVPNMRIWEYSLTWNEKNVKRYGYLFMGYPDERSTAQPPRDFYVYFLPPFVEANYNKKYILNGKEDEVFFEFINADEEIIEKIKKYAAAMELSELSSSDQKKIYEDKAKGFQRDITKWIRDNVSKCFNVSYKGETQSMIYWLKGKTANYDTIKSYIDEAASSCLSLYFSEKYSEYPTFYTKITEANLSEVFKSAMNYLAGKKTETGKKVLQSFDLILGDDIVPGNSKYANYFLNELYKLPPGKVLNREDIIENVNGEDIDKRFKLEVQWVVLLLSALVYSGDIILRIKNKVYDATTIEALANMNVGELIEFDSFERPRDIPVRELKTLFTLLGLPSGLVTASLSKPEEAIRQMVAKSEELAKKVVTVNQFVVSNKTIWGKPIFDEFEVRDYKNLLNSFSDFLDSLKAFNTPGKLRNFKYTEEELKEKFNILETVKKIEKIIDFKNEVEELVKYLASAEQQLPEEIELKQNINEMKNEVERFIKEIDTKESEDIKRLTRELEELKIEYIKLYMEYHKKHRLDYNGDERKKKIMASDPFNNLKKLKDVGIFPVNKFDEIEKVLASLKTCYNFGKENIKTEVLCPNCGYSIKSDEVPVFGKLDEIEDKIENLYKEWTKILLDNIEDPMIQERIEILNKDQQKAIRDFLNKKELPDKVDNLFVSSVKDLIAGLEKVEIEINEFISAITYDGPVTVDEFKKRFLENVDFLIKGKDKDKVRIIIK

SEQ ID NO: 779 - protein, 1227 aa, Thermoanaerobacter pseudethanolicus; identical to SEQ ID NO: 777

SEQ ID NO: 780 - protein, 1227 aa, Thermoanaerobacterium saccharolyticum
MRYGDLVHYDPIETIINLKDADDEEKAAALVKSYVMSDNMAENIINICISQLQFDETIDNKGLFIVGNYGTGKSHLMSVISSIAENEKLLKFVTNDKFKDGMRRIAGKFKVLRFDIGSTDMPLRDIVLSKVEENIHQLGIEYNFPPMNKVANNKDSFMEMMALFEEKYPGKGYLIVVDELFDFLKTRKEQELIKDLAFLREIGEISKSTKIRFMSGVQESLFDNPGFQFVARTILKVKDRFEQIIIKREDISYVVSERILKKDEKQKAYIRSHLGKFSSLYKNMAERMNEFVDLFPIHPAFIEVFEKIYIAEKREVLKTITNLIKNIIDEEVAEDMPGIISYDAYWDFIKDNMSMRTNPDIKDVIDKSSIIEGAILRSFPRPQYKDSAIKIINALSVYRLATGDIRTPIGITVDNIKDDLCLFIRIPEFEEDFLRTTIETIMKDIIRTVNGQFISYNQDNQQYYIDMVRVGIDYDVIIQEKAEKLDDDTLNRYYFEILLKVLDWNVKEYVPNFKIWEYSLKWLDKNIERDGYLFMGSPDERSTAQPPRDFYIYFLNPYSIDNRKYIENGKKDEVFFEFTNYDEKLESLLKSYSASMILYDSSANDGKAIYSSKADGFMKEIVKWIKTNIGNCFSVSHNGVTKRILDMARGTKREDETIKDYIDFVASSCLSFYFADKYPDYPKFKVIITRDNREAMFKYGLNYIAGQKSEHGAKILQTFDLIDNDGNITVENSRYVKYFQDIVNSLPEGKVLNHDDIFVLENEVEIDRKFRLDGEWVALILCTLVYNGEIAITVNNKKYDATMLSDLVKLAPNDIVNFSFCDRPKGIPINTLKRLMEIIGLPTGTISNPEKQVEAIKEMNKKFDELINEAHSVIQYVTSGKTIWDKLLFNDAEKKSYKDELNGFISFLNTLKRFNTPGKLRNFRYSKEDIEREFAALKLINRIQKIMNFVNSIDAYVVYISKACLVLVDNNDWIKKVEDVKQKIEDTIKNIDNVDLNAAKNDVINELINIKKEYIDIYFDEHRKHRLDYKGDEHKKKILNSSKLYNLRKLKSIDILSGSELTAIEEELGKINSCFSLTPQDLETEVQCKYCKYRYGDKNELLVYGKLDEIENKIDEIYKNWEEELLKNIEDPLIKDNINYLNDDQQKCINEFIARRSLPEKIDNLFLSSIKDLLKGLDKVEIDSKEFIANITGNGPVTLDDFKNNFMKFIENKVNGKEKDKVRIIIK

SEQ ID NO: 781 - protein, 1227 aa, Thermoanaerobacterium thermosaccharolyticum
MRYGDLVHYDPIETIINLKDADDEEKAAALVKSYVMSDNMAENIVNICISQLQFDETIDNKGLFIVGNYGTGKSHLMSVISSIAENEKLLKFVTNDKFKDGMKRIAGKFKVLRFDIGATDMPLRDIILSKVEENIHQLGIEYNFPSMDKVANNKDSLMEMMALFEEKYPGKGYLIVVDELFDFLKTRKEQELIKDLAFLREIGEISKSTKIRFMSGVQESLFDNPGFQFVARTILKVKDRFEQIIIKREDISYVVSERILKKDDNQKAYIRSHLEKFSSLYKNMAERMNEFVDLFPIHPAFIEVFEKIYIAEKREVLKTITNLIKNIIDEEVAEDMPGIISYDAYWDFIKDNMSMRTNPDIKDVIDKSSIIEGAILRSFPRPQYKDSAIKIINALSVYRLATGDIRTPIGITVDNIKDDLCLFIRIPEFEEDFLRTTIETIMKDIIRTVNGQFISYNQDNQQYYIDMVRVGIDYDVIIQEKAEKLDDDTLNRYYFEILLKVLDWNVKEYVPNFKIWEYSLKWLDKNIERDGYLFMGSPDERSTAQPPRDFYIYFLNPYSKDNRKYIKNGKKDEVFFEFTNYDEELESLLKSYSASMILYDSSSNDGKAIYSNKADGFMKKIVKWIKTNIGNCFSVSHNGVTKRILDIARGTKREDETIKDYIDFVASSCLSLYFADKYPDYPKFKVTITRDNREAMFKYGLNYIAGQKSEHGAKILQTFDLIDNDGNITVENSKYAKYFQDMVNSLPEGKVLNQDDIFVLENEVEIDKEFRLDGEWVALILCTLVYNGEIAITVNNKKYDATMLSDLAKLAPNDIVNFSFCDRPKGIPINTLKRLMEIIGLPTGTISNPEKQVEAIKEMNKKFDELISEAYSTIQYVTSGKTIWDKLLFNDAEKKSYKDELNGFISFLNTLKRFNTPGKLRNFRYSKEEIEREFAALKMINRIQKIMNFVNSIDAYAVYISKACLVLTDNNDWIKKVEDVKQKIEDTIKNIDNVDLNAAKNDVINELINIKKEYIDIYFDEHRKHRLDYKGDEHKKKILNSSKFSNLRRLKSIDILTGSELTAIEEELGKINTCFSLTQQDLETEVQCTHCKYRYGDKNELLVYGKLDEIENKIDELYKKWEKTLLENIEDHLIKDNINYLNDDQQKCINEFIARRSLPENIDNLFLSSIKDLLKGLDKVEIDSKEFIANITGNGPVTLDDFKNNFMKFIENKVQGKEKDKVRIIIK

SEQ ID NO: 782 - protein, 1227 aa, Thermoanaerobacterium xylanolyticum
MRYGDLVYYDPIETIINLKDADDEEKAASLVKSYVMSDNMAENIVNICILQLQFDETIDNKGLFIVGNYGTGKSHLMSVISSIAENEKLLKFVTNDKFKDGMKRIAGKFKVLRFDIGSTDMPLRDIVLSKVEENIHQLGIEYNFPPMNKVANNKDSFMEMMALFEEKYPGKGYLIVVDELFDFLKTRKEQELIKDLAFLREIGEISKSTKIRFMSGVQESLFDNPGFQFVARTILKVKDRFEQIIIKREDISYVVSERILKKDEKQKAYIRSHLEKFSSLYKNMAERMNEFVDLFPIHPAFIEVFEKIYIAEKREVLKTITNLIKNIIDEEVPEDMPGIISYDEYWDFIKDNMSMRTNPDIKDVIDKSNVIEGAILRSFPRPQYKDSAIKIINALSVYRLATGDIRTPIGITVDNIKDDLCLFIRIPEFEEDFLRTTIETIMKDIIRTVNGQFISYNQDNQQYYIDMVRVGIDYDVIIQEKAEKLDDDTLNRYYFGILIKVLDWNAKEYRANFKIWEYSLKWLDKNIERDGYLFMGSPDERSTAQPPRDFYIYFLNLYSKNNRKYIENGKKDEVFFEFTNYDEKLESLLKSYSASMILYDSSANDGKAIYDNKADGFMKEIVKWIKTNVGNCFSVSYNGVTKRILDIAKGTKREDETIKDYIDFVASSCLSLYFADKYPDYPKFKVTITRDNREAMFKYGLNYIAGQKSEHGAKILQTFDLIDNDGNITVENSRYAKYFQDMVNSLPEGKVLNHDDIFVLENEVEVDKEFRLDGEWVALILCTLVYNGEIAITINNKKYDATMLSDLAKLAPNDIVNFSFCDRPKGIPINTLKRLMEIIGLPTGTISNPEKQVEAIKEMNKKFDELISEAHSTIQYVTSGKTIWDKLLFNDAEKKSYKDELNGFISFLNTLKRFNTPGKLRNFRYSKEEIEREFAALKMINRIQKILNFVNSIDAYVVYISKACLVLTDNNDWIKKVEDVKQKIEDTIKNIDNVDLNAAKNDVINELINIKKEYIDIYFEEHRKHRLDYKGDEHKKKILNSSKLYNLRKLKSIDILSGSELTAIEEELGKIHSCFSLTQQDLETEVQCIHCKYRYGDKNELLVYGKLDEIENKIDEIYKKWEEKLLENIEDPFVKINIGYLNDDQQKCINEFIVRRSFPENIDNLFLSSIKDLLKGLDKVEIDSKEFITFITGNGHVTLDDFKNNFMKFIENKVQGKEKDKVRIIIK

SEQ ID NO: 783 - protein, 1227 aa, Burkholderia thailandensis
MPKLREIFDLPEQVHQGDFVLRLTDGLSAPAETVRDYIATPQLVKCFDQALGVVKGAIDSRMSKGAYLHGSFGSGKSHFMAILSLVLRGDAAARGKPELAPVVSKHNGWTQGKKFLVVPFHMINAETLESALFSGYAELTARLHPDAPSPGFYQSEGMLNDAQKLRTQMGDEVFFRTLNGAAGAASGGGWGRVTQTWAAARFEAALKVPPGSPERFKLVGALTRAFYGSVSHLSASQREMYTSLDEGLSAMSHHAKDLGYDGIILFLDEFILWLASRAADVAWIAREGQKVAKLVESSNADRPTPIISFMARQRDLRELVGEHMPGAEQLSFADTLQYWEARFDKVNLEDRNLPEIAKKRLLRTRGPAEDALLKGAINKLLGSQPEVLQTLLTRDGDQQMLQDLYPFTPALIQTLIAVSSMLQRERTALKLMQQMLVDKADALEIGDVIPVGDLFDVIADGDEPFTHGIKLFFEQAKQLWRRRLLPILETQHGVAWEDIESGKADFKKAAALQNDARLLKTLVLAALVPEVEALKNLTPTKLAALNHGTIRTPVPGSEGITVLTKLKRWAGQAGEIKIADDSPNPIVSVEVAKVDTDAILANAMVFDTQGNRQAEVRQLITDGLGLADAGSSLLPPEMEISWRGSRRAAEILFGNVREQSFDTLKGREGTWRILVDFPFDHQPEHGPQDDVAKINGFLNEGRVGRSMVWLPSFLSPNTQDQLGRLVVINFVLRGNNLDQYASQLSQTDREQARVLLTNQRDQLRQFIRNCLYTAYGLNSVAQEALDPAQTVDEHYFSLDPSLVLRPPVAANFKDAFEKLAEQALDYEFPAHPHFDAEPRPIAVKRLADLMVLAAQKPAHRVELEASLRDDAKRIAPRLDLAEVGEAALQLRDDWSQHFARQIAQQAGREPTVTDLRRWLDLPDRRGLREDLQDLVILTWLAKSNRSLYRFGQPFKGEIGNVPNECEVREQPLPTVVEWDKATKLAGEMLDPAMSTLYRSAPGLVEFSRAARKRVADTAAHLLNYLRVVDQLMTLVQTDVVATGEPALRKLGATRLRDWFAAMESCSSEIDLVNMVSRLDFSAEEIAEAKAVLGGVQTLARVEAKHYLVNSVRSIAGGSSEFAPRANQILESLAHAVLRYEYVDGLQVAVVQFERDAGTLMADVANRATPPSPQPQPASEPGMKAPQKIEYTRLTKTDALKTLADARMLLEELGEISVDIQIVIREQE

SEQ ID NO: 784 - protein, 1215 aa, Candidatus Accumulibacter
MTLIRELIPIPERVHQGDFVLKLSDGVRAADETLGNYVVTPQLAQAFDNALAFIQSALATRQSKAAYLHGSFGSGKSHFMAVLNLLLAGNVRARSIKELASVVTRSNAWTEGKKFLLVPYHMIGARNMESAILGGYADHVRSIHPDAPVPGFYLAEGLFRDAQQLRARMGDDAFFGKLNEHAGSADGWGELSGGWDAGSFEAAMLESPRGDERSRLVGDLISCFFSAYASVASSSGGGQGEAFVSLDDGLAILSRHASELGYDGVILFLDELILWLASRAADVAFVSSEGSKLSKLVEAANADRPVPLISFVARQRDLRELVGDNMAGAMQMQFADVLKYWEARFHKIILEDRNLPVIAQARVLKPATESARQVLDAAFEDFANRSRTVTDTLLTSNADREMFRLVYPFSPALVQTLVAVSSVLQRERTALKLMLQLLVDRRDDLELGQIIPVGDLWDVIVDGDEPFSDAMRLHFDNAKRLFSQKLVPLLERTHGVVWQDLRNPQAHAAVDPVRARNFRNDARILKTLLLAALVPEVESLKALTAQRLAALNHGSVKSPIPGREAQDVLKRCRDWAGEVGELKITDEQNPVISIQVTGVDIEPIVKGAEGHDNTGNRRRKIREMLFGELGIPDSNELFTRFSFWWRGTLREVEVLYENVRELADDRLRGREGAWTVILDFPFDEPNRTPADDLARLDRYTGEGSQTLVWLPAFLSEKALKDLGRLVVLDYILTGERFNDYAAHLAQVDRAQARSLAKNQRDQLQQRLKQYLEVAYGIAQDPREAVDQKLGVADQFRTLDRTFQPQAPVGANLREGFINLLDQLFTHRYPAHPQFETEIRIAVLKKVEAELVRALEDKDQRVHVADRALRQLTLAVVNPLRLGNMGATHLALENHWRTHFLQRQAADGDPGAPITVARMRKWIDDPSPMGLLPEVQNLIIHAFAAMTNRSFFLNNGPYPPTLENTPNELELREQALPGEDDWKVAIRRAGLFFGLTVAESLNAGNVARLKDQLTTEASARLAPLQDYAKALAVKWRSLGNAGRDSDRLRTAEGAAALLLGMTSANADVISTLAGAAMATTEAAYGQTIGKAKALDEALKTTDWELFTAVIALVDHRRVAAQSMRERLAEILASDEHAIGLKAALAEQKNKALKLLTDAPPRPEPEPPKPGTRVIREEVKKDLAVSDAINSLDEIRAELVKDADYRLSISWKITKKG

SEQ ID NO: 785 - protein, 456 aa, Corallococcus coralloides
MAVVPESAAIVNALRSGLVPNVGLEHFATGLDALVGAVNEDLDFVAGGKGLSKWIRGEYGTGKTFAARYLCAKARERKFASSEVQISINDTPLHHLETVYRRLIEKLETAADGPNAFQAIVEGWLYQVGDEVTRLRGISEDDPGFADATEQRLEDKLADLSKRNPAFAQVLRAYHRATHEGDFATAQGLLAWLAGQPHTDRSVLAAAGVKGKVDGQASLTFLAGLLQLLRQSGYAGLVVVLDEVETVQRMNTQTREKSLNALRQLMDMLAKEELPGLYLVVTGTRDFFEGYKGLKALAPLYQRVQVNFSEDSRFDNLKAPQVRLTPFMDDRLLTVGARIRNLYPAKNPARLTERVSDAFLQGLVTQVTAGFGGKVALAPRMFLRELIDVMDRVDIHEAYDPREHYKLELDDGKLTAEELAAKHGRPVEEPPEEPEEPTSNDSEGPPPAPARKRLDG

SEQ ID NO: 786 - protein, 1208 aa, Corallococcus coralloides
MTTITEAFELPRPEDIRAMGFVVKLRELDPNSEEVEQLARDYVVTPAVEKELPRILDDMKQVFERGEEYGRFIHGSFGSGKSHFMTMLSLLVEGALPAWKKFRPLLNAHRDAKASKGGEASDHEAWLTKAGLLVVRIHMLSVRGKSTGFDRAVYEGFNAALKRRGKAPFEFLNVDAIFEEVRREAKEYGEVVWKRLETEGIVGGREDFEALAAGSIQAKERFARAWLKYKGRDASDAGIDPRWSEGLNRMAEHSKAQGFGGIVLMIDEFLLWLAEKSGQEFVAEINNLNVIVDHNTGQRPTPVFVFVARQRNLQEFFPDLVDESKIHEHLDHHAKRFEITKLQDVELRHIVRGRVLRPKKAGEVKAAVSSLSEKHSKVLPALLAGGDLDYVRDVYPFHPALIEMLVDVTSLMQRERSALRLLYELLVVHYPKLPLGEFLPVGSAFSAIFPESGVEASKKVELMQDIHHQYYSRLAPAMAKMAEEGGAEFNDERRRALDQLVKTVLLAEVSPRLKQGGLTIERLVQLNAVDVEGETFRGQVRVAETDLLALSQRVPDLQVAGQGKTALVRYVLGRVSLGEILGRARSKVDNPAQRFRVFWLALREALGVAGTKGFEDGGPNEGDWDLSWRRTKRRGRIKLGNVREMSYEDFAPPDGAFKILVDYPWDEPGHTVDEDRLRATNVRKKQGLLHTVCWLPRHMSPTELGVLTELAAVRYLLSEAGQEDLLETLGSQDKSKVLDQAGIRQKTLEGQLEDLLKEVYVRHGEFFALISDVDSSRPRETLAENLEHIAALLMDRRYPQHPAFLAEPKKQDLESLLGWMVDAGEGSVSVAYDENVGKVLKNLGQPLELVNLGQTKASLRLDSRYIKDVLHRTDQDSVSWSPIADHLRETYGFQPLLIDLFLCFLCQRDHRALEDISGEPADVRIGMSQTTRIRLQRGKLVSAADWHRLRDLGSQLFEVARPAAHRSLQGQDRFTTELRTRGQAKRTVLQALHTRLVHLGVQGGDRLKELSTANTRLGPLAQTTTDSHKVLSELLPAWPDDASDALRTLVQQAETLRDALAELNEHARGNLKAGVNHLVIGSEVSGHLRALDSRLEAAQAEQPLTKDWVATWNKKAQELIKRLIEQPQSPQPSVTGGGVQPPAIGGGAQSPLVGGGTAVTPRTVLLKKRVNPTDADAISDFLAEVRKALTEQGAKPISVVLVRTEEFE

SEQ ID NO: 787 - protein, 1304 aa, Corynebacterium variabile
MGKFTLPGASSAAPTLGEIFDIPESAGDTFVLKLSDSVSDHGKLKATIDSYVITDEIAGNLNAALGYVDRALTTGNNQGVYLTGSFGSGKSHFMAVLFALLAAEPATRDVPELQPLITEHTGTGHAIGRNLLQLPFHFLDSTSIEDTIFRGYLKHLEALHPEAPLPVLHASEGLFADADSTRAAMGDENFFARLNEAHSGPEGVRTPGAACASSPAGSAAPAVTGGVDFGALMGAAGVDTAGANDWTAASYQVARATTASEAQRRNLSSALTETLFTAYRTHSQWIPLADGLAEIARHAKSLGYEGVVLFLDELILWLMFQRSAELFNNEAQKLTLLVESGQGQLAVPLISFIARQYDLATWKDSSVEAGRELEARRQSFKHQEGRFNDIQLGSRNLPMIAHKRLLRPLNDSAEMKLSRAFTDLKLNGDVMNVLLDGVNTDENHQASDLERFKLTFPFSPALIDTLISLSSIMQRERTALKVMETMLIDKRSSMTIDGVIPVGDSFDYLLAGNEKMGNDAAHRFALGKKFWNDKLRPLILKTHKLPPSTRDEDITDTPAGAELRIGKTLILSAIAPEVPALKQMTASRLAHLNHGSIRTPFRGGDVSMVLKIVRTWAAEFPEVIITPGVKNPTITLKLEDVPWEAVIAQARSQDTEVRRARKIRTLLADAFGIASVEAGADGSYARTVTWRGTDRNVEFVFGNVRDRADLPDHFFTPGFEGTLRIIVDVPFDEPDHSVAEDHTRVKALAGSVTTAPFTAIWLPHFLSAERMEKLGELVIIDHVLTENGWRDYTQNVAADDREAIRQMLKQRQLTLTNQLVLWLEEVYGVDSGQEFAIGQEPLKTLDPALTVSKPRGASLADATDNLITTLYDQKFPDHPRYETDRSLTRADFGKVVEVLRTAAADAQGRADMPADARKACRTILPALGIGSVHESHLVFTADNAGTVINTGIPQRLRANGLDLTGPVSVGAVESAVGEINPNAGFTDLTEDLYVCAWAAMTNRSWVDHSREIEAPAFRDLDYRMELRPVVLPDAAEWDTALEIAGRLFGVLTGSHCTAANLRSLQSAVLEQVEEQRRDASLYSENLGAVQGALGVSTVTKRSRLADATSALLETLHRDGANALALVTHLAAARTADDRILGATVDEAIAGLANAKPAATALKRLTANGSVALTVPAAYARSHADGDDLGAAVLLANLRDALADHEFTTPTTSAVDRFFADRARWEAAMAAVPQPVQPGPDPVVPPVQPPVAPPVVEQPEPGKETGTVPVIDEEITTESVASFGAQLSELLKAGRRVRVTVEVIE

SEQ ID NO: 788 - protein, 1227 aa, Frankia sp.
MTLISELLDIPEAVYPGDFVLDLSRGVTQIDRTLREYVVTPELAIRFGEALGLIKSALTDGSSKAAYLDGSFGSGKSHFMAVLGALARNHPGARAIGELAPVITAFDGDVIGKQFLVVPYHLVGKTSLEEAVLGGYLAHVRALHPDAPLPAVLIDKPLLDTAVALRGQLGDQAFFGLLGGGDRSSAADPRWGTLNHGAWDADRFEQALTAAPAAQERRDLVGTLEKALVGFAELARGAATGYVNIDDGLAAISQHAAGLGYDGLILFLDELILWFATRMADHAWVANEAPKVAKLVEAANADRPVPIISFVARQRDLRELVGTNLPGTEHLAFADSLKWWEGRFGSIKLSDNNLPLIMSKRVLRPRSDATRAQIDTSFAAMDRVRADIRAALMTAHADRAAFRLTYPFSPAFVETLVALSGFLQRERTALRVMQQLLVDQRDTLQLGQLVPVSDLFDALITDASPISGELGGLWRNAQKVYGEIRRLILESHGLTEETVTGVAPKHAVHMDDRIAKTLVLAALLPEVPSMRDLTARRIVALNHGYIRSMVPGQETGAVTQVVRKWAARLGAVQVSGDDASPLLSVRLEGVDIEGILENAKGADSPGDRRLTVRTLLFDALGATKPEGIDRATIVTATWRGTKRNVELIYGYLRDPGDVGDSMFTPTHNGWRLALDVPFDPDDHSPAEALDRVSRLRDALPARTLCWVPRHFTAHTQWSLGRYLRLEYAVGPSFDQLAGHLSDNDRAIAHQQLTAQLDQLRSQLTNALLQAYGLVTPDETVVDPAHGGIDMFVSLEPGFTPRVPAGAALRPAFENLLDQALSWEFPAHPHFDGEVRPGDLAKVHAQVRRAIEHPEHRIMVESSERPVMRKVANPLGLGEQSDQYFVLGHHWERHLGRKIIEAEAAGRPVTVGDLRAWLDEPKRMGLPQEIADLVVLVFAEQTNRGILHGRPLDVSIPRPLPADARVVAEPLPDRDTWEEARGRAHALFLITDITELCTARNVALLATRVRSAVADRLPKVRALHAALIRRGPTVLRDGTDPATERVRIAQGALRLCADLATITDNLALVERLAAFDLPAVPLHTGRSLTTAADLDAAIREVDWNIFTTVADWGPEHPRGAEAAALVTELAAVWAANEYVQHLQPALTKADRKARGLLLEWSRRVSRPASRTGTINPPGVATPGVATPGGVATSGAREVDQDSVAEFTSTLAALTAQGWRIKVTWQAVR

SEQ ID NO: 789 - protein, 1313 aa, Frankia sp.
MTSPSPLPLLREVIDIPERTSDSDFVLKLTEGVTDAAATMRDYVLTDRLVGNFDEALGLIAQAASTGASKGVYLHGSFGSGKSHFMAVLHALLRGEPAARSFDDRLTDVLGKHDADLAGKKFLLVPFHMLGAKSIEQRVLGGYADQLRAMHPDAPIPAVHRAEALLDEARNVRARVGDATFLVELNHAGSGSGDEDDWGDDASWTAAELDAALAPGAQDTAIRRQLVSDLLSTWFANTFRDLREDAEGFVSLDAGLTEIARHAKDLGYDAVILFLDELILWLANNMGDQAFVSREVQKVTNFVEGGLGARPVPIVSFIARQRDLRELVGEQVAGDVRLSFLDVLTLADGRFDKIILEDRNLPLIANRRLLKPLNADAGKAIEKAFETTAKVRAEVWETMLGGSAQIGADRDAFRLSYPFSPAFMETLVHVSSALQRNRTALKLMRQLLVDHRDDLRLGQVVPLGDLWDVITRGADTPFTDVLKAEFDAAQKLYARRLRPYLLDAEGLDEDALAQVRRARATGAAVDPTLATKVRRFTADDRLVKTLLLSALAPSVPALHNLTPRRLSALNHGSITSPIPGGEAGQVGKKVERWAGQFGEIKYLPVEGGDPGVGLELVGVEVEGILNSAVGYDSAGNRRALIRRLLVEELGVTVTGDAYGDKLDLVWRGSKRTAEVIFGSVRGAELRDDQLAPVDPESWRLVVDYPFDDAGEPPVNARARVERLRGAGVQHRTVCWIPADFTAARLADLGMLVRLDHLLAGGGHRFDSHAQHLSADDRQRARSVLKSRYDALLTKTRTTLRSAYGLTSKDEHDVTADFNDHLRSLWPGLNPTLPLGASFREAARRLAGDLLADQFPGHPDLDPDQTGVPVKLADLKLVLGYVTKAAESDGGSVEVARGDRGPVRRIAPALGLGVMHEVRFELGREWVDHFTRRAGQAAADGGPGSAGSGADELRVVDLLRWIDEPKPRGLDDNVAHLVVAAFAEQTDRAWYRYGGLVNPPPELTAITKDMTLREQPLPDQAEWETAGERAQALFGVRPPALRRGRLLRAFTEELVAKAEPRRAPSQELVGALEARAFELGLDLRTGTAAAGRSAGGTTEGRLRTARAARDLLSALDDPKAGPQIVERLARADLAGSPKRLLVSMSHASEVAAAIRAAPWDETFGVIAGLPEPYKAEAQEILGRIQAAGAADEVINPLAAVLGNARAEATALLRRATQAAVAPVAPKPPITGPPPVGVPVVPGPRPTAGSVPITIPGPGPGLAAGGNAGSGGVTGAGAPRHWQVRASDLDEALAELRAHIGDRPGQIEIVWRPER

SEQ ID NO: 790 - protein, 1192 aa, Haliangium ochraceum
MRISDALDIPAFSDLSEFIARINDSDERVMQSLRTFVVPKNLETKLDQLLRAVGHNLDQKRDIGRYIYGTFGSGKSHLMTVLAKMLEHDETVYDVGDEALHRLRAQHPWIDRHSPLVVRVNMMGKQTLVSALFEAYAEALPPDAPPIAFTDEDEVFALIDKDAERLGGMDALLGRLVEDKAIPSLGFYERMRQGTPSQRLDLAARLDTWRNHGRPVRPEDLWVDADEGFARIARHAKDAGYTAIVWLIDELVIWIRGKSADQYVQQINDLSALVDHDQTSARPTPFFVAVAVQQDVAETCPQDLSEKGFREQLGFIGNRFQPRLDLEDQDLFEVTSRRVLKPKQEHAEAWRQAVAQTFQKHQAEIRKLSGEIEPAQVQALYPFHPALMRVLVDVTQGLSRNRSAMSALYGLLHAERDLEVGHFIPVGSLFDVVFTRDSVEDARQRTQSVLAQRLAEAAESYERLEHKLDQASEEVSADPVELRQLVKTVLLCQLSDRDYFRTEPLSKRVKASFLLHLNQRDIQASHPRLGLSKVVKLFRQIDSTEVTLGEGTDPSIKILTDRVDSDAVLKAALAEMHHSARFAYIRRVIDQVLGLGLGSGKEIALDVPGWRGTKRRGRLLLENVRTLSYAGKQNQFEAGESEFLILVDYPFDEDPTKTRQDDIQTLQRARSHRRQWTVAWLPAHFQRSELSALDQAAAVDIIRQDKARFLERYNTRDADKISRALELHQAKQRQLLEDAVRRVYIDEGEVHACSELLDSVTHAGKDIGKVPQGLAKDILDVRYPNHPQFSRRVVARDLQTLVDLVVRAAATGTADNLKSSDMDLVQAFAVPLEMVYPGQNSISRRADGRYLTRVHGLLRDGERTQARALRDVLSADVQSGDGFGFTDEVVQFFLFYLLHAEGYEALKNGSLTVRVFRDLPSDFELKKADMVEHAEWDAALRVDAALFGGSKRADIPSVPEQAKLSREVEAQARELRSRLTELKSALGEVLAWTGLKLEDSERARTLVALESTLVALGEQQGNAERVRRLAELDKASDTLSAFASVIRSVEAERAALDSLSSQQAAFTIVAERGDDAERAAVVLALKNRLRAPVSAPLADFAPGWQAEAQSCLQAIVGRTPSPPPSVAEAGPEVAAQDAERGGGRVLTRRASGVSRAALAKELARLSKDAVRELGPDGDDAHFDIEISLVRRR

SEQ ID NO: 791 - protein, 444 aa, Haliangium ochraceum
MDTRTADIIIESLRAGEVPQEGLEHFATGIERHVAAFDEELGRIASGRGRYRFLRGEYGAGKTFFLRFLGARARFQGYAAAYVRVAYPEVPLHKPVELYRAICAGLGVHRKAEGGLQDVLDQWLMQLSERVADPALGPGMAPDHPDFARALEEESRRMLGQVADAAPAFAQALSAYIRASMNGEYDLARALLQWLAGDPKVAAQARKQALLVGKLDASDVLGMLRALAAVVTQAGYKGLVILFDEVERLVRLPRSDSRTRGLELLQNWMGALDAGQVPSTLLVVAGTTSFFDSPRGVSMLVPLQQRIGVLDDGPFPDMGAVQLGLPAFDEARLVAVGRRVRDLFDELYPGVAARVSDGFLTRLARDVGGAFGGKVEITPRRFLREVVGVLSRARQYQEYVPEQHYAFQLDDAGAPVLSFQERAVIEGRGVREVEEETLPDELDL

SEQ ID NO: 792 - protein, 1239 aa, Microlunatus phosphovorus
MSALLRDVIDIPEHAGAEDYVLRLTDSVGAGHAVAAVDNYVVTPALADAFERALALVADAVTSRISRGAFLTGSFGSGKSHFMAVLHAVLRQDPVARAKLELQPAIGSVDPVLRDRTILPLAFHLLGAESLEDALFGGYLRQIRALHPTAPLPSLHQSDGLLADAERMRDVLGDQEFFAQLNGTDSVGDGVDEWSALLGSGTWNADSYAQARAASPESPQRQSLVSALVERFYQSYVRQARYVDLDTGLAAIAAHAQALGYDAVVLFLDELVLWLAFAVQDREFFRRESQKITKLVESGIGHRPIPLVSFVARQMDLRRWFADAGASGAEQDALDRAFRHQEGRFAQIALGDDNLPYVAQQRLLRPKNDEGRRILDEAFGRISHRAGVWDVLLDGINTDEQHRGADEAAFRQTYPFSPALVSTLRSLASVMQRERTALKVMQQMLVDRRDTLTVDDVIPVGDTFPYVVQGAQPLDQKVAALFRSANTLYADKLEPLLREPYELTEGQLDGREPLPAGLVANQRLARTLLLSAVAPNVPALKGLTASRLASLNHGSIVSPLPGNEATMVTSRVRDWARQVPEIHLDSDVRNPVIRMQLSDVDYESIVEKAKGEDNEGRRRELIKSMVASGLGIELGPEDVRGAYVHQIVWRGSRRDVDLVFGNVRDPGWLSDEQFQNRPNTWRVIIDHPFDEAGHSWLEDSERLDSLISRERHAQTIVWLPRFFTEERMRDVRRLVILNWLLDGSGDRWTSHADHLSETDRVQARAILESSRTTLRHTVERAIQVAYEAAAPTRSGDVIDDAHERVLTSLDRGFDPQRPVGVTLAAAFANLLEQAFDATYPAHPRFQPSDIEVRPRDLKAVYEHVERAMADPDRRVPLQGDIAAVRRVANPLGVGHAAETHFVFGDDRLQPWAAEFERELGRRGNATGPVTVGEVERWIESMTPPNGLRSEVKHLIVLAWAALRRRAWFAYGAPIPAPAPGALRPEMEMREQAMPEPTDWSVANDRAGRLFGTTGGRHLTPQAVADLAQRVKEAVQARYQAVQDLVPAVERAYGRVDLDAGGAGQRLATAKSAAELTQVLRHLDGVDLIRRLAVADVGNETALARSMSTAGAVASALGQFRWERLRPLQDAQRGEGPRAEQAADILEDVRRSLESDEMVVGIVGALERAETALFTWLTPPTLPDSPVRRQDQEQQRRTHPSAGRRTLAAGDSPVAVVSELQAVRDAHPGRAIIVEWHVEE

SEQ ID NO: 793 - protein, 1268 aa, Micromonospora aurantiaca
MTLLRDLIDIPTSVGEGDFVVKAAEGADLHRYVVTDQLRDNFATALQRIGHAITTGRSQAMFLHGSFGSGKSHFMAVLREILAHNPEARKIKGLEGPVVAADSWLPGRKFLTLTLHMLDARSVEQAILEGYLRQITAAHPDAPVPAVHRSDALLDNAAGLRRTLGDDKFFAALRGGAAAPGAGGLGLAAMRAQAEGWTPQRYAEAAAQPPGTKDRDALVSALTQTFFSGAVHSAEYLDLDSGLAVITRHAKSLGYDGIVLFLDELILWLSGRIADYTFVNTEGAKLNKLVESADAARPLPLISFVARQRNLEEFLGPQVGGTEREALAHVMRSVQGRLGEIVLADTNLPEITEKRLLHPNDEAARAVIDNAFAAVRHNREVWDILLLGAQYGDAGIGSDATAFRQLYPFSPALVATLVALSQALQRERTALKVMTELLVERRDTLKVNDLIGVAALFDPLVLHGELPDRPKLRQQFDAARNLYLRKMRPLLLTLNGIDDERAAAHTQFQLDDKLVKTILLGALVPEVPALHNLTAAKLHALNFGSIASPIPGYENTMVLTRLRKISQDAGELHLTDDHDPVVSLKLHAVDFDKLLDLVPHNETSAGVRQQLLRELISAEMGLTGTEGSHGELQHPREWRGRRHVVQVKFGNVRDPLTMPVAALIAPGESWRVIIDYPFDPQDFPRNADRARIDELPRGSNTVFWLPLYLTDDMMSRVAQLAKINYLLGVGGAGERLNTLAADWPQADRQQGRVYLLQRQTQLRDGLITALKQAYGAATPQPSDVHSDSVGVLHTLADGLRVGDPRGGTLADAFRNLTGELLEWSYPGTPALPVDEKPLARADLLKVFEYAKRAAADPTHGVSIDSPADQKTLRRICNPLQLGEVVDHRYVLDISTCFWSRHLLQEAARQDYRDRWPVHVLRKLLDLPKARGFDRELQNLIIAVFAFEQQLSWYDNGGKISVAAVNGVEDRFELRHPPMPDDETWKAAVSFGQPFFGEVLPRFRNPANLGTLAGTMRQVANRYAGDAGQLVVKLDENAERLGLDPHAETGRLATARRVAQFLSEVAQEPDDVVLVAVVAEGEPRLGGMDGHAASQVFKQARQLVDALAAAQWSVIDAITRRAWAQEDARARLIIDRLHAAGRDEQHGTDLAEALRQAVDASVEMLAAQRITPHPLPPATPISPDPTQRVVPSGGPAPVVDPGRPDVRPAIPKPRENGSSALADPDPMTGEAVVHDAAALEKVVGELRKEISAGRRVIISWRAEAPERQS

SEQ ID NO: 794 - protein, 1230 aa, Mycobacterium gilvum
MSTLLRDVIDIPERVGSDDYVLRLTDSTDDDAHIAATLDAYVITESLRENFDAALDLVADAVNQNTSRAAYLTGSFGSGKSHFMAVLYALLGNHPAVRTSKFQALTGHYDGELTGKKLLRLTYHLLGATSLERAVLRGYVDQITRLHPEAPLPAVHLSDKLLTDAENLRDKMGDEQFLAGLAGSNGGGGGDPWGGLIGGGWDLPRYRGALAAGPEDPERRELVSALAGSYFGSFAETADYVDLDRGLVVISEHAKALGYDGVVLFLDELVLWLAFSVRDTEFFARESQKITKLVESSGRQRAIPLISFISRQMDLRKWFADAGASGAEQDALDRAFQYQQGRFREIELGDDNLAEVAHARLLKPKDEAAQEILNKAFADLTRSPEVWEVLRDSLNADDKHRGASEAEFRLTYPFSPVLVSTLRNLSSVMQRERTALKVMQRMLVDRRDTLTVEDLIPVGDAFDYIVEGSEPIDSHAKNMFDAAHDLYRNRLLPTLLDKHGVSTEQLDTDPDSVPRGFRGQERIAKTLLLSAIAPNVPALRDITAGRLAALNHGSIKAMVAGGEARVVLGVVRDWAQKDAPEISVSDGANPVIRVQLAEVDYQSVLDRIRAEDNSGRRRALLRRLIHQALGVGTAQDDLGGAATRTVIWRGSRREVDIVFGNVRDAASLPEQSFDARPGTWRAVVDYPFDEAGFTSADDINRIDRLLAGGDRHTVVWLPRFFTESAMEDLALLVKLDWLFTGSGDRWTENSDHLSATDRAQALGILKNLESGTRTGFDNLLKQAYGIEPADAKRITADSQQFDVLTSLSRDFQPQLPPAANLENAFLNIIDQAFSATYPNHPQFDPADSEVTARNFETVRDYVEQASTHRDGRVPTTPGADRTAVRRIAGPLRVGKATEDHFLFDQTSFDYWATELDRAAQAADPVTVGALQAHIDVLSPAWGLRPEARDLVVSAWALLRKRAWFEAGSAITAPPLGRMRPNIELRAEQLPEQQAWDDARAHAAKLFGYTMARTYLTGANVADFAAQVRTHATEVGTKLGHLVDELHEAYGRLDAVAGADDRLTAARALHDAADTLSRTAGNVAVIDALAAVELPVALETAGQIGADAPRDSVTLRNFKWPLVEVLKTGARTGGDVGDRANAIWKSLQEAVSIPGRSLSDDLTAAEGKLVTWVVEREPVTSPPPPPPPPPPPVTERDRVLRNTDDLAGLQSEITAALQDSGKKVHVRWWLE

SEQ ID NO: 795 - protein, 1302 aa, Nocardia cyriacigeorgica
MDQRPLLRDLIDIKEHVAGSDYVLTLADAVTEEGSTKAVEDYVLTDRLLGNFDEALALIKSALDGNTSKPAFLHGSFGAGKSHFMAVLYALLSGNPVARSRGEFDPVITKHDWLLSDNKKFLMVPYHMIDAKAMEQRVLGGYVEFVRKKHPEAPIPPVYRTDALFTDLRALRASMGEDRFLAVLNQDQAGEDDEWGESTAFWTTQKVDTALSASESHDGGGLNLVNPTTPPELRAKLVHDAGTHLLPGFAQRAAEDESGFISLDAGLSVIAAHAKSLGYDAIILFLDELILWLASLIHDEKRVAREASKITNFREGGDARRAIPIVSFIARQRDLRELVGEELAGAAESAIQDALNHASGRFDLISLEDRNLPQIAHARLLKPRDAAARAEIDAAFEKTKKLGPKVWDTLLGSDESTTGADEASFRLSYPFSPAFLDTLVHISAALQRSRTGLKLMGQLLADHRNELRLGDLVPLGDLYQQLTRGGDRPFVADKKVLFEAADKLYKTRLRPYLLSSCEVTEDDIDAYLNRRETITDPKLAGNCKKFVGQNRLACTVLLAALAPSVPALRDLTIRRLGALNHGSITTMIPGREEGVIKDMIGEWAARFPEIKLTGTDVNPGVRLELSGVDVELVLANAQVNDNPSNRLALARDLLAEEFGLDRANGRFDADELRFVWRGSNRTVEVIFGNVSDEDALPNHDLQPTYEGLWRIVVDLPYDEGLLGPVEDADRIRRLKQEQGGNHPRTVAWLPSHLTKPRWEDFRRLLVVTKALADPYRFDTQYAQHLNPDNRASAKQLLESQRETLRKRVLATFKQAYGLAERKPDDVTNDLDQLFHPLPDIDGLTISIGQSMHDAIRTLAGKLLAHQFPEHPNLDPDGTGTAVKPTDAKTILAHVKGAAEARDNRFEVPAKDRALMRRVAEPLGLGQQKEAYFELSRRWADHFRKSAQNAGSTGDLSVISLGDWIDLPQPRGLEPHIANLVIASFAEMDDRIWVRGGVPIDTPELTKIHAGDALRTQPLPSESDWDTARNRFEVIFGEKPPTLRRGGPVQLFARQISSSATKYHDAATRLVEQLEKHAEFLGLDDNEPSGRLALARRSLALLSALVSTGGGGSAGAKKTVEALAHFDLAEVNADRYATSIKSAENVIAALTHAAWRNLEQASLLGPEGAALLDSLRNVARSDQRSADLADALRSTDAKITALTTRKLREEDERKRREASPTPISPISEGTTRRTAEADDVDLGTRTSNPPLDGSTPQSTRSRRRSGKYTTTARDAVAKFSAEVAELAELEPGASVEILWRVIE

SEQ ID NO: 796 - protein, 1240 aa, Polaromonas naphthalenivorans
MTLLKDLINIPERVHQGDFVLKLSEGVTHADATLRDYVVTPQLVDAFENALGFIKQSVESSGSKAAYLHGSFGSGKSHFMAVLNLLLAGNTQARSIPELAGVVAKHGWTNGKKFLLVPYHMIGARDMESAILGQYAEFVRKLHPSAPVPGFYLAEGLFGDAQRMREQMGDAAFFAKLNEAGGGAGGNSGGDNAGWGDIDSGWDATRFEAATLEAPNGEERSRLVGDLITQFFSAYRSLAGGGESFVSLDDGLSIMTRHAQALGYDAVILFLDELVLWLASHAADVGFVSREGTKLVKLVEATNADRPIPLVSFVARQRDLRDLVGENLAGAVQSQFSDVLRHWEARFHRITLEDRNLPAIAEKRVLRPLNEAARQILKAEFEKILAVRRDVLDTLLTTSADRDMFQKVYPFTPALVQTLIAVSAALQRERTALKLMMQLLVDRREDLQLGQLIPVGDLYDAISEGDEPFSEGMRLHFDNAKRLYNQRLLPMLESQHQVTLEAMKLGQADSTAARNLRNDARLLKTLLLAALVPEVESLKGLTGARLAALNHGTFKSPIPGREAQDVLRKCRDWSSQIGEIKVTDDQNPVVSIQVTGVDIEPILRAAEAIDNAGNRRKKIRESLFAELRIPDDGALFTTYGFTWRGTHREVELLYENVREMTDDRLRGRSGAWTVVLDFPFDEPNFTSNDDIARLGDYCGGDTKTLVWLPSFFSHKALADLGRLVVLDHILSGERFESYATHLSFVDRVQAKALAKNQLDSLRSKLRSQLEVAFGISTEPRDAVTQVLSADQQFCSLDPTLSPRPPVGASFKEAFEALLGQLFSHQYPGHPEFDTEIKPGVIRKIWPEMQRAIEAPDRRGLVPDSATRRLVRSVVFPCQLGQMGETHLLVQDHWRARFAQSHARDGGGAMTVAQLRRWIDMPTPMGLPLELQNLIILSFAAMTNRRFILRGGPVEPTLDSLADELELREQALPDPAHWATAVKRAASLFGLIVSQTLNAGNVGRLVDEVRREAGTKREAVGTLVASVRDRATRYGASMAGRVRTSESAQALLATLQAASDAELVQALASASVETSEAAVGRSMGQAPQVAQALSNAKWSIFDSMRNLQDHRQAAAASILSRLTEVLGSDEHVIALKPRLEEIERDAVHLLTMAAPTPPVPPLPPQPPIISPVPLPVIPDPAPFTRNGTPPSAAEFVDGDEKMGLGTDEAASLLKDLQERLQGDPGLELSLSWRLERRSAQP

SEQ ID NO: 797 - protein, 1285 aa, Saccharomonospora viridis
MSTNEVYLRDVLDIPESVHAGDFKVELTGGFTQVEARVAEYVVTDQLRQAFDKALSIVRAAVRDGTSHAAYLHGSFGSGKSHFLTVLHAVLNNHPAARAKPGLQPVIADHDDWLRGKKFLMVPYHLVGATDLDSAILGGYVNTVRSLHPDQPTPPVYRADAMLDDARRYREARGDDAFVDWLSIGATTPVPGTPDEDDDLDLDIPDDTGINDTGWTSEQLDRAFTAPAGDPVRDRLVQALLSGPMSSYIRGASGDAEAFLPLENGLSIITKHARDLGYDGLILFLDELILWLQAHMSDRQFVNNQVSKLVKLIESGDAGRVLPIISFISRQRDLSKLVGEDVTGAEVKELERQVEYLAGRFDTVPLEDSNLPAIIKERVLKPKPGGREILDAAFAGIESAKQAVRDVLLDADGATGADWQDFRDVYPLSPALLNVLMALSGALQRERTGLKLLQEMLRRRRDDMKVGELIPLGDLWDVLADGIGEAFTDRLRREAEAAQRFYTKARAWLVERHGGEHTQQFRATDRLVKTLILAALAPQVSALTRLTGSRLAALNHGSLRARTVSAGSLAVTRLRELQAEFGELRHEGDEDPVFRLQLSDLDVEPYLDAVGEQDTPGARRIWIRKQLWSQLGVNDTDDFVSEKEIVWKGTRRTAEFVFANVRDERELPDVQFMPSTPGRIRFILDYPFDGSGDYTPRHDAERIHRMRRDDITAATIVWLPHFFSAQKSAQLGRLLKIKYLLERDRLDDYVRNRSADERVKIRHQLEAQCDTLENQLAAALRQLYGIAGGDDTTVGAPVGEDGHVMSLYPDHKPRLAGGAGFEYNALTLADGLFDKLYPKHPNFDPTGNRKAITLGELRTVLDWITKAMEDGSRRVVVDRNHLALVRKIVHPLELGEVSDGPLNVSAEWRRRIEQAATQHGVTGDLRVEDIRSWIADLGYTGLDKPVVNLIIATYAMLADRTWTLHGSVLRQPPELDKIGPGHALRAQQLPDAAEFATARDRAAVLFGIVVPDTLFARNVSRLAEGVRAKVAELETPVNGVRRMLERHADTLGLTHRPDAPRVVATRDAADLLARLSGAAEDTDLVNRLAKATYGTNDTVLAATMAAAPRLLESLRDVEWSLVSSVQGFAGRGDLIGNRADALLDEVGHAAAEDEFAVSLAPVLEQLQSKAVALVSDAARLTAVATPGPVSPVRTDTENTSSGQAAGADTVSLTDTGQPGISRHEPEPSATPSHRAPRRLRASAAERDLAALLEGVRDEIRDYAREHPGAEIEILWRTVGGEDNAE

SEQ ID NO: 798 - protein, 1273 aa, Saccharopolyspora erythraea
MSQTFLRDVIHIPESVHSGDFKVELSGGFGKTAERVEQYVVTDQLRTAFGKALSIVRAALRDGSSHAAYLHGSFGSGKSHFLTVLHAVLNDDPAARAKLGLQSVIADNESWLSGKRFLMVPYHLVGATDIDSAILGKYAEYVRIEHPDAPVPAVYRSDALLADARRLRESVGDTKFIEMLGESSQPAKSGSGGIKDVPNLKRKPSSSWESSTLDAAFAAPVGDGNRDALVSALLSGPMSSYQRGASGDEKAFIPLEDGLSVISRHARDLGYDGLILFLDELILWLQAKMSDQKFVNEQVQKLVKLIESGNADRALPIVSFISRQRDLSQLVGDDIAGKDVKNLEAQVHYLAERFDTVSLEDRNLPAIIKERVLKPLPGGREILDEAFSTIESSKAADREVLLDADGATGASWENFREVYPLSPALLNVLVALSGALQRERTGLKLLQEMLHRRRNDMKVGELIPLGDLWDVLVDNSGDAFTDRLKGEAAAATRFYAKSRAHLEAKYGSGSQDFVAVDRLVKTLLLAALAPSVSALGRLTGQRLAALNHGSLRSRTVQAGSLVVSKLRDLQADFGELRSEGDEDPVFRLMLSDLDIEPLLDQVGEQDSLGARRIWTKKHLWAELGIRDADSRVAEREVVWRGTRRTAEFLFANVRDTSELPDADFAPSVPGRVRFVLDYPFDDPDKSPADDAARVARLRRDEHAPTIVWLPHFFSTQKAAQLGRLLKIEYLLERDRLSDYAGTLSEDSRLKIRHQLQANADNLRTQLVATLRQLYGIAQVDENAVGRHVGEDGHLMSLQPGHKPRPYGGAGFDYNVLALADGLFDVLHPKHPDFDVNRNRKAVTNAELRTVFSWIAQAAENGGRAVVDAKQLPLVRRIVHPLELGDVADGPLNLSSEWRRRIEQAAAQHGVSGDYPVDKIREWIEELGYTGMDKPVLGLVIATYALLADRAWLINGSPLGETPDLDKIGLGHSLRAQELPSAEEFARARERAAVVFGVKIAETLSARNVGKLASAVRVPAKSSEEALSQVRHALERHHAKLGIAGDAPRITSTLDASDLVARLVRRADGDTALVRELAAAEYRTADASLGSAITSAPSLATALTTIEWQLVDSVRSLVGGGDPVSNRAEGLVDQLAEVASADEWTRDLAPVLQEFRPAALQLLADALERDRRSKEAEREKAGPDVPNPPLPPAPSKADDIALPDNGRPSVSGTIGHPTEQRNPRTTKRVRASAVEDRLAEFLNQLKDEIGEHAAAHPDDEIEITWHVVRDEEAR

SEQ ID NO: 799 - protein, 1218 aa, Saccharothrix espanaensis
MTTAASGSAPLLRELIDIPEGVHRGDFVLKLTEGVDSKRDDALRSYVVTPQLRVAFGEALKLIKSALDEHSSKAAYLHGSFGSGKSHFMAVLHALLDGDSRALDRPDLAEVTTRHRWLGEKRFLLVPYHLTGSESLEAAILGGYVDHVRRYRSDAPIPQVYRAQGLLEDARKLREKLGDQQFLSGFPNEADTGWGDLGAVMTPEKLDEGFDAPIGSPASDNLITKVVQAYFPNYVDSVRGAASAFKPLDQGLSEISRHAKSLGYDGIVLFLDELVLWLAGKIGDQAFISRETEKVAKLVEAGDAHRPAPIISFIARQRDLRELGIGADRTGAELQSFHDRLNHWDGRIEKIPLEDRNLPVIARERVLRRLPGGEEQVRQAFQRTGALPGSVRDVLLGSGDGDSFERTYPFSPAFMDTLVHVSSALQRERTALLLMRQILVNRRDDIKLGQLVPLGDLFDAVADGADQPFTEQLKHEFDEARLLYQRTLRPMLLRDRDLREEQVAGQAAVGPAVLQAFRSDDRLVKTLLLAALAPDVDALRDLTARRLTALNHGTITTPIPGQEVAEVVRRLRSWASRVAELQLGEGSDPSVRLNLVGVNVNAILERVTTLDQQPARRRLVRELLFKELGVTDTGTTPIEHPVAWRGSRRVLEIVYGNVRDQQDLRDDLFEPSYDDRWRLLLDYPFDPDSPSAADDYHRVVRLRAEKGNRSAVAWLPGFFTSDVLDKLGRLIKVEYLLADRARLEEHTRTIGAEDRQRARDLLGNLRTSLHSELKEALKNAYGLVTRPKEEIVQDWHDHLVSLDATVTPRVDAGRSFAEALKSLVDQVHSMTYPDHPDFDPQRKGDLVRDADLRTTLTIIRRAADAPEGRVEVDRPHREALRRIAHPLKLGEEHNGPFVLSRHWADELERRAAREHEQDADLPVRTVRGWLRDLGMERRVENLVIATFAELTHRAWRHRDRLVDPPESPEAVADDMVLYRQALPTPEQWDRACLLAAALTGTDLRTAVISPRAVARFARVVGKKVDQLRLPAVGLVELLDQHSGRLGLDRSASRGRYATAVAASDLAIELHTVTDPTGLVAAVAAADLHDIEPMVISRSLETAEDVSTALRAADWAIFEMLDDPTAADIAAELRQGVNANEHATPLRRALDQAKRRLIALISKPTPPPPPSPEPTPLNPGGGVHQATGRLTDVMAELTRFGEEHPDVTIEVTYRIVERG

SEQ ID NO: 800 - protein, 1235 aa, Singulisphaera acidiphila
MPERLISELLILPERVRKGDFVLNLSKGVTDPKKTLEDYVVTPQLVECFDDALGFISSAVDAVNSKACYLHGSFGAGKSHFMAVLHLLLKHDADARSLPDLAKVCAKHSWVENKKFLLVPYHMIGARNMETAILGGYVDHVMEAHPGAPLPGVYLADEIFKNAVQYRQRLGDEKFFEDLNQGQKNPGSAGWGKMAKGWDAPRFEAAMEAPPSSQERSRLVGDLVQYIFPAFKGIAQGKDEAYVDLDVGLSIISAHAKSLGYDALILFLDELILWLATHSADLGFVQTEGNKLAKLVESRKSDRPAPIISFVARQRDLRDLIGDNVTGVEQLNFSDVLAHWEGRFHTITLEDRNLPLIAQKRVLRPKNDVCAAELNEAFEKTAQVRQEIMEILLTRESDRAMFKQVYPFSPALIQALVAVSSALQRERTALKIMLQLLVNRRDTLRLGDVIPLGDLWDVVAHGDEAFTDVMRVNFENAKKLYQAKLRPLLEQQHQVDLEVDRERAADSEEVAARLRLFENDDRLIKSLLLSALVHGVEALKNMTCMRLAALNHGSIRSRIPGREHQVVAQKFRTWAGMVGEIRVGEEPTNPTVSIQLSGVDTEGIIEAARVYDNPGNRQFKLRQMLFKSMNVPEQDEMYISHAFVWRGSRRSCDVLFTNVRSLPDDSLRSGDEWKLVVDFPFDSEGHSPIEDLDRINKFRNKKEKPRTLAWLPSFFSPRTQTELGKLVIIERLLLGNNLDQYAQHLSLQDRQTARLLLQNQQSALSQRLVQAVEAAFAIRSEPTPGTLDDSYDMSESHFQSLYPTLVLQRPVGANLGEALEHLLDQALTHQFPKHPKFGQEIKPGKDLRQVLEVCQEATRTPDGRVFVEDKAVRQKLRNVCNPLELGTMSETHFVLTNFWKSHFNRLLAASDQTHPTVGELRKWMDQPEERGLPREIQNLLILVYADQTNRSFMRYGGNYAPSLDDLPNELELLEQSLPDLKDWEGSVTRVAEILGHAVSKLLNASNLATLTSKVNESLKEYRPDCDRLADRLQVVLSHLNLAEGDVAQADRVKTAKAVREFLASCDGKEATKLVGAIARATLETSSTAMGKSLKSAAAVLNSLNNTRWDLFTAVSDIHGDRADEAARLIKDVVTWLKTDEHALASGLASKLSDAEGRAIQLLTPPKVAKPKPPIQPDPKPTPAPGPKRWTPIGSGQQDRMTAKDWDSKSQELLEKLKANPRSRLTIDWTLEEESE

SEQ ID NO: 801 - protein, 1215 aa, Sorangium cellulosum
MTVLHDLLDLPAQVTKSAFVVRLVEGVSHPDALLDSYAITPDLHGSFDRGLGLVGAALRDRRNIAAFVHGSFGSGKSHFMGVLSLLLANDARAWGEPALHDLLGKYEWVKTRKVLRLHFNLMGARSLDEKVFAEYLVRVRELHPDAPIAPLFEDQALFDNAQGVRETLGDAAFFDRLGASAGADARWGKKGAAAAWDAARFDAARESVDPEERARLFSALVKTLFPAFAAQKSQYVSFDSGLPRLAQHAAALGYDAVVVFLDELILWLASGASNREWLNLEIGKLAKMVEGQSDDQKIPIVTFAARQRDIGEMVGEQYAGADAEAVKAALKWWEGRFDVLKLEDRNLPAIVEKRVVRAKSDAAKRALDTAFDRLRASLGNVAWGTLLGEIGDEKGFRRVYPFSPALVEALVAMSHYLQRERTALKVLVELLVEHLDDFEIGKVVPAGDLYDVLAGGEEPMDGTMRERFAAAKRLYLNELLPVIQRANETGSKERCQRERSDHPVTLGCSNCREARCRADNRLAKTLLLAALVPNSAVFRGLTASRLVQLNHGTLKSPVPGAEAQQALGRIRAWAAECGKVRIGEQPTDPTVSIVLEGVDLKPIIDAARGYDSSGTRRAKLREILFTAIGIELGAGPIVHTVPWRGTDRIGAVHYGNVREMDDGTLRAESGHDFKLIIDYPFDDPGRTPAEDEARLRAYTERYPETPTIVWLPSFFAETPQRDLADLVVIERILEGDNWKTHLQNLRPDDQSRARAELSSLAAQKRERVKRALNAAYGLARVEPGMLDAGRTVDQHFHVLMQGFRISTLVVATMKDGVIEVVGQLLHELHPRHPHFDIRVTKGKLTANLEQLQRLYEAEGQRLLLAKTERDVLYFAEKLGLVNVNDGQATLQPLRFQEAENALRAQGIDTPTVAQVQRVFDTKGVLGLTREVEDFLVLAHGIATGRELMRLGTPVRDPVLGKLGEDLELPKPPMPDPVSFQRALERAGVIFGVSLGGRALHARNLRALGDKLGAAVAKATADRATEVAGLLERRSAAFFDEPHGPPPRLLTARKVAELLGGLGGDPLKQVTALAALEVAPTSETAMQRHLLAARATAECLADDLVFQSLEALRGHDEPEAQAMLAEVRETLEKDELQKALATPLRALALKAQQWARKTRRASSVPPPTGEVVGTGSATTLDELEAERARMLEALKNAGPGGRLVLSCSWKVVREKP

SEQ ID NO: 802 - protein, 1294 aa, Streptomyces coelicolor
MAQPPLLRDVIDIKESISTSDFVLSLAEATTPAGAQHALRDYVVTERLLENFDEALALIKSSLDGHRSKAAYLHGSFGSGKSHFMAVLYALLSGDQAARARTEFDPVLTKHQWLSTDGKKFLLVPYHMLGAKALEQRVLGGYVTHVKKLCPEAPTPQVYRTDSLFADIRAMRANMGDEAVIRALGTSGADDAEEDEWGEGFAWTPQLLDTALAAEESHEAGVHLNLTNPSTPAELRAKLVNDAGTNLLPGFTQNAAEDEHGFISLDAGLSVIAEHAKSLGYDGLILFMDELILWLATLIHDQKFVAREASKITNFVEGGDARRAIPVMSFIARQRDLRELVGEEVSGAAESSIQDTLNLASGRFDKITLEDRKLPQIAHARLLKPKDAEAAQQVDAAFEQTKRVGPQVWDTLLGSEKGTTGADAESFRLTYPFSPAFMDTLVHISSALQRSRTGLKLMGQLLADHRDELRLGQLVPVGDLYPVIAQGGDKPFTDSLKVVFEAADKLYKTKLRPYLLSSYDITEDDVEQYRNRPESLTDPKKLNGCRMFTGDNRLVCTLLLSALAPSVPALSELTIRRLGALNHGSVLAPIPGAEVGIIKNKVAEWAARFPEIKETGTDANPGVRLELSGVDVDSVIANAQVNDNPGNRVALARRLLSEELGVEHGQLSDQLGFTWRGTARTAEIVFGNVADEDELPDHDLMPQEEGRWRIAIDLPFDEGEWGPVEDVNRVQRLRERQQGERSRTIAWLPAHLSATRFADFRRLVVIDKALADEHRFDTQYAGHLNADNRSRAKGLLETQREALLKQAKGAFKQAYGLAQKQAADVVPDFDDHLVALPDVDGLTLSFGQSLHDGIRHVAGKLLTHQYPAHPDLDPDATGTAVKPADTKKVFAHVRAAAEARDGRIEVPAADRKLMQRIAGPLRLGQQKEAYFELSRYWGDHFRQLARSQGVTGDLSLITLTDWTDRPDPRGLPDFLARLVVAAFAEMDDRVWVRGGTVLDPAPELAAIKDHDALRSQPLPAESDWDTARQRFETVFGAKPPALRRGRMVNQFARQIIEAARDYRDHAADLVHQLEAHASFLGLDQTADTGRLALARRSLQLLDALTAEAGKGAAGAKKTVEALASFDLGETSADRYGTSIKKARAVAEAVASAPWSTLELAAGLGPEGEALLDSLRNVARDDQRTADLRDALARTQREVVALIKRTQAAATPPPAPAASQPTAGDLSLDTPTSDPRIPYTSQETPTSSGGAGTARTSGGRRTTAARAVTDLQAELSDLAVRHPEATIEITWRVVE

SEQ ID NO: 803 - protein, 1299 aa, Streptomyces griseus
MVQQPPLLRDVIDIKESLSTSDFVLRLSEATTPAGAEGALRDYVVTERLRDNFDEALGLIKAALDGHTSKAAYLHGSFGSGKSHFMAVLHALLSGSPAARARADLDPVLSKHEWLGTDGKRFLLVPYHMLGAKALEQRVLGGYVTHVKKLHPDAPTPQVYRTDALFDTIRSLRERNGDRFIIDGLASSEATGGVEDDEWGEAFAWQPELLDTALAAEEVHESGQALNLVSPSTPAELRARLVEDANAHLLPGFTRNAAEDEHGFVSLDAGLSVIAEHAKSLGYDGLILFLDELILWLATLIHDQKFVAREASKITNFVEGGDARRAVPVVSFIARQRDLRELVGEEVSGAAESSIQDTLNLASGRFDKITLEDRNLPQVAHARLLTPKDPESAALVNAEFEKTRKVRQEVWDTLLGSDRGADGVGADEESFRLTYPFSPAFMDTLVHVSSALQRNRTGMKLMGQLLADHRDELRLGDLIPVGDLYPLITAGGDKPFTDSLKVVFEAADKLYRTKLRPYLLATHNVSEEDVEQYTHRGPDSIADPDLRGRVKIFVGDNRIVGTLLLSALAPSVPALSDLTIRRLSALNYGSVVAPIPGREYGILKNKIAEWAGRFPEIKETGTDTNPGVRLELTGVDVDSVIANAKVNDNPGNRQALAKRLLSEELAIEHGQLANRVHFDWRGTSRSAEVLFGNLADEEELPDHDLSPNEDGLWRIVVDLPYDEGEYGPIDDVNRVRRLRERQQDGEPWRTVAWLPAHLSAQRYTDFCRLVVIDKALSDEQRFDTQYAGHLNADNRARAKGLLETQRESLLKNVKAAFKQAYGLAEKKPTDVELGFTEHLQSLRDIDGLVFSFGQSMRDGLRHVAGKLLADQFPEHPDLDPDHTGIPLKAADARKVFTHIRAAAEARDHRTEVPAADRKLLQRIAGPLRLGQQKEAYFELSLFWADHFRQLARERGVAGDLSLITLTDWTDLPQPRGLPDFLTRLIVAAFAEMDDRVWVRSGMPLDPAPELSQIKDHDALRSQPRPSEQDWDTARQRFATIFGEPAPTLRRGRMVNQFARLIIQAAHAHKDYAISLVSKLEEHAGFLRLDSTDEAARLPLARRSVELLTALGQSAGQGAAGAKKTVDALAAFDLGQVSADRFGSSITQARDVARALTDTSWTTLELAVNEGPEGQALLDSLRNAAGSDQRTIDLKDALARTQRDVLALVKRNRAAATSPPPAPPATPSADEVPLNTGTSHPPVPTDRVAEPAQSASRSRRSGGGRTTAARAVAKLQAEIADLAAREPGTAIEITWRVVES

SEQ ID NO: 804 - protein, 1261 aa, Thermobifida fusca
MTTSHPAASGKRFIGDLIEIPEAIHDGDLVFKVSEGTGGVDEEKQAQAIRDYVVTPQLARNFDEALTTIKGALAKGQSRATYLNGSFGSGKSHFMAVLHAILRHDPVARGLPRMPDILAKHDDWLAGKKFLLVASHLVDAESIEAAILGGYVRTVRRLHPDASVPPVYRADGLLADARELRARLGDEKFIADLPNPRGATASSGWGNTPWAAHSWTSEKLDEAFNVPAGTTDPEQARLRNNLISALLGSHFKRYADVVHGKGEAFVTLDEGLSLISRHAKEELGYDAVVLLLDELILRFTRFLGGDEARINAEAQKMSKLVESSESYRPAPIISFVPRQRDLRDLVGTNVTGATGGLFDTLKYWDGRFGHIKLDDSNLSEVVRHRLLRPKNSEAAAEISAAFERMVNTRPEVRDTLLDSSGGEADTWDDFRALYPFSPALLHVMVDLSAALQRQRSALKLMQQLLIDHRTTLPVGQLVPLGAILDVLVAGEDKPFHDRLSVEYEKIRNFYRDKVRPWLLSRHKLTEETAANLDVRNPFRAEDLLVKTMLLAALVPNVPALKEITVSRMIALNHGIIPARRTGQDIARTAAFFRELSAQFGEVRVGPGDNPTISLNLLRVDTESLMRSSYHAASDQAMRRLFKRLLWEELGLEPDATRTHILWRGTLRTVELDFGNVRSEDSLMRQRFEPEDPAAIRIVIDYPFDEGTHSPAEDRQRVQVLREEFDNPPATLVWLPHFLSESRQQDARRLLMMEYLLQDGVIEEKAPDWSSDDRREAYNQIDNQATQLRERLRGLLRSLYGATEPDDTEVGERVTQHVEAFLPNVDIAIEAGSQLRDALQRLAGKLLDHLYPEHPDFTATSGARREVRRSDLNAVLHAVEKAKADRLQRYEPENKNEIQALRRVAQPLNLATVSEVFVLRDTWLTALDDAARTEYADITDIKVRDLKKWIRERGDGKGLPDDIVDLLVLVYAIQSDRAWIRAGRRYTQVAIGSLEGDIVLRRQPLPSEEDFAIANQRAKLLFGLEPQPVRNARAVQRLAEQLKEKSVDWFAATESLLSQLQRHTEMLELDEEAPRLRTANITYDLLGQIRGQTEDSTLITALARADLPGDAAVYKVSMETAANVAAALDGAHWKFLRTLEKIAKGAGEHAPEARRLLQELRTVARHNEQQKKLATALDQITGEAIALIEKSVDPSTPGGEKKDDFSGPRPVTPPPPPSYTNAETTIRVSPGEDPAAAVANLRSRLNIPEDTELEIIVRVVRR

SEQ ID NO: 805 - protein, 1238 aa, Thermobispora bispora
MATLLKDVIHIPEELSANDFVLKLSDGVTAVEETLASYVVTPQLAEAFDAALSYIKGALEKGRSDAAFLHGSFGSGKSHFMSVLHAVLQHNPHARRLDGLAPVIAKHDHWLSGRRILCLTYHLIGAESVEAAILGGYLEQIRRLHPDAPLPELHTTDGLLADADRLRERLGDEAFFAGLGGGGAQPGWGTLAAPWTADSYERARNAPIGDPERGRLVSALVNSYFSGYVQTGAYLALDQGLEVVSAHAKQLGYDCVVLFLDELVLWLASRSSDVAFVSGEGAKVAKLVESAATRRAVPLVSFVARQRDLRDFLGPNVPGAEKYAIGETFRWWEDRFNKITLEDRNLPVIVKRRLLQPKPGAEGVLEAAFRKVTREPKIWNVLLEGLDESSDADAFERTYPFSPALVSTMVALSSLLQRERTALRTMAELLRRGRDELTVDDIIPVGDVYDVLMDSGVVPLTDEMKQRFANARALYEEKLLPRLLDRHRLATPDHAKGLPRTHPFVTDARLVKTALLAALAPNVPALRALTAQKLAALNHGTIATPLKGMEAARVLALFRDLAASGVSEIHLSDDPANPLISIQLAGVDYERVLDRVRHQDSKGERRRLLRELVFESLGVTGAKAETLGGTYTHSFVWRGTRRTVDIVYGNIRNADELPNSALMAEGDRWKIIIDFPFDEAGHGPNDDIARFENLQREGVRSRTVAWVPQFLTEARENDLGELVCLRYLLASDDRYEQNASDLSVQDRATAKVLLLNRKSTLETKLNQVIQQAYGAAKPEPADIDLDRGHSAYFATLEPGLELGAPVGARLADCLEHLLDQILSAQYPDHPNFPGEVRRSDLTTVLRYLELAAAEESGRIPVDPKDREVLRKVANPLQVGEALENAFLFTPDTFPWRKHLMQRAAQEGLDQVISVGKLIEWLDEPRPRGLDAGTRGLVIAAFALMEDREWYRAGERVPMPSPERIDASYELRLPRLPDDATWRRAVGRAARIFEVHVTELKSAANVRRLATEVRDQARRLQEPARRLVTALESRRGVLALPEDGGRLATARSAATLAATLAAEPDPTTLAEALANAPLAAGEEVLGYALRTAGEVLKALDDMDWGLLDAIASIGDDPRAADILDRLRAAAGNDEFAERLAPALALARRTAQMLLASRVQPQPGPGTGPEQPITSATLGAAASTGVTATAQYTAQAIDDRGAGGRITVPGRRIDEAIRELRAFAAAHPDTEITVTWSERK

SEQ ID NO: 806 - protein, 1227 aa, Hahella chejuensis
MILLKDLITIPEKVQSGDFVLNLSTGLEPAAVKQTLDQYVVTPQLARAFEDALGFIKSTIEGNQNRQKGAYLHGSFGSGKSHFMAVLHLLLQGNAEARAINELAPAVNKHDDWLQSKNILLVPYQMIGAASIEAGVLGGYAKYIHKHHPEAPIPGFYLADGIVKDAENLRATMGDVAFFQALNKNGQGGGEDSGWGDIDSGSWELDSYTLAISANGNRADRSRLVGDLVQAFFQSVTEAAKTDDQGFVDFDEGLLIMTEHAKALGYDAVILFLDELILWLASRISDEKFIAKNIQKVVKLVEASEPRALPIASFIARQRDLREFVGDQYTGAQQDSLSDALKYWDGRFHTIKLEDRNLPVIAQRRLLRPVSESAKIQVDSAFETMDSKMKEEIFNILLTNQGDREQFRSLYPFSPALVQALVALSTALQRERTALKVMLMLLVQQRDTLELGNVIPVGDLYDVIASETKPFSDAMRQQFENAKTLFERKLIPLLESDHNLKYADFDSIPDTDSAKRAFNNDLRLIKTLLLSALVPEVECFKQLTANKLAALNHGTIKSPIPGKEASMVLSRCRKWAGQVGEIKISDDTNPTIALQLSGVDTASILEQANSYDNDGARRKLVKDMVFAALGVQETDDMFQETTHKFTWRGTTRTVEVLFYNIREITDFTLFEARGDDWKVIVDFPFDRDNHTVSDDRARIQEYESHSSPTRTLCWLPYFFSQTAQKDLGTLVRLEYVLKTDDRFSSFSKHLSPVDRGQARTLLENQRSQLRQRIKDYLLGAYGASERISGSLDDGAGSLDSQIISLEEGFKPRLPFGSTLGKAFENLLGQALEHQYPEHPEFDSEIKLTDLGKVFEQIRRAIFAQNHRIDVETPMRPLMRSIAQPLKLGEMHERHFIFKPDWPNQLTRGLAKQQQTGEAITVKRIREAIDQPSPKGLPEIVQNLLIQIFAEFGQYAYSFHGGSYDVTLKDMPDNLELIKQDLAEPDQWQKGSHNAAEIFGITVSPLRTANNQNELQKHIREEIRSCLPNCESLAQHISKRLDWLKQPLTGNRIRNAQYALEVLRELQAAEGATLVKVLAGIKPITNLLALGKSMTTAGSVVQTIQDNNWELLETVWNGNDPAGKAIRQRVCDALAADELVTALSPAFRQAQQDATRLIAQNTPPALPEPTPEPKNPKVRVIKQDNKTGLNRDAAKALFAEIEGAMSTGETLELSYRILHTDDSAGGNS

SEQ ID NO: 807 - protein, 1120 aa, Aciduliprofundum sp.
MRYEEIIGLNDYFQPVYDLENEIGTYWKQFIPNEKFYKVLSETINSLESSKPEERKSIWLQGAYGTGKSHATAVVKHILFDDLDEINDFIENLEEQIKFKIKNFRKNKRAFPVVLKGTSSIIDNRTFALVLEKAVKNALKKEGIELNTKTDFDKMIKKLKSDEINWEKIFKGTELEIYGTKEDIISKLQQGDITILRKIENILSQKGIHFSTENIANWLVEVQNELKNKEIADYLVIYWDEFTGILELPKSGLLLTELQNIAELSINKGVYLFVVAHRKPYQTNISRDDVEKVLGRFKVLDYSMEPITTYHIINAAIKKKDMDKFTEIKDKYMDSVKSLIEEITGSEGTQVQKSLESLFPIHPYTAYLATFIARNIGSTERSIFNFLYDERSGFKKFIKENPGEKGRIFLTVDYLWDFFYEEFERMGSEKVYSVLEKFKLHKSILEEKGDEYLSVFKGALLLNFLYRFVEVGESSLVVPSEKNIINLFAGAIDRKYLTSILSFIDDKQIINKTPDNLYLITSSGLPSREVETEKNKIKSEYNTIDRILNRKQEKELQDTISASVNRVVEFMIMDASLNEHLIRRKIEKAFQKDYTIHLCLFLGKSEQELQQIKNILKEISNDDLRNIIFVVSEATLDDKTFNRFIEYKARAIVADKHNYPEERNINEEYARKIIDNWMNQVKSGYIEWFLQNESGKELMSQFSRKINEELSRKIFSYGLENIDGTQKNRNIWTYKRSKTSAEIFLFANNRKDIEEKTSKGPERYLREIIKDNNGEYIVDINLKIKDDVFENHPLKKMYLEIRKVFEKERDSGVFNLGDALRFLTKPPYGLYPNMINMAAIGFLMREYIGKLFEEGTGIPIQKEVMRDKILTLFDYWEKGTHGEKLEVRFGTEDEEELIEILKDLFKLKDVRSLNDARWKIREWVKKQGFPIWVFKFAENINENTKKAIDTIFELVQSIDRDLTYEKIKDYLNTIEDVKYDLDILIDRENPGELFKKWLKCIEGVEISSEDIGEVIGYIKRNMQEEVASWTEDKVREKVKDWDREKLKKQIDELEYSKRDDGITTSQHYKFHSHPISEEKVKNIKQQIESYSAERLKEILIKLIDEHPEIIETIEKYLEGS

SEQ ID NO: 808 - protein, 1387 aa, Anaerobaculum mobile
MWRYSDFLAVREDFIPVFSEEVDKNHREDWKFFIPHDQMKTLLDKLMIALERAHGGDKRSIWLTGAYGTGKTYASFVIKHLLEDDLEVIEEYFKKHQILTPLWQRFKALRQKKPYLVIYRSASGHITSSRGLMIEIQQAIKEQLRAHGYSNAFSESLMDQLVSKLSDPSGIFNWEAAFVKYRGRFRTVATAAGVIERLRAGDVKLGEQVAAVLEEEGLTLADSPAAVKAWIKEVIEANELQGIIFIWDEFTEFFTNNVPVTPLQELAQATADMPFYLILITHRSLNQFTRVDEETRKKLLDRFHNCQLEMVPITAYKLISNVIEIKPDYKREWEDKLDSLWDQVEKAVLQIHVLGEQINKEEIKRMIPIHPYTAYLLATISSLYSSSQRTLFQFLKTDPPGSFQWFIANYPQNSWYWLTPDYLWQYFFEDVRDVNIGNVEAIGNLLGYYNSKKSDMNEEELRVFRLMLLLLALWNQTQGVHSLLKPKLSNIKNMFLGTELYQKVKEIADELCSRNIMYAVSIGNDLEYIIPTSTIDQNKLNECFRWVENAFNFEKVAKEKDSDVGFASKIVGLLSLSGATKLRHPIQIFSAKEFKSRRERLLQGVDKPYEIGVIFLVAQEEGDLAGSEVVAAEVSKACPHYCILISQVAFGARDWKDWLDSRSHCRYYQEAKEDKMQRYYDIKSKDIVDKWLNMVRIGRIRAFFKGQQEELDGCQAVTGYLEDIVNSVFPYGPEKLSKVATLYAQSWGKAGAEIGLGIAHNIQQPYKNVVNELQLLGFWEGKVSVHSDHPLSKMQRVVDEFFNTNDHVNLKQLWEALQQPPYGLMPSPIGILIFAFLLRKYANGYYYSDGNNSFPLNPNKLAELIEQVMKGFKFSENYTIRKMSIDGERFCHIARNVFYLTQEQASYPEEARKNIRKIVSELGFPLWTLIYYIKRASSIGSANHIIEAVKKLNEILTFTKDELEDRDIKGLVDVVNPVCHDLSKMINRERMQEGMRSFWEIYNPQLISLMEKLRLEVSHVMNKLRILLNEDAFLWTEESVKEKLPEVVTELDLVDALNCLLGVKRQDLNELRNYFRNNWFKGKLPLIWYKEGQPDEIGTLIEYLYELIYRPSQGIKVNRSEDIRRYSSQLASVLNKGPFVVGVLVQKYTGHTLSDAESEALYNELSDLSQASEDEARSAIVRTLNNQVRQKKIAQLRQRWQELTGSESPERWSEERGVPIQWMLEGKDHHVFFECYDNIHKLAETDIDKLIEHLSHHAAEFVNLQDQQYVSDRFIRVIAGDYAELVLEANMADQLQAYIRKTLDGNIYRWPMLLSEIHQLVRKWVTENYRSTAYPKILKVIETIPPEEIKQLIIQLAADDALVGTKVLASISKVETKPRKMKWGFLR

SEQ ID NO: 809 - protein, 937 aa, Candidatus Desulforudis
MSGWLYTDYLEIDQQFVDVYTEEVDRQHARAWQSYIPEANTRALLERIWGILERRSPKPPFIYGPYGTGKTFTAFLIKHLLEDALDEIEPFFAKYSAIKDLWPRWRALRERGPYVVAYRSAATDASSPFRLVYIVQERIAQALKEKGYSATTTETIRSAVLRKLTNSESTFIWPRAFEKHRHRFKEFTKPEEVIARLTETGTEGETLGLLDRVRRTLEDEDIVVLRSAQELKSWIKEVIVQNGLQGLLFLWDEFTDFFKIPGAPVDLVQELAHAAEDTHFYFGLITHLAPDTILKVDEASRRKFLDRFHRHHLELAEVTAYRLMSAVLQVKTERKAEWERKHETLWNEVGRASSLVIMLQGETKEDLRNVVPIHPCTALTLANIARLFSSSQRTLFRFLREERPDRFCFPRFLREYPRDGWRWLTADHLWDYFYADDDPEYPEEIRRFIRHYRANVEKITDEVECRVYKLVLLFDLLHRRLPVSEESQFSFKPTRSRVQRVFEGVLDGERAVAALNSLCKQHLLQRYRVGQNEVYVLPLFAVDDRKIREIKDRIKQTNPFRSLTKTNGEFGRLIADSFQVNPPLGLRHQMCTVAADEFLGRRERVLPPESLKPYQVGIVMVLPFGEGEVATARETARRLSSETPRVIYAVAGKEFAESRWERWVEQRALAEHARERGESEGERSYREMAKILVEEWVRDVVSHGFQMYFRGEVDFVATKEGYEEYLEEAVEKLYPLRPERIFPRETLYTGSAGKQAAEIGLGLVQNPQAPFGEAVDKLRGDGLWDNKDWPQEHPLAGMRAELRNMLRNREEINLLKAWEMLMGVPYGLIPSRIGIMLFGFLLREYTEGYYYWDGNRCEGLNASTLASLIDNVVKQKRGAEDYAIRRMLPAEEEACRLLREIFDLSFEEARYLRTALVRLREHFRLLGYPLWSLSYAG

SEQ ID NO: 810 - protein, 1419 aa, Coprothermobacter proteolyticus
MRYSEILGLYENFKPAYDLTDEIKNGWKQFIPVDSFIDLLSSFLEALESSDPRTKRSIWLQGKYGVGKSHATSVVKHLLWDPWEDIEEFVDQLGNVKPQLQKKLENFRHRNRVFPVVLKGSGSINDGLSFKWAIQNAVKRALNQEGLDITPLTEFEQYKRHVLEQEKYGHDWDVFLNEKPQLRAMVGNRDGLITALEHGNVEVLKAFRKALGDVLLPTADIETWLEEVVKELKAQDVATSMAIYWDEFTSVLDIQRRAPEILTLLQNIAEKTFSSDIYLFVVSHRDPEQIAYTEDEKKVLDRFISKTYRMEEITTYDIIAHAIKKKDPEQWKILRDQCLRNTSITNLILRLTSTDGADIKRIVSDVFPIHPYTAFLAAKLADHVGSAERTIFSFLYDEEKGFNGFMKEYPKEFHGSTEYFLTAPTLWDFFVEEFENSESEKMRSILQKFTQYKDDLDNRGSAYGAVFRVILLLNVLYTFVGGSSAMAGVNLLLPSEENIRGAFAGTTLEEAVTDVLGYLVDREIFDLTADGLYEVAVSNLPEDEVKKKKVEFGKKYEDVSKLIKEYDDLYNNLLSGLRKNVLRELDIGIYGANSRNYEVKKVLREDFKKPYALKVAIFVGRSEDELRNIESVIDEIMKTPQESNPHSVVFVVARNTLGEKEFDKFITYKAKSAVAREHGYESAIENEKWARKFAENFASSIEKGTAMVFSKQGKQNVSFSSLPTVLNNHSKDIFEFGLENIEDLTQNKNIWEKKRAEKLAQIFCAAQSYEDLVQRTRNNARYNMIMAMFRTNGEYIVDNKLFLKKDLTDGDHPLVKICKEVERALENNRGSTFSLRAVLGFLAYEPYGLYANEVNTAALAFALRPYINKIFQANSGIKITPDQMGSKVVKLLDSFDNGGVASDELRVRLGSEEESSLVSLLTKLFDLQENENLTNVRWGVRKWFTEKARVPVWVLKYVDELKGLDNVKENTTNFIVTVIDKLVSSPDSELNQESISSFYKLLQRFEPFLTRALDIEKLNRAFEEWLQQQDDVATVLPDDIPSVKEYLTRNMQEQVALWKEDKLRLQLQKWGQEKEASETEKQLAKIIGKIFRLEEDLPEVGTTVKAVRQKINNEVGYPIWLFKYFYNDEDFSDAVMALNTLVVSSEGSGAMFDYGKYVNLLRGKEDVLASNFSPVVGSKALSIWAQRCNCDTTANVGQDLVRLAGGEVWKITEDQLREVITIKDFLLTTARLFGLESVSNMTDLSSGIQEWLDRVGYPYWFFEKIAQDSNLRSLLSDIADVVRSAGSKQDAEHLGNLAKRIKASEPQLKELLTPESASLYMKILLEESFSLYDLDDATVRQLLREVRQVLKDTDFYWNEEKFNEQLKRRIDVLKGEQKKNKLRETIESGSHDLKEIMLRLIEEYPEVCEWLVRELGLGE

SEQ ID NO: 811 - protein, 1565 aa, Cyanobacterium stanieri
MQISELVRVNEEAILANAVNFGMMEDEEKNLGLCQGFVFNYESINPKASTLGVLEAIQRSYRSRNEANIHLFVQDYGRGKSHFALVTANYFRQSIESQEIQGILEQVRKASINNPGIVEDLEAYKRRNKKHLVICLSGEEMDLRKSFLKAINKTLMEENITDTLAQEFCQKPLNYLKSLDAQQQQVANNFIESNYPELGDLDNIIESLTKENYRLIPQVKEISKHLNQGFAIDFETDLNVEQILENLLQKLCLGENAPYAGILILFDELNNYLQSWARDAIASGGLTLQNITNICENYKGKIALVCFTQIRPLKSVPNKSADDYKKLASRLEIAESTYEPISSLELVIKGLLVQQSHQPIWGEFIHKWGNTLLGNSRQSFETRITYYRERGWDLQTFHRNITLDSFPLHPLTTYLLCNLDFTQGRTAIQYIKEDVKNFILNQPLERNNLLNCLPAISLIDAFSDFSQTEFSRYHAEYKKTYQSISFSITTEEESILKAIFLFYISGNKLHKPNNQNHAIILSELSGLSETETSETLKKLSLERQVIYYNTGDNTYRFYSGSNLLEIRQQIEEEAERQPHKWTVNLPVKYCQDNIDKYLRSQYIEALTFIEKNKLINGEWYFENKFYTIEEFEQALSGYKTLENTEAKGIFAHILADRIEDLQDLKYRINDLLSKSQNKHLFAVAIPNKTVGDLPRELFMIDIIRRKTDKQESGTAYNQLKQDLEQKIDREIREILVSCDYYCLYQDKLTAQEEKQPQAIISLLLNELYSFVPPLAKNDKMALKSNPANTIIGYAIKLLIQDELKPQNFPNASYNNLISPVFISNWGLLKINNQKYSIQLPSQRNVRQAWDKISELTDLGSKEEKTTKIEDIWKTLSKPPFGYNEYTFTMLFGAWLGYHYNEVKISGTFGIPQRKKEHISYNIQPVKKWTETNIFDKPKDFVNKWILGKSKSPQIIRHKPIICPEIPSSVDYNQAKELINEIDNFIQSGEGEKYKKDEIKIKRVHLLDGIKTIDNNFEIVEEAENLSNDANIEKLISFYLSLQDELTPKRVINLVNYSDSNKVNNSHPVYVNPSENQKERQQKVRILINDKINDFVDELTQRSEKMKTEQELGRYQGELENTKAKISEVDTLPSHLIELLNYALKTAETNIKNIQYQENIKQCLSDIERRCRVLSDNASQKDYQDALLDIENLAEETIIIKENPRYIDIINEIKDKKNYLEQKIQIWQERVNNISKNQAFFLSQEINSLKNRFTDIESCQKIENLLQQLNPIILEWQNEEEAEKLKHQEDENILQQLRIKTPSLLKNISECQDAISLINNLREKLNYPDRFNQEIEQLRENLNQYISESDNQLDKLEVTIQHINDSQKLDKFNKELIKSETIWEKSSEYLRCQRLHQDIDNLRNLLKIIEYQRNNDLKDYENSLQQLNQWRSNVTNISPHIETKYQSISHQLTTKINRIRQQKSESAIAWLNQLNPQYNLLLENSEKLLDEKLKCANNLLKEIDCNYNQYLDCFEEKEEKLIQEYRNICIEIQNENTENQIIVLFQQLTLENKQLLHHKLEQYLNE

SEQ ID NO: 812 - protein, 1165 aa, Cyanobacterium stanieri
MNLSSYFTLQRRYGRSINLERDFNDLSALDGYVLTDKSVETLKRVLLGLSGENKYNCWTLTGVYGTGKSAFVHFLISLLANQKSEVKRKALEIVNNHINDDIILSNIPDDGMVRAIAVSQREAISLTIIRALINGLKDVGGKLSKQFIASLQDLESRIKDSKIVQNTAIISVIKDILLQTKKDIILVIDELGKNLEYAVYNQGAEDLYLLQQLAELEAVEGKRIYILGILHQAFTEYGQRLATIQRNEWSKITGRFEDIAFTESTGQMIRLIAEAITPNFDDVFEKKIDQYSSHWNQTLEPILKLEKIEDNLIKNIYPLHPLSALILPVLCVKYAQNDRTLFTFITSDEPFSFKKFLEETVINDDDLPTLKLDQIYDYFISSVGMGLTRVVNFQRWVEIYDLINDAKHLDEDSLRLLKAIGLLNLVSITGITRATRDLVAHSLCDGEDDDKFNYWQEKIEQLLRQGLITHRKQIDELRIWEGSDYNIDYELESYLKQEQSSLAKLLSPLRPLKPIIAQRHSYQTGTLRYFERHYLDASFDWDRVECEDNSADGWLGYWLEEEIPPTFPQKTVNGLPIIVITTNNLQVLRLQAQEFSALNRMNNEAKELQSDGVARKEVRYRLMEAQKALDETLNSVFDFSRGECRCWIGGELTPVKSVGELNGYLSRLCDETFVDTPILWNELINRRNLTSQGSKARRELITAMINHSSLPNLGFSGYGPEVTMYYSLLRETGIHRSLSLNKNSLESSDSKDCVIHTTPPDIDVTNLEDEEWGIHAPTGGDNPNIDKVWGAIALFCTSATENPQNIAQLYEILQLPPYGVKEGIIPIILTAVLLYYKEEVGVYQDGTFIPVLGEEHLELLVKNPERYAVKYFAIEGLRAEVFQELEAILRNPQTKAKRNIRNATLLTVVTPLYQFVKQLPRYTLQTKELNPTAVSILTILQKTVEPDELLFKQLPEACDLPPITSNKEKDGITAKQLKTNLITALREINLAYENLLSECQSLLYSAFGVRNEATKLRQDLRIRASYLKDKCVEPILKRFTQAVCDETKNDKQWLEALMMIIADKPAESWKDEDVNLFQSKLAELSRKFTNLEAIQGEVKVKGEGLSARRITVTRSDGEETNHMIWIDSQRESEVNQKVEEILAMLPKDKQLRETILAKLTEKILN

SEQ ID NO: 813 - protein, 1376 aa, Denitrovibrio acetiphilus
MSNKYFEYFEIDEDYFPQVNDSTIQEKPDCWKKTFPHQTFIDMLKNMERCLARQEKRSLWIEGAYGTGKSQCAYTLKKLLEVPEDDFRKYWNGFKALENQKDLMEKLIGHKHNGIVTAYKYASGGINSPRDLFLAIQEEVKNALVANKLHTGENTLKESVIAWIEEPSHKRIFDILLEKPEWKATFTQSSADDVLDALCKNSEVKQLMENIFRLADKEGITALNIDANRLIAWLSDVMDKNNVKIVLIWDEFSDYFKNNRDSLSEFQKIAELVNSKPFFFVVVTHESGQLFTTADTTWTKVRDRFVSSQISLPDNIAFELIGHALNVKNAAKEPWAKLADDLNGRVSSSRSAVMKVTKISEPHVMKDIMPLHPMAALLLKNIASAFKSNQRSMFDFIKSSNIDDVKAFQWFIQNTGPYDDHPLLTVDMLWNFFYEKGRNSLSSDIRVILDSFQHQQDLRDDEKTVLKAVLIMQAIDQRLGGTIDLFKATEQNISYIFEGIDSGLDVACKNIAKQLVSKGILVNTPISGGRYVYSAAVLAGDQVKIDDYKKDIRKGTNTAKLVTEGGLASVLSLTPALKLRYEIEPGSGKITPVTINDFTRTVNILRDKTSNWKFHAVIAFAKDDSEAASFRKQIKDVISDKQYENIVFIDALSTPLGLESFDQYVDYSAMAMYYNGNNNSESKENTDKAKRVLDQDWKNRIYNGQFIVYTYSNQEGEKFGNAQGVASILQSIVTRRFPFAFDFIKGLTENQLKLTPAIKQSAKSGITENTSGVVVGIEKHILPTVWKTEKYWDVQTSLPISKIKVETDKLINKAFDRDGQVPIGEIYDFLESQYGFAQCNLSAFIAGFLLKEYSIEPFRYSDSTGSHETMTHDKLAEMIGNYVGKLPKPTYVVKMTPEEMAFYELTEKAWNIPSNTCSSSGQAVRMLSSRMKALQLPVWCLSEVDENGIFNVVQKYIDFVQKEGNEAHKLAIEIGKFSISNKNLAEQLSILITSENCQKGMRKFLASFESGKILALAKEIIVDENVVLADIRELFDVKHSCLWDQGTGEYEIRKLLIDYSIVKETNTILNSNAHSLSEAYKEWRDKLRFIGISYEILKSKFPSITHILDVLLKICQQTELLTEQRKTFYSEIKAHGAEIRELLNNDKKIFAEVYLPYLEDLSDNDISEIKSKLTTGMYELPKTDCNTKVKSVAEEFRKGQLKTKLHNLWKAKTETKDPYEWSYRYKVPILCMVEEKEFGTAKKAFETIRRSSPSDIEIKDSLDFLESTNLFKVLSDEKSRQEVFEREIIGEYISLLSSERVLGALERMSIEPYDWYINPSVKNTIRNLAEAEYNAGGSDKALSKIDSMDDAQLKQYLKRLVKDNMTVGVEIIASEG

SEQ ID NO: 814 - protein, 1402 aa, Desulfitobacterium dichloroeliminans
MKYYSDYFVVPQDYKANMTREAINETQETWLNFYPHKKFAEFLETLLDGFKSNLSTWLYGNYGTGKSNAALVTQKLFMDDAERVHSWFRSCADALSDREALEKDLFAHRNEGTFVVYDYNASGVGPKEDFLVRLEKGIVATLRERGLTVPAKANLDSIIERLKREADHFFTTRDSIQSELAYLHTGITTVEQLTELLNKEHKTADAPTRLLGDVQRVFHEDSIFLNIDVPTFRKWVAAILLENNLSRIVYIFDEFSEFIDENRAHLKTFEDVTENPGINHFFLVPVTHLEITAFVAEGSENAQRSKDRFYRRKLQMPNDTAFRLAAHAMKPLADPETDPISVAEWKTEKDNLYSAISDIAGYFNTTDPSSEDYVSRQSFYDVLPIHPMAAFLLKFLSESTRSGQRSIFDYLKGSANGREFQDFIRTAGPSVANKQFLTVDYLWKYFIDREDLGINEEITSIRSEYERIKNREFSNQTNDATEIRVLKAVLLFCLLDRLNPDGHERLRPTVTNIELSFRGDGALVNVGEIVKDLAEDRHCFSVVNGHIELFATSVGGADLQKKIAEQENKFHDLLSPKVASMLEEHTKSTRASHSAHRFEIRVSDAIHTTLTNITSSVRDRYSVGLNKDNASVCLWFVIARNEKEQLEITEKIKSILSHLHDHRVLMFTFPTLSFCHNNVNLWNDYIRQYAQYLLENDGGAKTQIKNSYERLEREWFDEIKKQSTIIKMHSIQSGQVVSSDTYWSAFKQRISDYVRKTLPNCVDYLTQYISAFDIRGLKEWALSGIQFDNYAGKSKQLINIFKAQSITDDENWFAQNPKHPLSEIHALFEKKIANSIGKGGQLSVRRVYIELQRAPFGMRYNALSAFVLGFTLRNILTKNFQWTDGKLTRPLDADTLAEIIESVVKNDGNENMKGEKVICRLSKEDKAFIEKAPQMFGVSSIADATIEIVLGQIQNSIQDMSGRVPLWVLPEYIRSVSEEKADKIEEILNNVCIAFSTSSKGKTEERSNAVRDVGTAILECPDIVDVIADYIKSENFVTAFDLYIDKTNLALAELAKRIGDVSHGYSRAIREKASEAAGWLWKQADISKEVDEMFCEYEVIELAKPLLGFTDFIPYKHVFEALRSAIMQTNCLPKSMIVTAYPALSMFLSVLQQSGSVYDIKSALLQYSEIIAKLFFDSTKAEALEIVKKRLNGAEISNDELRDILGGMPSGFGLDEPTFLNGLRAKIEDNAKQSVVSKLKAEWLRLSSGVKTPFEWALSNGIPARFLLGGLPQSDDILKAIEQPETFAAAKLAELLDTLQEITPPSIVECQQAFLAETVPTRYAKFNISLASLLEFLREIYGKQPNFWSKQPDISEFIRSQYKGMLAPQVAEKIRNQSSDELKQKLLLLAQENAELGLLFWE

SEQ ID NO: 815 - protein, 1389 aa, Geobacter sp.
MACYKDYFGIRPDYAPCMTLADINKTPETWLGFYPHDSFVDILRLLLKSLEGGNKTLWITGAYGTGKSHASLVLQKLFTDDDARVQKWLALRKAQIPEPVREGLLARRGEKTLVVYDVNADGVDAKNQFLMRLQRGITKALVSGGHTIPLKGKLDEVIERIRQDEPYFFAKRDTMQARLSHLNAGIKTADSLEKKLRDANQEAGLVSDAMRVLAARHIFLDLNAEDFLAWVDASLKANGLSKLVYIWDEFSSFMERNRAELKTLEQLAEAAQLGRFYFVPVTHTDISAYVAAGSESAKKANDRFMFKQLDLPNETALKLAADAFVVKPEKAVEWTQDRDELWRSVNRVAENYMVVNNAGIDAADFKGILPLHPMAAFLLKHLSVAIGSNQRSMFEFLNGEEFRVFIEKGGLEVAGHQFLTVDHLWRYFVEREDLGTGQAVQEVRAEYARREKDLQPDEQRVFKAVLLFGLIEQMQGTGHPLLSVTKENIQRSFEGDGALQGVDAILRDLEQKHCFTIVDGRCERFRDRSDSKEIEEKKAALDGKFAEYVLKDTETELVKQLKGVNYGGRFDVRAASVNGLSASNIARRESFGETGNRVLVQFILARDEQEQLRIPDKARDLAKQFKDQRMLFVTLPEVSFCRDDKKSWESFKENFARSALAEKSGDSTGKKVFEAQVSKAKEKWNEKVTSAAAKLIVYKPNPTGEPFVDEVTWGQLKKDWLTDYAKQTFEAYTDDLSGFNIKAFEVPPRDLHRWALAGMEFDGYAPPGMWKTVVATWQKSGITGEDAWFDANPNHPLTQLRVKCKAWQDNTVGAGNTCSIRKLYIDLQRPPFGLMGVPHSAFVLGFVLKTWLTGRRNLQWSDNVTSKALDRSTLAEIIDAVVKDDGANAIKNEKLICLLSKEEKAFIAQSSVIFETSTLVDGTVEAALNAVRTRLELIAERVPLWVLPEYICSQAEPSAEEMGKVIDALCAVNGISSKGDTETRGTKVKEIGAILLATPGLAEALAKYMKSTVFDEAFQRYVDNAKPELKAAAERMGDLSRNYCKAIKNRFAATSGWLWKRGDAESVLEEVYWQTLCAEHIRGLAGSSGYMNFEDALCRLRNAVLSENKVPTEFWAKKHPALQRFFELLNRPLLSGEDVKAFGEILEQQNGVICEVFFDVAQARQFGAMLEIFGEIWPMAPAESRELYNTFPSGMALADAQTFKAQGRDKIEEYCRTLVSKLVATLWRQHTDTESPVEWSRKHSLPAECVLAVDDAKGIIDAVANPGGVSAERLQTVHNELEKEGAFVDVATAGEKFLERVLPARYQKFGFSVRDLGDWLCKNLSDTPSRWLTNGGLREAVEAFVKQGYDSHARKQAVEKVNTLSDAEAKMLLLKMIDQIPDVGLSVLE

SEQ ID NO: 816 - protein, 1133 aa, Prevotella denticola
MPYSKIVTLRQMRPAYNIKEESNGEWKFFIANDQFNEVLQKVISAVRNNDADNHKSIWIAGTYGTGKSHAGAVIQHLLCDPIEDIRDYVEDEYKKERYDILRNSLLQLREKKRLFPVNMYGYQNIAHEEDLSLQMQREIKRALSAAKIDITVQTDFDMYVQHVENQPQFWENLIEQSAQLASVAPDTNKLKQRLRAADTDVLESVRQALRIGGYDIRLQSNNLKQWIFEVQNALREKTDYNGLLIIWDEFTEVMTSSIGTRLLVQLQELAEAMMNAENDSYFLFISHPSALNTLKEEEREKTKGRYHYIIYNMEPVSAFKIMSKKFEIVNYTLYMMRQDRFFNIHPELLEMFSTTSTDTEQTIENIKNLFPLHPATANLATYYAREAGSSSRSVFEFLASDAVREFLDDDEAYKEEQTITADYLWDYVQEFFESDSTKFGAVTERYNSHHLAVESQGDCYLKVFKGILLLNALNNIANNDTVTPSEENINNLFSGTKEQDDLPTILDFFNAKSIIQRQPNGNFSILFTALPGDEIQKIKQELKTSSFLFTDQVIKFGSTASNIFTRNLSQVARPYAFQFFGIQGNEYTLMNQIANAKKQTQPYEVFLAIMVARNNQELLLLKEIAEKNCKDERFTTISFVVIEAIMGDKEYERFIEYQANAQCAQSHGLPQQHQTYAKQAAEMIQQWVNKMRSNIMTFYLNGDSMTIVGSKMTSTINGSIAPSIFTSGPESLETIRTKFSATYWKKASVKATVDAVLSYNTKQDIIDKCGGPARHVEFLLQDSVDDNLQWKDTISPNHPLKKVCDYVDEWLSGRHTSKNQSFNLGDKLVGLTEAPFGLFQSYAPMAMVAFAMRKYVNIIFDTNGKQRTAQHLVEDVVELFKAWENGKTSNKLNFIFESKEAGRVCKSLIRMFNLNKLKGYSDISSLKDARWAVLHVYCKEKGYPLWSLKNIEECSPEIKEFIDNLMRVVSDPESMKNPSLLENTINGYDTLKTDFGNLLIPSANNFHKGFVIYMQSIDNVNVMDEEVEEALKYLHEHLESEVGLWTEEEVKDKLKDWRISKVTPIVQPASTSNPSTIIDDSSVDTPAVDSEELKKKRNKAINRINNSEDLRQAIENMITEEDSFVIDILLKYV

SEQ ID NO: 817 - protein, 1123 aa, Thermotoga petrophila
MRYEEIIELNDYFQPVYDLENEIGTYWKQFIPNEKFYKMLSETINSLESSNPEERKSIWLQGAYGTGKSHATAVVKHILFDELDEINDFIENLEGQIKFKIKNFRKNNRVFPVILKGTSSVIDNRTLALVLEKATKNSLKKEGIELTTKTDFDKIITKLKSDEINWERVFKGTELEFYGTKEDIISKLQQGDEYILTKIEEALSQKSIHFSTENIANWLVEVRNELKDKGIADYLVIYWDEFTGILELPKSGLLLTELQNIAELSINKGVYLFVVAHRKPYQTNISRDDVEKVLGRFKVLDYSMEPVTTYHIIDAAIKKKDMDRFIKIKDEYIDSVKPLIEEITGSEGTKVQKSLENLFPIHPYTAYLATFIGRNIGSTERSIFEFLYGKAGAEISFKKFIKENPEEKGKIFLTADYLWDFFYEEFERMESEKVHAVLEKYKLHKNSLEEKGDEYLSVFKGVLLLNLLYGFVEVGEFSLVAPSEKNIINLFAGVINQKDLTVILSFIDEKQIINKTPDNLYLITSSSLHSREVETEKNKIKNEYDTIDRILNGEQKKELQDTIRASVNRDVEFIIMDANSKEYLIRSKIEKAFKKDHAIHLCLFLGKNDQELQQIKDILKSISNDDFRNIIFVVSEIILDNKTFNRFIEYKARAIVADRHNYTEERRINEEYARKIIDDWINQVKSGYIEWFFRDETGKELMNQFSRKINEELSRKIFSYGLENIARTQKNRNIWTYKRSKTSVEIFLFANSREDIEEKTSGSLEKYLREIIKDNNGEYIVDANLKIKDDVPENHPLKKMYLEVRKVFEKEKSNGVFNLGEALRFLTKPPYGLYLNMVSMAAISFLMREYIGKIFEAGTGIPIQKEVMRDKILTLFDYWGEGTRGEKLEVRFGTKDEEQLIEILKDLFRLEDVRSLNDARWKIREWIKKQGFPIWVFKFAENINENTKKAIDTIFELIQSIDRELTHEKIKDYLNTIEGLEYDLSNLIIRENPKEMFKKWLKSIEGIEISSEDIEEVIDYIRKNMQEEVASWTEGKVREKVKDWKLKELLKNQQKESRSPKQGNETATPRNNSISEEKVEDIKQDIKQQIESCSAEKIREILIKLIDKHPEIVKTIKEYLEED

SEQ ID NO: 818 - protein, 1169 aa, Actinomyces sp.
MDMKGLYAKDIFRSIDGVIKADDVSKVASEVDEYVMTSEIRSGLSRIVDAWNQVDAPSNGVWIAGFFGSGKSHLLKMLSYLLGEQAGSQPMTREDVERAFEQKVAGDETLIADLKRSLHTPMRAVLFNIDAKDDKSTRERGSAMIEVFYKVYFEARGLYSKDLGVGALECDLEDRGELARFREAYQEEAGHTWEVGRVNTVFSEALVSRALARLGHQVDQPFRSYREQMNLSAEAFAQDVASWLDRQGPHQRIAFFVDEVGQFIGDDSQLMLNLQTITEQLATHCPGRAWVFVTSQEELSGITAQMNERRSTDFSKIQGRFAIKVSLSTEEVTDVIARRLLTKSEQGAEDLDTLWQRLGAGFPSMFRFPVKTKKYDNYLTRDSFVAKYPFVDYQFEMFTQAMRGLSDNDLFTGRHSSVGARSLLGVCQQIAQELTDDELGTVASFDRFYDGIAAMLKSDVKDNIGRAAQDSRTCDSFTMSVLKVLLLVRYVDSFHAYPRNIAVLLRRSLDQDATDLETRVERALRILSDQVYVQRQADGTYAYMTNEEKEVRREIRQITVESREIADLLRTDIRKHVGTSATSFVYPGTNRRMGVSLFVDGRREQAEPLVISVSTPQSSLDEAGIRNESAYRHDSLSLGLDISSEILEDVRVFCQTEEYVKRQAGAASGLRKRIILAHKEDNEQRRRVIGEAVKDALMRASLFVAGEEVKTGTAKTPADVIELGLTRLAQKVYPRIEDAKPLAGLKDGQIVSFLRDQEDATLDVDPGVDIAQSLAGECAQWVEQARVLNGQNVFVKNAIEYYGRAPFGWDKNAVLAIVATALRLELLEALENDRPLTRTELEGALRDVTRQGRVLLQKKKHLDRAALADFQRFVGHFVPRESPQDGPSRVRAVEVKAAEWVKLLKGYRSDWYSFDDEVAEALDLLTPLTTTQHTEEEMLAPQIRGGFDDLIEIVDDFLMPYREFVEEHEQELRDALAEADSLSFFELTEDGEQAIDELRKLAGDSRLYVRTQEIAPLVRRIDAARRALVQAQRDKVLRRIDEAVAGIRGSAEFKAASEEARLRVDAVMERLCAAVNSVSKPGHAEEIGRQLDQRVDDLYAALIASATPAEYPDPDEATEPTKRPTIVRLADLLPKTNGLLSTPDQVNEYIERVREQMLAAVNDGKQLRP

SEQ ID NO: 819 - protein, 1225 aa, Vibrio cholerae
MKIEQIFSKKLTRDINGVVKAEQKDNDSVYVELDEYVVTRELDRHFRAFFEAYVPSVTQSGASMSGKIGVWISGFFGSGKSHFLKILSYLLENKSVEKDGQGRQAFEFFKEKINDAMLLADIQNAVTKDTDVILFNIDSRANTDDRENAILKVFLKVFNERVGYCADFPHIAHLERELDKRNQYMSFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTHLIDVFAEKGDILRNQLTFDKTTTASLKGYTDAPSFVDNYPFVPYHYTLVQKVFESIRTKGATGKHLAMGERSLLDAFQSAAKQMKDSGLEVLIPFYSFYAPIESFLEPAVKRTIDQACELDSLTDFDGKILKTLFLIRYVDVVKSTLDNLVTLSIDRIDADKIALRKQIEESLNRLERQLLIARNGDEFIFLTNEEKEIENEIRHTDVEMSEVSNKLSAIVFDGILKGNRAYRYPINKQDFAVSRFCNGHPKDGTTLEDLVIKVISPLDSHFENYSHDQACINHTLEADGCVLVKLGEHKRLWDDLTTFIKTDRFLKQNSGQRPEQEHLLREKQMENIEREKRLRTDFEALFAEADVYAIGTKLPKKSATPSAIVEEAYKYVIENTFAKLNMLKATPGEVLRELQAVLVADDIAQIGLDLQADECNPEATREVEQYVTLKVERNEPVYLRDIVARFGKRPYGWPDNEILLLTARLGLAGKVSFSTQGTDLALKKAYEPFTSVRKRGEIRVHKIRQHDERQIKKAAGLVKEIFSKTFTGSGEKELYELVRDELLAWNEELKSFRTKSQTGHFPGKSQIDDGLALVAGILEQTSSFALIARFLEDADALEEFAEDFEDLDDFYNSQFQTWQALAGALNEKFKANRPALEKDSEALKALTELERIYNMSSPYEQLRHINPLIEQVAKVNSTLVEEKRTHALERVDLRIGRVKEALADAHAPSELQNQALRPLQMCRQRIEATSSIPQIISEQTEAEGYEDEAYELLNGFIEDQRKKAEAEQRRRELEQKKREEEAAKAGKAAPAPEPAPEPVQPQPVAKRTVTINPTDAMAKSVTTGFIESEAEVDAYLAALREQLIAAVKAGDRVRIK

SEQ ID NO: 820 - protein, 1225 aa, Vibrio harveyi
MNIKQLFTKDIARPINGVVKADQTENETVFVELDEYVITNELKEHIENFFKFYMPSVYDPEQAAITGKSGIWVSGFFGSGKSHFIKILSYLLKNVSATDGITTRTAFDFFSEKLKDDAFLVGDIEKAIQKDNKVILFNIDSRADTDDKEDAILKVFLKVFNEEMGYSGDHAHIAHLERELDSRGQFEGFQTAFESITGESWLEQRDSYDFYRDDMAEALAQVTGQSLDSTKLWVEKIEENFPLDIANFCKWVKEYLDGNRDRRLLFFVDEIGQFIGKNTQMMLKLQTITENLGTICGGRAWVIVTSQADIDSIVGGMQGSKSQDFSKIQGRFERISLSSSNTNEVIEKRLLSKTEEAKSHLSELYDAKGDIIRSQLSFEQSNAAEMANYQSSDDFINTYPFVPYQYNLVQKIFTGISRAGASGQHMSRGERSLIDAFQIASKEFADKNVGRLIPIHSFYHSIKKFLDDAVVRDINHAADKTSIDEFAVQVLQTLFMIRYVDEVKSNIDNLVTLCISEIDQDKRALRLAIEARLEVLERNNLIARQNDEYIFLTNEEKEIEEAIKKTDIEPSDETTELSNIIFNEILRRNNNFRYPENKQDFPVARFCNGVPFDRNLDSDILLKVVSPIDNSYDEYNDATCANFSSDCILVKLNDNPRLFDDLRTYIKTEKFIRKSSSASGSSQEQIRRDKANENMNRRKRLVGDLEELIKESDFYTLGSGFDAKGSSLAVMLEGAYRYIIENTFGKLKLIKPFPGNILSEIQQTLAAGDTAQIGLDLAGEEANPLAVLEIEQHVSLSDDHGYAVTAADIIKKFSKRPYGWNTDEIILILARLGLANKLVFQANQQEVPLKGLYEHLSKSQKRANLRIRRIKQQSEANLKKAAKLYKDLSFGTAPSAEKELFNSAVEKLNQWLTKLRRFKSMSSTGHYPGGNEIDDGIMLLSGLTEIKTSFQFVDEFIAKTNDLLDFEEEYELLENFYETQFTSWQGLERALNITFSANRAFLEKNAEAMAALDKLTAIYHNASPYRDIRNIQPLVETLTSINNQLIEKQQSYTIKKLEQRIDEVKELIENAGASAEISNKVLLPFQNAIKRVQRENSVSQIKHELIEADDWFNDAEKAVNAYILQQQALAKKTKEAQSSNSEATDSPSSTSQSTANYGSSTTEAMPVREKAPKAKPTQAIDAMEVYREVSEATYMETVEDVENYLKALRDKLVTLVESNHKVRIK

SEQ ID NO: 821 - protein, 1182 aa, Lachnospiraceae bacterium
MMIRDMFADDINRKINGVIKVDQAADDVIEQELNEYVITRELKKHFITFFNYYGDAFDQPTADMGVWISGFFGSGKSHFLKMLSYLLENKEVKGIRSVERFRKKFEDDPATFMLIDRATKGTTETILFNIDIEGFSNKDKTAVLRVFAKMFYNHLGFYGENLKVAMMERYIDQQGKTEEFRRVFEEKKGKPWLEMRRAFAFNGKFIIPTLMEVLDMSEDDAKAWFNDKTATEISIAQLVEDMKAYVDTKPANFRLLFMIDEVGQYVGTDTDMLLNLQSLTEKIGSECEGKIWVICTGQEAIDEIIKVRADEFSRIQARFKTRLSLSSSSVDEVIQKRILKKKPEAAKNLEDVYEQNDSVLRNLFSFSGSILDIKGYSGPREFTENFPFVPYQFIIMQKVFAEIRKHGNSGKHLSGGERSMLSGFQEAAQKIQEKDEYALVPFFRFYDTVHTFLDGSIRRVIERCQKAVDNGDGIEQQDVDVLKLLYLIRYIDDIPSNLDNIVILMADDIRVDKIIMREAVRGCLDRLMSQNYIGRTGDTYNFLTDEEQDIQREIRDTNVDTASIVERIAQMIYGDIFTTKKFRYGKYDFAFDQMVDGITVGAATGGMRLRFLTVATDAIEKTDYRLMAESKGNEAIVVLADTPYYESLESVMKIRKYVKQRNVSQLPKTVQKIISDQQDEAGKYELSAMTELQNAIEGAQFYVDGEHLEIKAGNAKSKIDQSLEYLVAHVYSKLDLITDHAGSDADIIAILTGAVTALPGMEPNRDAASAMEEYLEMQDAKKLPTSMADVQSKYSAIPYGWKEIDIAAVAAQLIYSQKVTIKYAGNTIQPDDPKLPDMLRKKSEIGKTSISKRKTISATMMRDVKAMLREYFDVMDVPDDEDGLIRFVTEKFGEQRDYYASLDARYDGHKYPDRALVQEAIHLMEDVLSQKKDNIALIERVLKKEDALFDNKEAVSNGIENFFKTQVAVFDQAVQFEKSLHDDLDRIAENEEAHKALNTIRLITMVQTGSKFNYNRIRELNPLMDTVRTAHDKMLEEKRAEVLETVRQCMEATHTAANGDSKASHLIEKSDRYFSQCKEKIAELKSLALLDAMFLPMCQYKDDTVSNIESVLAPPAPKPPAQATQPGKGQAIAKKKVIRTYNRQVVFQAKTLQTEADIDDYVEKIRSQLKQLLKNCDEIKLN

SEQ ID NO: 822 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADIDAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKSKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 823 - protein, 1182 aa, Coprobacillus sp.
MIIRDMFADDINRKINGVIKVDQAADDVIEQELNEYVITKELKKHFITFFNYYGDAFEQPTADMGVWISGFFGSGKSHFLKMLSYLLENKEVKGIRSVERFRKKFEDDPATFMLIDRATKGQTETILFNIDIEGFSNKDKTAVLRVFAKMFYNHLGFYGENLKVAMMERYIDQQGKTDEFRRVFEEKKGKSWLEMRRAFAFNGKFIIPTLMEVLDMSEDDAKAWFNDKTSTEISIAQLVEDMKAYVDTKPANFRLLFMIDEVGQYVGTDTDMLLNLQSLTEKIGSECEGKIWVICTGQEAIDEIIKVRADEFSRIQARFKTRLSLSSSSVDEVIQKRILKKKPDAAKELEAVYEQNDSVLRNLFSFSGSILDIKGYSTSMEFSDNFPFVPYQFIIMQKVFAEIRKHGNSGKHLSGGERSMLSGFQEAAQKIQERDEYALVPFFRFYDTVHTFLDGSIRRVIERCQKAADNGDGIEQQDVDVLKLLYLIRYIDDIPSNLDNIVILMADDIRVDKIIMRESVRGCLDRLMSQNYIGRTGDTYNFLTDEEQDIQREIRDTNVDTASIVERIAQMIYGDIFTTKKFRYEKYDFAFDQMVDGITVGVTTGGMRLRFLTVATDATEKTEFRLMAESKGNEAIVVLADTPYYESLESAMKIRKYVKQRNVSQLPKSVQKIISDQQDEAGKYELSAMTELQKAIEGAQFYVDGEHLEIKSGNAKSRIDQSLEYLVAHVYSKLDLITKNADSDADIIAILNGTETMIPGTEPNREAASAMEEYLEMQDAKKLPTSMADIQSKYSAIPYGWKEIDIAAVAAQLIYAQKVTIKYAGNTIQPGDPKLPDMLRKKSEIGKTSISKRKTISATMMRDVKEMLREYFDIMDVPDDEDGLIRFVTEKFTEQREYYASLDTRYEGHKYPDHGLVQEAIHLMDDVLSQKKDNIALIERVLKKEDDLFDNKETMSNGIENFFKTQVTVFDQAVQFEKSLHDDLDRIAENEEAHKALNTIRLIITIQMGTKFRYDRIRELNPLMDTVRAAHDKMLEEKRAEVLETVRQCMEATHTAANGDMKASNLIERSDKYFSQCKEKIAELKSLALLDAMFLPMCQYKDDTVSNIEAVLAPPAPKPQPQPNQAGKEAAPAKKKVVRAYNRQVVFQAKTLQTDADIDEYVEKIRSQLKQLLKNCDEIKLN

SEQ ID NO: 824 - protein, 1223 aa, Enterococcus faecium
MLIKDIFAKPIDRNIQGVIKVGQAKDENVQQELEEYVVTKELQKHFKTIFDAYQRSINTPTDKMGVWIQGFFGSGKSHFLKIISYLLANREINDKKAIDYFKEDGKIKDPLTLATMERCSQINTDVILFNIDSKSDAGGKKDKNGIVNVFLKVFNEMQGLSTIPHLADFERRLIKEEKFDAFKAAFEEINGAKWQEERHEFDWIQDDIKEAALKIDFMSEAAIDNFLEKASGNYLISIDDFANLVKSYLDSKEADHHIAFLVDEVGQYIGGNRELTLQLQTVVEDLGRICEGKAWVLVTSQEAIDHVTNFDNNSDNDFSKIKDRFATTVSLSSANADEVIKERILKKKEFANDSLALQFETVQTELKNKLLFVDSPELKLFQDAENYAEVYPFIPYQFNLLGQILTEIRNHSYQGSNLSSGERSLLAMFKEAAERNKENDTTSLVSLDQFYYSLERWIDTAISRVITQATNNSHIQRPTDIDNFNVNVLRILFMIKYVDQAIKPNVENITSLMIRNINEDRLETKKRVEEALDLLIKENFVRKNLDSYIFQTDEEQEITREIKNQNITDSDLIVELSKRIFDGVLDRNSFAYEKLGMSGGNKFKNRYTFTYAQVLDQRPYKQAGNAEMTVNFISPYSDLAGQEAELALKSSRNLLFVELPSDKEFKDDIAMYARMNLYLTTTYSSVVKNFDAIRSEKSGELQELSASINDQLNELLKSAKFFYNGAEIQLTGSDFKAKFQSALQKMAEEVYHKLNQIDAPKEKEDILYLVKESKNEIIEDPSNEQAVQEIFNFINDQKRNHLTITMKTIRDRFETKQPYGFTELDVEWCIAKLFMSGKIDLLYNNVQISRMDDPNSIVMIIQKRRESEKIKIEPSAVISPKAKKLVDEIGRELFQSRNIVDENNNEHTMENFKKYLKGQLDNLRSYFDLQNTYTYPSAYEYEQIKKYLEVIVQTSDVEDFFYTIKKYRDELFDWAETYDKIKNFHKQNSTQKKIWENAQDKIRLIEKSRRQTSSQEIDQLIHEMKTILKKADPYSDMMKLNELIQEFIEQYNQLLELESQEILNKLTEEKQATFKLLEGKDFKDQFVPIVDQEFQELKAKIEQANTIDDLVFLSLNVAEQYLIFNQRFDNEENRRRQEEQARKQIEAANLIRETEKDEIDSAAKAEEIAIVKPTIQQKTVPMRTLNVHVKTIKSAADIDELTAEINQKLKEQLQENTEITIQF

SEQ ID NO: 825 - protein, 1151 aa, Vibrio cholerae
MLGYIIDNQIINGTPARERFIPRLKGVSDAGLIENALRNLDAINSRVVFLDVAKQNTERGLAFTLFANLLKNLGFRDDIYGYMEFDLLLDGKYDEFKSIVQKLESKDWDELKKSNRHVARVMRKVFSEMGYSESDYEDTKSVYSASIEDFSASKFKTELEKYLKFNSEETLVFVFDEASEAISQKKFTLLDLEGISESLSSISNKVWTIAIAQEKLDDVINNANVSRSSLTKVTDRFKTKIHLESTEVDVIIRSRLLQKTEQAKQDLVAYYQKNEGLISDATNLKSSFPTKTETAEDFAVYYPFHKYQFDILQKFLFSSNALVATQIAARGMIITTFDVLRKQMRDKELYSFTPGFAICDEAQTAPPVGLVNKYDTSRKILKENGSSIDGEKLLKTMHLLADSEVVAPTVENITKSYITDITSYYEVKPAIEDALKLLLEAKVLLLSNNNYKITSDLEGKLLEEMKDFDVELFSKKRELIKYLKDYKTFNAVASYNDGSDAFKFSVLSDQDDELAPVGSKHLKITAYSLFNISDDRQDFIEQLKLDTQYQKELITLVPDTSEFSQIDKLIGEVMRYAYMEEKYSNEKDADKRQIIREFEVIREEKQRTLRGLIQDAYHNASLIYMFDEHLLNVDTFKGTIADNQRKMVKNIYTKRLSSQLSDSLVSKIFSTHKESLNKLFTANDFAFFDGHGNFTGDHLKIVEEINAKIKSRYMDGKSLEADLSGAPWGYSYGTLVTTLAVLFRAGRLSVKFNGDTYFSHEQKAVHDAFTNTTKFKSASFKSITATLTAVQKNQAVQLLMELETQDHIGKKVDWNTNDFDLADSIRLMAEHFISAITNLSDTVQDFEELFPKVVGLKQDLQGFAGKVTESNYIEKVEYLLNNSDTFSDAVQAILKAQKFIKKNFPKVKEFKRFIDDVRSELIKADRSDNNIDEAYEEFERLFKQDLVKNFANLQQQVQVVKDAYYKLVKTASIGMSHEYKVLSGKIEAAFRELKNYPAAPNRLNQQKLDALKAYAEKRVVGEPVLAFSISCSNSGFSLSDILNYTAQAPLKDSELLIVQSSFITEEPQPEPVPTPQPTPNRGPDGGEPAPAPTPVQSPAPKQPRKVAFKVSSKVMTVQEYKTLLTTQLTALAAAKPDEEIELTVDINSEGL

SEQ ID NO: 826 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLESSRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKADILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWINMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELCKKQEAQLRAANEAKRAADSEQTYVVVEKTVIQPVPKKTHLVNVASEMRNAAGGEVLETTEQVEKALDTLRTTLLAAIKAGDRIRLQ

SEQ ID NO: 827 - protein, 1217 aa, Lachnospiraceae oral
MQIKDMFAKKIDREIQGVIIVGQGEETNVSQELEEYVVTKELQKHFADFFAAYKKSIDGGTPKMGVWISGFFGSGKSHFLKILSYLLDNKIVGDKHALDYFIDDNKIADKKVLSDMQLAANIPADVVLFNIDSKSESSGKHNKDAIVNVFLKVFNEMQGFCGSMPHIADLERRLVEVGRFDEFKAVFEDEYGESWEESRKDFDFIQDSVVDALVNMDYMSEAAARNWCEKAAESYTISIEDFAKRVKSYIERKGNNHHVVFLVDEIGQYIGDDSKLMLNLQTVTEELGKECMGRAWVIVTSQQDIDSITKVKGNDFSKIQGRFDTRLSLSSANVDAVIKKRILDKTDTAAQTLRLLYEQKSTIIKNLIVFNDGVEKKLYANENDFTESYPFVPYQFNLLASVLTSIRTHGASGKHLSEGERSMLALFKESASTLKEREMGVIVPFHRFYDALENFLDHSHKGVISKAYNNNYINPEQKDADVFTVNVLKTLFMIKYVLEIESNIDNITSLMIENIDDDRIALKEKVEDAIKILMRQMLVQKNGNIYVFLTDEEQEINNEIEKENVEMSEVITKIAEMIFEDIFADKKYRYPEFNGRYSFSFNQMVDDRPYKSSQNADIGLRILTPWYDGGMDDAKLRMMSGQGREVLVVLPNDDEFLTEMRVYLKIERFLRKNTSMQLAKYESIKDTKRVEMRERNANARLYLTEGLKDATIYVNGDIANISAKEVNNKISEAIGRLVQTVFHKLSYIDTVMGEADIRKLFQTTNQMQMLPEGGRFANAYALDDVQGYISMNSHNHLKTSMKSVKDRFMKAPYGFVEDDINWLVACLFKRGDISFTVNGASVSLNNKSEDEIINYITKKAFVEKLLMEERVRVAQKDKKSVRDVMKEVFNTTLSTEDEDSIMKDFKRLSSNMINEMDKLEVYYRQYNYPGKNVLDSGKRLLQSVMQLNGALEFFSHISKYQDTFFDMAEDYEPVKAFFNGEQQNIFMRALDMLAIYEDSKTYIVDSELEKVVGEMRAIVKQDKPYKNIPKLPELIAQFRDAYNQVIDVEEAPVLNSIDQSRQRVLEVLSTKEYEKQKKEHYLSLFEEIKDGAQSCNNISSLRSFADKAGALKIRLMDEMDNMDRQIAERKQAEEIRRIEEEAKKRGSDVSDVEVARSIAEQKKQYKVRKTKNVPIKKITGTSSWRLENKADIDKYVEELRMRLLSQMDEDTIVNIEF

SEQ ID NO: 828 - protein, 1213 aa, Salmonella enterica
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERHAYSFFEDKIKDALFLADINKAVHHPTEVILFNIDSRANVDDKEDAILKVFLKVFNERVGYCADFPHIAHLERELAKRGQYDAFKTAFATITGSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWQEKGDILRNQLAFDPTTTASLRPYTSEEEFIDNYPFVPWHYQILQKVFESIRTKGAAGKQLAMGERSQLEAFQTAAQQIAPQGLDSLVPFWRFYAAIESFLEPAVSRTITQACQNGILDEFDGNLLKTLFLIRYVDVLKSTLDNLVTLSIDKIDTDKVELRRRVEKSLNKLEREMLIARVEDKYVFLTNEEKEIENEIRNVEVDFSAINKKLASIIFDDILKNRKYRYPANKQDFDISRFLNGHPLDGAMLNDLVVKILTPKDPTYEFYSNDAACRPYTSEGDGCILIRLPADARTWTDIDLVVQTEKFLRDNAGQRPEQASLLSEKAKENSVREKMLRVQLESLIAEADVWAIGERLPKKSSTPSSIVDEACRYVIENTFAKLKMLRPFNGDIAREIHALLTVENDAELDLGELEESNPDAMREVEAWISMNIEFNKPVYLRDILNHFARRPYGWPEEEVKLLVARLARKGKFSFSQQNNNIERKLVWELFNNSRRHSELRLHKIRRHDESQIRKAAQTMAEIAQQPFSEREEPALVEHIRQVFNDWKQELNVFKAKAEGGNNPGKDEIESGLRLLNSILSEKEDFALIEKVTSQANELLDFSEDREDLVDFYRKQFATWQKLGAALNGSFKSNRSALEKDAVAVKALGELENIWQMSEPYKHLNRITPLIEQVQSVNHQLVEQHRQHALERIDARIEESRQRLQEAHATSELQNSVLLPMQKARKRAEVSQSIPEILAEQQETMALQTDAEKKINQWIDELRKKQEAQLRAANEAKRAAESQQTYVVVEKPVIQPVPKKTHLVNVASEMRKATGGEVLETAEQVEKALDTLRTSLLAAIEAGDRIRLQ

SEQ ID NO: 829 - protein, 1204 aa, Pectobacterium wasabiae
MNIEQIFEKPLKRNINGVVKAEQTDDESAWIELDEYVITRELAGHLRQFFEVYAPATGPGRLQLADKMGVWVSGFFGSGKSHFIKILSYLLANREVSHNGVTRNALSFFEEKINDALLLADIRKSVQHPTDVVLFNIDSRANVEDGVDAILKVFLKVFNELAGYCGDFPHIAHLERELDKRGQFDTFKAAFADISGSRWEDERDVYLMINDQMAQALSVATGQSEESSRQWIEQLDKNFPLDIKNFCTWVKEWLDSQGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDAAIPALEAVWQEKGDILRNQLAFDTTTTATLRAYTNSREFVDNYPFVPWHYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIERIDTDKVELRRQIEASLNRLQAEMLISRIDDKFVFLTNEEKEIENEIRNIDVEFTTINKQLSTIIFEEILKNKRYRYPANKQDFDISRFCNGHPLDGANLNDLVVKVLTPLDSNYESYKGVHSNSLLMTDSKGCILICLPDEARTWQDLTMYVQTKAFLSKQSGQRPEQATLLAEKGRENGMREKTLKAQIEGLLAQADVWALGERLDKKSSSPLAIVDAACGYVIENSFSKLKLLRLSTGDVNRETHALLTVENDTQLDLGEMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAALLMAEIAGEPFNEREEQLLVSHIRELLGRRKSELTVFKTRAESGQNPGRKEIEEGLVLLNGILNEKEEYAVIEKITAAVDALKDFSEDWDDLVSFYKNQYATWQRLSVALNGSFKANRNTLDKDETAQKALQELEGIYSKARPYGELHRIIPLIETVETINQRLVEEYRSHALLQIDGHINELKQSMLEMHVPADLQHSLLHPMQQSRKKVEQNGLIPQIMEEQAEVRALQFKANEQLNGWVEEQRKKVPEPKPAPQPGVIDPVVKPEPKLKKTIYVNTRKTMERAAGVTTLDNAEQVDKALEQLRKTLMDAINAGERVQLQ

SEQ ID NO: 830 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVTCGGRAWVIVTSQADINAAIGGMSSRDGQDFSKIQGRFSTRLQLSSSNTSEVIQKRLLVKTDEAKAALTKVWREKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELCKKQEAQLRAANEAKRAADSEQTYVVVEKPVIQPVPKKTHLVNVASEMRNATGGEVLETTEQVEKALDTLRTTLLAAIKAGDRIRLQ

SEQ ID NO: 831 - protein, 1176 aa, Ruminococcaceae bacterium
MFQKDIERDINGVIKVMQDDDRSLEQELSEYIITKELRRHFRTFFDNYTKAIDQPTDKIGVWISGFFGSGKSHFLKILSYLLSNQEVCGKRAIDYFADKFDDPIMYAQAVKSVSVPTQSILFNIDIEGPLTKDKTAVLRVFAKMFYNHCGFYGDDLKIAKLERFIEKQGKTQQFREAFEKVNGAPWTETRDSFAFFEDDIVSVLQSTLGMSEQAARNWFNGEETNELSIAQLVADIQEYVDGKGKDFRLLFMVDEVGQYIGDDGDLMINLQSLVEEIGIRCHGKVWVMVTSQEAIDSVVHITGNDFSKIQGRFNTRLSLSSSSVDEVIKKRVLAKTDAADQLLRMVYDKEHAVLKNLYTFNNPVLDIKGFTDGAEFSATFPFVPYQFIVIQKVLAEIRKHGNSGKHLSGGERSMLSGFQEAAQDVKDKDENALVPFHLFYNTVHTFLESPIRRVIDRCQTAADNHDGLEQQDVSVLKLLYLVRYIEDIKANIDNISILMIDDIRTDKIALRASVSASLERLLSQNYISRNGDTYAFLTDEEQDIAIDIKNTPVDSAQVITSIAQTVYGEIYPSKKFKHDKYDFAYDQYIDETLNGSACGGMRLRIVTVASDYYGAPNERLIMDSQVNNEAIVVLSNETPYFDELEQAMKIRKYVKQRNVSQLPESIQDIIRKRQQQARILEERARSYIEKAIVGAKVIVHGEVMDIKTGNAKDKLDAAMNGLVESVYSKLNMVNRFVESDADILSILNGTDDGQIAFTGQGANNEDALNEISQWLELQNQKMLSTSMGDVQRRYQAIPYGWREIDIAALIARLISQQKISIKYGGALVGKDERRLVDYLRKKSEIDKAVVTRRIAPSEDLMRKSIAFLRDYLGAMDIPSDEDGLIRFVLDTFTQKQEHYQELLDKAYSEFRYPEKEVVTKAHDLMNDVLSQRRDNVALLTRMVQRQEDLLDCSEDMEGVEFFFKSQRSVYDEARRQMERVNKERDYFASDADTLEVFHTIATILAQPKPYDRIGELPELIQKVKTAYSGLLDLKKDEVVENIRQCMQDVHQLATEARDAGVLLRQADDYFVGKREAAKNASSLTELDAMITQLLTYKDNICRRMEVMSASHQERTTPVGTGTAQPAPKMPKITTLRRYDLCSVKRLQSKEDIDRYVDGIREKLLKTLESCDGVQIN

SEQ ID NO: 832 - protein, 1205 aa, Holophaga foetida
MQIQDLFERRIARAINGVVKADQMDDASVWQELDEFVVTRELNGHMAKFLDAFASTLGKAADAEAASKNGVWISGFFGSGKSHFIKVLSYLLKNDTHRYEGQERKAAEFFQSKVEDAMILGDIRRVATAHTDVILFNIDSKADTNHGRDAILRVFLKVFNEMQGFCADHPEIAYMERHLTKKGQYQAFVDAFLRDYGSEWEKERDAKDLLRDHVIAALSEALAISTESAEKFFDSGSDSVSITPENFSRWVKEYLDEKGPQHRIVFLVDEVGQFIGSDSHLMLSLQTITENLGTICEGRAWVVVTSQEDIDAVLGQLKKDKAQDFSKIQGRFKTRLSLSSTNVDEVILKRLLEKKPQVTGELQAIFRAKGDILKHQTSFQNAGMTFRHYKEADDFAAHYPFAPYQFQLIQKIFEAIRKHGATGAHLSRGERSILDAFQSAAKQVAEQELGVLVPLYRFYPSIESFLDTAVKRTIDQAKDNEALQPFDVLLLQVLFLIRYVEEMKADVDNLASLCAEEIDQDRIPLKRRIEESLARLEKETLISRNGEIYFFLTNEERDINREIKNVDVSSSEEATTLGKLIFEDVYKDNKKFTHLRTKRPFVFNRECDQHAIGHKAEAGLPVLVITPLADDYDTWDKGRCLAESAARDGGAVVIKLGDTFGKLQQELRMCLQVERYNSQKNDGTLPPATLRILQDLAAENRKRRERLVVEVGRLLEEADTYVAGQPLALKKSGPQDCLFEALGYLVDNTFTKMGYLHKRGEGDTSQTVLREIQAVLRANDVAQARLGIEEEESNPQAIKELRDYLYLMNVRSTQVVLHDLVETRFSRRPYGWPEEETLLLVARLLVLGEIHLVMDGASLALDKVFEAITNAQKRRKITLVQRKALDPKAIQTARQLGKDVFAQMGPDGEDPIVAFLRSKLEGWQDELKRFQGLEGSGYPGKAEVEHLLKLVKPLLAEKEGAAFLEAFSAAKNDLLDGGEDFHTLSHFFGSQRPTWDRMRKAYGKFELNRLQIEEEEAGKVALRRLKEILQMAHPYTSIMEGPDLIAKLEGIQNLLVAQHRQQTKGKIAGLLTSLGQDAERLHVSGSVFEGCVAALKGLLDRMDRQESIPHLKQAVEEADQLYGEALHRLEAAYEPPAPIVTPVGEPKIDIPPQPKPVIKKPRVVKPAELAPNGVLENQEEVDAFLVTLRTQLEAALANHERIQIR

SEQ ID NO: 833 - protein, 1213 aa, Escherichia coli; identical to SEQ ID NO: 822

SEQ ID NO: 834 - protein, 1214 aa, Oribacterium sp.
MQIKEMFKKSITRDIQGVVIAGQGEKNNIATELEEYVVTPELQRHFADFFSAYAKGVNGETTKMGVWISGFFGSGKSHFLKILSYILDNEIIGSKHAIDYFFYDKKISDPMVLADMQLAANTPADIIIFNIDAKSEADGKSNKDAIVNVFLKVFNNSLGFCGAIPYLADLERKLSEDGKYEEFKETYQKVTGHDWYSERHEFLSRQDGVVDTLIEMGYMSEKAAWNWCDAAIGDYQISIEDFAKRVKSYIDRKGNNHHVVFLVDEIGQYIGDDSKLMLNLQTVTEELGKECKGKAWVIVTSQQDIDSITKVKGNDFSKIQGRFDTRLSLSSANVDTVIKKRILDKTDTAAQTLRLLYEQKATIIKNLIVFNDGVEKKLYGSDRDFAEVYPFIPYQFNLLASVLTSIRTHGASGKHLSEGERSMLALFKESAMALKDEEAGAIVPFHRFYDALENFLDHSHKGVIIKAYDNSYINPDHKEKDVFAINVLKTLFMIKYVLEIESNIDNITSLMVDNIDDDRIAVKSRVEEALKVLMRQMLVQKNGSNYVFLTDEEQEINREIDSQNVEIAEVINKVSEMIFEDIFTDKKYRYPAFNGRYSFSFNQAVDDRPYKASQNYDIGVRILTPWYEGGNDDLTLRMMSGQKNEVLLSLPNDAAFLEEIRQYLKIEKFLRLNTSTQLAKYETIKEAKRVEMRERNANAKLYLTECMKEATIYVNGDVPRISGKEVSTRISEAMGKLVQTVYNKLSYITAAMGEMEIRKMFHSSNQMNLGLDDAEANIHALDDVLQFIASNTRIHIKTSMKTVKDRFMKAPYGFVEDDVHWLVARLFKRGDLAFTMNGVSVNQNNKTEEELIDFITKKAFVEKLLMEERIRVNEKDKKAVRDIMKELFGVSSSAEDEDSIMKNFQKYAQNMINEILRLEPEYKKYATYPGEKVLHSGKILLEEVMQIQSPLEFFQQVSKKQDYFYDFAEDFEPVKIFFSGEQQKIFARALDMLAIYDDSKTYIVDEALEKIVADMRHIVRQDKPYQNIPKLPELRSQFNEAYGKILSQEEEPVLDAIHHARERVLEVLNTKEYAASKKKKYLDLFKEIQDGAEKCNNVSSLRSFADKADALKIRLMNEMDALDRQIAEEKSLIAKKEAEEAAQKAKEEGRAVPIHVAEEKATYLKNTKNVTIKNMTRTSSWRLENEQDVDQYLAKLRQVLLEELEESDIVNVEF

SEQ ID NO: 835 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRYSELRLHKVRRHDEAQVRKAAQTMADIAQQPFNEREEPALVEHIRQVFEEWKQELNVFRAKAEGGNNPGKKEIESGLRLLNAILNEKEDFALIEKVSSLKDELLDFSEDREDLVDFYRKQFATWQKLGAALNGSFQSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 836 - protein, 1226 aa, Acinetobacter johnsonii
MNIKELFYKPLDRAINGVVKADQDDNATVYQELDEYVVTNELEKHFRDFFQSYGTDLSDPSIANRVGVWISGFFGSGKSHFLKTLSYILANKVASDAEGKERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPDSFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQAEGQVLFKLADDKQFFNELRTWLKTNKFIRLNDDGTQSDISRILADRGRENQERKKRLRARVEEMLLDAESYALGQHLQLSSSSPTTKLDEACRYLLENTYTKLSYLQVYQQDAWRELNAVLTVDDMAQLGLSLDGGQSNPKALQEVEQYIALRATGTERILVSDVIDRFAKRPYGWPDAEILLLVGQLAAMGRVSLQLNGGSLQLKEAFEPLQNSRRRRDVSIIKKRQTDDQVLKQARQLTQDLFSAMGPATEKELFEFYTQHFKNWLANFKSYKSKTDVGQFPGKKVIEKSILTLERLLANSDSFDFFKAVVENKDDYLDLEEDYRDIHEFFSNQMPSWQQLQHALRHFEKNKQALGSDEVAKKALSELHRIFTLESPYGLLNKVADLVRTVESVNEQLLTEKRNQAIEHLDDKIKQLEAEIKNSGIASAELSNKLLRPLQLLKTDIEVETSLSTIYMLQTQTSVERFDEALYELESEVQAEIQRQAKAAQLAQSKAESITNTATTSSPATSTPAASPVQPATAVVPPKPVVEVDVASIYSKTSSSVYLETEESVDQFVDALKAELKKIVGDKKRVRIR

SEQ ID NO: 837 - protein, 1183 aa, Selenomonas sputigena
MCLMMIKNMFAEDIDRKINGVVKVEQDESAILVQELDEYVITKELKKHFIAFFNNYGESFEENISDIGVWISGFFGSGKSHFLKMLSYLLENKEVQGVKTVERFRKKFEDDAAAFMPIDKVTRGETHTILFNIDVQSSGQKDETAVLRVFAKMFYHYLGFYGEDLKVAKLEQFIEKQGKTAEFRRVFEEKNGASWLSSRDSFAFFEDDVVSTLTQVLGMSESAAENWFNGTQTVDISIAKLVSEIKEYSDAKPQDFRLLFMIDEVGQYVGDDRSLLLNLQSLVETIGAECKGKVWVVCTGQEAIDEVIKARENEFSRIQARFKTRLSLSSASADEVIQKRILKKTPDAQEELESLYTQNDSVLKNLFSFTESVKDIRGYNGAAEFARNFPFVPYQFILMQKVFAEIRKHGNSGKHLSGGERSMLSGFQEAAQKIEDKNEYALAPFYLFYDTVHTFLDSSIRQVIERAERAAEAGHGLEMQDVAVLKLLYLVRYVDDVKATLDNLVILMADKISLDKIAVRERVGASLERLLTQNYIGRAGEIYSFLTDEEQDIQRDIYRNTVVDTAAVVSQIGSMIFGDIYTARKYRYGGKYDFPLDGMVDNTVVGTATGGMKLKILTVAADAVEKTDLRLTAESVGQALVVLADTPYYQSLENAMKVHKYVKQKNMTQLPPSVQAIIRSHQEEARKYELEAKKELVKAIETAEFYVDGEHLLLKGGDAKGMIDQALEYLVDHVYSDLSLIRKNADSEADISSILRGTEQTLFGTGANSEAAVKVEEYLEIQHAKKLRTSMQDIQSRYKGIPYGWKELDIACVVAQLIHEQKVTVKYGGSTIQPNDPKLPQMLHKKSEIGSTIVSKRQTVSLAKIREVREFLRDYFDEMDVPEDEDGLIRHITVRFEGEKARYENLLALYAGRKYPDKLLVSSAVDAMKELLSHAKDNMALIDYVIKKQDAICDLKEQVQNVESFFSNQKALFDEAVKYEEALQHDLEYIAKDKEAEKALNTIRLITLIPDGGGFNYRRLPELNDLLAKVHAKHDAMLEEKRQELLKIVDDCLEEIRAKAKTESKARDILQQEEGYFARKKEYIAGIRVLTLMDGQMPNIWLRKDEAISRIENLCKEDDKREEEQKPSVTAGKKPKKIIKSVYRQSMFPKRTIETDADIDEYVEHIRRRMKTMLKDCDGIRLD

SEQ ID NO: 838 - protein, 1226 aa, Acinetobacter junii
MNIKELFYKPLDRAINGVVKADQNDNTTVYQELDEYVVTNELEKHFRDFFQSYGTDLSDPSIANRVGVWISGFFGSGKSHFLKTLSYILANKVARDAEGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPESFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDGHSLDGKYESDLKVEIISPLDTEYNLYTEAFCIGKSTQAEGQVLFKLADDKQFFNELRTWLKTNKFIRLNDDGTQSDITRILADRGRENQERKKRLRVRIEEMLLDAESYALGQHLQLSSSSPTTKLDEACRYLLENTYTKLSYLQVYQQDAWRELNAVLTVDDMAQLGLSLNGGQSNPKALQEVEQYIALRATGTERILVSDVVDRFAKRPYGWPDTEILLLVGQLAAMGWISLQLNGGSLQLKDAFEPLQNSRRRRDVSIIKKRQTDDQVLKQARQLTQDLFSAMGPATEKELFEFYTQHFKNWLANFKSYKSKTDVGQFPGKKVIEKSILTLERLLANSDSFDFFKAVVENKDDYLDLEEDYRDIHEFFTNQMPSWQQLQQALRHFEKNKQALGSDDVAKKALSELHRIATLESPYGLLNKIADLVRTVESVNERLLSEKRNQAIEHIDDKIKQLEAEIKNSGIATAELSNKLLRPLQLLKTDIEVETSLSTIYMLQTQTAVERFDEALYELESEVQTEIQRQAKAAQLAQSKAESVTNTATTSSPVTSTPAVSPVQPATAVVPPKPVVEVDVASIYSKTSSSVYLETEESVDQFVDALKAELKKIVSDKKRVRIR

SEQ ID NO: 839 - protein, 1229 aa, Shewanella baltica
MKIEQIFSKKLMRNINGVVKAEQKDNESVCVELDEYVVTRELDRHFRAFFEAYVPSVTHPDSDMSGKIGVWISGFFGSGKSHFLKILSYLLENKSVEKDGQVRQAFEFFKDKINDSMLLADIRNAVTKDTDVILFNIDSRANTDDRENAILKVFLKVFNERVGYCADFPHIAHLERELDKRNQYVAFKDKFAELTQSTWEKERDAYDFYRDELSEALAHASEQSLESAKAWVEQVENNFPLDIRNFCKWVNEYLELTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTYLIDVFAEKGDILRNQLTFDKTTTVSLKGYIDAPSFVDNYPFVPYHYTLVQKVFESIRTKGATGKHLAMGERSLLDAFQSAAKQMKDSGLDVLVPFYSFYAPIESFLEPAVKRTIDQACELDSLTEFDGKILKTLFLIRYVDVVKSTLDNLVTLSIDRIDADKISLRKQIEESLNRLERQLLISRNSDVYVFLTNEEKEIENEIRHTDVEMSEVSNKLSAIVFDGILKGNRAYRYPINKQDFAVSRFCNGHPKDGTTLEDLVIKVISPLDSHFENYSHDQACINHTLEADGCVLVKLGEHKRLWDDLTTFIKTDRFLKQNSGQRPEQEHLLREKQMENIEREKRLRTDFEALFAEADVYAIGTKLPKKSATPSAIVEEAYKYVIENTFAKLNMLKATTGEVLRELQAVLVADDIAQIGLDLQADECNPEATREVEQYVTLKVERNEPVYLRDIVARFGKRPYGWPDNEILLLTARLGLAGKVSFSTQGTDLALKKAYEPFTSVRKRGEIRVHKIRQHDERQIKKAAGLVKEIFSKTFTGSGEKELYELVRDELLAWNEELKSFRTVINTGGQTGHFPGKSQIDDGLALVAGILEQTSSFALIARFLEDADALVEFAEDFENLDDFYNSQFQTWQALAGALNEKFKANRPALEKDSEALKGLIELERIYNMPSPYEQLRHINPLIEQVAKVNSTLVEEKRTHALGRVDQRIGRVKEALTEAYAPSELQNQALRPLQMCRQRIVATSSIPQIISEQTEAEGYEDEAYELLNGFIEEQRKKAEAEQRRRELEQKKREEEATKAGKEAPAPEPAPEPVPPKPVAKRTVTINPTDAVAKSVTTGFIESEAEVDAYLAVLREQLIAAVKAGDRVRIK

SEQ ID NO: 840 - protein, 1151 aa, Vibrio cholerae; identical to SEQ ID NO: 825

SEQ ID NO: 841 - protein, 1213 aa, Escherichia coli; identical to SEQ ID NO: 660

SEQ ID NO: 842 - protein, 1230 aa, Halomonas sp.
MRIQELFLKPLNRSINGVVKADQRDQETIYQELDEYVVTNELEKHFRAFFESYTTPLDDPSIANRVGVWVSGFFGSGKSHFLKTLSYLLENTEAFDANGHAKRAADFFDEQKLVDSSIRADITNAVREPAHVVLFNIDSKASSNDDGNPILNVFLRVFNEYQGFSSDYPHIAHMERHLEKRGVYEPFKQAFNDASGMAWEEERDGYQFYQDDIEQAISVALELSPEAAHKWFEESEANFSVSVENFCHWVKEFLESQSSTRRMVFMVDEVGQFIGSDTRLMLTLQTLTENLGTICGGRAWIVVTSQADMDAVLGEMTASKANDFSKIAGRFKTRLSLSSSNSDEVIRKRLLVKTDPARAELEGVFEAKGSILRNQLTFDRSGPTLKNIEGVDSFIANYPFVPYHFQLVQKVFEEIRKVGATGAHLAYGERSMLDAFHMAAKAVQEKSIGALVPMHCFYTAIEGFLDTAVKRTIDQASENPVLEAFDVETLRTLFMIRYVDLVKGTVDNLVTLSLTQIDDDRIAIREQLDATLARLEKESLITRNGDEYQFLTNEERDITRKIKATEVTSSDENKELSSLIFKDLLRDRAKYRYPLNKTDYSIGRYLDGHTLDGRYQSQLRVEVVSPLDVEYVQLSDAGCIHKSGDNGGQVLIKLPDDKRFTDELRTLLKTDKFIRLNLSANDHSVERILADRGRENQERKKRLRVRLEEMLLDADAYALGQKLELNRSQLSTRLDEACRYLLENTYNKLGQLTVLNPEPMRELQAVLTADDIGTQNLNLDGEEGNAQAVKEVEQYISLHSGEPVPLNPLIERFSNRPFGWPEGETLLILGRLHTAGRLTFHTAGPALSGKEAFELLNNARRRSEVRIQKKRQTEDAVLNKARNLTKDLFGQLGPASEKELFSYYVDRLSRWRRELEAYKSKTDVGNFPGRKAIESSLLEVERLLRLDDSFDFFKAVASQQDTLLDLEEDYRDLSDFFTKQLTTWQQLEQARVRFGVNHLELEKHPEAQQALAECECIYSADAPYAMLNKVDGLVRTLDDINTRLVTEKREHAIARIDTRIAKVSAEIAKSGIGNAELSNRLLHPLQQLKASVNQSVSIAQIYQLQTETAVEQEEESLDALHNAQAEVAKRQPPAPTPAGGDSTAPTATPGSQPPAGHTAARDKTYDPHTATAPAAVNAPKPVARVRVSDVLSRVHSGVYLESQAEVDAFMEELRKELEGSLSAGKRVQVR

SEQ ID NO: 843 - protein, 1218 aa, Bifidobacterium angulatum
MNGESAISFKELFSKDIDRNINGVIKANDEKNLDDEVNEYVLTEEICRNLAKFLDAYNDPSNHEQNGAWISGFFGSGKSHLLKMLSHILGEVPAELVDKGNKPTMSREQIVHAFMGKAEAQDDQMLAGQLEKALTIPATSILFNIDQKADKSNASDMLLYAFVRVFDEARGFYGKNPYVAKFERDLASNGYFEDFKQEFEQVAGKPWSEGRGEAVLWDDEICEAYAAVTGKPEQDSIIQRYEDTYTMTVGDFADDVNAWLSHQEPNRRILFLVDEVGQFIGENRELMLSLQSIAEDLAVKTNGRAWVVVTSQEDMDTIVGDRTKQQSYDFSKIQGRFSIKLKLNSADVVEVIQKRLLTKKPEYESVMNELWDEQNANLRTMFEFTRETSKFSNNKAYSKDDFIASYPFVNYEFELFQNVLREMSRYNMFSGRHASVGERSMLSTISSTLRSSQNEMVGALMPFDKLYDGIADAIQSTSNFRINQAEKRLGSDIKELGVRLLKVLLLVKHVDGFPTTPHNLRILLTDQFDMDVMELERNIKYVLGELEKDTYVQRVGDTYNYLTNEEQDIEQEIKSTDIDSSKEIDELKKILVSDVLGKMTVAYGEQRAQFRYGLRIDGVQQSAQQPIWLNVVTSTNAQDRADAIRMGMGMRDTITLLLDMSDRTLFDDLRMYVKTYTYLMRTDKNSQSEVRQQIISRKSVANERLYTELRTRIVKAAANGEFDYNGGTVEVKSTEVQARMAEGLGTLIGRYYTNFSLLGGQRYEETDLARIIMNASQHQPGMLDGMNAVQDKLDVPADDVFAAVSRDKGKGIFATVKSLLDAYGSVPYGWPYAATLACIGHLYGSDRITLTLDGKPVQRSEAARLLRETKKQDSIRVDLPRVFDTRKVSQLRDFARDFLGLTAADLPSNAIDLAEAVTTRLKREAESLTQLRVRNARFGFVQQLDKAIEKINYASGMGEDWLLGDFTAQETENGSEELLEFKEDVIDPIVAFLNGSQSRILADGLEWLKNNKPNIDYVSGTTAANLYQSAEQLANDPNIFRKTNKFKTAIDDLREATDATIQTERANALNDVEDIRTRIHDSTEYQHATQAAQTKVETELDQVAERMQRIPFIYKMRESVHELSERTYPQLINTLAASAPRPKTALADEAQTPSTTPMDVNIPESQQKETPRVAVSFATISRPHTKDALETKDDVDDFLDAYRRELIAAIENGKKILL

SEQ ID NO: 844 - protein, 1151 aa, Vibrio cholerae; identical to SEQ ID NO: 825

SEQ ID NO: 845 - protein, 1192 aa, Alcanivorax pacificus
MTLKNIFLKPVDRPIEGVIKADDEASLRLEIEEYVLTNEVEKRLEEFLDAYNNYEGANGVWVSGFFGSGKSHLLKMLALLLENREMDGATTLDLFLPKCSENEILRGDLKRAISIPSKSILFNIDQKADVISKTQIDALLAVFVKVFDEMCGYYGKQGHIAQFERDLHSRGLYKQFKAEYEAIAGRSWKKGREQALLEGANIAKAYASVTGGDPQSAAGILDKYRSEYRVSIEDFADNVNAYIEKQAKEGGHKEFRLNFFVDEVGQYIADNTKLMTNLQTIAESLATKCRGRAWIIVTAQEEMKDVVGEMGKQQGHDFSKIQARFNNRMKLSSADVAEVIQKRLLTKTEEGVNQLSDVYHAQANNFKTLFDFADGSATYRNFRDRDHFIHSYPFVPYQFALFQSAIQNLSQHNAFEGKHSSVGERSMLGVFQQVAIHIGNHEVGQLATFDLMFEGIRSALKSQIQRAIIQAENHLDNAFAIRLLKALFLVKYVKEFKPTVRNLCVLMLDAFDQNLPALRTKVEEALSLLEQQTYIQRNGDQYEYLTDEEKDVEQEIKNTEVESSDIADELEKIVFDFVIKQRKIRYDAGSSQNQGQDYSYSRKLDDRLHGREYELSINVISPFHEHTDNEQMLRTASTYKADELFVLMPSDERLVRDLLMFKRTEKYIKQNISVTQQKGVKRILHDKGFQNREREARLRQQVQTLIGKSKLLIGGADVEVANEDPQTRIIRGFHELISRAYPNLRMLRGVSYTENDISNCLNRTDDGLFGNDATALAESEQEVLAFIQSNNRGGVRTTLKSLLEKFERKPYGWYYAAVLCTLANLCARGKVEVRLDGNILEDSELERALRNTHGHGNVVLEPQIEFTASQVRALKSFYEDFFDSPPRSSEAKALGKEAGEAFRDMYHDLDRRIAQVDQYPFLNALKPALETLKEVAAKPYTWHLTELGKQEDQLLGLKEDVIDPIRKFMGGSQKDIYNQARSFLQSQKPNFIYVSGDEIEQIRTILNDANCYKGNRIQQLKGQLDSLQERIDEKVQQIRSQAETSLKTMQERMQSMDEYQSLPEPRQDELNKPLRELVDYIGQERLIAVIKDRIRYFEEEGYQKLLGKMVAMAKQKPAPSDDPAQRTGVENGWNGGQPHEIKEPSADYIHTRNLRVAFDKAWLADEDDVDRYLNALREALLVEIQQGRKVQI

SEQ ID NO: 846 - protein, 1151 aa, Vibrio cholerae; identical to SEQ ID NO: 825

SEQ ID NO: 847 - protein, 1151 aa, Vibrio cholerae; identical to SEQ ID NO: 825

SEQ ID NO: 848 - protein, 1178 aa, gamma proteobacterium
MLLEQLFNKPVDRAIEGVIKADDDVSLYVELDEYVITNEVSKRLDDFLDAYLNYAGANGVWVSGFFGSGKSHLLKMLALLLQNKPIEDTYYPLDLFLQKPPFNEGGMQAEDLKRAVAIPSESILFNIDQKADVISKDELDALIAVFVKVFDEHCGYYGKHPYIAQFERELDVDGQFDAFKTAFEKLAELDWESGRRRAKRMAQHIDTAYTEVTGTSVVDILDKYRDDYRLSIEDFAEQVNAYIESKGDTFRLNFFVDEVGQYIADNVKLMTNLQTVAESLATKCKGRSWVVVTAQQDISSVLGEGAHQSNDFTKIQARFNNKMPLNSQDVAEVIQRRLLAKKDEHINALSDLYHANENNFKTLFDFADGSTTYQNFKDREHFIQSYPFVPYQYLLFQAAIQGLSRHSAFQGKHSSVGERSMLGVFQQVAIGIKGHTLGDIATFDLMFEGIRTALKGSIQTSIHSAEKTLTNEFALRVLKALFLVKYVKAFKPTVRNICVLMQNNFNTSITALKADVEEALALLENQTLIQRNGDLYEFLTDEEQDVEAEIKNTEIDTQTVAGELEKLIFDGVIKNRKIRWDESGQDYAYTRKLDDVQSGREHELAINVITSFHDYRDAFDKHKTDTVYNDELRVVLPDSDRLIRDLMLLKKTEKYISHETRTTQQDSVKRILAEKAAQNGERATQLKALISSLMGKAVYFVGGKEIELAGEDGQTKVQRAFVELAKQTYPNLKMLRGKQYQESEISGILTQGEQGLFGDETSLPEAQQEMFSHIQSNHRGGIRTTVKLLLEKFERKPYGWSYAAVLCTLAHLCARGKIEVRESTNLLDDSELARALTNTNVQGNLILDPQIEFTQAQIKRLKTFFNDYFDKVAHATEAKALAKETQDAFANQKTELERLHLQADRYPFLRALTVVIDDLSELSTKPYQWFVTELTRDEDKWLDDYKDGLVDPIVSFMKGSNKAQLDEASRLLSDHKANLSYVQADELDAIKSAVVDPNIYKGKAIQTLISNIQSLKSKLDSVIADEKAAADARIDALEAKLTQYDGYLSLSDENKATVQARIDAAKQAISEQNLIAMIRDAVNNFENHQYSALLQQIEDWNTPVVPEPPVKPGNGDTPIDPPTPPVSPAPKVEIVGARDLSVAYAKPLLESEADIDAYLESYKQALVNTVKQGKKVRL

SEQ ID NO: 849 - protein, 1213 aa, Escherichia coli; identical to SEQ ID NO: 657

SEQ ID NO: 850 - protein, 1221 aa, Enterococcus faecalis
MKINDMFQKDIHRNIEGVITASQASEEQVYQELDEYVVTKELQGQFRTFFDAYKQGINGHTSKMGVWIQGFFGSGKSHFLKILSYILENKEINGKTAFDFFTEGDELTRKIKDPMTIADMELAVKTPTNVILFNVESKHQTGIEGKNSLVNVFLKVFNNSLGYSTNPKVADLERRLDKDGKYNEFKEAFKAEHGLDWINERHEVDFIQDSMVNALSSIGYMTEDAAKTWFNKLESEYIISIEEFAVMIEEYLQSKGNNEHIVFLVDEIGQYIGGNSDLTLQLQTIVEELGNKSRGKAWVIVTSQQAIDAITDIAGSAALDFSKIKGRFETTLSLSSANADEVIQKRILAKNISGQQYLEADYPNHESNIKSMLIFEDSPELKLYNSAKNYADVYPFVPYQFNLLANILTQVSKHSIQGANLSRGERSLLAFFKETAERNADNDSGVLVSLDQFYPSLEKWLNETENAKVIKQAEENTNIVSDGKDLFNVEVLKVLFMIKYVDQNIKPTLNNITNLMVRRVNEDKLALRKRVELALKILIKENLIRQNLQNYVFQTDEEQEVTRLINHIDLSATDVEDRLARDILDDKVGRNSFSYKNANASGRAFENRYNFMYNFYVDDYAYRKNNNPNLEVKIITPYYNELWNNEPQLILTSTKNQMLINLPVDTEFMNHVQTYLKVEKYITTANVSSAIKNFAAVKAEKTAENQELVESINSQLNDFLKQATFYFNNSKLEVSGSDFKVRLNDALQQMAKLVYHKNDLVDAAVSESDINSLLKDNGTTLVAYTENQNVVDDVKRFIQLQHNQNLTVTMKTLRDNYVNREPYGFINEDLEWAIARLFKEGSISLFKNGIPLDTNSDINEISKAIFDRKSPEKIRVELRPKSNDLQKKMVRNLGEELFNSRNIVDETNDDTTRIRFNEKAQHMVRELQRFKDTSGHHYPQSDEIVEAIKVLDQVINARDTKSFFEVLQNREEELLDWAEDYEDIHSFHTSSQKSIWDKTRDYIGRIEDSKIKESTEEMNTIISEMKSIRKQSVPYKDIPRLSELNGKFEIEYMKFMEAKSDKATSQINVIKESVLEDLLRRNFGDDFRNDVIKEFDKLNDELSTAKTFDEIILIQAQAEPLQRKFTAKFTTEENYRREEEAKKISIAISNNCDEDTNSMADKIPDVIAVTPVKKVENVYVKELISSRQRIKSEEDIDLFVNKLKQELLAKLNDDNELDILL

SEQ ID NO: 851 - protein, 1225 aa, Pseudomonas syringae
MAVSIKEIFFKELDRPINGVVKADQADDATVHQELDEYVVTNELEKHFRSFFESYSTDLSDPSIANRVGVWISGFFGSGKSHFLKTLSYLLANIEAHDARGNSKRAVAFFDQNKVRDAMIRADIDKAVANSADVILFNIDSKASSNDAGNPILNVFLRVFNEHQGFSGDHPHIAHMERHLTQRGVYEQFKQAFNTATGLEWVDERDGYQFYQDDIEKALASALGLSAEAAHKWFEASEQTFSVSVENFCNWVKEYLDTQPAKHRVLFLVDEVGQFIGSDTRLMLTLQTITENLGTICKGRAWIIVTSQADMDAVLGELSSTKANDFSKIAGRFKTRLSLSSSNTDEVIQKRLLRKTEAAEAELRALWEQKGDILRNQITFDRSGPTLKNYDGPDSFVANYPFAPYHFQLVQKVFEEIRKVGATGAHLAYGERSMLDAFQMAALSLKDKPLGALVPMYSFYRAVEGFLDTAVKRTIDQASESEVLDDFDVQILRTLFMIRYVDLIKGTLDNLVTLSIEEVDTDKLALRRRLEGTLQRLEKENLVIRNGDEFVFLTNEERDITRKIKATEIASSDENKALAELIYKDLLKDKNKFRYNLTKTDYSIGRFLDGHSLEGRYEQDLRVEVISPLDPDYALYGEASCLNKSNEAPAGLALFKLPDSSELFGELRIWLKTNKFIRLNNDDNQPDLSRILSDRGRENQERKKRLRLMLEALLERAEIYALGQHLKLSGNNIQTRFDEACQYLLENTYNKLGYLRVLQQEPERELHAVLHSDDIAQLGLTLDGEDGNAQAIKEVEQFITLRASGNDRLLVADIIERFNKRPFGWPDGEILLLIGRLAAAGRISFHVAGPSLALPDAFEYLTNSRKRREISVQKKRQTDEVLLKKVRNLSQDLFNAIGPAGEKELYAFYRSRLETWLSELKSYKSKVDVGRFPGKSTIEKSLLTLQRLLGNSDSVDFFKEVVDNSNDYLDLEEDYRDLNEFFTNQLHSWQQLQQALRRFDKNRNALEKNDSARKALAELQAIESHASPYNQLHKVSGLVETVEAVNVSILTEQREQALVAIDQKIALLQAEIAKSGIESPELSNRLLRPLQLLKAEAETETSLAHIYQLESQTAEERLQDGIFELERAIQSEVDRQQKLQQQADKAAQQAAQGSNQIKEERTPPLVPVKPVAPPKPVVEIAATSVFNKLGNGVYLESQSDVERFVEALKAELVAAIQQEKRIRIR

SEQ ID NO: 852 - protein, 1213 aa, Escherichia coli; identical to SEQ ID NO: 660

SEQ ID NO: 853 - protein, 1178 aa, Pseudanabaena biceps
MLLQTIFAQDIKRPIEGVIKADDEARLGVEIREYVLTNEVEKRLESFLEAYNGYQGANGVWVSGFFGSGKSHMLKMLALLLENREVDGEKILEAFLWKCRDNEILRGELRKAVAIPSKSILFNIDQKADVISKTQIDALLAVFVKVFDEMSGYYGKQGHIAQFERDLDSRGFYASFQDKYEEIAGRTWQKGREQALLEGQNIARAYAAVTGNDSESAIAILDKYRSQYRVSIEDFADQVKAYLDKQSLDFRLNFFVDEVGQYIAENVKLMTNLQTIAESLTTKCQGRAWIIVTAQEDMDSVVGEMNRQQSNDFSKIQARFHNRMVLTSQDVAEVIQKRLLTKTEAVKPLLATIYQEQANNFKTLFDFTDGSQTYRNFQDCEHFTNCYPFIPYQFTLFQAAIQNLSKHNAFTGKHSSVGERSMLAVFQLVAIQICDRPIGKLATFDLMFEGIRTALKSSAYKSIRTAEQNLDNQLAIRILRTLFLVKYINEFKSTLRNLCVLMLDEFNQDLPQLSKDIEEALDLLEQQNYIQRDGEQYVYLTDEEQDIEQEIKNTEVEFRDLADDLEKLIFDYVIKNRKIRNAENNYDYEYSRKLDGRLQGREHELTINVITPFHENADNEAALAMQSMGFDELLVIMPVESRLMSDLMMYKRTEKYIRQNVTIAKQEGIKRILEYKASSNRTREAQLKESIKALLGQSKLYVAGTKFEVGGEDAQSRIIKGFQTLIERTYPNLKMLRGISYSENDLGNVLNNSQEGLFGNDVTTLDESEQEVLAFIQGNNRTGIRTTLKLVIDRFRKKPYGWYEAATLCQIAKLSVRGKLDTKIDSNIVEGDALEKALRSASGYGNVILEPQIDFTTSQVRNLKEFYQEFFDASPTMSEAKALGKETGEAFQKLLNLLMPIASQVSQYPFLQALDPAIAMISDVKGKSYAWYLTELSKKQDDLLDLKEQVIAPIRGFMNGNQREIYEQAQKFVQAQESNFAYIAGTDVEQMRAILADRQCFKGNRMQQVKVLSDRASAAVAEKVKEEIAIAKTSVTELQTRLCAMSEFTGLSAEQQTQIVQPFSNFLTAIANQSLIAVIRDMRRRFEEETYAGLMVRVSEWATATNRVQPDSTAKSLVGGTYKVSVKDNQAIAYVAKQSIQVKFDRVWLENEADVDRYLAAMREAFMAEIQQNKRISI

SEQ ID NO: 854 - protein, 1151 aa, Vibrio cholerae; identical to SEQ ID NO: 825

SEQ ID NO: 855 - protein, 1229 aa, Vibrio cholerae; identical to SEQ ID NO: 729

SEQ ID NO: 856 - protein, 1213 aa, Escherichia coli; identical to SEQ ID NO: 822

SEQ ID NO: 857 - protein, 1176 aa, Actinomyces sp.
MDMTGIYAKDINRTIDGVIKADESAHIRSEVDEYVMTSEIRAGLDRILDEWNAPRPQSNGVWISGFFGSGKSHMLKMMSYLLGDVRGSGEMTRQQVAEVFTQKARGHEMLIAGIGRSQQIPALSMLFNIDAKDDKATSRPEAMIEVFYRAFFEARGLYTADLGVGALERDLVDRGLFNQFKECFRAVAGGEWEDRRAGTVFAEAPTARALAGVGIEVDKPIASYRASLNRSAEAFADEVAHWLDSREPGARIGFFIDEVGQFIGRNTHLMLNLQTITEQLFTKCSGRAWVFVTSQEKLDDVIGGLGEQQGNDFSKIQGRFTTQINLSTQEVEQVIARRLLAKSDAGRAVLEGQWSRSGAGFASMFTFPAWQKAYSNYADEEAFIAKYPFVDYQFDMFSQTMIGMSESGLFTGRHSSVGARSLLGVCQQIAQDLQERPIGTITSFDQFYDGIAAMLKSDVKENLHRAQANSLTSDPFTISVLKALLLARYVKDFPCAPSNLVVLLRRDLGQDATALEARVKRSLDALVGQYFVQKLPEGTYTYMTDEEKEVKQQIGRMSVSEGEVTGHLMRSVRAVLGNAAASYRHPDTDLDLRITTIMDCMRPASTESLVLNCVTPLSQVDAEAARIRSTGGQDTLTVVLALSDETVEEVYMYLRTERYVRGATGSSAPSGRKRLIQTYGEQNNERDERIKAAVRMSFKGARFFTDGSEVEVPASMPPAEAVNRGMGVVVGRVYHRMGDALPLAKLKEGDVDRFLRDEDEGLLPEGGLQAANPLADQFAQWVKQSRDLEGRSVFVQDAVDHFRAAPFGWGQNAVLAIVATAIRRGLVDAKLNERPLTRTELSSGLRVSQERSRILLEPKRQVDQRALARFRAFAKEFVLSDGRLEDDNARAVAVDNAVQGWRAVLDRARRTPFDFGGEIDEAEATLEAVGAGPLGAEAYLAPGVQAVFDDVVEIRSDFLEPLQEFLTRHMPAVEDAVRAADSLAAYGDGVGEDGRRAIEELRALVSDEHLYNRTDEVAPLRERVDRARRVFVEERRSEALRAFEGVRAEVTASDEFGQADPTAREAALSRIDAECASIRGMTDPGAIVIAAQKVDALSAELFARLIASHERVDEAPGHSDEAPGGRAAPPQVVQLSALTRDLCRTTIRTPDDVDAYVEELRSALHRAVSNGNIIRR

SEQ ID NO: 858 - protein, 645 aa, Fusobacterium necrophorum
MDEIGQYIGENSQLMLNLQTLVETLGVKFKGRIWVGVTSQQDLGNILGKARERSNDFSKIQDRFKTMLPLSSANIDEVIKKRLLEKKQLQQEELESLYDKTRIYIENAITFDKTGMTLALFEDRKDFAESYPFVGYQFNLLQKVFEKVRNMGYSGQHMSRGERSLLSSFQEAGIRVKDMEVGSLVPFQYFYQSIEQFLEDNVRRPFIHAKNERGIDEFGLEVLKLLFLLKGIKGITPNINNLVSFMVDSVDCDRLALEEKIKKALGKLEQQVLIQKDGEGYYFLTNEEQDINKEINQELINEQDVYKELNTYIFGQIFTSPTVTMEDTKNKYNFSQKIDEIPFGKIGGQLDILILTPRSDEYDNIAILGYRDGYDLILRLPEEMTYWKEIQQSLRIASYVQKTLRGSIREVVHQILQMKQQENSKRKQRIQSEVERMLSEAEIYIQGQKVNITTTQADKRIAEALKAVARHRFNKAKLIQKPYYESEIRNVLSYEYDAGTNLFDVKKDMSTNRNYEALQEILTYITLHTSRGNVITLKHIVEYFSKKPYGWETFSIHGLVAELWIYKQIQIEESKNLIHNAEELKTLLVKSQSKTEERLVISLREEIDTELLQKVNNLLKKLFGPEKEVSVDQPKEDILEILKKK

SEQ ID NO: 859 - protein, 1226 aa, Acinetobacter radioresistens
MNIKELFYKPLDRAINGVVKADQNDNTTVYQELDEYVVTNELEKHFRDFFQSYGTDLSDPSIANRVGVWISGFFGSGKSHFLKTLSYILANKVARDAEGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPESFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQAEGQILFKLADDKQFFNELRTWLKTNKFIRLNDDGTQSDISRILADRGRENQERKKRLRVRVEEMLLEAESYALGQHLQLSSSSPITKLDEACRYLLENTYTKLSYLQVYQQDAWRELNAVLTVDDMAQLGLSLDGGQSNPKALQEVEQYIALRATGTERILVSDVVDRFAKRPYGWPDAEILLLVGQLAAMGRISLQLNGGSLQLKDAFEPLQNSRRRRDVSIIKKRQTDDQVLKQARQLTQDLFSAMGPATEKELFEFYTQHFNNWLANFKSYKSKTDVGQFPGKKVIEKSILTLERLLANSDSFDFFKAVVENKDDYLDLEEDYRDIHEFFTNQMPSWQQLQQALRHFEKNKQALGSDEVAKKALSELHRIFTLESPYGLLNKVADLVRTVESVNEQLLTEKRSHAVEQIDDKIKQLEAEIKNSGIATAELSNKLLRPLQLLKADIEVETSLSTIYMLQTQTAVERFDEALYELESELQTEIQRQAKAAQLAQSKAESVTNTATTASPITSTPAASPVQPVTAVVPPKPVVEVDVASIYSKSSSSVYLETEESVDQFVDVLKAELKKIVSDKKRVRIR

SEQ ID NO: 860 - protein, 1151 aa, Vibrio cholerae; identical to SEQ ID NO: 825

SEQ ID NO: 861 - protein, 1217 aa, Bifidobacterium bifidum
MNGESGISFKELFNKDIDRNINGVIKANDEKNLDDEVNEYVLTEEICRNLAKFLDAYNDPSNHEQNGAWISGFFGSGKSHLLKMLSHILGEVPAELVDKGNKPTMSREQIVHAFMGKAEAQDDQMLAGQLEKALTIPATSILFNIDQKADKSNASDMLLYAFVRVFDEARGFYGKNPYVAKFERDLASNGYFEDFKQEFEQVAGKPWSEGRGEAVLWDDEICEAYAAVTGKPEQDSIIQRYEDTYTMTVGDFADDVNVWLSRQEPNRRILFLVDEVGQFIGENRELMLSLQSIAEDLAVKTNGRAWVVVTSQEDMDTIVGDRTKQQSYDFSKIQGRFSIKLKLNSADVVEVIQKRLLTKKPEYESVMNELWNEQNANLRTMFEFTRETSKFSNNKAYSKDDFIASYPFVNYEFELFQNVLREMSRYNMFSGRHASVGERSMLSTISSTLRSSQNETVGALMPFDKLYDGIADAIQSTSNFRINQAEKRLGSDIKELGVRLLKVLLLVKHVDGFPTTPHNLRILLTDQFDMDVMELERNIKYVLGELEKDTYVQRVGDTYNYLTNEEQDIEQEIKSTDIDSTKEIEELKKILVSDVLGKMTVAYGEQRAQFRYGLRIDGVQQSAQQPIWLNVVTSTNAQDRADAIRMGMGMRDTITLLLDMSDKTLLDDLRMYVKTYTYLMRTDKNSQSEVRQQIISRKSVANERLYAELRTRIVKAAANGEFNYNGGTVEVKSTEVQARMAEGLGTLIGRYYTNFSLLGGQRYEETDLARIIMNAAQHQPGMLDGMNAVQDKLDVPADDVFAAVSRDKGKGIIATVKSLLDAYGSVPYGWPYAATLACIGHLYGSDRITLTLDGKPVQRSEAARVLRETKKQDSIRVDLPRVFDTRKVSQLRDFAREFLGLTAADLPSNAIDLAEAVTTRLKREAESLTQLRVRNARFGFVQQLDKAIEKINYASGMGEDWLLGDFTIQETENGSEELLELKEDIIDPIVTFLNGSQSRILADGLEWLKNNKPNIDYASGTTASLYQSAEQLANDPNIFRKTNKFKTAIDDLREATDATIQTERANALKDVEDIRARIHDSTEYQHTTQAAQTKVETELDQVAERMQHIPFIYKMRESVHELSECTYPQLINALAASASRPKTALADEAQTPSTTPTDTNIPESRQEETLRVAVSFATISRPHTKDALETKDDVDDFLDAYRRELIAAIENGKKILL

SEQ ID NO: 862 - protein, 1208 aa, Bacteroides ovatus
MKLKELYNKPIDRAVNPAVSATKFDPETERIEIQEYVFTDEIMNGLFRILDAIKNNQPYDHVGIWIDGYYGSGKSHFLKYLDYCITPSTREDALSRLLEAIKAIDPLDDKHYLSFDYEQMVSIANWLERATIDTCIFNLETSYDNSTDKKKAFLHVFWNEFNGKRGFNKFNITLAQNLEKPLEEKGVFEAFKQRIAEEGGDWNDPGMAADLIDNELDWVLDIAKELAPTLSVDSIRERIIKRDTNMSIDRFGLELASYLKDKGDDYRLIFLADEVSQFINKERDRYLNLQEIITKLSEACDNKVWVACTAQQDLSEIMDDCHIAEEKDKEGKIKGRFEVKVSLKGTQPEVITQKRILDKKEEVKDTLASLYNKYKAGFDLQFKLPNSYSSYDSQDDFIDYYPFVPYQFKLIMQVFNSFLNLGYVAKEVKGNERSIIKVIHSTAKANADAELGKFISFDELYNNMFEEGLQARGQKAVDNALRMARTYQTDKPEKTRLAVRVANVLFMICNISQTDQLLFPATVDNVTSLLVNNMDTPRLTIKNEVEKIVEFLCDNNIIRREQGKQGAPDTFMFYSEEEMKVAQLIKNQVVDNNTQAEQLKDIFNKYITALKNKEQYKTRSFSVGLTIKQRTFLSNNPDVMVEFVMDPDYDTAEQLALQNSNTNRMVYYVGPQYRENRRLYNAFYWYCQAERYMSTPVPNEDNANTRKEFAKRAEELYEGLIKKEFEKILDTCPIVSGLYVIDDAELGQKRGNDRYRVAIEKHLAGIYPKANLVDSPSIPRTTEQLKKAILRNVNPGDYEGMGAILTDAEHEVEIYLNKQFAEVNVTDVLTKFSKAPYGWDNICTLYVINELVRRHNRDYTYTNNPNVETSTVANRIVSESNKFTLRQAQVISPQVIQNFIAAWKEVFGISSAPTTTDSTQLFRMCRDIESERSLSKLIKGYKDIEQQIIAYPFVEPIRKAIDLFESWLDERDPLKFFNLIISSKDEARMLTDKCKEVVQFTHDQLSTYKQLIQFADENTYNFSFVPEEMIGAVDEFLKVKDDLWPMGNTFRGYIKLRNQLSGSLDDVRNQLRDKIKAAYNDIFDYLLQVAEKQNVPASVLSDREATIQLKTAPTNILVLRNNILTDVFYQEQVNKIMSYIPPKPTKKDNDEVDPPTPPVREKRIRQASLQTRTKLPITNEEDIDRYLEGLRQQIERLLVDHDGVMIIK

SEQ ID NO: 863 - protein, 1151 aa, Vibrio cholerae; identical to SEQ ID NO: 825

SEQ ID NO: 864 - protein, 1208 aa, Parabacteroides sp.
MKLKELYNKPIDRAVNPAVSATKFDPETERIEIQEYVFTDEIMNGLFRILDAIKNNQPYDHVGIWIDGYYGSGKSHFLKYLDYCITPSTREDALSRLLEAIKAIDPLDDKHYLSFDYEQMVSIANWLERATIDTCIFNLETSYDNSTDKKKAFLHVFWNEFNGKRGFNKFNITLAQNLEKPLEEKGVFEAFKQRIAEEGGDWNDPGMAADLIDNELDWVLDIAKELAPTLSVDSIRERIIKRDTNMSIDRFGLELASYLKDKGDDYRLIFLADEVSQFINKERDRYLNLQEIITKLSEACDNKVWVACTAQQDLSEIMDDCHIAEEKDKEGKIKGRFEVKVSLKGTQPEVITQKRILDKKEEVKDTLASLYNKYKAGFDLQFKLPNSYSSYDSQDDFIDYYPFVPYQFKLIMQVFNSFLNLGYVAKEVKGNERSIIKVIHSTAKANADAELGKFISFDELYNNMFEEGLQARGQKAVDNALRMARSYQTDKPEKTRLAVRVVNVLFMICNISQTDQLLFPATVDNVTSLLVNNMDTPRMTIKNEVEKILEFLCDNNIIRREQGKQGAPDTFTFYSEEEMKVAQLIQSQVVDNNTQAEQLKDIFNKYITALRNKEQYKTRSFSVGLTIKQRTFLSNNPDVMVEFMMDPDYDTAEQLALQNSNTNRMVYYVGPQYRENRRLYNAFYWYCQAERYMSTPVPNEDNANTRKEFAKRAEELYEGLIKKEFEKILDTCPIVSGLYVIDEAELGQKRGNDRYRVAIEKHLAGIYPKANLVDSPSIPRTTEQLKKAILRNVNPGDYEGMGAILTDAEHEVEIYLNKQFAEVNVTDVLTKFSKAPYGWDNICTLYVINELVRRHNRDYAYANNPNVETSTVANRIVTESNKFTLRQAQVISPQVIQKFIAAWKEIFGISSAPTTTDSTQLFRMCRDIESERSLSKLIKGYKDIEQQIIAYPFVEPIRKAIDLFESWLDERDPLKFFNLIISSKDEARMLTDKCKEVVQFTHDQLSTYKQLIQFADENTYNFSFVPEEMIGAVDEFLKVKDDPWPMGNTFRGYIKLRNQLSGSLDDVRNQLRDKIKAAYNDIFDYLLQVAEKQNVPASVLSDREATIQLKTAPTNILVLRNNILTDVFYQEQVNKIMSYIPPKPTKKDNDEVDPPTPPVREKRIRQASLQTRTKLPITNEEDIDRYLEGLRQQIERLLVDHDGVMIIK

SEQ ID NO: 865 - protein, 1204 aa, Escherichia coli
MNIEQIFEKQLKRNINGVVKAEQTDDESAWIELDEYVITRELDGHLRQFFEVYAPATGPGRLQLADKIGVWVSGFFGSGKSHFIKILSYLLANREVSHNGVTRNALSFFEEKIDDALLLADIRKSVQHPTDVILFNIDSRANVEDGVDAILKVFLKVFNELAGYCGDFPHIAHLERELDKRGQFDTFRAAFADITGSRWEDERDVYLMINDQMAQALSIATGQSEESSRQWIEQLDKNFPLDIKNFCTWVKEWLDSHGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDAAIPALEAIWQEKGDILRNQLAFDTTTTATLRAYTNSREFVDNYPFVPWHYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIERIDTDKVELRRQIEASLNRLQAEMLISRIDDKFVFLTNEEKEIENEIRNIDVEFTTINKQLSTIIFEEILKNKRYRYPANKQDFDISRFCNGHPLDGANLNDLVVKVLTPLDSNYESYKGAHSNSLLMTDSKDCILICLPDEARTWQDLTMYAQTKAFLSKQSGQRPEQATLLAEKGRENSMREKTLKAQIEGLLAQADVWALGERLDKKSSSPLAIVDAACGYVIENSFSKLKLLRLSTGDVNRETHALLTVENDTQLDLGGMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAAQLMAEIAGEPFNEREEQSLVSHIRELFGRWNSELTVFKTRAESGQNPGRKEIEEGLVLLNGILNEKEEYAVIEKITAAADDLKDFSEDWDDLVSFYKNQYATWQRLSMALNGSFKANRNALDKDETAQKALQELEGIYSKARPYGELHRIIPLIETVETINQRLVEEYRSHALLQIDGHINELKQSMQEMHVPADLQHSLLHPMQQSRKKVEQNGLIPQIMEEQAEVRALQFKANERLNGWVEDQRKKVSDPKPAPQPGIIDPVVKPEPKLKKTIYVNTRKTMERAAGVTTLDNAEQVDKALEQLRKTLMDAINAGERVQLQ

SEQ ID NO: 866 - protein, 1177 aa, Lachnospiraceae bacterium
MFADDINRKINGVIKVDQAADDVIEQELNEYVITRELKKHFITFFNYYGDAFDQPTADMGVWISGFFGSGKSHFLKMLSYLLENKEVKGIRSVERFRKKFEDDPATFMLIDRATKGTTETILFNIDIEGFSNKDKTAVLRVFAKMFYNHLGFYGENLKVAMMERYIDQQGKTEEFRRVFEEKKGKPWLEMRRAFAFNGKFIIPTLMEVLDMSEDDAKAWFNDKTATEISIAQLVEDMKAYVDTKPANFRLLFMIDEVGQYVGTDTDMLLNLQSLTEKIGSECEGKIWVICTGQEAIDEIIKVRADEFSRIQARFKTRLSLSSSSVDEVIQKRILKKKPEAAKNLEDVYEQNDSVLRNLFSFSGSILDIKGYSGPREFTENFPFVPYQFIIMQKVFAEIRKHGNSGKHLSGGERSMLSGFQEAAQKIQEKDEYALVPFFRFYDTVHTFLDGSIRRVIERCQKAVDNGDGIEQQDVDVLKLLYLIRYIDDIPSNLDNIVILMADDIRVDKIIMREAVRGCLDRLMSQNYIGRTGDTYNFLTDEEQDIQREIRDTNVDTASIVERIAQMIYGDIFTTKKFRYGKYDFAFDQMVDGITVGAATGGMRLRFLTVATDAIEKTDYRLMAESKGNEAIVVLADTPYYESLESVMKIRKYVKQRNVSQLPKTVQKIISDQQDEAGKYELSAMTELQNAIEGAQFYVDGEHLEIKAGNAKSKIDQSLEYLVAHVYSKLDLITDHAGSDADIIAILTGAVTALPGMEPNRDAASAMEEYLEMQDAKKLPTSMADVQSKYSAIPYGWKEIDIAAVAAQLIYSQKVTIKYAGNTIQPDDPKLPDMLRKKSEIGKTSISKRKTISATMMRDVKAMLREYFDVMDVPDDEDGLIRFVTEKFGEQRDYYASLDARYDGHKYPDRALVQEAIHLMEDVLSQKKDNIALIERVLKKEDALFDNKEAVSNGIENFFKTQVAVFDQAVQFEKSLHDDLDRIAENEEAHKALNTIRLITMVQTGSKFNYNRIRELNPLMDTVRTAHDKMLEEKRAEVLETVRQCMEATHTAANGDSKASHLIEKSDRYFSQCKEKIAELKSLALLDAMFLPMCQYKDDTVSNIESVLAPPAPKPPAQATQPGKGQAIAKKKVIRTYNRQVVFQAKTLQTEADIDDYVEKIRSQLKQLLKNCDEIKLN

SEQ ID NO: 867 - protein, 1151 aa, Vibrio cholerae; identical to SEQ ID NO: 825

SEQ ID NO: 868 - protein, 1202 aa, Bacteroides ovatus
MQLQDLYIKSINRPVNPAVSATKFDKETIDIEIKEYVFTDEILNGLYRILNAIKNNKPYDHVGIWIDGYYGSGKSHFLKYLDYCITPETRDVALKRLLDAVKEIDPFDGKHNLQFEFSQVQDIASWLKTATIDTCIFNLETSYNAATDKKKAFLQVFWDEFNGKRGLNKFNLTLAQLLEKPLMERGLLEQFKEVIAEMGGDWNNPSEAADLVDQALEMVVDAACELNPQFDRNSLYNHIDKRDYAISIDRFGMELADYIKDKGEDYRLILLADEVSQFINKERDRYLNLQEIITKLSEACNNQVWVACTAQQDLSEIMDDCNIGEEKDKEGKIKGRFEVKVSLKGTQPEVITQKRILEKKPEVKTDLAAMYEQQQGAFSLQFKLPNAYKSYDTETDFIDFYPFVPYQFKLIMQVFDSFLALGYVAKEVKGNERSIIKVIHATAKAPNNAQAEVGKFVSFDELYNNMFEEGLQARGQKAVDNAIRIARTYADPKLAVRVANVLFMVCNISQTDQLVFPATLDNITTLLINDMTTPRLNLKNEVEKVVDFLCDNNIIRREQGRQGAPDFFSFYSEEEMKVAELIKSQTADNNLQAGELKEIFNRYLKGLKNKEQYKTRSFAVGMTINQRNYLSNNPDVVVEFMMDDDYDTPEQLALQNQTNRLVYYVGPQFRANARLRNNFYWYCKVQSYMTANPATSDENAAVREEFKKRASEVMSGIIEKEFQKILDTCPLVSGLSVIDDVELGNKKGNDRYLAAIEKHLSGIYTKAGLVDLPQIPRNSDRLKTAILRPVNPGDYEGLNDSLTEAEHEVEIYLNKQYEELNVGDVVAKFSKAPFGWDGICTLYVVNELVRRHKRDYSYSNNPNVEVNIVANRLLSETNKFTIRPAVTISPEVINGFIAAWKNIFGVSESFSTTDSTQLFRLSREKENVRSVENVVARYKQHYKDNAAYSFSAPLDEMVTLLEGWLAERDPLKYFRRVIDEQQQARTLFDTCKEVVQFVQDQMGNYKDVLRFVRDNRDNFSFVPIELHEAVTQLIGIENAAWPIGIRTYMKLRNTLAGAIDVKRTELRKQIAEEYAKTYAQLEQGCKENEVSTSVLSDQEVIVKLKTQPDSIPVLQTNLDTNAFFAEQTAKILAAKPKPKPTVGDDKNKKEEIPAKKYPTQVALSTRTTLPIGSEADVDKYLAQLKKQLMAHIDKGETVMIIK

SEQ ID NO: 869 - protein, 1223 aa, Enterococcus faecium
MLIKDIFAKPIDRNIQGVIKVGQAKDENVQQELEEYVVTKELQKHFKTIFDAYQRSINTPTDKMGVWIQGFFGSGKSHFLKIISYLLANREINDKKAIDYFKEDGKIKDPLTLATMERCSQINTDVILFNIDSKSDAGGKKDKNGIVNVFLKIFNEMQGLSTIPHLADFERRLIKEEKFDAFKAAFEEINGAKWQEERHEFDWIQDDIKEAALKIDFMSEAAIDNFLEKASGNYLISIDDFANLVKSYLDSKEADHHIAFLVDEVGQYIGGNRELTLQLQTVVEDLGRICEGKAWVLVTSQEAIDHVTNFDNNSDNDFSKIKDRFATTVSLSSANADEVIKERILKKKEFANDSLALQFETVQTELKNKLLFVDSPELKLFQDAENYAEVYPFIPYQFNLLGQILTEIRNHSYQGSNLSSGERSLLAMFKEAAERNKENDTTSLVSLDQFYYSLERWIDTAISRVITQATNNSHIQRPTDIDNFNVNVLRILFMIKYVDQAIKPNVENITSLMIRNINEDRLETKKRVEEALDLLIKENFVRKNLDSYIFQTDEEQEITREIKNQNITDSDLIVELSKRIFDGVLDRNSFAYEKLGMSGGNKFKNRYTFTYAQVLDQRPYKQAGNAEMTVNFISPYSDLAGQEAELALKSSRNLLFVELPSDKEFKDDIAMYARMNLYLTTTYSSVVKNFDAIRSEKSGELQELSASINDQLNELLKSAKFFYNGAEIQLTGSDFKAKFQSALQKMAEEVYHKLNQIDAPKEKEDILYLVKESKNEIIEDPSNEQAVQEIFNFINDQKRNHLTITMKTIRDRFETKQPYGFTELDVEWCIAKLFMSGKIDLLYNNVQISRMDDPNSIVMIIQKRRESEKIKIEPSAVISPKAKKLVDEIGRELFQSRNIVDENNNEHTMENFKKYLKGQLDNLRSYFDLQNTYTYPSAYEYEQIKKYLEVIVQTSDVEDFFYTIKKYRDELFDWAETYDKIKNFHKQNSTQKKIWENAQDKIRLIEKSRRQTSSQEIDQLIHEMKTILKKADPYSDMMKLNELIQEFIEQYNQLLELESQEILNKLTEEKQATFKLLEGKDFKDQFVPIVDQEFQELKAKIEQANTIDDLVFLSLNVAEQYLIFNQRFDNEENRRRQEEQARKQIEAANLIRETEKDEIDSAAKAEEIAIVKPTIQQKTVPMRTLNVHVKTIKSAADIDELTAEINQKLKEQLQENTEITIQF

SEQ ID NO: 870 - protein, 1202 aa, Yersinia ruckeri
MNIEQIFEKPLKRNINGVVKAEQTDDESAWVELDEYVITRELDGHLRQFFEVYAPATGPGRLQLADKMGVWVSGFFGSGKSHFIKILSYLLANREVSHNGVTRNALSFFEEKIDDALLLADIRKAVQHPTDVVLFNIDSRANVEDGVDAILKVFLKVFNELAGYCGDFPHIAHLERELDKRGQFDTFKAAFADITGSHWEDERDVYLMINDQMAKALSIATKQSEESSRQWIEQLDKNFPLDIKNFCTWVKEWLDIQGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDTAKPALEAVWQEKGDILRNQLAFDTTTTATLRAYSNSKEFVDNYPFVPWHYQILQKVFESIRTKGAAGKQLAMGERSLLDAFQSAAVQISADGLDSLVPFWRFYSAIESFLEPAVSRTIIQACQSSSLTEFDGKLLKTLFLIRYVDVLKSTLDNLVTLSIDRIDTDKVELRRQIEASLNRLQAEMLISRIDDKFVFLTNEEKEIENEIRNIDIEFTTINKQLSTIIFDEILKNKKYRYPANKQDFDISRFCNGHPLDGANLNDLVVKILTPLDSNYESYRSAHSNSLLMTDSKDCILIYLPDEARTWQDLTMYAQTKSFLSKQSGQRPEQATLLAEKGRENGMREKTLKTQIEALLAQSDVWALGERLDKKSSSPVAIVDAACGYVIENSFSKLKMLRLSTGDVNRETHALLTVENDTQLDLGEMEESNPEAMREVDNWISMSIDTHKPVYLRDILTTFGRRPFGWPEDEVKLLVARLARSGKYSFNLQGSEIALKQAWDAFNNSRRYSDLRLLKIRRHDEAQLTKAAQLMADIAGEPFNEREEQSLVSHIRELFGRWKSELTVFKTRSESGQNPGRKEIEEGLVLLNGILSEKEEYAVIEKVTAAADDLKDFAEDWDDLVSFYKNQYATWQRLSAALNGSFKANRNALEKDDTAQNTLRELEAIYGKPRPYGELHRIIPLIETVEAVNQRLVEEYRNHALMQIINHIEDLKQSMQEMHVPPDLQHTLLHPMQQSRKKVEQNGLIPQIMDEQSEVRALLLKANERLNAWVEELRKKEIKPEPESGGVVPPTEPKPKLKKTIYVNTRKTMERAAGVTTLDNAEQVDKALEQLRKTLMDAINAGERVQLQ

SEQ ID NO: 871 - protein, 1202 aa, Pantoea sp.
MNIEQIFEKTLKRNINGVVKAEQTDDESAWVELDEYVITRELDGHLRQFFEVYAPATGPGRLQLADKMGVWVSGFFGSGKSHFIKILSYLLANREVSHNGVTRNALSFFEEKIDDALLLADIRKAVQHPTDVVLFNIDSRANVEDGVDAILKVFLKVFNELAGYCGDFPHIAHLERELDKRGQFDTFKAAFADITGSHWEDERDVYLMINDQMAKALSIATKQSEESSRQWIEQLDKNFPLDIKNFCTWVKEWLDIQGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDVAKPALEAVWQEKGDILRNQLAFDTTTTATLRAYSNSKEFVDNYPFVPWQYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIDRIDTDKVELRRQIEASLNRLQAEMLISRIDDKFVFLTNEEKEIENEIRNIDIEFTTINKQLSTIIFDEILKNKKYRYPANKQDFDISRFCNGHPLDGANLNDLVVKVLTPLDSNYESYRSAHSNSLLMTDSKDCILICLPDEARTWQDLTMYAQTKAFLSKQSGQRPEQATLLAEKGRENGMREKTLKTQLEALLAQADVWALGERQDKKSSSPSTIVDAACSYVIENSFSKLKMLRLSTGDVNRETHALLTVENDTQLDLGEMEESNPEAMREVDNWISMSIETHKPVYLRDILTTFGRRPFGWPEDEVKLLVARLARSGKYSFTLQGSEIALKQAWEAFNNSRRYSDLRLLKIRRHDEAQLTKAAQLMAGIAGEPFNEREEQSLVSHIRELFGRWKSELTVFKTRSESGQNPGRKEIEEGLALLNGILSEKEEYAVIEKVIAATEDLEDFAEDWDDLVSFYKNQYATWQRLSAALNGSFKANRNALEKDDTAQNTLRELEAIYGKPRPYGELHRIIPLIETVESVNQRLVEEYRNHALMQMTNHIEELKQSMQEMHVPADLQHTLLHPMQQSRKKVEQNGLIPQIMDEQSEVRALLLKANERLNAWVEEQRKKEPKPEPAPGGAVLPTEPKPKLKKTIYVNTRKTMERAAGVTTLDNAEQVDKALEQLRKTLMDAINAGERVQLQ

SEQ ID NO: 872 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYTFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAADSEQTYVVVEKTVIQPVPKKTHLVNVASEMRNATGGEVLETTEQVEKALDTLRTTLLAVIKAGDRIRLQ

SEQ ID NO: 873 - protein, 1229 aa, Vibrio cholerae; identical to SEQ ID NO: 729

SEQ ID NO: 874 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRYSELRLHKVRRHDEAQVRKAAQTMADIAQQPFNEREEPALVEHIRQVFEEWKQELNVFRAKAEGGNNPGKKEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 875 - protein, 1184 aa, Collinsella intestinalis
MRIQDMFERDIDRNINGVIKIEQNDEEVIEQELAEYVVTNELRGHFSTFFDAYERALDAPTDKIGVWISGFFGSGKSHFLKMLSYLLSGQTANGHPAIDIIAPRFEDPMIEAKAKRAVDVPTETILFNIDSKGPSNKDKTAILRIFARVFFEHLGFYGEDLKLARLERDIDQKGKTEAFRAAYRQITGTEWLDERDAYDLNSDAVIDALEQAGAKSREAAERWFDNTEEFEFTIDWLVRQINQYVTERAEQEGGEFRLLFMVDEVGQYIGTDTSLMLNLQTIVEDLGAQCAGRVWVVVTSQEAIDEITTVAGQDFSKIQGRFNTRLSLSSTGAGEVIRRRILSKNEHAHDLLTVEYGKNATVLKNLFTFKGARNDLGGYDGAKSFADAFPFVGYQFKLMQDVINGLRNQGSSGKHLSAERSMLSGFQEVAQALEDRDEHALAPLWMFYNTVQSFLEGYHRRVIDRAAAAARDGAGLEEYDVAVLKLLFLIKWVSQEMPGNVDNIATLMADDLRANRAEVREQVQAALERLERENYITRNGECYLFLTDDEQEIARQIARTQVDAAKLTRKAAEIVFGQIFETPKITVGKNNFPVAEWLDETRVNNAGGLTLRVLARMDGSDAPSRDELILRSSRGEAIVLLSSEIDFYSCLMEAARIQQFASATIIANLPANQQDVIRAKQQERTALETKAQALMEEAVRRGEFYAGGSQVTITGTNSAKKLIEQCTAKLVDAVYTKLGYIDRNYDDDAQIRQVLNGAAPALEGIEPNKRAIDDVRTFLGAQAMRAVSVSMDDLQKRYQAAPYGWRERDIAAVVAELIAAGEARVSYAGQVVDARDAKMIDYLRKLSMTQRAVVEMRVRASAGDMTRARRAIETLCRVHDLPTEEEPLATACRNALQERQDGLNELITGAYSRNRNYPGFGTVADAAALIKDLLAIRGDSGDLLRAIAKAENDLCDAGEDLEDVDGFFPDMQRIYDNASNLLKRLDQDRSYLAAHEGATKAIENIERILGSERPYSQITDLVPAMQTIENAHAKLLEGKREEVKAQIEDIFASVRQHGEELGVTLSSVGERERARTGAVRDAATLTQLDAVSAQLTGDQARLFGDLDREHERIHRPAPASTGQVVTTSHAPIAPERPRKVRELQRSTAFLPKTLHSEAEIDAYLADARKRLVSELSHNDAIKLN

SEQ ID NO: 876 - protein, 1213 aa, Salmonella enterica; identical to SEQ ID NO: 703

SEQ ID NO: 877 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLESSRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKADILRNQLAFDTTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITLLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 878 - protein, 1179 aa, Nitratireductor indicus
MATLLRDIFAKPVDRSIDGVIKADDKASLLTELDEYVITNEIGARLEQFLDAYNNYDTANGVWISGFFGSGKSHLLKMLALLLENAEVEGQRPVEIFERKLEGNPMLAGALRKAVSIPSWSVLFNIDQKADVISKTDVDALLAVFQKVFDEMCGYYGKLPHIAQFERDLDSRGKLEAFKEAFAQASGKPWERGREQALMEGKHIASAFAQVTGDEVKDVLGQYRKDTKVSIEDFANMVKAWIDAQGPKFRLNFFVDEVGQYIADNVKLMTNLQTIAESLNTKCKGQAWIVVTAQQDMGSVIGDLTAQQENDFSKIQARFANRMPLNSQDVAEVIQRRLLAKTEAGQITLGNLYDAEENNLRTLFDFGDNSFKFRNFSGKEQFVASYPFPNYQYDLFQRAIMGLSQHNAFEGKHSSVGERSMLGVFQEVAKKLADAPVGGLATFDLMFEGIRTALKSSVQQSIQLAERNLGDDFAVRVLKALFLVKYVKEFKPTARNIAILLLSRFEADQTEQRRNIEEALSLLERQTLIQRNGEVYEFLTNEEKDVEAEIKAIAVDPAEIERQLDELAFGTILRHGKIKHAGTGIDYAFTRKLDGHSLNREYELSVNIISPFSDDSDAPDVVRSNSMASDEMVVLLGRDVRFTRDLVLWLQTVKFARQVTSGDAQPGRDRIIAEKRDQNTRRETELVQRLRSLIADARLFVRGTELEIGGEDPQERLVKGFQVLVDKVYTSLPVLRGATYTEADLGRAGRVDGGLFGGEGSGLTEAEQDVFNHAQAQMRLGTRVSAKALVEKFGAKPYGWPTIAVLCLTASLVARGKLEARSDSALLEGDALVQQLRNSHALGNILLSPQIEFTAAQIRKSRELFQELFDLPASGNDARSLGAEWQAQLRKLTSELETLGRQATGYPFVAALDPLRTLLDNMRDQSATWFITGPVGHEDQLLDAKEDILDKVRSFMSGPQKGIYDEVRAFLAAQDQNLAYAGDSAADKLRQALADPHCFKGNAIQELKADFYALKERIEQTVLAERNAVITAIDEVADKIAQTSEFRALPPEQQTRIRDGLATRKSGLAAQSLIPALRNLAAEARSNLLANTLTRIAELTPAPAPAAAPQPQPAGGVAEPQPAPYVPPAPAKPQYVNAQSITVSIGKAYLEDADDVTRYLDAMKKTLLAEIGAGKKVIV

SEQ ID NO: 879 - protein, 1213 aa, Escherichia coli; identical to SEQ ID NO: 872

SEQ ID NO: 880 - protein, 1226 aa, Acinetobacter baumannii
MNIKELFYKPLDRAINGVVKADQNDNTTVYQELDEYVVTNELEKHFRDFFQSYGTDLSDPSIANRVGVWISGFFGSGKSHFLKTLSYILANKVACDADGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPESFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQAEGQVLFKLADDKQFFNELRTWLKTNKFIRLNDDGTQSDISRILADRGRENQERKKRLRARVEEMLLDAESYALGQHLQLSSSSPTTKLDEACRYLLENTYTKLSYLQVYQQDAWRELNAVLTVDDMAQLGLSLDGGQSNPKALQEVEQYIALRATGTERILVSDVIDRFAKRPYGWPDAEILLLVGQLAAMGRISLQLNGGSLQLKDAFEPLQNSRRRRDVSIIKKRQTDDQVLKQARQLTQDLFSAMGPATEKELFEFYTQHFNNWLANFKSYKSKTDVGQFPGKKVIEKSILTLERLLANSDSFDFFKAVVENKDDYLDLEEDYRDIHEFFTNQMPSWQQLQQALRHFEKNKQALGSDEVAKKALSELHRISTLESPYGLLNKVADLVRTVESVNEQLLTEKRSQAIEHIDDKIKQLEAEIKNSGIASAELSNKLLRPLQLLKTDIEVETSLSTIYMLQTQTAVERFDEALYELESEVQAEIQRQAKAAQLAQSKAESVTNTATTSSPVRSTPAASPVQPVTAVVPPKPVVEVDVASIYSKTSSSVYLETEESVDQFVDALKAELKKIVSDKKRVRIR

SEQ ID NO: 881 - protein, 1213 aa, Escherichia coli; identical to SEQ ID NO: 872

SEQ ID NO: 882 - protein, 1223 aa, Enterococcus faecium
MLIKDIFAKPIDRNIQGVIKVGQAKDENVQQELEEYVVTKELQKHFKTIFDAYQRSINTPTDKMGVWIQGFFGSGKSHFLKIISYLLANREINDKKAIDYFKEDGKIKDPLTLATMERCSQINTDVILFNIDSKSDAGGKKDKNGIVNVFLKVFNEMQGLSTIPHLADFERRLIKEEKFDAFKAAFEEINGAKWQEERHEFDWIQDDIKEAALKIDFMSEAAIDNFLEKASGNYLISIDDFANLVKSYLDSKEADHHIAFLVDEVGQYIGGNRELTLQLQTVVEDLGRICEGKAWVLVTSQEAIDHVTNFDNNSDNDFSKIKDRFATTVSLSSANADEVIKERILKKKEFANDSLALQFETVQTELKNKLLFVDSPELKLFQDAENYAEVYPFIPYQFNLLGQILTEIRNHSYQGSNLSSGERSLLAMFKEAAERNKENDTTSLVSLDQFYYSLERWIDTAISRVITQATNNSHIQRPTDIDNFNVNVLRILFMIKYVDQAIKPNVENITSLMIRNINEDRLETKKRVEEALDLLIKENFVRKNLDSYIFQTDEEQEITREIKNQNITDSDLIVELSKRIFDGVLDRNSFAYEKLGMSGGNKFKNRYTFTYAQVLDQRPYKQAGNAEMTVNFISPYSDLAGQEAELALKSSRNLLFVELPSDKEFKDDIAMYARMNLYLTTTYSSVVKNFDAIRSEKSGELQELSASINDQLNELLKSAKFFYNGAEIQLTGSDFKAKFQSALQKMAEEVYHKLNQIDAPKEKEDILYLVKESKNEIIEDPSNEQAVQEIFNFINDQKRNHLTITMKTIRDRFETKQPYGFTELDVEWCIAKLFMSGKIDLLYNNVQISRMDDPNSIVMIIQKRRESEKIKIEPSAVISPKAKKLVDEIGRELFQSRNIVDENNNEHTMENFKKYLKGQLDNLRSYFDLQNTYTYPSAYEYEQIKKYLEVIVQTSDVEDFFYTIKKYRDELFDWAETYDKIKNFHKQNSTQKKIWENAQDKIRLIEKSRRQTSSQEIDQLIHEMKTILKKADPYSDMMKLNELIQEFIEQYNQLLELESQEILNKFTEEKQATFKLLEGKDFKDQFVPIVDQEFQELKAKIEQANTIDDLVFLSLNVAEQYLIFNQRFDNEENRRRQEEQARKQIEAANLIRETEKDEIDSAAKAEEIAIVKPTIQQKTVPMRTLNVHVKTIKSAADIDELTAEINQKLKEQLQENTEITIQF

SEQ ID NO: 883 - protein, 1187 aa, Alcanivorax sp.
MFERSIQRSINGVIKADQKDDANVWQELDEYVITKELDGHLRGFFERYLSALDNPAEASGNVGVWVSGFFGSGKSHFIKILSYLLANRQVSQEGQTRKAQDFFEDKITDPMLAGDIARAITGDTDVLLFNIDSKADADNSRDAILKVFLKVFNEMRGFSPDHPHIARLEQELEEKGAFDTFKAEFEKAAGSPWLDERDGYTFYSDAVATAYGAAMGQAVSDPDVWLERLERDFDNWLSVENVGKMIKEYLDKCGKQHRIVFLVDEIGQFIGGNTQLMLNLQTITENLGTICDGRAWVIVTSQEDIDAVVGQLKASSANDFSKIQGRFRTRLSLSSANVDEVIQKRLLKKRPEAADTLRELFRKEADILKNQLSFTNTGRTFKAYADEDEFAEVYPFAPYQFTLVQSIFESVRKAGATGLHLARGERSLLDAFQSAAKAVVEQEPGILVPLYCFYPSIESFLEGVVKSTIENAAKNPSLQDFDVNVLQTLFLIRYVDEIPGNVDNLITLFIDQIDADRRGLRTQIEESLQRLEGQTLVSRNGDNFFFLTNEERDISREIKAVDLTAAEEAKKLGELIFEDLLGGMRKFRFTDNGNDFALNLSCDQHPYGNRNEGALNLQVITPLIDDRDEWRDDKTLMRSTDGDGQVILRLPDDSQLATELRQYIQTDKYVMKRTDGSLPSTARRILQDRADENRQRRDRLKITLEKLLQNAVAFAAGHQPVLKASTAQAIVNEALHDLVRNSFGKLAYIEHLTGDPQAEIKALLDDPSTLALDLGEGETVNPRALKEVQQYVELASASHRQIILHDLANTHFARRPYGWSEWETVLLVIRLVRAGELSLKLNQTVLPIEKVYEQLNPPSRWRSIEVERRKAIGSGELQQARNLTRDIFGKLPPEDEDRLYAAIKGHLQNWQQDFKQWNTLSNTGYPGKSLADEGLALCDKLLSPPDSFTAIQQFTGHKDDLLDAADNHQELGHFFTNQKPVWDKLIQALREFDPNRPALEKDNGAKTALQRLEAIRTAPSPFGLLQEVEALVSKIDQVNSAEIARVRTHALDYIDSQIARVSADLDAAKADADTRNQCLHPLQTLRQRAETQTSLAHLHQLSTQSTDAADDAVDKLAKISAKAKKVAEETGEYPVETVPAVKPVKAIHASRLTSTYIEDAESAEQYLEALRKEMMDALAKDCRVQIR

SEQ ID NO: 884 - protein, 1151 aa, Vibrio cholerae; identical to SEQ ID NO: 825

SEQ ID NO: 885 - protein, 1151 aa, Vibrio cholerae; identical to SEQ ID NO: 825

SEQ ID NO: 886 - protein, 1225 aa, Escherichia coli
MKIEQIFSKKLTRDINGVVKAEQKDNDSVYVELDEYVVTRELDRHFRAFFEAYVPSVTQSHGDMSGKIGVWISGFFGSGKSHFLKILSYLLENKSVEKDGQGRQAFEFFKDKINDAMLLADIQKAVTKDTDVILFNIDSRANTDDRENAILKVFLKVFNERVGYCADFPHIAHLERELDKRNQYASFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTYLIDVFAEKGDILRNQLTFDKTTTASLKGYTDAPSFVDNYPFVPYHYTLVQKVFESIRTKGATGKHLAMGERSLLDAFQSAAKQMKDSGLDVLIPFYSFYAPIESFLEPAVKRTIDQACELDSLTDFDGKILKTLFLIRYVDVVKSTLDNLVTLSIDRIDADKIALRKQIEESLNRLERQLLIARNGDEFIFLTNEEKEIENEIRHTDVEMSEVSNKLSAIVFDGILKGNRAYRYPINKQDFAVSRFCNGHPKDGTTLEDLVIKVISPLDSHFENYSHDQACLNHTLEADGCVLVKLGEHKRLWDELTTFIKTDRFLKQNSGQRPEQEHLLREKQMENMEREKRLRTDFEALFAEADVYAIGTKLPKKSATPSAIVEEAYKYVIENTFAKLNMLKATPGEVLRELQAVLVADDIAQIGLDLQADECNPEATREVEQYVTLKVERNEPVYLRDIVAHFGKRPYGWPDNEILLLTARLGLAGKLSFSTQGTDLALKKAYEPFTSVRKRGEIRVHKIRQHDERQIKKAAGLVKEIFSKTFTGSGEKELYELVRDELLAWNEELKSFRTKSQTGHFPGKSQIDDGLALVAGILEQTSSFALITRFLENADALEEFAEDFEDLDDFYNSQFQTWQALAGALNEKFKANRPALEKDSEALKALTELERIYNMPSPYEQLRHINPLIEQVAKINSTLVEEKRTHALERVDLRIGRVKEALAEAHAPSELQNQALRPLQMCRQRIEATSSIPQIISEQTEAEGYEDEAYELLNGFIEDQRKKAEAEQRRRELEQQTREEEAAKAGKAAPAPEPASEPVQPQPVAKRTVTINSTDAMAKSVTTGFIESEAEVDAYLAALREQLIAAVKAGDRVRIK

SEQ ID NO: 887 - protein, 1218 aa, Bifidobacterium bifidum
MNGESGISFKELFNKDIDRNINGVIKANDEKNLNDEVNEYVLTEEICRNLAKFLDAYNDPSNHEQNGAWISGFFGSGKSHLLKMLSHILGEVPAELVDKGNKPTMSREQIVHAFMGKAEAQDDQMLAGQLEKALTIPATSILFNIDQKADKSNASDMLLYAFVRVFDEARGFYGKNPYVAKFERDLASNGYFEDFKQEFEQVAGKPWSEGRGEAVLWDDEICEAYAAVTGKPEQDSIIQRYEDTYTMTVGDFADDVNVWLSRQEPNRRILFLVDEVGQFIGENRELMLSLQSIAEDLAVKTNGRAWVVVTSQEDMDTIVGDRTKQQSYDFSKIQGRFSIKLKLNSADVVEVIQKRLLTKKPEYESVMNELWNEQNANLRTMFEFTRETSKFSNNKAYSKDDFIASYPFVNYEFELFQNVLREMSRYNMFSGRHASVGERSMLSTISSTLRSSQNEMVGALMPFDKLYDGIADAIQSTSNFRINQAEKRLGSDIKELGVRLLKVLLLVKHVDGFPTTPHNLRILLTDQFDMDVMELERNIKYVLGELEKDTYVQRVGDTYNYLTNEEQDIEQEIKSTDIDSTKEIEELKKILVSDVLGKMTVAYGEQRAQFRYGLRIDGVQQSAQQPIWLNVVTSINAQDRADAIRMGMGMRDTITLLLDMSDRTLFDDLRMYVKTYTYLMRTDKNSQSEVRQQIISRKSVANERLYAELRTRIVKAAANGEFNYNGGTVEVKSTEVRARMAEGLGTLIGRYYTNFSLLGGQRYEETDLARIIMNASQHQPGMLDGMNAVQDKLDVPADDVFAAVSRDKGKGIIATVKSLLDAYGSVPYGWPYAATLACIGHLYGSDRITLTLDGKPVQRSEAARLLRETKKQDSIRVDLPRVFDTRKVSQLRDFARDFLGLTAADLPSNAIDLAETVTTRLKREAESLTQLRVRNARFGFVQQLDKAIEKINYASGMSEDWLLGDFTAQETENGSEELLEFKEDVIDPIVAFLNGSQSRILADGLEWLKNNKPNIDYAFGTTASLYQSAEQLANDPNIFRKTNKFKTTIDDLREETDAAIRTERANALKDVEGIRAKIHDSAEYQHAAQAAQAEAETELDQVAERMQNMLFIYKMRESVHELSERTYPQLINALAASASRPKTALAGEAQAATATTPMDANIPESQQKETPRVAVSFATISRPHTKDALETEDDVDDFLDAYRRELIAAIENGKKILL

SEQ ID NO: 888 - protein, 1204 aa, Escherichia coli
MNIEQIFEKQLKRNINGVVKAEQTDDESAWIELDEYVITRELDGHLRQFFEVYAPATGPGRLQLADKIGVWVSGFFGSGKSHFIKILSYLLANREVSHNGVTRNALSFFEEKIDDALLLADIRKSVQHPTDVILFNIDSRANVEDGVDAILKVFLKVFNELAGYCGDFPHIAHLERELDKRGQFDTFRAAFADITGSRWEDERDVYLMINDQMAQALSIATGQSEESSRQWIEQLDKNFPLDIKNFCTWVKEWLDSHGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDAAIPALEAIWQEKGDILRNQLAFDTTTTATLRAYTNSREFVDNYPFVPWHYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIERIDTDKVELRRQIEASLNRLQAEMLISRIDDKFVFLTNEEKEIENEIRNIDVEFTTINKQLSTIIFEEILKNKRYRYPANKQDFDISRFCNGHPLDGANLNDLVVKVLTPLDSNYESYKGAHSNSLLMTDSKDCILICLPDEARTWQDLTMYAQTKAFLSRQSGQRPEQATLLAEKGRENSMREKTLKAQIEGLLAQADVWALGERLDKKSSSPLAIVDAACGYVIENSFSKLKLLRLSTGDVNRETHALLTVENDTQLDLGGMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAAQLMAEIAGEPFNEREEQSLVSHIRELFGRWNSELTVFKTRAESGQNPGRKEIEEGLVLLNGILNEKEEYAVIEKITAAADDLKDFSEDWDDLVSFYKNQYATWQRLSMALNGSFKANRNALDKDETAQKALQELEGIYSKARPYGELHRIIPLIETVETINQRLVEEYRSHALLQIDGHINELKQSMQEMHVPADLQHSLLHPMQQSRKKVEQNGLIPQIMEEQAEVRALQFKANERLNGWVEDQRKKVSDPKPAPQPGIIDPVVKPEPKLKKTIYVNTRKTMERAAGVTTLDNAEQVDKALEQLRKTLMDAINAGERVQLQ

SEQ ID NO: 889 - protein, 1213 aa, Salmonella enterica; identical to SEQ ID NO: 703

SEQ ID NO: 890 - protein, 1225 aa, Vibrio cholerae; identical to SEQ ID NO: 728

SEQ ID NO: 891 - protein, 1220 aa, gamma proteobacterium
MNIKELFVKPLDRSINGVVKADQNDDATVYQELDEYVVTNELERHFRDFFQSYATDLKDPSIANRVGVWISGFFGSGKSHFLKTLSYILANRPVHDDNGNERYSVSFFDDSKVRDAFIRADIDKAVSTHADVILFNIDSKASSNDDGNPILNVFLRVFNEHQGFSGDHAHIAHMERHLSQKGVYEDFKAAFEKSSGHSWESERDGFQFYQDDVEAAISEALKMSPDAAHKWFEASEETFSVSVENFCHWVKEYLEEQGKDSRILFLVDEVGQFIGSDTKLMLTLQTLTENLGTICKGRAWIIVTSQADMDAVLGELSSSKANDFSKIAGRFKTRLSLSSSNTDEVIQKRLLRKTPEATEALKAVFEQKGDILKNQITFDRSGPTLKNFDGPDSFVNNYPFAPYHFQLVQKVFEEIRKVGATGAHLAYGERSMLDAFQMAAGAISNEEIGALVPMHRFYSAVEGFLDTAVKRTIDQAGENATLDSFDVQMLRTLFMIRYVDLIKGTLDNLVTLSIEKIDDDKLGLRKRIEESLQRLEKESLITRNGDEFLFLTNEERDITQKIKATEISSSEENKELSNLIFKDLLRDTNKYRHQPNKMDYSLGRYLDAHSLDGKYETDLRVEVISPLDSDYALYSEAGCINKSSEGDGLILFKLGDDKQFFSELKTWLRTNKFIRLNDDGSQADITRILADRGRENQERKKRLRARIEDIFLNAEAYALGQHLALSSANPLSKLDEACRYLLENTYTKLSYIKVYQQDPWRELNAVLTVDDIGQIGLSLEGEEGNPKATRDVEQYIGLRASGTERILLSDIVDRFSKRPYGWPDAEVLLIVGRLAAAGRISFQLGGGTLPVREALEPLQNTRRRREVSIIKKRQTDETVLKQARNLTQGLFSSMGPATEKELFEFYTTHFSKWLANLKSYKSKTDVGRFPGKAVIEQSILSLERLLSNDDSFDFFKQVVDKKDDYLDLEEDYRDIHEFFSNQIHTWQQLQQALRHFDKNRQALERDTQASKALSELQAIESANAPYGMLHNVATLISAVESVNEQLLTEKRAHAISRVDEKIQQLEAEIAKSGIGTPELSNRLLRPLQIVKADIEAETGIAGIYMLQTETATERFDDGLYELERAVQAEIERRAKAQQAAASKPDGTPDTGSPSTPVPQAAPQAPVAKPKPVVEVNVASLYNKTGEGVYLETEESIDQFVEALRTELRAAIRADKRVRLR

SEQ ID NO: 892 - protein, 1212 aa, Pseudomonas psychrotolerans
MEIKQLFDPSKDIYRSIEKVITYGVSQEERLKAEIAEYVVTDSIDEQFNKLLLKMQAAMDAGGENEVGVWVSGFYGSGKSSLTKYLGLAFDDSIKIDGTPFIQHLQDRLKKTTTRQLLSTVAKRFPAAVLMLDLASEQVAGATMEEVSTVLYYKVLQWAGYSRNLKVAALERRLKKEGRYQEFLDLFKDMAGGEEWHNYRNDELVVDSLVPALAHQLYPNLFKTESSFSTEASEVIRFENDRVQEMLEVAREASGKDYIIFIIDEVGQYVGSRPNLILNLDGLAKNLKALGDGKVWIIGTAQQTLTEDDPRASLNSPQLFKLKDRFPIQIDLEANDIKEICYTRLLGKSPQGAAELGALFDQNGQALRHHTKLEDARAYGTDFDKAAFVNLYPFLPAHFDILLHLLGALARSTGGIGLRSAIKVIQDVLVEPGEGKTPIADQPVGWLATTVTLYDALEKDIQRAFASIHKAVDSVCKNRFIDSPIHQKIAKTVGVLQILGNLPITRQNISSLMHGSINEPSQSEATNQAVEELISDRYVAFGEQDGFLRFFSEKLNDIEQERSQIPLRAVELKRLANNALTAAYNPLPSTQLHGSLAVQTGIKAQTQGGMPVALAGDRNTIQTIVELVDPKDYDTTRTRLVDESRHKQAQYQIFLFGRTTPEIDDLTAEIYRCKEIANKYRTDPDQEIKEYCNGQSDRASRLTTELERLIKRSLLQGSFIFRGQINAVENLGSELVDAARKHLGEVAEQVFDRYGEAPVRAATELAEKFLRAGSLTAISTPIDPLGLVQANAGKASIRTDHKALVSIRDHIDRFGVVEGKSLSDRFADAPFGWSQDTLRYLLAALLVAGEIKLKVGGREVTVNGQQAIDALKTNNTFKSVGVSLREDKPSMEMLALASTRLTELCGDLVVPLEDAISKAATKLFPNLQQRYAPLAEKLKSLGLPGVDRLDSLSRDIADVLLTDASDAPQRLGKQDSALYENLKWAAEVRNSLEHGLEQTLRDLRQHRRAIEGLPQTDIPAQLKDELAEPFAQLEQRLQQLDFHCHSADFNTRLTHLRAQVSTAATSMQSAQAERLKEAEVDLQRVPEWVELTLQEQQELLGKLEGLILQVEPNIGGLQALVNRDYEIHNQVQQLKQRIERLGRERLQERIKSEQQEKEQEGAPEAKTITRSFKARARITSLSELDVMIQALQKLKSELKFAHAFELDVQVEE

SEQ ID NO: 893 - protein, 1183 aa, Acetivibrio cellulolyticus
MFIKHMFAKSIERPIKGVIKVAQTDDENIHQELDEYVVTREINERLSKFYDNYQKGIDGKTDKMGVWISGFFGSGKSHFLKILSYLLDNKGIKGKKALDYFDGKIQDPLLLGNMKRIGNVDTEVILFNIDSKSSIDGKSKEDGILKVFTKVFYEHRGFYGENPGVAEMEKYLSKEGKFDTFKASFKRIKGDEWVNRRRTFRFDTDAVVGALTEATGMSQESAREWFKNGVNDYVMSIEKFAQDVKEYIDSKGPKFHLVFLVDEIGQYIGGESKLMLNLQTITEDLGTYCQGRVWIMVTSQESIDDLFKVKGDDFSKITGRFDTRLSLSSISVDEVIKKRILEKNETATDTLKVLYHDKAAILKNLISFKDAATDLLGFECERDFIDVYPFIPYQFKLLQNVFEQIRKHGSSGKHLSEGERSMLSAFKESALKYKEAKDGALIPFYAFYETIKEFLNPAVVRVIEGAYKNPALKDDDFNMELLKVLFMVKHIKELPKNVDNIATLMITHIDEDKLALREKIKISLGKLTRETLIQKNAEEYIFLTDDEQDINREIKIINIDDDIIKKELRTYVFEEFYEDKKFRYSKQYNFSFNKKMDEKEHGNQTAHIGIHILSPKSDLYDQADTNLIMRTSGSGEMIVKLGGNGVYLEELEEALKISEYTSRKNISQLPENIQNIINNKKAEERVHRIRAKEYLETALKDATFFINGQKEEIKGSSVKEKINAGLKILVETVYTKLSYVKVFCEDTRELLNLINGDFEQTNIDGFEKVDNSLATGEIFEFIKIQDDINKQVRVKILIDRFSDKPYGWREFDISALIATLLKEQRIRLKLNSEYLEIGDSNLINGLTKASDIDRVIVTKRVKVDEALIRSAKNVCKELWNSTNIADDEDGLAKDIKALIKSQMEEINALKNRYEGRKYPGESLLDKGLEYFEAFRHLGDNASLFFKLQEMEEDLLTWEEDFSYVKNFFDNQKTIFDKGLEAAKKFEDNKLYLSEGDVNENATKLNDILNHYLPYGRIKEIPEYVKVINEGISRVVEQKKAEATDKINADFENMKLKINQYGVKEDTKERINKFYNDLLSGLSGYNDIYKVDATITHSSNFRTRNETIIEDEIKQFNDELQKGDNTVTKEKPEEADSVVEEIKLNRYISIRTIKTEAEVDVFVKELSEKLKAVIRNNKQIKFSE

SEQ ID NO: 894 - protein, 1240 aa, Fusobacterium sp.
MKNYLIQNTFQKDITRKINGVIKADSKEEDIVVTELSEYVVTEEIQKYLNIFFHRYVDSLQSPTEDIGVWISGFFGSGKSHFLKMIGRILENKEYQGKKVVDFFEEKIQDSILQENINKAAGAPTDVILFNIDNVSDQNTQQNKDTIPIAFLKKFNEYLGFSRDNIKIADFERMLWEKGKFEVFQKTFSEISGKIWKEEYRNLDFYADDFLDTIEKLEIMSREAAIRWLEKETDISISAESLADLLEEYLKQQSEGHRIVFLVDEIGQYIGENSQLMLNLQTLVETLGVKFKGRIWVGVTSQQDLGNILGKAKEKSNDFSKIQDRFKTILPLSSANIDEVIKKRLLEKKLLQQEELESLYDKTRIYIENAITFDKTGMTLALFKDRKDFAETYPFVGYQFNLLQKVFEKVRNMGYSGQHMSRGERSLLSSFQEAGIRIKDMEVGSLVPFQYFYASIEQFLEDNVRRPFIHAKNEKGIDEFGLEVLKLLFLLKGMKGITPNINNLTSFMVDSVDCDRLALEEKIKKALGKLEQQVLIQKDGEGYYFLTNEEQDINKEINQEFINEQDVYKELNTYIFGQIFTSPIVTMEDTKNKYNFSQKIDEIPFGKIGGQLDILILTPRSDEYDNIAILGYRDGYDLILRLPEEMTYWEEIQQSLRIASYVQKTLRGNNREIVHQILQRKQQENSKRKQRIQNEVERVLSEAEIYIQGQKINIMTAQADKRVAEALKAVARHRFNKAKLVQRPYSESEIRNVLSYEYDAGTNLFDVKKDMSTNSNYAALQEILTYITLHTSRGNVITLKNIVEYFSKKPYGWETFSIHGLVAELWIYKQIQIEESKNPIHNAEELKTLLVKSQSKTEERLVISLREEIDTELLQKVNNLLKKLFGPEKEISVDQPKEDILEILKKKIDLPKMYSKECESGVYPGKKELQEWIDLLEEILLSKEKTEKLLKHFLEMEEELLEAYDNQGIVLDFFRSSKRKKFDEGLEKRKKIKEYEAVIGSIQEMKPYQDLVSILTSKSPYNQIKNIDALLEEIQVEEEKLILEEKNMLLQRIEEKAKEFSTLFQERDAMLEKTLEKLKEFKNKIEKTSSLSIFFSMSDWNKVLSSIETEYRKHIQEELRSLEKAAFEVTEDKTGVKELVEDIRNTFHAYQEEAKSKDVNQLEQLIQKAKKDEEGFILQGNGRAKKKERVQFRKIRVVEKSNIETMEAVEEYISTLEKEIQNLKEKMLQAIRENKIVDIQ

SEQ ID NO: 895 - protein, 1223 aa, Enterococcus faecium; identical to SEQ ID NO: 882

SEQ ID NO: 896 - protein, 1229 aa, Vibrio cholerae; identical to SEQ ID NO: 729

SEQ ID NO: 897 - protein, 1213 aa, Salmonella enterica; identical to SEQ ID NO: 703

SEQ ID NO: 898 - protein, 1151 aa, Vibrio cholerae; identical to SEQ ID NO: 825

SEQ ID NO: 899 - protein, 1250 aa, Fusobacterium nucleatum
MENLTIKNILQKDIERKINGVVKADSNEKDTVITELNEYVVTEEIRERLTKFFDKYVESINFPTEDMGVWISGFFGSGKSHFLKMIGHILENNTYDGKKVVDFFKEKIDDAILMGNIEKAAEIPTDVILFNIDNVSDQDTYQNKDSIAVAFLKKFNEYLGFTRDDIEIAEFERKLWEDGKLEEFKKVFEEESGKTWKDANRNLDFHSDDFLDVIEKLKIMSRESAERWLERDVVRSISAESFRDILENYLKMKGPKHRIVFLVDEIGQYIGDNSKLMLNLQTLVETLGVKFKGRVWVGVTSQQDLSSILNNSEHRKNDFSKIQDRFKTMLALSSGNIDEVIKKRLLIKKKIEGEDLEKIFDKKRVEIENLIHFEKTMTLPLYDDNKDFSETYPFVAYQFNLLQKVFEKVRNMGHSGQHMSRGERSLLSSFQEAGIKVKDKNIGILVPFNYFYESIEQFLEDNVRRPFIHARNEKGIDDFGLEVLKLLFLLKGINGIEPTLNNLTSFMVNSMDCDRIELEKKIKKALEKLEKEVLIQKDGENYYFLTNEEQDINREIEREDIDLKKIDEKIDSYIFKEIFTKNSILMEETGNKYNFTRTIDETVYSKSGEDLAITIFTERADDYDNVAIVGTRAESDLILRLAKDDETYRNEIKLFLKVESYIRNKQKDNERETIIRILEIKQRENKIRDRRIKNELERLIVEAEVFVYGQKQDIKTKDASKKIEESLKALANHRFHKAKLVKKPYDEAEIRNILSYVYDTEKNGVLFAIKKDVESNINSEAIKEVLERITLLEKRGDTPITLKNISEYYLRTPYGWGQLTINGLVGELWKYKLIDLQESKVFVTDENIATNLLIKLQNKNLEKIVISLREEIDPELIRKVNNLLKEIKTIKEDTGEVTLDSPKEDLLEILKRKIGIAKSYKIECEHNSYPGKKELNDWIDLLDEIILSKSNAEKTLKNFLEMENELSKEYDKVDRVFDFFTSSKKERYDKAIEKINKIEEYKDYIGSLKETDAYKTIEEIKLDKNIYERIREFDDLISELDKAKDELIEIEKTSLKEKVEKYKKEFSEKLKDNPEIIKKLKEKLNEFLEKEVNNKDNSNDMAIFMKSKKLENIVNNFEEEYKNSAKKEIEKLENYLNEVAEDKTDIDELRKSIKSTYSNYKDEIAKSDIKNVSVTIAKAIKDKEDFNAEINGKAKKKERIKLRKISINSKSNIESEEQVNEYISAIEKDIEKLKNEMLEAIKNNKIVDIG

SEQ ID NO: 900 - protein, 1249 aa, Fusobacterium sp.
MSDLTIKNILQKDIERKINGVVKADSNEKDTVITELNEYVVTEEIRERLTKFFDKYVDSINFPTEDMGVWISGFFGSGKSHFLKMIGHILENNTYDGKKVVDFFKEKIDDAILMGNIEKAAEIPTDVILFNIDNVSDQDTYQNKDSIPLAFLKKFNEYLGFSRDDIKIAEFERKLWEDGKLEEFKKVFEEESGKTWKDANRNLDFHSDDFLDVIEKLKIMSKESAERWLERAEKSLSVESFSDLIEHYLKIKGPKHRIVFLVDEMGQYIGDNSRLMLNLQTLVETLGVKFKGRVWVGVTSQQDLSSILNNSEHRKNDFSKIQDRFKTMLALSSGNIDEVIKKRLLIKKKIEGEDLEKIFDKKRVEIENLIHFEKTMTLPLYDDNKDFSETYPFVAYQFNLLQKVFEKVRNMGHSGQHMSRGERSLLSSFQEAGIKVKDKNIGILVPFNYFYESIEQFLEDNVRRPFIHARNEKGIDDFGLEVLKLLFLLKGINGIEPTLNNLTSFMIDSMDCDRIELEKKIKKVLEKLEKEVLIQKDGENYYFLTNEEQDINREIEREDIDLKKIDEKIDSYIFKEIFTKNSILMEETGNKYNFTRTIDETVYGKMGEDLAITIFTERADDYDNVAIVGTRPESDLILRLAKDDETYRNEIKLFLKVESYIRNKQKDNERESIIRILEIKQRENKIRDRRIKSELERLIGEAEVFIYGQKQDIKTKDACKKIEESLKALANHRFHKAKLVKKPYDEAEIRNILSYVYDTEKNGVLFDIKKDVESNINSEAIKEVLERITLLEKRGDTPITLKNISEYYLRSPYGWGQLTINGLVGELWKYKLIDLQESKVLVTDENIATNLLTKLQNKNLEKIVISLREEIDPELIRKVNNLLKEIKTIKEDTGEVTLDSPKEDLLEILKRKIGIAKSYKIECEHSKYPGKKELNDWIDLLDEIILSKDNAEKTLKNFLGMEDELSKEYDKVDRVFDFFTSSKKERYDKAVEKINKIEEYKDYIGSLKETDAYKTIEEIRLDKNIYERIREFDDLISELDKAKDKLIEIEKTSLKEKVEKYKKEFSEKLKDNPEIIKKLEEKLNEFLEKEVNNKDNSNDMAIFMKSKKLENIVNNFEEEYKNSAKKEIEKLENYLNEVAEDKTDIDELRKSIKSTYNNYKDEIAKSDIKNVSITIAKAIKDKEDFNAEINGKAKKKERIKLRKISINSKSNIESEEQVKEYISAIEKDIEKLKNEMLEAIKNNKIVDIG

SEQ ID NO: 901 - protein, 793 aa, Acinetobacter lwoffii
MLDAFQMAANAIATNEVGALVPFHRFYTSVEGFLDTAVKRTIDQAEQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGHFLDSHSLDGKYESDLKVEIISPLDTEYNLYSEAYCIGKSTQAEGQVLFKLADDKQFFNELRTWLKTNKFIRLNDDGTQSDISRILADRGRENQERKKRLRVRVEEMLLDAESYALGQHLQLSSSSPTTKLDEACRYLLENTYTKLSYLQVYQQDAWRELNAVLTVDDMAQLGLSLDGGQSNPKALQEVEQYIALRATGTERILVSDVVDRFVKRPYGWPDAEILLLVGQLAAMGRISLQLNGGSLQLKDAFEPLQNSRRRRDVSIIKKRQTDDQVLKQARQLTQDLFSAMGPATEKELFEFYTQNFKTWLANFKSYKSKTDVGQFPGKKVIERSILTLERLLANSDSFDFFKAVVDNKDDYLDLEEDYRDIHEFFSNQMPSWQQLQQALRHFEKNKQALGSDEVAKKALSELHRISTLESPYGLLNKIADLVRTVESVNQRLLTEKRSQALEQLDDKIKQLEAEIKNSGIATAELSNKLLRPLQLLKADIEVESSLSTIYMLQTQTAVERFDEALYELEREVEAEIQRQAKAAQLAQSKAESVTSTATTASPVAAAVSPVKPVIAVVPPKPVVEVDVASIYNKTSSSVYLETEESVDQFVDALKVELKKIVGDKKRVRIR

SEQ ID NO: 902 - protein, 1215 aa, Lactobacillus casei
MEIKELFKRPIDRNIQGVIKVDQDDEANVKQELDEYVVTSELRDHFSAFFNAFDNSLQTPTDDMGVWISGFFGSGKSHFLKIISYILANKVVDGKNAVDYFDDKIDDQMILNEMHAAASAKNDVILFNIDAKAKDTVGSDKQSILKVFMRVFNEMQGFTDADFWIADLERQLTEAGKLDAFKEQITAIDANHKSWEDLRDAYYLNKGTIKAAMINSGFSDEANAQGFIDTLSTEYQISIDDFAELVKQYIDKTGHRVVFLADEVGQFIGDSVQRMLNLQTIVEQLGTMTRGKAWVVVTSQQAIDKVTDIASGQDFSKIQGRFKTRLSMSSANVDEVIRKRLLEKTDVAEKMLEDQYSANAAAINNSFDFDDDVKRPKYESPKDFAQNYPFVPYQFNLLQLVLTAIRENGSDGKHLSEGERSMLSLFQESAEAMMSESTETLAPFSRFFDGLDQFLDHTHHIVLVRAHDNPAVNPNKEKNPFALQLLKVLFMVKYVSNFTASLNNLITLMISSVDADRIALKKQVQDALDVLVTQGYVEKTVKGYDFLTDAEQDITREISKQEVTDNEVAKEIGDYLFNAKPGVATTLTYPKLNGRYVFAFNRKTDNIFGAQRNKLSVHIITPVNDDFLEDNDYLRVSTGLWNHDVLIALPRSSNFVGEIRNALRIRKFVVNSNVSTDPRYQAMVSTRQAQQNEEFAHAHEQLIAALDNAEIYENGQSVSSEAGFDSRLEKAMKLLVDNTYRSLQYITVAKSEKDIRELFENISSLALDEKDNQAAVDAVLDYMRRESQNNAHITMESVLSKFNDIPYGYTDEDIQWLVAKLVAIGKLKMFYNGSSINPMDDKHTTQDLAGFFTKKQAMRNLAFQIKEEVAPSKIKAMQTVASAVFGKKSFKSDNDEQRASELKDTVEDNLENLVDFEAKPQGYPGHVVLQQGIQMLQQLLNMPDSGAFYDYIGKHKDDLLDWNDDFLDDGIRDFYFSVSMQKIWDKGLNALRVYRDSSDFLSDSKLQNIVEEMGKLLRLQKLQGDTAVKISELNNDFDTLFTAAFDKKAAEYLAQIDELKDRGIKRILESGISNEETKDRLKRDFENKIKIIRNAAQNAVTLNEVVAKPAQAHAQLDQLSDGIQKEIEREVKLVEPVSPDDHDKTNPPIPDPGPDPEPEPIPRAKEEKFIKLDQVLRRGDYKLEDSADVAELTAEFKRLLEAQLSDNTIVTLQVD

SEQ ID NO: 903 - protein, 1213 aa, Escherichia coli; identical to SEQ ID NO: 872

SEQ ID NO: 904 - protein, 1226 aa, Acinetobacter sp.
MNIKELFYKPLDRAINGVVKADQNDNTTVYQELDEYVVTNELEKHFRDFFQSYGTDLSDPSIANRVGVWISGFFGSGKSHFLKTLSYILANKVARDAQGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRILFLVDEVGQFIGSDTRLMLTLQTITENLGTICKGRAWIVVTSQADIDAVLGEMSSSKANDFSKIAGRFKTRLSLSSSNTDEVIQKRLLRKTPEAEALLRSVFEQKGDILKNQITFDRSGPTLNNYEGPDSFIHNYPFAPYHFQLVQKVFEEIRKVGATGAHLAYGERSMLDAFQMAANAIATDEVGALVPFHRFYTSVEGFLDTAVKRTIDQAGQNQTLDSFDVQMLRTLFMIRYVDIIKGTLDNLVTLSIEKIDEDKLALRKRIEESLLRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQDEGQVLFKLADDKQFFNELRTWLKTNKFIRLNDDGTQSDISRILADRGRENQERKKRLRARVEEMLLDAESYALGQHLQLSSSSPSTKLDEACRYLLENTYTKLSYLQVYQQDAWRELNAVLTVDDMAQLGLSLDGGQTNPKALQEVEQYISLRATGTERILVSDVVDRFAKRPYGWPDAEILLLVGQLAAMGRISLQLNGGSLQLKDAFEPLQNSRRRRDVSIIKKRQTDDQVLKQARQLTQDLFSAMGPATEKELFEFYTQHFKNWLANFKSYKSKTDVGQFPGKKVIEKLILTLERLLANSDSFDFFKAVVDHKDDYLDLEEDYRDIHEFFSNQMPSWQQLQQALRHFEKNKQALGSDELAKKALSELHHISTLESPYGLLNKIADLVRTVESVNERLLSEKRSHAVEQIDDKIKQLEAEIKNSGIATAELSNKLLRPLQLLKTDIEVETSLSTIYMLQTQTAVERFDEALYELESEVQAEIQRQAKAAQLAQSKAESVTNTATTSSPVTSTPAASPVQPVTAVVPPKPVVEVDVASIYSKSSSSVYLETEESVDQFVDALKAELKKIVSDKKRVRIR

SEQ ID NO: 905 - protein, 1151 aa, Vibrio cholerae; identical to SEQ ID NO: 825

SEQ ID NO: 906 - protein, 1180 aa, Holdemania filiformis
MKIQNMFVDDINRKINGVIKVDQDADDVLVQELNEYVITKELKKHFITFFNYYSDSFQEPTADTGVWISGFFGSGKSHFLKMLSYILENRSVEGVPTVERFRKKFEDDPATFMLIDNSTKCETETILFNIDIEGSINKDKTAVLRVFAKMFYNHLGFYGENLKVAKLEQFIAKRGKTGEFRRVFEEKNGGSWVSTRDTFAFFEDDVVETLMEVLGMSETAAHNWFDGTETTEMSIAQLVSEIKDYVNTKPANFRMLFMVDEVGQYVGADTDLLLNLQSLIEKIGSECGEKVWVVCTGQEAIDEIIKTRQDEFSRIQARFKTRLSLSSSAVDEVIQKRILNKKPEATQMLEQVYDKNDSVLRNLFSFTDSVLDIKGYSGAMEFAVNFPFVPYQFIIMQKVFSEVRKHGNAGKHFSGAERSMLSGFQEAAQKIQDRDEYALVPLFRFYDTVHGFLDGSIRRVIERCAKAAEDGNGIEAYDVDVLKLLYLVRYIDDIKASIDNIVILMADDIRVDKITLREKVKASLDRLDSQNYIGRTGDTYNFLTDEEQDIAREIKNTNVDTASIVERIAHMIYGDIYTTKKYRYGKYDFSFDQMVDSTTVGAVTGGMRLRFLTIAADSNERQELRLMTDSNDCAIVVLAETSYYELLENAMKIRKYVKQRNVAQLAKSVQDIIRDQQDEAGKYELLAKEKLEEAIVSATFYVDGERIEIKSGSAVSKIEQALEYLVTHVYSDLNLITKNAESDADIAAILTGAVQQIPGTEDNRDAAAKMEEYLEMQHMKRLPTSMADVQSKYQGIPYGWKEIDIAAVAALLIYQQKVTIKYGGVTIQPDNSRLPDMLRKKSEIGKVSISKRQIVSVSNMKAVKSILREYFDVMDVPDDEDGLVAFIVKKFTEQKEHYEKLLARYTGHKYPDHNKVSEAISLMQDVLSQQKDNISLIQRVLDDENKLFDSKDDLQGVEGFFATQVTVFDAAVKMEEDLRNDLSYLQREEEANKALGQIRLITMTQTDSRTVYKCIPELNGLMATVKAGHDTLLAAKREELLEIVRQCMEEIHTTAGGDVNCKMIIQKSDTFFTQCKQRIAELQSLALLDGMVPQMWSYKDDSVDRLETMKQPSKPVDPKPHINPATPPKPAPKKHIKTVYRQAAFPSKVLESQADVDAYVERMRAYLNAMLKDCDGIKLN

SEQ ID NO: 907 - protein, 1223 aa, Enterococcus faecium
MLIKDIFAKPIDRNIQGVIKVGQAKDENVQQELEEYVVTKELQKHFKTIFDAYQRSINTPTDKMGVWIQGFFGSGKSHFLKIISYLLANREINDKKAIDYFKEDGKIKDPLTLATMERCSQINTDVILFNIDSKSDAGGKKDKNGIVNVFLKVFNEMQGLSTIPHLADFERRLIKEEKFDAFKAAFEEINGAKWQEERHEFDWIQDDIKEAALKIDFMSEAAIDNFLEKASGNYLISIDDFANLVKSYLDSKEADHHIAFLVDEVGQYIGGNRELTLQLQTVVEDLGRICEGKAWVLVTSQEAIDHVTNFDNNSDNDFSKIKDRFATTVSLSSANADEVIKERILKKKEFANDSLALQFETVQTELKNKLLFVDSPELKLFQDAENYAEVYPFIPYQFNLLGQILTEIRNHSYQGSNLSSGERSLLAMFKEAAERNKENDTTSLVSLDQFYYSLERWIDTAISRVITQATNNSHIQRPTDIDDFNVNVLRILFMIKYVDQAIKPNVENITSLMIRNINEDRLETKKRVEEALDLLIKENFVRKNLDSYIFQTDEEQEITREIKNQNITDSDLIVELSKRIFDGVLDRNSFAYEKLGMSGGNKFKNRYTFTYAQVLDQRPYKQAGNAEMTVNFISPYSDLAGQEAELALKSSRNLLFVELPSDKEFKDDIAMYARMNLYLTTTYSSVVKNFDAIRSEKSGELQELSASINDQLNELLKSAKFFYNGAEIQLTGSDFKAKFQSALQKMAEEVYHKLNQIDAPKEKEDILYLVKESKNEIIEDPSNEQAVQEIFNFINDQKRNHLTITMKTIRDRFETKQPYGFTELDVEWCIAKLFMSGKIDLLYNNVQISRMDDPNSIVMIIQKRRESEKIKIEPSAVISPKAKKLVDEIGRELFQSRNIVDENNNEHTMENFKKHLKGQLDNLRSYFDLQNTYTYPSAYEYEQIKKYLEVIVQTSDVEDFFYTIKKYRDELFDWAETYDKIKNFHKQNSTQKKIWENAQDKIRLIEKSRCQTSSQEIDQLIHEMKTILKKADPYSDMMKLNELIQEFIEQYNQLLELESQEILNKLTEEKQATFKLLEGKDFKDQFVPIVDQEFQELKAKIEQANTIDDLVFLSLNVAEQYSIFNQRFDKEENRRRQEEQARKQIEAANLIRETEKDEIDSAAEAEEIAIVKPTIRQKTVPMRTLNVHVKTIKSAADIDELTAEINQKLKEQLQENTEITIQF

SEQ ID NO: 908 - protein, 1250 aa, Fusobacterium sp.
MSDLAIKNILQKDIERKINGVVKADSNEKDTVITELNEYVVTEEIRERLTKFFDKYVDSINFPTEDMGVWISGFFGSGKSHFLKMIGHILENNAYDGKKVVDFFKDKIDDAILMGNIEKAAEIPTDIILFNIDNVSDQDTYQNKDSIAVAFLKKFNEYLGFTRDDIEIAEFERKLWEDGKLEEFKKVFEEESGKTWKDANRNLDFHSDDFLDVIEKLGIMSRESAERWLERDIVRSISAESFRDILENYLKMKGSKHRIIFLVDEIGQYIGDNSKLMLNLQTLVETLGVKFKGRVWVGVTSQQDLSSILNNSEHRKNDFSKIQDRFKTMLALSSGNIDEVIKKRLLIKKKIEGEDLEKIFDKKRVEIENLIHFEKTMTLPLYDDNKDFAETYPFVAYQFNLLQKVFEKVRNMGHSGQHMSRGERSLLSSFQEAGIKVKDKNIGILVPFNCFYESIEQFLEDNVRRPFIHARNEKRIDDFGLEVLKLLFLLKGINGIEPTLNNLTSFMIDSMDCDRIELEKKIKKALEKLEKEVLIQKDGENYYFLTNEEQDINREIEREDIDLKKIDEKIDSYIFKEIFTKNSILMEETGNKYNFTRTIDETVYGKIGEDLAITIFTERADDYDNVAIVGTRPESDLILRLAKDDETYRNEIKLFLKVESYIRNKQKDNERESIIRILEIKQRENKIRDRRIKSELERLIGEAEVFVYGQKQDIKTKDASKKIEESLKALANHRFHKAKLVKKPYDEAEIRNILSYVYDTEKNGVLFDIKKDVESNINSEAIKEVLERITLLEKRGDTPITLKNISEYYLRSPYGWGQLTINGLVGELWKYKLIDLQESKVLVTDENTATNLLTKLQNKNLEKIVISLREEIDPELIKKVNNLLKEIKTIKEDTGEVTLDSPKEDLIEILKRKMGIAKSYKIECEHSSYPGKRELTDWIDLLDEIILSKDNAEKILKNFLEMEDELSKEYDKVDRVFDFFTSSKKDRYDKAIEKINKIEEYKDYIGSLKETDAYKTIEDIRLDKNIYERIREFDDLISELDKAKDGLIEIEKTSLKEKVEKYKKEFSEKLKDNPEIIKKLEEKLNEFLEKEVNNKDNSNDMAIFMKSKKLENIVNNFEEEYKNSAKKEIEKLENYLNEVAEDKTDIDELRKSIKSTYNNYKDEIAKSDIKNVSVTIAKAIKDKEDFNAEINGKAKKKERVKLRKISINSKSNIESEEEVKEYISAIEKDIEKLKNEMLEAIKNNKIVDIG

SEQ ID NO: 909 - protein, 1215 aa, Clostridium butyricum
MDIKLKSMFYKPINRDIKGVIKVGQADDENIKQELEEYVVTGELNKHIDRFFEAYKAGIVGHTDKNAVWISGFFGSGKSHFLKILSYLLENRSIEGQNAINYFDDKGLDSFILANMKQAGDISSDVILFNIDSKSDSDNKSNKDAIVNVFNKVFNEMQGFCGSMPWLADLERQMVKDGVYENFKTVFEEISGNSWIEAREDFYYEEDSIIEALSKTTKMSEDAARSWYEKCQDNYSLSIEKFAKRVKEYCDSKGKNHHVVFLVDEIGQYIGDSRDLMLNLQTVVEDLGTACGGKCFVIVTSQEGLDEFAVVKGSDFSKIQGRFDTRLSLSSANVDEVIKKRILRKTEGATSHLKALYEQKESIIKNLLTFTSDTAEMKLYKNSEDFADVYPFIPYQFNLLQAAFNGVREHGASGKSLSKGERSLLGAYQQVAVDYMNCDSSILVPFSAFYKTIETFLDSSIRSVIITAEKNDRLDKFDIEVLKLLFLVKYVKEINANINNLATLLVDNIDASQKGLKDKVNESLKKLIRETLVQKNGDEYIFLTNDEQDVNKEIKNMAVDNGEVIQKVGEIIFDDIYVESKFNYSKKYMFTFNKIVDDRTRGPQNNEIGVKVVTANFDLVGGTSQGELKQLSIRENNVIVNIAKDVNYLEEIENVLKIDAYLRLKGGTKSTTAIEDIKSKKGREREERIKRAKFLIEESLRTAEVYVNGSLLDIKEKSGVDRVNEGLRALIDSKYNKLNYVKEFKDNTKDLFDIMDTRLNQMSLVDNDPNRLAVDEIKTHIETSTSRNLQVTVKSALQKFSNAPYGWKEIDIQAIIVVLFKKQDIKVVLNNEVLAPNNREVVNYVTKRDYVDRVILKTREKVATKYIEALKDLNKDLFGFSSLPADEDGMISMFKEHSKTELHRIELMLNNFSVVSKYPGEETLKEGKKLFVEVIERKDTLEFFKMVYDLEDDFLDYADNIDNIKGFFFKKDNGVIDINSKGEQRQIFDNAIEKLKNYDDNKEYIVNDEIKEIIEEIGAILRMKEPYGKIPTIPLLIEKYNNKILSLLEEESIPVLGFIQTCKNEVIETLEGYEFKNKFINRVSEDFGNLIKRTESASSFAVLSSMSDLAEKLKVRFINEIVAEDETLKRIKAKEIEEANRVKETPLTKGTDTTYVAATVKPEPKVVIKTKTISMRELVKGQKVIKNEEDIDAVVEALRRKLKEELEKDTIISLI

SEQ ID NO: 910 - protein, 1226 aa, Acinetobacter baumannii
MNIKELFYKPLDRAINGVVKADQNDNTTVYQELDEYVVTNELEKHFRDFFQSYGTDLSDPSIANRVGVWISGFFGSGKSHFLKTLSYILANKVARDAEGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPDSFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDGHSLDGKYESDLKVEIISPLDTEYNLYTEAYCIGKSTQAEGQVLFKLADDKQFFNELRTWLKTNKFIRLNDDGTQSDITRILADRGPENQERKKRLRVRVEEMLLEAESYALGQHLQLSSSSPTTKLDEACRYLLENTYTKLSYLQVYQQDAWRELNAVLTVDDMAQLGLSLDGGQSNPKALQEVEQYIALRATGTERILVSDVIDRFAKRPYGWPDAEILLLVGQLAAIGRISLQLNGGSLQLKDAFEPLQNSRRRRDVSIIKKRQTDDQVLKQARQLTQDLFSAMGPATEKELFEFYTQHFKNWLANFKSYKSKTDVGQFPGKKVIEKSILTLERLLANSDSFDFFKAVVENKDDYLDLEEDYRDIHEFFSNQMPSWQQLQQALRHFEKNKQALGSDDVAKKALSELHRISTLESPYGLLNKVADLVRTVESVNEQLLTEKRNQAIEHIDDKIKQLEAEIKNSGIASAELSNKLLRPLQLLKADIEVESSLSTIYMLQTQTAVERFDEALYELESEVQAEIQRQAKAAQLAQSKAESVTNTATTSSPATSTPAVSPVQPATAVVPPKPVVEVDVASIYSKTSSSVYLETEESVDQFVDALKAELKKIVSDKKRVRIR

SEQ ID NO: 911 - protein, 1220 aa, Cellvibrio sp.
MTIKDLFIKPLDRPINGVVKADQNDDATVHQELDEYVVTNELEKHFRSFFESYSTDLSDPSIANRVGVWISGFFGSGKSHFLKTLSYILANKDAVDSNGNHKQAVQFFDEQKIRDAMIRADISKAVSNTADVMLFNIDSKASSNDDGNPILNVFLRVFNEHQGFSGDHPHVAHMERHLSQKGAYEAFKKAFTASSGLQWEVERDGYHFYQDDVEKALAESLNLSPEAAHKWFEESEKTFSVSVENFCTWVKEYLDTQSPKHRVLFLVDEVGQFIGSDTKLMLTLQTITENLGTICKGRAWIIVTSQADMDAVLGELSSAKANDFSKIAGRFKTRLSLSSSNTDEVIQKRLLRKTPEAEAELKAIFDKMGDVLKNQLSFDRSGPTLKNFDGPDSFVKNYPFAPYHFQLVQKVFEEIRKVGATGAHLAYGERSMLDAFQMAANAIAGQPVGALIPMHRFYSSVEGFLDTAVKRTIDQAKENTTLDDFDVQMLRTLFMIRYVDLVKGTLDNLVTLSIAQIDEDKLSLRKRIDESLQRLEKESLITRNGDIFQFLTNEERDITRKIKSTEIASSDENKALSELIFKDLLRDKNKFRYNANKMDYGIGRYLDGHTLDGRLETDLKVEVISSLGADYNFYSDAQCITKSVEGYAILKMTDEVSFFGELRTYLRTDKFIRLNNDGSQADITRILADRGRENQERKKRLRAALEDMLLQSEVYALGQHLKLNSNNIHTKFDEVCQYLLENTYNKLGYLRVLQQDPWRELSAVLNTDDIGQLGLTLNGEEGNPQATKEVEQFIALRTQHDSIILAEIVEKFSKKPYGWLDAEIILILGRLAAAGRISFMLSGATLPLREAFDPLQNSRRRREVTVIRKRQTDEGVLKQARNLTHDLFSAMGPATEKELFEFYVAKFAEWLRNLKSYKSKVDVGRFPGKRVIESSMLTLERLLNHSDSFEFFKQVVEKKNDYLDLEEDYRDIHEFFTNQIHTWQQLQKALRQFDKNKSALEADAGAKAALAELQTIEAAESPYGMLHKVAGLINTVETVNDSIVTQRRTQALTVLEEKITQLEAEIAKSGVATPELSNKLLRPLQQIKEDLNDDSSIAGIYMLQSQTIGERLDEALYELDLAIQKAQEAERKKQLAAEQATKAASATTQTPVAVGAISETPAPVYVPPPKPVVEITPASIFSKVSSSIYVETESDVEQFVAALKQELQQAIANNKRVRIR

SEQ ID NO: 912 - protein, 1222 aa, Faecalibacterium prausnitzii
MEETVMQIKDMFRKKIDREIQGVIIVGQGEETNVAQELEEYVVTRELQRHFADFFAAYKKGIQGTTPKMGVWISGFFGSGKSHFLKILSYLLQNKQVGDKHAIDYFIEDQKITNQMVLADMQLAANTPSDVILFNIDSKSDSNGKENKDAIVNVFLKVFNEMQGFCGSMPHLADLERRLSEEGRFEEFKEKFEEEYGDPWESSRQDFDFIQDSVVDVLSDMDFMSESAARNWCEKATESYQISIEDFAKRVKSYIDKKGNNHHVVFLVDEIGQYIGDDSKLMLNLQTVTEELGKECMGKAWVIVTSQQDIDSITKVKGNDFSKIQGRFDTRLSLSSANVDAVIKKRILDKTETAAQSLRLLYDQKATIIKNLIVFNDGVEKKLYANAEDFAEVYPFVPYQFNLLASVLTSIRTHGASGKHLSEGERSMLALFKESAMQLMDDEMGAIVPFYRFYDALENFLDHSHSSVIIRAYDNSYINPEKKEKDVFAINVLKTLFLIKYVLEIEANVDNIVSLMITSIDDDRISLKAQVEDALKVLMRQMLIQKNGSIYVFLTDEEQEINNEIEKENVEMPEVITKIAEMIYEDIFSSKKYQYPSFGGRYAFSFNQTVDDRPYKANQNYDIGLRVLTPWYEGGTDDGTLRLLSGQGKEVLVVLPNDDAFLTEMRAYLKIERFLRKNTSVQLAKYETIKEAKRVEMRERNGNAKLYLTEALKEATIYVNGDVLHTSGKEVTSRINEAIGRLVQTVYHKLSYIDAAMGEADIRKMFKTSNQLSLALGDTGESNVHALDDVLQFVAGNSRMHMKTSMKTIKDRFMKAPYGFVEDDIHWLVARLFKRGDLSFTVNGESVNLNNRSEEEIIGYITKKQFVDKLLTEVRVRVPENQKKAVRTVMKELFKVAPPADDEDTIMKNFQHYCENRITEIERLEPKYENYAYPGKELLEKGKKRLSALVQIQAPLEFFKTVFDEQDDLMDFGEDYEPIRDFFGGEQLTIFTRALDMLNIYEDSKTYIVDAELEDVVAKMRTIVRMPKPYKEIPKLPELREKFMNCYMRILEEQAEPVKDSINQDRNRVFEVLNTKPYKDAKFNRYLELFKEIMDGAEHCNNVSTLRSYADKAEALKLRLLNEMNAEDIRLAKEAAAKAEAERKRQEEEAEKRGETVKPAEKLAEPQPVYKVRTTKNVSIKTVAKTASWRLESKDDVDKYLAALRENLLKEMDEDTIVNIEL

SEQ ID NO: 913 - protein, 1204 aa, Fulvimarina pelagi
MTSTTIADLFDRPISRQINGVIKADQDDAKSVWQELDEYVITQELDRYMRQFLSAYLAPETLARSGDAACSNGVWVSGFFGSGKSHFIKIISYLLENRAVEQNGTMKTALDFFKSKVVDPMFSADIDRATRIPTDVVLFNVDSKASSNDERAILQVFIRVFNEKLGYCADFPYIADMERFLERKGKYEEFKAAFEKKAGSPWVVERSAIRFHEDALIEAVAEVLGKPRSDAGDWLDKYEANFQPTPENFANWVAEYLARKGPDHRIVFLADEIGAFIGKNGKMMLNLQTITENLGTVCKGGAWVVVTSQANMEAILGEMRHAVEDDFSKIQGRFKARLSLSGSHADEVIQRRILAKKDELKPELKARYDTNGEILRHQVTFRDNRMTLRSYDGEEDFIRHYPFVPYQFQLVQKIFDASRTHGMTGAHLAKGERSMLDAFQTAAILNASKAVGALIPLHFFYPAIESFLEDIVRRAINGVVSNPALEPFDAEVLKTLFLIRYVDEISGNVDNLVTLFLDRIDADRVALRNKITASLKRLESETLVSRNGENFFFLTDEERDIGKEIKAVRLAPGEEKRLLGDLVFDDTLRCVDRGLFNYKVINSDLDVVRFVDGSPRSGPKDKAIPLKIVTPLADDYADFADASITMRSHDEVLVVLDNDNDLARDVYDYLKVEKYATQKMDGTQSESVKRIVRTRQHENSERRKRLNQSMESLIRNARVYVNGRRLDPKATTADAIVGEALDYYIANTFKKIGLLAHLSDDPIRDARVILTTSDDTLDLKDEDPNKAALNEVLDHIGLIERQSKQAVIFDIAEHFNKRPYGWGQRETVLLVVKLFRQGSADILMNSERLDRGQLSSEIDGANKWRKLVIQRRKMLDETTLHGARQLAKDVFGRMPGVGEDAIAEDIRLNLTNWQNDLKTWGALADDGELPGKATVATIQGIIAPIMQKRGSYELIEAFVAAKSELSGVFEDYEDLSDFHSSQKQAWYAMRKAVKEFAINEKEIEKDDAAARALASIKEILTLEAPYSRVREGSALIATVAEANRVLLEKRREHAFGIIDPLIAKIQTELDSVSAEAELRNRSLYPIQNIRKRIETTPSVSAIFMAQTEARDAYDDAFEVIAKAVKLAKERVKTAEPVGIGSQPQTPSGGFSETPVFRPRLVVQPSKLVSAGGYIESQAQVDDFIDRLRARLLEAVSKNERVEIR

SEQ ID NO: 914 - protein, 1213 aa, Escherichia coli; identical to SEQ ID NO: 660

SEQ ID NO: 915 - protein, 1215 aa, delta proteobacterium
MKKIRDIFAKPIDRTIEEVIKVEQADEKAVLVELDEYIPTDYLQEQYARLFDEIASGPASPREGIGIWISGFFGSGKSLFAKILGYTVAARKVGAKTASEIFKVKLNNPKIAALMDSINSRIPFHPIIFDVSMDRGVRLANERLTEIIYKALLRELGYSEDFDLAELEITLEGDGKLDAFEKKFQEIYGEPWQIRRLLGLAINEAGAVLHDLEPATYPTADSYAISVGSGRADIDPNKLAKRAYELTEIRRPGHALIFIIDEVGQYVSRSVDKMLDLQAIVQSLGVESKNRVEHKQAVSPCWIVVTSQEKLDEVVNALDSKKIELARLQDRFRLTVDLKQSDIAEITAKRILEKTAEAVGDLGRLYDDNEGRVNELGRLERTSRDTTITKDAFVRLYPYLPYEIDLCVDIVAGLRLRRGAHRHVGGSNRTIIKQAQELMINPRTRLGEAPLGDLVTLDKVYELLYLGNLLPSEVSREIDDVARNLPDNPMAKKVAKAIALLEPVKDLPRTPHNLAVVLYPSITSGAILGDVETAIAVLEKAQVIRNSEEGYKLLTVQEKTWETKRNSLDPREADRNRIKREVLRQIFSDPQLRKYQYRKLRNFRNTLVVEGDTVESAGEIPLNLLLAESVQSKADRISEARDESSTERNNLFWIVTQTDEIHDLIVEVYRSREMVSEYERLASQQRLSGEESSCLAEEKNRRDVHYRKLRAKMLEAVQSGTGFFQGVQHDATALGSGFVDIFHKLFDIVVPVLYPKLEVGVLPLKGDEPEKLITAANLNGLPPVFYNDKPEQSLVVKQSGKFLPNLGADLCREMFDYLKKEHAYGNKVTGKILETHFSGIGYGWEREALRLGLAVLFRGGAVEVTHQGRKYRNYSDPACRPPFVNNPAFRAASFAPRETLDLKILARAAQAYEEITGKDVNIEEGDIANAFQEIAAADREKLLPVVARLTALKVPGADSVAAHLQWVEGILDMAPDDCVKTLAGEGRSYLEGRKNAAILESLASETNLEILKTARRVLIEQWPVLADRSPSPELEESANELTEAFDSENVLDQLERVRQASEKLGNEYGNLYRATFEQRNKAYETAIDHVKGLPEWAAFTEDTDVTKIEQEALLRPLTSRLGEKLDLQKGDTVCRINHATISQMESDIAAVEGLTWAVILALQKSVEPEEKVERFRVSQHFSGKIGNKEDLDSVITVLRDKLEKLLAQGCKVILE

SEQ ID NO: 916 - protein, 1223 aa, Enterococcus faecium; identical to SEQ ID NO: 869

SEQ ID NO: 917 - protein, 1243 aa, Lactobacillus johnsonii
MTKIKNIFKKDIDRDIRGVIKIGQDSEKIKKQELEEYVITDELKNDFTRFFDAYDKSIDAPTDKMGAWISGFFGSGKSHFLKILSYLLENDIVDGRKAVDYFLEDGKFDDNHLSNAIEKATSVSTDVALFNIDSKADSNSANDSSAILNVFLKVFNEQLGYSPIAEVADMERWLDSIGKYDAFKKAFQDLDPENHSSWEETRSRYAIMLNTRIKPALISSGALDEVDAQNYINEFLSKKFSIDAIGFAKLVKDYLDKKDGNHHFVFLADEVGQFIGEDDNKMLNLQTIVEQLGIQCHGRAWVVVTSQQQMDEVTGNFHKHERDFSKIQGRFNTLISMSSANADEVIRKRLLDKKPLAKEELDDLFTQNEYSINNKINFSDAIKREKYEDSQSFVDNYPFIPYQFSLLKDVLSAVRKHGASGSHMSDGERSMLATFQEATRRYEDDDLGKLVPFSAFFIGMKEFLNHDHQAVFDRAMTDRYVAGNKGGDSFNIQVLAVLFMVRYVDNYPSTLENITTLLLDDINQDRQELTAKVKDALSVLIRQNLIQKNLDTYEFLTDSEQEVNEAINAIDIDDQKIVREIGSYLFTSNLIDSKYVYPKKKNQYIFEFNMYIDGTGLNPLKNDLNIRIVSPLQSGNYREIDYKQQSGDNRNIIVVLKDDDRYIENYRQVEKIKEYMQKPESRSDEKIRYIAANRNSQAKDIERNTQKMLEDDLLDADIYVDGDVLAKGNNFASRLAEAKKTIIDANYRNLQYIDDVKSDQDILNVLKGTQNDVLLTDNEQAINAVIEYINGQAGLMNNISLSSVVDRFGKIPYGYKPNDTAWLVAKAFSDGKLKIYFNNSKISLDEARKDPKSIQRYFISKSNLSRLTMKPVKEISAREKKDAKEFASDVLEVSLVLPDGATSEQLADEIKKKTQQKVRILEDILNYNHDNKYPGKDILHEGINSLKQISMVPDSDQIFSIISKHLDDLEDWRDEVEDKAILQFYGDIGNISDQEKIWRKSNSYLARFNHAKGFIEDENLKEIANELEKYLDMDQFNISIPKLKNLNSEFVSLYSDDMDKVHEKIIGKVNESYDRLKSLVTDAEFPKKESDELFAEVNNTLKSISDRADQYNESSDENAFLNLISLDNAIESANDRLRNKISEVSQKLAEKAQEEQEVAARNVVEEATNPDNKQEETVKVSPSPQPKPTVKIKKTIFKKIYDVVLEDSWKIENEADIDKYLNALKVSLEKELEDNDIINIDFK

SEQ ID NO: 918 - protein, 1209 aa, Thiothrix nivea
MNVEHIFNKPLTRDINGVVKAEQLDNASVYVELDEYVVTRELEQHFRHFFETYTPSLTSRSPAMAGKIGVWVSGFFGSGKSHFIKILSYLLENRQTDKDGQQRRAIDFFQEKCDASAIDATLYSDMHSAAHHAADVILFNIDSRANTDEQENAILKVFLKVFNERVGYCADFPHIAHLERELDGRGQYQAFKDKFAGLTGSTWEKERDAFDFYRDELMTSLAAASKQSEPSVRQWVEQLENNFPLDIRNFCKWVNDYIEHNGGRNVLFLVDEVGQFVGKNSQMMLKLQTITEDLGTYCGGRAWVIVTAQADIDAAIGQLDKRQGDDFSKIQGRFYTRLQLSSTNTAEVIQKRLLEKTEPARAQLEALFADKGDILRNQLSFDKTTTAELKSYTDTRSFVDNYPFIPYHYALVQKVFESIRTKGATGKHLAMGERSLLDAFQSAAKQVKDQALDVLIPFHRFYAPIESFLEPAVKRTIDQACELDSLTAFDADILKTLFLIRYVEAVKSTLDNLVTLTVERIDTDKVALRRQIEESLNRLERQLLIARNGDEFIFLTNEEKEIENEIRHTEIESSEQTHKLSQIVFDTLLQRQTAYRYPVNKQDFRVSRFCNGHPRDGANLEDLVVKVVSPLDPAYDSYHLEANCIKHTLANDGCILIRLGENKRLWDELTTFIKTERFLKVASGQRPEQEHLLRDKAFENTQREKRLYTEFTALFTDADVYAIGARLQPKNTTPSTLVDETYRYVLENTFSKLNMLRPTQGDLNRELQAVLTADDVAQLGLDLNVPECNPEAMREIERYVSLKISRNDAVYLKDVLNQFTRRPYGWQENEILLLLARLGLAGKLSFTLQAADLPLKKAYQPFTSVRSRADIRLQKIRQHDERQLQKTAALVKDLFQKPFTGSGEKELAELIRRELSQWHDSLKTFRSKAQTGQYPGKADIDKGIVLVVGLLEQSNSFTLIEQMLQDAAALEDFAEDFEDLDNFYNSQFQTWQTLATALHNQFKDNRQALEKDDTARNAVAELEGIYNSASPYGQLRRISPLIEQVQKINQQLLEEKRPHALNRVAQRINNITAALDAAGAPSELRNRALHPLQQCRQTIEKAVSIPLILSQQTEANTLEDEAYDLINRHIEEKVKQPSPPPPSPGKSGDTPPPPPPKPVTPVKKTITVRAVGSHGETILETEAQVGEYIRQLQESLLKAVRAGDRVRVK

SEQ ID NO: 919 - protein, 1213 aa, Escherichia coli; identical to SEQ ID NO: 657

SEQ ID NO: 920 - protein, 1178 aa, Brevibacterium mcbrellneri
MQLTEIFAKDVQRPIEGVIKADDVAHLATEVDEYVLTNEAAKGLELLLEAYTNYTNANGVWISGFFGSGKSHLLKMLAHLLGDVEGDDFPRERVSASFRAKATDAFLPPLLDKADRIPAKSLLFNIDQKATLISKDQTDALLRVFVKVFDESRGYYGDQGHIARFERQLDDEGQLDTFKKAFLKVSGRDWVERRPSFGLPTVRRQVNEAYAQITGLDATTAPDILKTYQDTYSVSIEDFADEVRAWLDKQPAGYRLNFFVDEVGQFIGSNTHLMLNLQTIAESLNTKCGGRAWVFVTSQEDMDKVVGDRTKQQGNDFSKIQARFKTRVKLTSADVEEVIRKRLLEKNDKGTQVLEAVYAQESANFKTLFDFVDGAKTYRNFTDETHFAGTYPFVSYQFPLFQAAIEGISDHNVFEGRNSSVGERSMLGVVQQVAKDIGNVEIGTLATFDAMFAGIRASLKSAAQRSIDRAERDLPDSGSPVTKLAVRLLKALFLVKYVESFRATPRNLTVLVYDRFGLDLPTLSKQVQDALMLLETQTYVQRNGNVYEYLTNEEQVIEEEIKNVEIDSSEVSTRLNKILSGDVVKTSKLRYAKNGQDFPFGYKLDDQPFGQQRELSLHFITPEYPYGPEEIRMHSAGKDELRVILAPDDRVLADLRLLIKTEKYTKRKQTSSLSPVEEQILRAKATQNAQREKELVERIRRAVGRADLVINAADLTSGSQEAVTRITEGFQDLIARTYTQLSLLGGRTYSAQQVAGFANPDQAAMIDDSSMHALAAPADEVLSYVLQRDRLGEQITVKKIVDHFQAKPYGWDLASIECVTAWLVGTSKITLTVDSNTLKRSEVAAVLRNTQKHSHAVVAPQKTFDQRRIAALRTFCTDFFDEPNAPKDPLELARHASERLRAKCEELKARVSGSKYPFVTQLEAPIALLESVAGKPDDWFLTDFVLTDDLLDAKTDIIDPIQAFFGDEKQRGAQRKIYDEATQLLADNASNLNYLPSGSSQEVAQLLADPQAFRGNRMTKLKGAALELQSRIDEALVANRDGAVLEIDSRWAPLQTSTIYLGAADDAQRSVSQKVNAILDRISRENQIAVVREIANTFEECTYPAILDQLAAFPSISSADDSDELAPAPIKKQTVSVKSISATGIHGVLETEEDVDRYLDALRAALVQALNDDKRIAL

SEQ ID NO: 921 - protein, 1213 aa, Escherichia coli; identical to SEQ ID NO: 660

SEQ ID NO: 922 - protein, 1194 aa, Geobacillus thermoglucosidans
MQIKQLFKKDIFRNINGVVQAGQLDSETIQNELEEYVMTEEVTEYLHTFYKNYLAVYKTPSANIGVWISGFFGSGKSHFLKILSYLLDNKPINGKKPVEYFYDKTNNQELLSMMNEVAAKESDALLFNIDSMSSSASTHKERIVEVFLRVFNRHLGYSDTLWLADMERQLDEEGKYEQFKSVIRQLYGVEWEEFRLKALLRRKKIIQALVEIGYDEETASSFFEVSKNTFDITSEQFSKMVADYCKKRGLEYRLIFLVDEVGQYIGTDVNLMLNLQTVVEDLGNRCRGQAWVIVTSQEKIDAVTNLHSTNDFSKIQGRFATRINLTSSNTDEVIKRRLLEKTETADKTLKAIYEPIEQLIRGRLAFDPNSTQLRSGYRSAEEFVALYPFVPYQVELLQKVFNKIRIHGEGGTSLAHGERSLLKAFQEAVQLNANEDSGNLVTLAEFFPSIRNFLETTITRTISRAEDRAKNGEGLKPEDVDVLKVLYLIKGIDEIKATPNNIATLLVETIHDERGPLEYRVKESLNRLEQAMFIEKHADGTYSFLSDEEQEINKEIKNVEVNPIKIKEQLGDLFFTKMYPKTKYEYKKDIPPFDFNKRFDNYTKGHMTYPLTLQVFSVAISDMEAAMKANSGQLVICLDEELVAEAESAIKYSEQVQRYVQLKRNNSTTLTQHRIYDAKLAQVDEFERKAEELLRKACEKARFYVQGQERIFKGSFENQVNSAFDMLIKNTYTKLDYIDVPISFKAHKEEWKRLAEHGIDQDLLNMTGNRNAYDELKTYFEDLARMHEKPSLKTVIEKFSDVPYGWSEYDIIGLILALMHDGKVNLYVGDERFTPAHPQFFDRLSRISERERIRIIPEIEVDPKIKKEFTSLMREFFGRQEVGETYQDFAEIIQQEINERFTMPLEEIRSRRRESKSADYPYPGEREINTISMGVQKLLQIRDAEQLVNKFIEAQDEIDQWLEMIEKLLGFYKKTPISVFDDAVSTLQLYQNDLILIQNSDVQIIKKQITDILTKQEPYRDIPKLPQLINELEEKIKAEVNEQRKAIQVQVQTLEEKLVELKDYYQHESSIVQYIDTEWQTFNRLKSNIVTETSIVTIRALVQQLNEHAKLVQDRAKQMEEELRKKPLTVVDSDGDTPSVVREKTTKKLSANELHRMFFNGRTKIETQQDLDAALEQLRTNLLRELKDHILEIE

SEQ ID NO: 923 - protein, 1151 aa, Vibrio cholerae; identical to SEQ ID NO: 825

SEQ ID NO: 924 - protein, 1223 aa, Enterococcus faecium; identical to SEQ ID NO: 882

SEQ ID NO: 925 - protein, 1223 aa, Enterococcus faecium; identical to SEQ ID NO: 882

SEQ ID NO: 926 - protein, 1225 aa, Vibrio cholerae; identical to SEQ ID NO: 728

SEQ ID NO: 927 - protein, 1190 aa, Sporosarcina newyorkensis
MLLKEMFLKDIERDIRGVIKVAQTNEADIYQELDEYVVTQELHRHFSKFYENYQKGINGKTDKMGVWISGFFGSGKSHFLKILAYLLENRAVQGKKPVDFFEEKIKDSLVYANMKRTADVDTEVILFNIDSKSSLDNKSKEDAILRVFMKVFYEHRGYYGDIPGVAEMEKYLDKQGVYETFKTEFKALAGESWEDRRNSFYFDADFVIGALVKATNMTEESARNWFENGVNNFEISIEKFAKDVKEYIDSKGPNFHLVFLVDEIGQYIGDSRNLMLNLQTLTEDLGTFAQGKVWIMVTSQESIDSIVKVKGDDFSRIQGRFDTRLSLSSISVDEVIKKRILEKYPHVLNKLRADYPNKSAILKNLISFRESTADLRGYDNDLEFGDVYPFVPYQFKLLQNVFEQVRKHGSSGKHLSEGERSMLSAFKEAGLRYKDAEEGSLIPFYAFYDTIKEFLNPSISRVIEGAKENPALKDDPFNVDLLKVLFMIKYIKELPANIDNIATLMVTRIDEDKLQLKEKIKASLRKLISQTLIQKNGDNYSFLTDDEQDINKEIKDTKIEEEILKRELRSYIFDGLYGDKKFVYSKQYMFPFNQKMDEKNHGSQTASIGVQIFSPLSEHYYKSDQELMMMSSGSGEMIIKLGGNEIYVEEMEEALRIEEHRRKKNIPQLPENLQNILNNKLAEVRDRKRRVQELLEDAVKDAVFFVNGEKMDIKGSTVKEKFNTSLKQLVDNVYTKLGYVKEHLENERELISILASNDQQISFDEQIISNPNELAKREVYEFIDLQEQIGKQMRVKLVYDRFQDKPYGWKQLDIARLVAELLKEQRIRIRYNSEYMEPEKDTNKLLTVFGKTTEADKGIITKRVKVDEALIRTAKRVCKEVFNTTDLADDEDGLVKDIRTLIANQIAEINAYKDRFEGRKYPGMSLLNKGFEYFEQFNNQLDNASFFTKLKDLEDDLADWEEDIVYVKSFFGTNQKEIFDQGLAGLIKFDENKAYLSGKEVEEAMNQLRNIIQDPIPYRKIKDIPELLHALEQQINSVLDEKKANALEKLQADYSELILQAKQYGVSNETKQRVEGYYDGLKANLDQFTDIFKVDATISQSDSFRDRTIKEIQREITEWQRKKAEEQKRNAGTVVETPVKTVVQKQTVKVTDLVTVKTLSTEEDVDLYINTLSNKLKQIIKANKQIEFVE

SEQ ID NO: 928 - protein, 1151 aa, Vibrio cholerae; identical to SEQ ID NO: 825

SEQ ID NO: 929 - protein, 1151 aa, Vibrio cholerae; identical to SEQ ID NO: 825

SEQ ID NO: 930 - protein, 1151 aa, Vibrio cholerae; identical to SEQ ID NO: 825

SEQ ID NO: 931 - protein, 1151 aa, Vibrio cholerae; identical to SEQ ID NO: 825

SEQ ID NO: 932 - protein, 1204 aa, Desulfotomaculum gibsoniae
MLIKDMFVKRIDRDIKGVIKVGQADDENIRQELEEYVVTRELQKHFADFFGSYKKGINGYTDKMGVWISGFFGSGKSHFLKILSYLLENKEVNGKKALDYFVEDNKIIDPMVLADMKLAAGVSTDVILFNIDSKSEITGKHNKDAIVSVFLKVFNEMQGFCGSIPFLADLERQLTEKDRYKEFKQLFKKDFGGTWEASRHKFDFIQDSIVDVLSEMGFMSKSAARNWCEKATEPYRISIEDFAKMVKEYLDRKGHNHHIVFLVDEIGQYIGDDSKLMLNLQTVTEDLGTACRGKVWIVVTSQQDIDSVTKTKGNDFSKITGRFDTRLSLSSANVDEVIKKRILAKTATAEQTLRLLYEQKATIIKNLIVFNDGVEKKLYSDDDDFAAVYPFVPYQFNLLAGVLTSIRTHGASGKHLSEGERSMIALFKESAMKLMHEQSGAMIPFNVFYDALHQFLDHSHKGVISRALDNDFINPDHEVDCFNVNVLKTLFMIKYVKEITANIDNITSLMIPDIDTDRIALKKQVEEALKILVRQMLVQKNGDIYVFLTDEEQEINREIENQHVEMSEVLGKVSELIFEDIFSGKKYRYPAFNGRYSFAFNQIVDDRHYKANQNHDIGVRVLTPNSDYGAQETTLRLMSGQGREVLVVLPNDAAFLNEMTSALKIEKYLRFASSNNALVKFEQIKEAKRVEMRERGANAKLFLIEAMKNADIYVNGDKAPIGAKGVTVRINDALGRLVATVYHKLPYIDVAMSEANIKALFNNTKQLTLTLEGGTEPNIHALNDMLNYIGGNSSMHMKTSMKSLMDRFMKAPYGFVEDDVEWLVAKLFKNGDITLTVNGSTVTLLNKTGDEIVRYITKKEYVEKLLVERREKATDKQKKAVREVMKELFGVSSIHDDDDSMMRSFQSYSQTMLNELEKFEIMYNSQNLPGKKTVATGKGLLRGVIQILSPVEFFQKINHDKDDYLDFAEDYEPVKSFFAGEQKTIFERALRLMKIYDESKTFIVDEKVEEYVAAVKAILHKDAPYSDIPKLPELLDNFNEAYAGVLESMVAPIIAAIDDAKARVFELLNTKTYKAEFRERFIKLFDELHDKATHCNNVATLQNIKVEADALKVRLLNEMDKKDELLAAQSVKDVRVKYGQNGGKIVVPQPKPKMKKKKNISIKTISVSSSWRIETAEDVEKYMAALKERILKELEEDTIVNIEF

SEQ ID NO: 933 - protein, 1151 aa, Vibrio cholerae; identical to SEQ ID NO: 825

SEQ ID NO: 934 - protein, 1223 aa, Enterococcus faecium; identical to SEQ ID NO: 882

SEQ ID NO: 935 - protein, 1225 aa, Vibrio shilonii
MNIKQLFTKDIARPINGVVKADQTENETVFVELDEYVITNELKEHIENFFKFYMPSVYDPEQAAITGKSGIWVSGFFGSGKSHFIKILSYLLKNVSATDGITTRTAFDFFSEKLKDDAFLVGDIEKAIQKDNKVILFNIDSRADTDDKEDAILKVFLKVFNEEMGYSGDHAHIAHLERELDSRGQFEGFQTAFESITGESWLEQRDSYDFYRDDMAEALAQVTGQSLDSTKLWVERIEENFPLDIANFCKWVKEYLDGNPDRRLLFFVDEIGQFIGKNTQMMLKLQTITENLGTICGGRAWVIVTSQADIDSIVGGMQGSKSQDFSKIQGRFERISLSSSNTNEVIEKRLLSKTEEAKSHLSELYDAKGDIIRSQLSFEQSNAAEMANYQSSDDFINTYPFVPYQYNLVQKIFTGISRAGASGQHMSRGERSLIDAFQIASKEFADKNVGRLIPIHSFYHSIKKFLDDAVVRDINHAADKSSIDEFAVQVLQTLFMIRYVDEVKSNIDNLVTLCISEIDQDKRALRLAIEARLEVLERNNLIARQNDEYIFLTNEEKEIEEAIKKTDIEPSDETTELSNIIFNEILRRNNNYRYPENKQDFPVARFCNGVPFERNLDSDILLKVVSPIDNSYDEYNDATCANFSSDCILVKLNDHPRLFDDLRTYIKTEKFIRKSSSASGSSQEQIRRDKANENMNRRKRLVGDLEELIKESDFYTLGSGFDAKGSSLAVMLEGAYRYIIENTFGKLKLIKPFPGNILNEIQQTLAAGDTAQIGLDLAGEEANPLAVLEIEQHVSLSDDHGYAVTAADIIKKFSKRPYGWNTDEIILILARLGLANKLVFQANQQEVPLKGLYEHLSKSQKRANLRIRRIKQQSEANLKKAAKLYKDLSFGTAPSAEKELFNSAVEKLNQWLTKLRRFKSMSSTGHYPGGNEIDDGVMLLSGLTEIKTSFQFVDEFIAKTNDLLDFEEDYELLENFYETQFTSWQGLERALNITFSANRAFLEKNAEAMAALDKLTAIYHNASPYRDIRNIQPLVETLTSINNQLIEKQQSYTIKKLEQRIGEVKELIENAGASAEISNKALLPFQNAIKRVQRENSVSQIKHELIEADDWFNDAEKAVNAYILQQQALAEKTQEAQSSNSEATDSPSSTSPSTANYGSSTTEAMPVREKAPKAKPTQAIDAMEVYREVSEATYMETVEDVENYLKALRDKLVTLVESNHKVRIK

SEQ ID NO: 936 - protein, 1160 aa, Brachybacterium paraconglomeratum
MKLSEIFLKDVTRSIEGVVKADDVDHLGTEVEEYVFTNDAAKGVAPLLEEYSNYTNANGVWISGFFGSGKSHLLKMLAHLLGDVDGQAFSREKVSEAFLGKTDDAMLIASLRKAAAIPAKSLLFNIDQKATLIAKDQTDALLKVFVKVFDESRGYFGNDGAVARFEEDLDNRGQYEAFKAAFATHAGIDWSQGREQTALEGHNIDKAFAEVNGEANPGIIGQYQKSYAVSIEDFATSVKAWIDKQEPGYRLNFFVDEVGQFIADDVKLMLNLQTIAESLNTKCKGQSWVFVTSQEDMDKVIGDRTRQQGNDFSKIQARFSAKVKLTSQDVEEVISKRLLEKNVVGAAALTSIYSKEAANFPTIFNFVDGAKTYRNYVDEARFINAYPFVTYQIPMFQAAIEGLSDHNMFEGKNSSVGERSMLGVVQEVAKRIDGEQVGYLATFDQMFAGISAALKSSAQSAILQAEKHLPDPGTDVTILANRLLKAMFLVKYVDTFKATPRNLTVLVYDRFGLDLTGLGKQVQQALNLLEGQSYVQRNGNVYEYLTNEEQEIEKEIKAVDVDSSEVSSKLFRYLSSEILRVNKLKYAKNGQDFSFGYKLDDIVQGNQRELTIHFITPETSYSDSEIVAHSLGRNELRVFLGRDKRLLTDLRLLLKTEKYTKQRTNSGVTPSMQAILQSKQALNADRGKELIERLRQAVGKAQLIINGAEVASNAQDAVTRVADGFQELVNRTYTSLGLLGGKVFPEQQVASAVQNDKGLFGAGTLSALNSPGTEMESWIITQTGLGEQVTIRKIVDRFETKPYGWDLGSIEVVLGWLVGNGKVTLGVDSNPVVRTEAAALIRNTGKHQHVVVAPQKAYDQAKVATFKRFCSDFFDEGAVPSDPTELARFGKDKLAARRDELNALVSSSRYPFVGELAGVVALLDEVAGKKADWYLTDFDKADELLEAKEDLIDPIKSFLNGQQAKIFDEAQLLLSTNAGNLGYLPTGSADAVRALLSDANAFRGNKMNQLKAATDTLRGQIDEIVTDKREEVAAAIEGRKAEILGSAYYANATLAAQESVIRRIDGILARLGGETQAALILQARASFEQDDYPELLSMLVEAQQGGDDDAPPPKPIVSVKSISVPGAAGVLESETDVDNYLAKYRAALVATLDDGKRITL

SEQ ID NO: 937 - protein, 1213 aa, Salmonella enterica; identical to SEQ ID NO: 703

SEQ ID NO: 938 - protein, 1210 aa, Eubacterium cellulosolvens
MKIQNMFEKKITREIKGVIKVGQKDDENVYQELDEYVVTAELEKYMNRFFDAYKRSVTGRTDNMGVWISGFFGSGKSHFLKILSYILSNRVVEDENGAKREAVSFFTQGIKVEDRKLKDKIAEVASDRGDIDVILFNVDSKSTTDSKINKEAIKDVFMKVFNDYLGYCGSIPFLADFERKLDDQGQYEAFKQKFEEIEGISWKEGREDYYFVQDSIVQAITELGIMSEESARSWADNAEKSYSLSIDKFAEYVKKYCDKKGKNHHILFLVDEIGQYIADDSKLMLNLQTVTEDLGTACGGKAWIIVTSQQDIDSITQTMGEDFSKIQGRFATRIALSGADAAEVIKKRILYKKPEARPILENLYKEYESSIKNIITFSEGTPNMPLYTDAEEFADVYPFIPYQFKLVGDVLTAVRQFSSSGKHLADGERSQLALFKEAAVAYADEREGLLVPFNAFYSALDDFIDHTHRIVITQASRNTRLNNFDVELLKVLFMTKHLNNFKRDVENLTTLMISKVDQDRLELSKAVEKSLRALCDEALVQKNGDEYTFLTNEEQEAEIRIQHYNIDPKDVVDYVAQVAFEEVIVFPNNKYRYNSRYQFSFNQLIDDKAYRNNVSHKIGLKLLTAYSGKEDERVLSLLSYQEKCVVVRLSDDYAYLSEIDGMKKIEAFLNDPTSANLTDFDIISANKRKERSQKAKRVSDYIRFSLENADIYVAGSKISTKAKGVTARISEAFEKLVNSEYHKLKCMESKPSQSDILSLLKQTKTQMNTSDFGTGNEENHDALLAMIDEIRYAGAHAAQYSVKQALDQFMDPPYGYTEEDIEFLIATLYRRGMISLKVNSIIYTPASTTPEDAYKYITKREYREKVLIEIKEVAPPQHIKAVKDVIREFYGKTVTTDDQDSLMRDYRNYATTKKGAIEEVLREDYGVSSKLPGKKVLEKSLRLIDETLKISDPISFYKRVDELCDDFIEVGLDIADLNSFLGGVQKNKFLHAVKVLGIYENSKNYISDQEIIDYATEVKRILSVERPYSFIPKLEEYDNKLWDAIMKLLEKDTQRIQPDVYTDWKTVKTSIPSDRPYAQRVLDRINPKFQDLIDKLEKITDIATLNGIPAESNALLQNCLRMIQTEEDAFQAEVERKKKEAEKQGGGSDAPVVSPVEPVKVIKNKPVSFRTITGNKTYSIKTEADIDHMLEELRTALKAQLEENTIIKLS

SEQ ID NO: 939 - protein, 1237 aa, Pseudoalteromonas luteoviolacea
MQIKDLFIKDINRPINGVVKADQLESNTVFTELDEYVITKELATHFEEFFDAYMPSVRDPKKKAESGKIGVWVSGFFGSGKSHFIKILSYLLQNIKATNGEIDRSAIEFFKDKNLDGFLLGEIDTAVTKENTVILFNIDSRANTDEGVDAILKVFLKVFNEQMGFSGDHPHIAHLERELDQRGVFQQFKEEFNTLTSSNWLEERDAYDFYRDDMAEALGKVTNQSTESARQWVEQLENNFTLDIANFCKWVKEYLDADLNRRVLFFVDEVGQFIGNNTQMMLKLQTITENLGTICEGRAWVVVTSQEDIDSVIGHMAGSKGHDFSKIQGRFERLSLSSSNTSEVIEKRLLSKQEQARPVLQTLYDQKGDILRNQLAFDSTTTAELANYKDATSFIHSYPFVPYHYNLVQKIFEAIRKAGATGLHLSRGERSLLDAFQSAAKQVRDQEVGVLIPLYYFYPAIESFLDTSVKKDIDQAAEKDSISDFALNILKTLFLIRYVDVIKSTMDNLVTLCVSKVDEDRLTLRRDIEQALNALEANLLIARQGDEYIFLTNEEKEIENEIRETEIELSDETKKLSDLIFDDVLRRDNIYRYPENKQDFPISRFCNGMPRDGSQENDLVVKIISPIDPNYSEYDSTVCANQSQDGLSSGGAGAIIIKLADNSKVFDEIRTFIKTDKFLRRNTGNRPEQQQLLHQKGSENQDRNRRVKLAIEDLLKDAEFYALGSQQNPKGGAISTILQELYKYVIENTFSKLKLVKPFEGDIRREIQNTLVADDIGQIGLDLQGQEVNPHAILEVEKFISLGDDAGRPITAEDIVKRFSKRPFGWNDEEIVLIISRLALANKICFQSRQQDVSLKSAYDNLMQVRKRAELRVRRIKQQSEANLKRAAKLFKDVFQKNAPESEKELFNVAQSNFANVKSKLDAFANKASTGHYPGVSEIENGRVLLAGLIETQSSFQFIEQFLASENDLLDFEEDYQDIEDFYETQFATWQKLHRALTIDFDRNRTALEKDNDALAALKKLENIYNKPRPYREIKDIEPLIESVSKVNDQLLQDKRAHAKSRIEHRIEQVQKQITAAHVPSELSNRALRPLQLALQRLDGLSGIAEILQEQADSINLEEDAYDLINKHIEDQQALAAKQPKEAASNSTSDSSAASGSTTNTGSGGYESPSTEPQQVAEPAVNTPIPKKIVSIDTASIIRDVNATGVIETEQDIDTYLAALKEKLTSLVNSNNKVRIR

SEQ ID NO: 940 - protein, 1221 aa, Clostridium perfringens
MEANLGSMFYKKIDRPIKGVIKVGQSDEENVKQELEEYVVTRELSTHIDKFFEAYKEGILGITDKNGVWISGFFGSGKSHFLKILSYLLENKKIDEKRAVEYFNDKDLDNFTLGNMKQAGDISSDVILFNIDSKSDSDSKSNKDAIVNVFNKVFNEMQGFCGSMPWLADLERQMCKDGVYEDFKKEFEEISGTPWIEAREDFYYEEDSIIEALAKTTKMSEEAARSWYDKCQDNYSLSIDKFASKVKEYCKSKGANHHVVFLVDEIGQYIGDNTQLMLNLQTVVEDLGTKCEGKCWVIVTSQEGLDEFTKVKGNDFSKIQGRFNTRLSLSSANVDEVIKKRILRKKDWATSHLKVLYEQKESIIKNLLTFTSDTAEMKLYKDSDDFAEVYPFVPYQFNLLQSAFNGVREHGASGKSLSKGERSLLGAYQQVAIEYMNKESNILIPFSAFYSTIETFLDSSIRSVIMKAEINDKLEEFDIEVLKLLFLIKYVKEIKANIENLATLLVDDIDISKKELKDKLNDSLKRLMRETLIQKNGDEYIFLTNDEQDVNKEIDNIFIETGDVVNKIGEIIFDDIYGEAKFSYSRKYIFSFNKAVDDRPRGSQNNDIGVKVITAAFDLSGDGDQFALKQLSVRENNVIVDISKDSNYFEEIENVLKIDSYLRVKSGSKSSIAIEDIKTKKSREREERLKRSKFLIEEDLKTCDIYANGNLLEIKEKNCVDRINEGLKSLVDSKYNKLNYVKEFKNGIDDLYGIMDKRVNQLSTLDMDQNRLAVDEVRNHIEQNSTRNLPITVKSVLTKFSNAPYGWKEIDIQGIIVTLFKNQDIKVIYNSEVLSPNNRDVVLCVTKKDRVERVNLKIREKVPNKYVDNLKDINSELFGFSSMPSDEDGMMNLFKDQCKTELNKIDAMLSCFGIMSYYPGEKTLKKGKGLFEEILSIGDTLEFFKTVYELDDDFADYIEDIEDIKKFFFNKENGRIDTNTNKGEQRKIFDDAIKTVNNYKINEAFIVDEDVDIIIKSIEVILRMAKPYGKIKDIPVLIGKYNDKIVELLEIKSEPVIDFIEGCKKEVLETLDNEEVKEKFSNKILEEFNSQIEKVEHSKSFMELSSMKEPAENLRLKWIQKIITENEVIKRREERKLSELTSTRGVGEEEPKNSYGNDNEVPVDKVKPVEIIQVKTKAVSVRELVKGEKIIKNEADIDAVIESLRRKLKNELEENTIINLI

SEQ ID NO: 941 - protein, 1223 aa, Enterococcus faecium; identical to SEQ ID NO: 882

SEQ ID NO: 942 - protein, 1225 aa, Vibrio cholerae; identical to SEQ ID NO: 728

SEQ ID NO: 943 - protein, 1213 aa, Escherichia coli; identical to SEQ ID NO: 660

SEQ ID NO: 944 - protein, 1151 aa, Vibrio cholerae; identical to SEQ ID NO: 825

SEQ ID NO: 945 - protein, 1151 aa, Vibrio cholerae; identical to SEQ ID NO: 825

SEQ ID NO: 946 - protein, 1242 aa, Fusobacterium ulcerans
MKSDLSIKDILQKDITRKINGVVKAESNQEETIITELSEYVVTEEIRKHLTKFFDKYVDSLNSSTEDIGVWISGFFGSGKSHLLKMIGRILENKKYGEKKVTEFFESKLKDAILQGNIEKASEVPTDVILFNIDNVSDQDTYQNKDSIAVAFLKKFNEYLGFSRDDIKVAEFERMLWEEGKFEEFKKFFEEESGKTWKDGSRNLDFHADEFLDVIEKMQIMTRESAERWLDKESIKSVSAESFRDLIEGYLKIKGAKQRIVFLVDEIGQYIGENSQLMLNLQTLVETLGVKFQGRVWIGVTSQQDLGTILTANDSRRNDFSKIQDRFKTILPLSSGNIDEVIKKRLLEKREIEREDIENLYEKKRIDIENLISFDKKGMTLSLYKDKFDFAETYPFVGYQFNLLQKVFEKVREMGHSGQHMSRGERSLLSSFQEAGIRVKDMSLGTIVPFNYFYESIEQFLEDNARRPIIHAKNERGIDEFGLEVLKLLFLLKGINGIEPNLNTLASFMINSIECDRINLEAKIKKALEKLEQQVLIQKDGDNYYFLTNEEQDINREVNQEEIDFNDIYKELDSYIFKEIFNKNNISIEETGNKYSFSRKIDEYPFGKLGGQIDIVIFTPSADNYNNIEFIGLREGYDLIIKLPENQEGYMEEIKKSLKIESYIKRKQRENVREAVIRILESKQRENQNRKRRIQNNIEIALQEAEVFIYGHKISIKAKDAGKVIEEALKAAANYRFKNARLIVKKYDENKIKEVLTYDFSGNDQLIKIEKDLETNVNCEAIKEVLNKITIQEKRGMNITLKDLSDYFTKIPYGWDQFSINGIIAELWTYKYINLEESKVIVTEAKEAKELLIKSQNRNLERVVITLKEEIDIELIKKVNNILKSFFGNGVEITNNSPKEELFVILKEKIGCVSKYESEYNEKNYPGKKELKEWKELLKEILFSKGKAEKVLQDFLDMEEELYDLYEKQSTVVDFFTNSKKRKYDEALDKIKRIEEYIDFVGSLKDNSAYNILLEIVRDNNPYSRIREIDDLISAINLEENILIENEKNNLKKKVEKKNEFFSEVLKDRDAILNRVNNNLQDFIEEINKIKDTNIFLRGRKLENIIFNIETEYRNSIKEEINSIEKELISILEDKTDIEELVKEIKVTYNSFKEEVEKKELENLEKIIEMAKKDKDGFIQQSNGKAKKKERIKLRRINVTSKYNLETEEQVQLYITELEREIEELKFKMLEAIKKNKIVDIN

SEQ ID NO: 947 - protein, 1172 aa, Roseobacter sp.
MTTALRTIFAKPVDRPIDGVIKADDEASLRIELDEYVITDEIGKRLETFLDAYNNYDTANGVWISGFFGSGKSHLLKMLALLMENREIDGTQAFDLFEEKLTGQPMLLGALRKAVSVPSKSILFNIDQKADVISKTDVDALLSVFQKVFDEACGYYGKLPHIAQFERDLDDRGQLAAFKDAYAAAAGKPWERGREQAALERKNIATAFASVTGGDPADAADILGQYRADTRVSIEDFANKVKAWIDKQAPKFRLNFFVDEVGQYIAENVKLMTNLQTIAESLNTKCKGQAWVIVTSQQDMEAIIGDGKAFQSQDFSKIMARFGVKMPLNSADVAEVIQRRLLSKTDEGQVRLGNLHDREENNLKTLFDFTDGSIKLKNFDGRAHFVSSYPFPPYQYMLFQMAITSLSQHNAFEGKHSSVGERSMLGVFQEVAKKMADQPVGGLATFDLMFEGIRTALKSAVQQSIQIAEKEIQDIDPFAVRVLKALFLVKYVKEFKPTVRNISVLLLSEFDTDQVKQRRKIEEALSFLERNTLIQRNGEVYEFLTNEEKDVEAEIKALDVDPSELSKEMETLAFDTILRHRKIKHLTTGNEYSFSRKLDDHLLGREYELSINVISPFNDDVASPEAVRMRNMSREELAVVLQPDVRFIRDLTLFKQTDKFIRQARAGSQQPGRDRIVAEKGDQNSRRYKDLELRLRKLMAETRMFVRGDELDIGGEEPQDRIVKGFQGLVDKVYVNLPMLRGVTYAEADILKAATPESGLFGNNGEGLTEAEQDVLNYVQSQARNGVKVSVKYLTERFGGKPYGWPTTAILCLAASLSGKGKLEARSDGTVLERAELAKALNNSHALANILLTPQTEFTSAQIRKAKELYKELFDLPSDGTDARTIGAEWLESTRTLSEDLGKMLAQKAQYPFVVALEPLATKIAAMVGKPATWYITEPAAQEDDLLDAKEEVLDKIRSFMGGSQREIYDDAREFLRDQEANISYVDAAAGEALARALADPACYKGTAIQALKSDLYGLKDRVELTVLEERKAVIAAVEDCAAKVTQTPEFQALSADDQAHIKRNIDSHKSGLDSVKMIPILRDRANGAKLDLLPRILAEVERLNRPVVDPKLVPPGPPQPEPPQTTYVNASEIKVGFAKPYLTEEADVEQYVEEMKKTLLEQIRAGKKVIV

SEQ ID NO: 948 - protein, 1213 aa, Escherichia coli; identical to SEQ ID NO: 660

SEQ ID NO: 949 - protein, 1187 aa, Paenibacillus elgii
MLIKDMFVKDIERSIKGVIKVAQTDEDNIYQELDEYVVTRELNKHLSKFYENYQHSIDGKTDKMGVWISGFFGSGKSHFLKILAYLLENKKAKDKRAVDFFADKIQDELVYANMKRTANVETEVILFNIDSKSSLDNKSKEDGILRVFTKVFYEHQGFYGDIPGVAEMEKYLTKEGVYEDFKREFQAAAGEDWIDRRNTFYFDADYVIGALTKVTSMSEETARNWFEKGVNNFEISIEKFSKDVKEYIAQKGGNFHLIFLVDEIGQYIGDSRHLMIDLQTLAEDLGTHCQGKAWIMVTSQESIDNIVKVKGDDFSRIQGRFDTRLSLSSISVDEVIKKRILEKKEHVTDKLKQIYHSESATLKNLMSFKDSTADLRGYENDLEFAEVYPFLPYQFKLLQNVFEQVRKHGSSGKHLSEGERSMLSAFKEAGLRFKNAEEGTLIPFYAFYDTIKEFLTPSIARVIEGAYENPALRDDEFNMDLLKVLFMIKYIKELPANIDNIATLMVTKIDEDKLALKEKIKVALRKLISQTLIQKNGEFYLFLTDDEQDINREIKAMKIEEDVIKREIANYIYQDLYDDKRYRYSAQYQFSYNQKMDEKNVGNQTSSIGINILSPLSDHYAKSEQELMLMSSGTGEMILKLGANEAYVEEMEEVLKIEEYRKKKNPTQLPESIQNILNNKQAETRDRRRRVRDMLEEAIKGGIFFINGNKAEIKGATVKERINAGFLSLVENVYTKLSYVKTFLDTENDLRSILRRNTEQLTIDGTATNANELAVKEVMDYISLQDSIQKQIRVKMLVDRYKDKPYGWKDLDIAGLIAELMREQRIRIRLNSEYLEPEDGNTVNALTKASEIDKVIVVKRVIVDESLLKVAKNICKQVFNKTDVADDEDGLIKDIRGLIEDQLKEINALKNRYEGRKYPGGSLLNRGLEYFGEFTKGLDNVSFFTKLRDLEDNLLDWEEDVTYVKSFFASQKDIFDKGLRAIEKYKENDVYLSGNEIKGYADKLQEILKDVQPYKKIKDIPELVNKIDEQIQSVLEEKKVAAKTVIKVDIDHLTLRAKEDGVSEETKKRVQAYYENLFSGMKDLVDIFKVDATITQSTAFREKQEIIINREILEFEEKQVERPVTGGGVDKPQVIVKPVPQRERVKVNSLLATKTLRTEEDVDMLLNTLSAKLKQIIKSNKQIEFID

SEQ ID NO: 950 - protein, 1213 aa, Escherichia coli; identical to SEQ ID NO: 660

SEQ ID NO: 951 - protein, 1185 aa, Pseudomonas mandelii
MKLNGIFKSPVSRPIEGVIKADDEASLFNELSEYVLTDEVAKRLEHFLDAYTDYHHANGVWVSGFFGSGKSHLLKMLALLLENRQVDGSTALDIFLPKIKDDDELLRAQLKKAVVIPSKSILFNIDQKADIISKTQVDALLSVFVKVFNEMCGYYGKQGYIAQFERDLDSRELFQPFKEAYQSIANKPWERGREQALLETGNIAKAYAQITDEDLALAKGILDKYRTQHSVSIEDFGNQVKEWLDKQPSNFRLNFFVDEVGQYIADNTKLMTNLQTVAESLATKCQGRAWIIVTAQEDMDSVMGDMSKQQSNDFSRVQARFANRLKLTSADVAEVIQKRLLTKNDIGAALLKIVYDQQLNNFKTLFDFADGGQHYQNFRDLEHFTYCYPFVPYQFPLFQSAIRGISMHNGFEGKANSVGERSMLGVFREVAMAIDNEPVGQLATFDRMFEGIRGALKSAIQSAINNAERHLGDPYAVRVLKALFLVKYVKEFKATLRNLNVLMLERFGEDIPAQRKKLEAALNLLEQQTYIQRNGEFYEYLTDEEKDIEEEIKNTEIETADVIKELETLLFDGVIKQRKVRYENAQDYAYTRKMDDRSLSREFELAIHIVTPLSDNFDNLTVQRMQSMGRDELRVVLPADARFMQDLTLHKRTEKYIRQNSSTQQEAVKRIIDAKGFQNTERLAELQDRAKELLGKAHLIINAADVEATSSDGQTRILKGFYQLIETTYPNLRMLRDVPFNENDIGKYLRQAQDGLLGNDATSLTEPEQELLAYIQNNARSGVRTTVKTLLERFERKNYGWYYAAILCNLALLCARGKVEVRQDSNPLEGDNLERSLRNTNAHTTLVLEPQIEFSASQVRHLKEFFADFFDRPASCNEARALARETIDAIKELEIELADLHGQKALYGFLNVLDGVMATLKEIAGKNASWFLTDLSRASDAMLDTKEQIIEPLRRFMGSPQKAIYDQARQLVQEQEDNFAYVVTGEVEVIKALLTENKPWQGNRLQQAKPQLESLQQAIANQLTGEKAAAVGRLAELELRLQGSNEYGSLKPEQQAQLAVPFVEARQSMQGQKRIAMIRDQLRAFEDNQYAQLLLKLERLARPQPVPDPIPPFSPPPAGNQDNDYPPQPSAEPPQEAEPRLVPARSIKVGYSKPWLASESELDDYLRQQREAWLKEIQAGNRVQI

SEQ ID NO: 952 - protein, 1225 aa, Vibrio cholerae; identical to SEQ ID NO: 819

SEQ ID NO: 953 - protein, 1151 aa, Vibrio cholerae; identical to SEQ ID NO: 825

SEQ ID NO: 954 - protein, 1151 aa, Vibrio cholerae; identical to SEQ ID NO: 825

SEQ ID NO: 955 - protein, 1190 aa, Geobacillus sp.
MLVREIFKKDIFRPINGVVQAGQLDHDTIKNELEEYVLTDEVTGYLQTFYENYLSVYKTPTKDIGVWISGFFGSGKSHLLKILSYLLDNKEIDGKKPYEYFYEKTDNKKLLSMMEEVAQKESDAILFNIDSLSSSSSTNKERIVEVFLRVFNRHLGYSDTLWVADMERQLDEIGKYQEFKDTIFRLYETKWEDFRLKAVLRRKKIVQALIEIGLDEETANSFFEISKNTFSISSTQLAQLIANYCKSRGPEYRIVFLVDEVGQYIGTDGNLMLNLQTVVEDIGSATMGQAWVIVTSQEKIKAAVNVHSEKDFSKIQGRFATRINLSSANTDEVIKRRLLEKTDTATKTLKATYEPIEQIVKNRLSFDPNSTQFRSGYRSADEFVSLYPFVPYQVELLQDVFNKIRIHGEGGTSLAHGERSLLKAFQEAAKLNSNEEIGNLVTLAEFYPSIRSFLETTITQTITRAEDRAKNNEGLKLEDVDVLKVLYLIKGIDKIKATPSNIATLLLGSIYDDHDDYHIKESLNRLEQAMFIEKHADGTYSFLSDEEQEINKEIRNVEVNPIKIKEQLGDLFFTKLYPKPKFEYRKDTPPFDYNKRFDNYTKGNMTNALTLQVFTVAMSDMEAALKANSGQLVICLDEEIVAEAESAIKYSEQVQKYVNFKRNSSTTETQKRIFEAKLSQVDDFEQKAEELLKKAAEKARFFIQGQERFFKGSFENKVNSAFELLIKNTYSRLDYVDEPIPFKTHKEAWRKLAEHGIENDLLQMTGNRRAYEEMKDYFEEIARWHEKPSLKSVIDKFQAVPYGWSEYDIIGLILALMNAGKVKLSIGDELFTPEQSNFYDRLARISERERIRVIPEIEVDPKVKREFISIIREFFGDRDFGETYQDFANVIVKELTERFAAPLEEINKKRREQKLYEFPYPGEREINALSMGINQILQIRDPEQMVNAFINTEDDLESWLESIEKLNGFYNKTPITIFDDTVDVLDRLQKDLTIIQDNDVLLIKKQITDILTNPNPYRDIPKLPQLTSQLESKINEIVNEQRQAINIQVEKLEKKLNETKEYYLEIPAIVDYIDTEMQKFNRLKSNLEHEKSLVIIRVLLQDLTDLTNQIENRAKQLEVEYRKPPIDNPSDEPTTVIREKQSKKLNANELYHLFFNGRKKIETQQDLDHALQELRKALLRELKDYTLEIE

SEQ ID NO: 956 - protein, 1204 aa, Escherichia coli
MNIEQIFEKPLKRNINGVVKAEQTDDESAWIELDEYVITRELDGHLRQFFEVYAPATGPGRLQLADKIGVWVSGFFGSGKSHFIKILSYLLANREVSRNGVTRNALSFFEEKIDDALLLADIRKSAQHPTDVILFNIDSRANVEDGVDAILKVFLKVFNELAGYCGDFPHIAHLERELDKRGQFDTFRAAFADITGSRWEDERDVYLMINDQMAEALSIATGQSEESSRQWIEQLDKNFPLDIKNFCTWVKEWLDSHGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTDAAIPALEAIWQEKGDILRNQLAFDTTTTATLRAYTNSREFVDNYPFVPWHYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIERIDTDKVELRRQIEASLNRLQAEMLISRIDDKFVFLTNEEKEIENEIRNIDVEFTTINKQLSTIIFEEILKNKRYRYPANKQDFDISRFCNGHPLDGANLNDLVVKVLTPLDSNYESYKGAHSNSLLMTDSKDCILICLPDEARTWQDLTMYAQTKAFLSKQSGQRPEQATLLAEKGRENSMREKTLKAQIEGLLAQADVWALGERLDKKSSSPLAIVDAACGYVIENSFSKLKLLRLSTGDVNRETHALLTVENDTQLDLGEMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAAQLMAEIAGEPFNEREEQSLVSHIRELFGRWNSELTVFKTRAESGQNPGRKEIEEGLVLLNGILNEKEEYAVIEKITAAADDLNDFSEDWDDLVSFYKNQYATWQRLSMALNGSFKANRNALDKNETAHKALQELEGIYSKARPYGELHRIIPLIETVETINQRLVKEYRSNALQQIDNHINELKQSMQEMHVPADLQHSLLHPMQQSRKKVEQNGLIPQIMEEQAEVRALQFKANERLNGWVEDQRKKVSEPKPAPQPGIIDPVVKPEPKLKKTIYVNTRKTMERAAGVTTLDNAEQVDKALEQLRKTLMDAINAGERVQLQ

SEQ ID NO: 957 - protein, 1213 aa, Salmonella enterica; identical to SEQ ID NO: 703

SEQ ID NO: 958 - protein, 1184 aa, Collinsella stercoris
MRIQDMFERDIDRNINGVIKIEQNDEEVIEQELAEYVVTNELRGHFSTFFDAYERALDAPTDKIGVWISGFFGSGKSHFLKMLSYLLSGQTANGRAAIDIIAPRFEDPMIEVKARRAVDVPTETILFNIDSKGPSNKDKTAILRIFARVFFEHLGFYGEDLKLARLERDIDQKGKTEAFRAAYRKITGTEWLDERDAYDLNSDAVIDALEQAGAMSREAAERWFNNTEEFEFTIDWLVRQINQYVTERAEQEGGEFRLLFMVDEVGQYIGTDTSLMLNLQTIVEDLGAQCAGRVWVVVTSQEAIDEITTVAGQDFSKIQGRFNTRLSLSSTGAGEVIRRRILSKNEHAHDLLTVEYGKNATVLKNLFTFKGARNDLGGYDGAESFADAFPFVNYQFKLMQDVINGLRNQGSSGKHLSAERSMLSGFQEVAQALEDRDEHALAPLWMFYNTVQSFLEGYHRRVIDRAAAAARDGAGLEEYDVAVLKLLFLIKWVSQEMPGNVDNIATLMADDLRANRAEVRERVQAALERLERENYITRNGECYLFLTDDEQEIARQIARTQVDAAKLTKKAAEIVFGQIFETPKITVGKNNFPVAEWLDETRVNNAAGLTLRVLARMDGNDAPGRDELILRSSRGEAIVLLSSEVDFYSCLMEAARIQQFASATIIANLPANQQDVIRAKQQERTALETKAQALMEEAVRRGEFYAGGSQVTITGTNSAKKLIEQCTAKLVDAVYTKLGYIDRNYDDDAQIRQILNGAAPALEGIEPNKRAIDDVRTFLGAQAMRAVSVSMDDLQKRYQAAPYGWRERDIAAVVAELITAGEARVSYAGQVVDAHDAKMIDYLRKLSMTQRTVVEMRVRASAGDMTRARRAIETLCRVHDLPTEEEPLAAACRSALQERLNGLNGLITGAYNRNPNYPGYGTVADAAALINELLAIRGDSGDLLRAIAKEENALRDAGEDLEDVDGFFPDMQRIYDNASNLLKRLDQDRSYLAAHEEATKAIGDIERILGSERPYRQITDLGPAMQAIESAHAELLESKRADVSTQAQDIFASIHEHGRELDVSLSLIEQTELARREAISRADTLTQLDALASRLGSDQTSLFQKLDEEHERIHRPGPACEGVTVATEHPTPRRPERRVKEVRRALAFKPKSNLSSKEDIDAYLENARAYLLEQLAGNDAISLK

SEQ ID NO: 959 - protein, 1189 aa, Glaciecola punicea
MKLSQLFAKKVDRPIEGVIKADDDVALYLELDEYVITNEVAKRLDIFLDAYLNYCGANGVWVSGFFGSGKSHLLKMLALLLENAPIDDVTPLDIFLEKRPLNEGGIFANDLKRAVDIPSESILFNIDQKADVISKTELDALIAVFVKVFDEHCGFYGKQAYIAQFERELKDDGLLENFTKIFESVSGMEWEKGRARAKRMADAVDSAYNQVSGQSVIGILDKYRDDYRLSIEDFAEQVQSYIEKQEDGFRLNFFVDEVGQYIAGNTKLMTNLQTVAESLATKSKGQAWVIVTAQEDMSKVIGESDQNSESDFTKIQARFKNRMKLTSQDVAEVIQRRLLEKKEEFLPTLSDLYHEQENNFKTLFDFADGSQSYRNFKDKEHFLQSYPFIPYQFGLFQSAIQNLSTHSAFEGKHSSVGERSMLGVFQEVAIAIKDHNLGDLATFDLMFEGIRTALKTANQQSILKAELNLDNTFAVRLLKVLFLVKYVKEFKPTIRNLCVLMHDSFSRDISSLKLEVEEALNLLEKETYIQRSGDLFEYLTDEEQDIEKEIKNTEVDSDVVASELEKLIYDGVLKNRKIRWQENNQDYPFSRKLDDKISGRENELAINVITSFHDHRDAFEKHKSDTLFNDELRIVLPESARLVSDLVLYKQTEKYVAHETKATQQDTIKRILTEKGIQNHERYNQLKTLTSKLVGSAKYFVAGAEIELSGDDGQNKMVRAFGELIKHTYPNLKMLRDITYSENDINDIIKNAGQGLLGDDAQLPEAQQEMFSFIQSNSRGGIRTTVKSLLTKFESKPNGWSFAAILCNLAHLCARGKIEVREATNLLDDTDLVRALRNIATHGNLILDPQVEFTPSQIRAVKDFYSDYFEKMPHANEAKAIAKELQESFLEQATLLDKLLAQSEQYPFLRALADIVTKLGEFKSKPYTWFMTELTQQEEIWFDHKEKTIDPIIKFMKGAQKSTFDKARRVTTEQLANIEYVTSDEYQNIKDALVNATIYKGSAIQQLKTDTESLENKIAEQVKVERAHAIETINLLKDKLETFDDFQTLDKEKQQQLITEFTVVKQKLEQQALIAMLRDEARRFEDVTYSKLVQKLMEWSQPAPTPITTPVTDNKTNNQPEDGLFGGKSQPSSSVNEPVKAEIQSISAKQIRVDYNKPWLSTENDVEEYVEEYKKALLSAIKQGKHIQL

SEQ ID NO: 960 - protein, 1221 aa, Enterococcus faecalis; identical to SEQ ID NO: 850

SEQ ID NO: 961 - protein, 1188 aa, Pseudoalteromonas flavipulchra
MKLSELFAKKVDRPIEGVIKADDDVALYLELDEYVITDEVAKRLDIFLDAYLNYNGANGVWVSGFFGSGKSHLLKMLALLLENNPIEGITPLEIFLEKRPLNEGGIFASDLKRAVAIPSESILFNIDQKADVISKTELDALIAVFVKVFDEHCGFYGKQAYIAQFERELKDDGLLEDFKAIFKSTSGMEWEKGRARAKRMADAVDKAYNQVSGQSVTGILDKYRDDYRLSIEDFAEQVQSYIEKQEEGFRLNFFVDEVGQYIAGNTKLMTNLQTVAESLATKCKGQAWVIVTAQEDMSKVIGEVEQNSENDFTKIQARFKNRMKLTSQDVAEVIQRRLLEKKDEFIPALSDLYHEQENNFKTLFDFADGSQSYRNFRDREHFLQSYPFIPYQFGLFQSAIQNLSTHSAFEGKHSSVGERSMLGVFQEVAIAIKDHSLGELATFDLMFEGIRTALKTANQQSILRAENNLDSDFAVRLLKALFLVKYVKEFKPTIRNLCVLMHDSFSRDIPSLKLKVEEALNLLEKETYIQRNGDLFEYLTDEEQDIEKEIKNTEIDSDVVAAELEKLIYDGVLKTRKIRWEENKQDYPFSRKLDDKLSGRESELAINVITSFHDHRDAFEKHKSDTLFNDELRIVLPESARLVSDLVLYKQTEKYVAHETKATQQDTTKRILTEKGIQNVERYNQLKALTSKLVGSAKYYVAGKEVELSGEDGQNKMLKAFGELIKHTYPNLKMLRDIQFNENDIADIIKKADQGLFGDDTQLPEAQQEMFSFIQSNSRGGVRTTVKSLIDKFERKTYGWSYAAILCNLAHLCARGKVEVRESTNLLDDGELVRALRNMALHANLILDPQVEFTPSQIRAVRDFSQDYFDKPLLATEAKAIAKEVQESFLEQAITLDKMQAQAAQYPFLRALTEIIEKLGELKSKPYTWFMTELAQQEDTWFDYKDKTIEPMTKFMNGPQKATYDNARKLITEQSANSEYVEGDELQKIKDALVNASIYKGSAIQQLKADSELLASKITEKVEEERNQALEQIDSKKSQLQGFNEFINLDSGQQQQLLAEFERIIDKVKQQSLIAMIRDDARRFEEHTYSQLVQKMMAWSQPIPPTSEPSKPNCNNDGAGSELNGGSSDVVTGVNEPAKPEIQSVSAKQIRVEYNKPWLSTEDDVDGYVAEYKKALLAAIKSGKHIQI

SEQ ID NO: 962 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVESWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKSEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEALATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 963 - protein, 1222 aa, Johnsonella ignava
MEETVMQIKDMFRKKIDREIQGVIIVGQGEETNVVQEQEEYVVTRELQRHFADFFAAYKKGIQGTTSKMGVWISGFFGSGKSHFLKILSYLLQNKQVGDKYAIDYFIEDQKITNQIVLADMQLAANTPSDVILFNIDSKSDSNGKENKDAIVNVFLKVFNEMQGFCGSMPHLADLEDRLSEEGRFERFKEKFEEEYGDPWESSRQDFDFIQDSVVDVLSDMDFMSESAARNWCEKATESYQISIEDFAKRVKSYIEKKGNNHHVVFLVDEIGQYIGDDSKLMLNLQTVTEELGKECMGKAWVIVTSQQDIDSITKVKGNDFSKIQGRFDTRLSLSSANVDAVIKKRILDKTETAAQSLRLLYDQKATIIKNLIVFNDGVEKKLYANAEDFAEVYPFVPYQFNLLASVLTSIRTHGASGKHLSEGERSMLALFKESAMQLMDDEMGTIVPFYRFYDALENFLDHSHSSVLIRAYDNSYINLEKKEKDVFSINVLKTLFLIKYVLEIEANVDNIVSLMITSIDDDRISMKAQVEDALKVLMRQMLIQKNGSIYVFLTDEEQEINNEIEKENVEMSEVITKIAEMIYEDIFSSKKYQYPSFGGRYAFSFNQTVDDRTYKANQNYDIGLRVLTPWYEGGTDDGTLRLLSCQGKEVIVVLPNDDAFLREMRAYLKIERFLRKNTSVRLAKYETIKEAKRVEMRERNGNAKLYLTEALKEATIYVNGDVLHTSGKEVTSRINEAIGRLVQTVYHKLSYIDAAMGEADIRKMFKTSNQLSLALGNTGESNVHALGDVLQFVAGNSRMHMKISMKTIKDRFMKAPYGFVEDDIYWLVARLFKRGDLSFTVNGESVNLNNRSEEEIIGYITKKQFVDKLLTEVRVRVPENQKKAVRTMMKELFKMTPPADDEDTIMKNFQRYCENRITEIERLEPKYENYAYPGKEILKKGKKRFSALVQIQAPLEFFKTVFDEQDILMDFSEDYEPVRNFFGGEQLTIFTRALDMLNIYEDSKTYIVDAELEDVVAKMRTIVRMAKPYKEIPKLPELREKFMHCYMRILDEQAEPVKDSISQDQSRVFEVLNTKPYKDAKFNRYLELFGEIMDGAEHCNNVSTLRSYADKAETLKLRLLNEMTEEDNRLAKEAAAKAEAERKRQEEEAKKRGETVKSAEKMAEAQPEYKVRTTKNISIKTVAKTASWRLESKDDVDKYLAALRENLLKEMNEDTIVNIEL

SEQ ID NO: 964 - protein, 1151 aa, Vibrio cholerae; identical to SEQ ID NO: 825

SEQ ID NO: 965 - protein, 1151 aa, Vibrio cholerae; identical to SEQ ID NO: 825

SEQ ID NO: 966 - protein, 1213 aa, Enterobacter sp.
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERNAYSFFEDKIKDALFLADINKAVHHPTEVILFNIDSRANVDDKEDAILKVFLKVFNERVGYCADFPHIAHLERELAKRGQYDAFKTAFSTITGSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAARPALAKVWQEKGDILRNQLAFDPTTTASLRPYTSEEEFIDNYPFVPWHYQILQKVFESIRTKGAAGKQLAMGERSQLEAFQTAAQQIAPRGLDSLVPFWRFYAAIESFLEPAVSRTITQACQNGILDEFDGNLLKTLFLIRYVDVLKSTLDNLVTLSIDKIDTDKVELRRRVEKSLNKLEREMLIARVEDKYVFLTNEEKEIENEIRNVEIDFSAINKKLASIIFDDILKNRKYRYPANKQDFDISRFLNGHPLDGAMLNDLVVKILTPKDPTYTFYNSDAACRPYTSEGDGCILIRLPEEGRTWTDIDLVVQTEKFLKDNAGQRPEQASLLSEKARENSVREKMLRVQLESLIAEADVWAIGERLPKKSSTPSSIVDEACRYVIENTFAKLKMLKPFNGDIAREIHALLTVENDTELDLGELEESNPEAMREVETWVSMNIEYNKPVYLRDVLNHFARRPYGWPEEEVKLLVARLARKGKFSFSQQNNNIERKQVWELFNNSRRHSELRLHKIRRHDESQIRKAAQLMADIAQQPFSEREEPALVEHIRQVFDDWKQELNVFRAKAEGGNNPGKNEIESGLRLLNSILNEKEDFALIEKVTSQANELLDFSEDREDLVDFYRKQFATWQKLGAALNGSFKSNRSALEKDAVAVKALGELESIWQMPEPYKHLNRITPLIEQVQNVNHQLVEQHRQRALERIDARIEESRQRLQEAHATSELQNSVLLPMQKARKRAEVSHSIPEILAEQQETKALQTDAEKKINQWIDELRKKQEAQLRAANETTRAAESQQTYVVAEKPVIQPVPKKTHLVNVASEMRKATGGEVLETAEQVEKALDTLRAVLLAAIEAGDRIRLQ

SEQ ID NO: 967 - protein, 1223 aa, Enterococcus faecium; identical to SEQ ID NO: 882

SEQ ID NO: 968 - protein, 1151 aa, Vibrio cholerae; identical to SEQ ID NO: 825

SEQ ID NO: 969 - protein, 1195 aa, Bacillus cereus
MQIQKMFEKEITRDIKGVIKVGQDDEKNIYQELDEYVVTNELLHHMGEFFKSYKKGITGHTDKMGVWISGFFGSGKSHFLKILSYLLENKHVMDEKEIDKDAISFFNNKILDPMVLADMKLAGNTTTDVILFNIDSKSESDSKSDKNAIVKVFNKVFNEMQGFCGSIPWIADLERQMVKDGCYEEFKAEFEKISGNTWGEAREDFYYEEDSIIEALSKTTKMSEDAARNWYERAEEDYFISIDRFAKRVREYVESRGNNHHVVFLIDELGQYIGNDSQLMLNLQTVVEDIGTQCGGKVWVLVTSQQDIDSVVKVNGNDFSKIQGRFDTRLSLSSAHVDEVIKKRILLKNETGKQTLRLLYSDNSSILKNLITFSGDTAEMKIFNNEEDFVDVYPFIPYQFNLLQKVFTGIRIHGASGKHLAEGERSLLSAFQESAMKYAESETGALIPFSVFYQTIEAFLDSSIRTVIIHAQNNSRLNEYDVEVLKLLFLIKYVKELPANLENLATLMIQNISDDKIELKKKIESSLIRLSKETLIQKNGQEYIFLTNDEQDVNREIKNMHVDSAEVIQKIGDVIFNVVYQDKKYRYSPKYHFSFNTIIDDRPIGMQTNDIGLKIITPYFDATTELNDSELKMMSIRESNVILRLPQDTSYLDEMTEILRIQAYLKIKSGTAVSQAIEDIKVRKSREANERKERVHTYVKEALKHAEIFVNSQQLDVKEKNPVERINDAFKVLIDNLYNKLHYVKKFIDTAKQLNELLVENSTQLTLSGDNEDANQLAVKEVNDYIARLTTRNQQITIKGITTHFTKQPYGWKDLDIVSFIIKLFKGQEIKLQLNSSNLTTSERDLVNYLTKRDYVERVIVKKRERISPALMKVVKNLSKEVFEVTALPDDEDGLMNRFKELLTSEQNKINVLLVQYRNTFYPGQDVLQDGKESIEQLLNISDTTSFYNKAKQLQNDFLDYAEDVEPVKAFFETQRDIYDDAVKRLNIFEKNQTYVTDQKVTGFIESISKIVKHKEPYRNIHQLPGLIKEFDELFVELLEKECEPIKKVIEADYETVLEELNKHEEIKSALFNKFKNNFDGIKDRLNRVNNFYEAIAMQTESDRLKVRSIDDIANEVERRKPLVTPPPTVTTGTGGATVIDPIVEYKAKKKTISKNTILRGTKIIENEEDIEAVLDEIRKQLQKELEDASVIKLV

SEQ ID NO: 970 - protein, 1223 aa, Enterococcus faecium; identical to SEQ ID NO: 882

SEQ ID NO: 971 - protein, 1213 aa, Salmonella enterica; identical to SEQ ID NO: 703

SEQ ID NO: 972 - protein, 1151 aa, Vibrio cholerae; identical to SEQ ID NO: 825

SEQ ID NO: 973 - protein, 1151 aa, Vibrio cholerae; identical to SEQ ID NO: 825

SEQ ID NO: 974 - protein, 1213 aa, Escherichia coli; identical to SEQ ID NO: 835

SEQ ID NO: 975 - protein, 1213 aa, Salmonella enterica; identical to SEQ ID NO: 703

SEQ ID NO: 976 - protein, 1188 aa, Bacillus cereus
MLQDSFTIKELFKKEIDREINGVVQAGQRDEDVIQNELEEYVMTKEISENMAYFFKNYAYSFENQTTKMGVWISGFFGSGKSHFLKILSYLLNNEKVYGKRAVDFFVNKTDDQELLDILQQSANYKSQAILFNVDSKSASGKKEKATIVDVFFKVFNEYLGYSSTPWIANLERQLAEEGIYNQFVERFEEIDGTKWIDSRARLLFKKKSFVEALTQLGYTADTAESVLSASNKNFEMSSTDFAKLVAQHVKNQGEEYRLTFLVDEIGQYIGDDTNLMLNLQTVTEDLGNHCHGKVWVIVTSQEQIDAVTKIKGTESFSKIQGRFATKIHLTSSNTDEVIKRRLLEKTAATADRLQIDFDQIGQSLNNTLTFEKDKSVLQNGFKEADEYASIYPFIPYQVELLQRVFNKVRRQGEAGAHLSQGERSLLNAFQEVAIQLKEEDTNQLARFSQFYETVKRFLSTSVSATIIEASKRDGITEFDIEVLKVLFMIKGIDEVKATVENITTLLVDSVDCIKNELEKDVKQSLYRLRQKMLIAENADRTFVFLSDDEQEINREIQSEHVNEANVVDALGRVFYEEIVQVKSYRYQKTHDFEFNKAFDTYNRGGKTNTLTLQVYTGDVSEEQARADANSGTMIMYIPDHYAEKFFEPMEYAQKIQAFANKKISTSLTEKQKRVLEEKRQQISEFEKKAREALAEAATNAKYFIQGQDYEFKSTLESQLQSAFEILVRNTYSYLGYIDEPVPVKNANDIILEWATKGLPARLDGTFGNHLAYDTVVRFLEENRGRQIVTMKLLVEKFKDVPYGWSENDIAGMVAAALYNKKIKLMYLNESFDITNSQFIPRITKASEREKVVIEAQIGIPSRVRKEVVETMRELFNFYDIGETYDEVAKSIRNQIQKHFIEPIEDMQRMKQREDQQYPYPGGIALSKIKNSIVDLLAITKQENFVEEFIELDEDLEDWLEDVQHLNSFYNGNAIRHFDESVRVLKERRDDLDVAQHDAEVQKVKNSIVNILTSDNPYKQIPNLPILNEQLKEGLSNFVKRELGTQLMQMEVIRRDMESLQTRYENIDSIKEVVQEKIVELQKRIEQMEDLESISRVYTYTQMANNDYRRLEEKVQELHKDYTHDPDDPNGTDQIVVVEMSVSQLMSAAVPTGKIEIKNSQDLKKWLKNLEDEINKELDQRKVVMIKN

SEQ ID NO: 977 - protein, 1210 aa, Lactobacillus rhamnosus
MKIKDLFKRPIDRNIQGVIKVDQDDEANVKQELDEYVVTRELRDHFAAFFSAFDNSLQTPTDDMGVWISGFFGSGKSHFLKIVSYILANKIVDGKPAVDYFDDKIDDQMILNEMHAAAAANNDVILFNIDAKAKDTVGSDKQSILKVFMRVFNEMQGFTDADFWIADLERRLTEAGKMDAFKEQIKAIDANHQSWIELRDAYYLNKGTIKEAMVKSGFSDEANAQGFIETLSTEYQISIDDFAALVKQYIDKTGRRVIFLADEVGQFIGDSVQRMLNLQTIVEQLGTMTRGKSWVVVTSQQAIDKVTDIASGQDFSKIQGRFKTRLSMSSANVDEVIRKRLLEKTDVAEQMLEDQYSANAAAINNSIDFDDGVERPKYKSPKDFAQNYPFIPYQFNLLQQVLTAIRENGSDGKHLSEGERSMLSLFQESAEAMMDADTETLAPFSRFFDGLEQFLDHTHHIVLVRAHDNPAVNPNDEKNPFALQLLKVLFMVKYVTDFNASLNNLITLMISSVDADRIALKKKVSDALEVLVGQGYVEKTVKGYDFLTDAEQDITREISKQEVIDNEVAKEIGDYLFNAKPGIATSLTYPKLNGRYVFAFNRKTDNIFGAQRNKLSVHIITPVNDEFQSDNDYLQVSTGAWNHDVLIALPRSSNFVDEIRNALRIQKFVVNSSASSDSRYQGMVLARQSQQNEEFQHAHEQLIASLDNAAIYENGQLINGEAGFDSRLEQAMKLLVDNTYRSLQYITVAKSEKDIRELFESISSLALDEQDNQAAVDAVLDYMRRESQNNTHITMESILSKFNDIPYGYTDEDIQWLVAKLVAIGKLKMFYNGTVIDPLSGERTPREIAGFFTKKQAIRNLAFQIKEEVAPSKIKAMQAVASEVFGKKSFEADNDEQRAAELRKLIVTKYQTLKTFEDKPQDYPGHVLLQQGLQLLRPMTEMSDSGAFYDYISKHKDDLLDWNDDFLDDGIRDFYYSQSMQDIWDKGLNALRVYRESSDFLSDNQLQDTVDKMAKLLRLQRLQGDTAVKISELNKQFDELFSAAFDKTAAGYLADIDDFRERGLTRIEKSAIPDQNVKDKLAHDFENRIKAISEAATDATTLNEVVAKPAQASAQLDQLTDRINHAKAQLIPVPDHSDEDNTGGKHKDPDKPVVPKVVSPQEKIVKLEEVLHKGDYKITTSTDVDKLTAQFKRSLEAQLSDNTVVTLQID

SEQ ID NO: 978 - protein, 1214 aa, Haloarcula japonica
MSDTTSTYQINEIFYRPINRKIDRVVKVDNDDPSVVKKELEEYILTPQLERHFSDALEAVIDTEHAQTEDVGMWVSGFFGSGKSHFMKILGHVLENREFGDTYAAEMFRDRIEGNEMLDGAVSSVTNKFDSEVLMFQIGAKADASGSESITEIIHREFNTSRGYASMPWVAQMEQELESRGVYDDFVATIESNTGKDWTEARKDAMFVRSDMETALVEATDEFDDEDDAARAIDDVQDNVLINASTLAEDIVEYVEQQERETGNNSRYFVFIDEISQFIGDDGQLLLELQSIVEEFGQKGKGKVYLGVTSQEQLQQLIPGVLEKEAEESKVIDRFPHRFDLTSENLDKVVRDRVLSKKGDAREAIGNLYDQHEGILSARYKLDSGQSLKPITRENFIDCYPFLPYQLDILPEMFKALGKGSDDQLAGSERTLIDVTQSVLKDEAHLYNDELGALVTLDMIFDEISNDIPSNDVKSIREATPKNADPEIASRVLKSLYLLQQLPWIPNTADNIATSLQTELGPTKQLENDVQDTLDALVEAGLVGRSEEGYRFLRETERELENEIKSIEVGPGDIRRSSKRFLNDILDETSRVNYQGKTFQLNLSIDGETITSNGHVDLKTYSPIHQRYEDLDPDGLKTQSFSEDDTLYWIADGEKQHSIYEKLKSIYQINTVVKSKRGNELSQEEQEALGQKQEDLQRLRNEVEREFKRSFQRGTLIYNGDTEEFDTTSTSLSSLVSRKTDNAIPKVFSSFKHGSATVKDRHIEQIFEDLQGSSNPSVFSDLGVVQDGDLIAEARIASEVEDEIQRREKAGESRSGSDLIDHFAEPPYGWSREVVRLAAAVLFRNGSVIPTHKERTYETYSEDGAQELFTQVTKFKSTSFDERETVDVETRTDAKQLLDRLFDRKVKSTDQAVDEGIREAANEWVSTTSTLLSQLQRVDFPLADDVEQFQTRLNNLLQQPTSAKRIKQFVDFEDELEGLTKTAKDVAEFCGETGGQNRLETYETIQRFITTEWESLVDEADDHAGLVDISDEAREAARRVADTLDTEGVISQWNNVKTDYRTTAEAFTTTYESLYEKRHETYTESIELVRAYAGSDIDETDLDTALSDLTERQGDGSVDLNISNEEHINPTPSLPRLIEHIQTVDSYEDAAKAEIDDLEDDEDDGTVRESVDIDSIFGSIVVTDPDDIDQPISELRAETEELLDQDGDIEIRFR

SEQ ID NO: 979 - protein, 1210 aa, Lactobacillus rhamnosus; identical to SEQ ID NO: 977

SEQ ID NO: 980 - protein, 1213 aa, Salmonella enterica; identical to SEQ ID NO: 703

SEQ ID NO: 981 - protein, 1219 aa, Vibrio tubiashii
MNIKELFFKPLDRSINGVVKADQDDDATVYQELDEYVVTNELEKHFRDFFQSYGTDLNDPSIANRVGVWISGFFGSGKSHFLKTLSYILANTVARDSEGNERSAVEFFDEHKIRDAFIRADIDKAVSGHSDVILFNIDSKASSNDDGNPILNVFLRVFNEHQGFSGDHPHIAHMERHLAQKGAYETFKAAFEESSGLSWTEERDGYQFYQDDVEKAISKALNLSPDAAHKWFEESEEAFSVSVENFCHWVKEYLDSKDPKHRILFLVDEVGQFIGSNTRLMLTLQTITENLGTICKGRAWIIVTSQADMDAVLGELSSSKANDFSKIAGRFKTRLSLSSSNTDEVIQKRLLRKTPEAADMLKSVFDQKGDILKNQITFDRSGPTLKNFDGPDSFVNNYPFAPYHFQLVQKVFEEIRKVGATGAHLAYGERSMLDAFQMAASSIAKEEVGALVPMHRFYSAVEGFLDTAVKRTIDQAGENATLDSFDVQMLRTLFMIRYVDLIKGTLDNLVTLSIEKIDDDKLALRKRIEESLQRLEKESLITRNGDEFLFLTNEERDITQKIKATDVASSEENKELSNLIFKDLLRDTNKYRHQPNKMDYSIGRYLDGHTLDGKYEADLKVEVVSPLDTDYSQYSEAGCINKSAEGEGQILIKLGDDKQFFSELRTWLKTNKFIRLNDDGTQADITRILADRGRENQERKKRLRARMEDMLLKAEVYALGQHLSLSSSNALTKLDEACRYLLENTYTKLSYIKVYQQDPWRELNAVLTVDDIGQMGLSLEGEEGNPKATRDVEQYIGLRATGTERILLSDIVERFAKRPYGWPDAEILLIVGRLAAAGRISFQLGGGTLPVREALEPLQNTRRRREVSIIKKRQTDEAVLKQARNLTQDLFSSMGPATEKELFEFYTQHFSKWLANLKSYKSKTDVGRFPGKTVIEQSILTLERLLSNDDSFDFFKQVVDKKDDYLDLEEDYRDIHEFFSNQIHTWQQLQQALRHFDKNRQALEKDAEASKALSELQSIESADAPYGMLHKVASLVSGVETVNERLLTEKRTHAIERVDDKIKQLEGEIAKSGIGSPELSNRLLRPLQLVKADLETETSIAGIYMLQTETATERFDDGLYELERAVQAEIERRAKAEQAAKAQQTAPTGADTSTPIPDTKPEPPVAKPKPVVEVNVSSVYNKTCEGVYLETEESIDQFVEALKTELKSIVRNEKRVRIR

SEQ ID NO: 982 - protein, 1151 aa, Vibrio cholerae; identical to SEQ ID NO: 825

SEQ ID NO: 983 - protein, 1151 aa, Vibrio cholerae; identical to SEQ ID NO: 825

SEQ ID NO: 984 - protein, 1213 aa, Salmonella enterica; identical to SEQ ID NO: 703

SEQ ID NO: 985 - protein, 1213 aa, Escherichia coli; identical to SEQ ID NO: 660

SEQ ID NO: 986 - protein, 1221 aa, Lactobacillus reuteri; identical to SEQ ID NO: 677

SEQ ID NO: 987 - protein, 1151 aa, Vibrio cholerae; identical to SEQ ID NO: 825

SEQ ID NO: 988 - protein, 1151 aa, Vibrio cholerae; identical to SEQ ID NO: 825

SEQ ID NO: 989 - protein, 1213 aa, Escherichia coli; identical to SEQ ID NO: 657

SEQ ID NO: 990 - protein, 1223 aa, Enterococcus faecium; identical to SEQ ID NO: 882

SEQ ID NO: 991 - protein, 1151 aa, Vibrio cholerae; identical to SEQ ID NO: 825

SEQ ID NO: 992 - protein, 1188 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKGDILRNQLAFDPTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNTDAMREVETWISMNIEYNKPVYLRDILNHFARRPYGWPEDEVKLLVARLACKSKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAAESEQTYVVVEKPVIQPVPKKTHLVNVASEMRNEPPRVSWRVFYL

SEQ ID NO: 993 - protein, 1189 aa, Sphingobium indicum
MTILRDIFEKPVDRPIEGVIKADDDASLRIELEEYVLTNEIEKQIEKFLDAYKNYTTANGVWISGFFGSGKSHLLKMLAMVLENRKVDGATAYELFKDKCADNEILSADLKRAVAIPSRSILFNIDQKADVISKDQIDALLSVFQKVFDEACGYYGKQAHIAQFERDLDSRNVFSAFREAYQAIAGKPWERGREQALLEGTNIANAYAKATGADASEAAGILTKYRSDYKVSIEDFADKVKAYIDAQGKDFRLNFFVDEVGQYIADNVKLMTNLQTIAESLNTKCRGRAWIIVTAQQDMNAVIGDMNERQENDFSKIQARFANRMPLNSADVAEVIQKRLLKKTELGVESLSDLYRRESNNMRTLFDFADGSIHLKNFEDRDHFIHSYPFIPYQYPLFQMAIQGLSQHNAFEGRHSSVGERSMLGVFQEVAIHLAELELGQIATFDLMFEGIRTALKSSVQQSIQIAERNLGDEFATRILKALFLVKYVKPFKPTARNIAILMREKFDEDETALKRRVEAALSLLEQNTYIQRNGDLFEFLTDEEKDVEQEIKNVDVDAAEVARELEALIFDGVIKDRKIRHDGAAHDYSFARKLDDRLQGRDYELSINVVTPFHEHSGNAEALRMGSMSKDELVILLKADDRFARDLVMYKQTEKYVRQTRATAPQASIERIISEKGQQNANRYRDLSTRARTLVAEAQLFVRGEELDLRGEDPQARVRRAFQMLVDKVYTNLPMLRGATFAETDIGRFLRQTNDGALISGASNLTEAEQEILNFAQGNVRTGVRTSVKAIVEKFEVKPYGWPNAAILCTVASLFAHGKLEARSDGAPLEGDALEKALKNAHALANIVLDLQVEFTANQVRTLREFYAEMFDSQPVASEAKALGKETGEAITKLVAQLVALEAQLQDYPFLAAITPVIANLREVESKAYGWYFTDLARHADALLDAKEQVIDPIRRFMGGAQRKIYDEARNFLAEQVTNLSYTGSTQAEAIRAVLADPLCYKGNAIQQVKAELDKLRANVDALLVQERDSALKGLTELKAKIEAVPEFAQLDAAAKAGILSECEAAETSVRNAKLVAMIRERTANFRSETYPALLGKVARLATPPAPPAPPATEPPQSGESKVREAPAGGIAPQPAPAPSPVEYVSTANLKVSFASPYLASEADVETYLQAYRETLLAEIRSGKRITV

SEQ ID NO: 994 - protein, 1151 aa, Vibrio cholerae; identical to SEQ ID NO: 825

SEQ ID NO: 995 - protein, 1151 aa, Vibrio cholerae; identical to SEQ ID NO: 825

SEQ ID NO: 996 - protein, 1213 aa, Escherichia coli; identical to SEQ ID NO: 830

SEQ ID NO: 997 - protein, 1184 aa, Sporolactobacillus vineae
MQIRDMFKKKIDREIEGVVKIGQEDDARVRQELDEYVVTNELAGHLSRFFSTYKDSIHHPTEKIGVWISGFFGSGKSHFLKILSYLVENREVDGRHAVDFFEDKINDPIVLADMKRAANGDTDVILFDIDAKSESSIKTKKDAVVNVLNKVFNEKQGFCGSIPWIADLERQMTLDGKYDDFRKVFHEISGRAWEEARDDFYYEEDAIIKALSRSTQMSETSARGWFDHAENDYTISIDRFAKRVKEYIDRKGNDHHVVFFIDEVGQYIGDNSSAMLNLQTIVQELGRQCHGQAWVVVTSQEDIDSVVKVKGDDFSKIMGRFTRLSLSSAFVDEVIKKRILEKTPKAALLLNDVFESKESILKNLLTFSDKGAEMKKFRDAEEFVADYPFIPYQFNLLQHVFTGVRLHGASGKHLSEGERSLLSSFQETAVHYADREEGLLVPFSAFYDTIKGLLDSIITNVIVRASNNERLTPDDVDVLKLLFLIKYVKEVPANLENLATLMVRSIDEDKIDLKKKISVSLGRLIHETLVQRNGEEYVFLTNDEQDVNKEIKNMHVERSEVIQQIGEDLFHSIYPTKKYRYSAHYNFPFNTMIDDRPVGSQSAEIGLKVLTPDYDAENDLNDMQLKAMSMRENNVILHMPAETDYLDEMEEVLKIQAYLRLKSGISVSQTIEDIKTRKTREVTDRKNRITLSLNNALETADIYVYGEPLAIKEKNPVDRINEAFHSLIRNLYHKIDYVTKFTENKEELLQLLKHPEEQMTAFDEDVPNHLALQEVDAYISRMAARHEDVTVKSVIRYFAGKPFGWMDLDTEALLIRLFLGQSIKLLLDRVYLQPNDRQLADAFTRRDLIDRVIVAKREKISPVLLKAVKDLCQMLFDRSAVPTDEDGLMQAFKHLLNQELQHLNAMLNVYRDHTEYPGKDVVISGQQAMQSLAALGDAGTFYKQAYKLRNTFEDYADRIKDVKGFFGNQRDKFDSAYRLMKVYEKNRTYITESDLIETEKEIEHIIENTTPYGQIQKLPVLCDAFRDSFMNQIEKESKPVEKNIDHDYQDVLAELEKDPISKEKFATTFRQEFLDLKDRLLKADSIIEVIAGREESDRLKLRCMDQIEDEREQRVTVPVGPDPDNTGKPPVVKERQKKTKTISKHVIMRGTQTISSEADLDQFINELRKKLEAELDENTIIKLV

SEQ ID NO: 998 - protein, 1151 aa, Vibrio cholerae; identical to SEQ ID NO: 825

SEQ ID NO: 999 - protein, 1163 aa, Streptomyces sp.
MQLNAIFAKDVQRPIEGVIKADDTAHLGTEVDEYVLTNEAAKGLEPLLEAYTNYTNANGVWISGFFGSGKSHLLKMLAHLLGDVDGQEFARERVSESFRSKAQGAFLPALLTKADRIPAKSLLFNIDQKATLITKDQGDALLKVFVKVFDESCGYYGNQGHVARFERDLDNRGQYGAFKAAYAQIAGRDWAHGREEGVLEEANVAKAYAEVSGQTEGTPTNILTKYRNEYSVSIEDFANEVKAWIDRQAVGFRLNFFVDEVGQFIGSNTHLMLNLQTIAESLNTKCQGRAWVFVTSQEDMDKVVGDRTKQQGNDFSKIQARFRTRVKLTSADVEEVIRKRLLEKNEVGESALATVYAEQHANFKTLFDFVDGAKIYRNYTDEVHFVGTYPFVSYQFPLFQAAIEGISDHNVFEGRNSSVGERSMLGVVQQVAKDVGDVEVGRLATFDHMFAGIRASLKSAAQRSIDVAERNLDNELAVRLLKALFLVKYVEGFHATPRNLTVLVYDRFGLDLPALSKQVQEALTLLETQTYVQRNGNVYEYLTNEEQVIEEEIKNVDIDASEVSGRLSKILSGEVIRTSKLRYAKNGQDFAFGYKLDDQVYGQQRELTVHFITPEYPYGPEEIRMHSAGKDELRVILEPDERALSDLRLLIKTEKYTKRKQTTSLSPIEDQILRSKATQNAEREKELVTRIRRAVGKAELVINAADVASTSQDAVVRVTDGFQDLVSRTYTQLKLLGGITYSEQQVASFANPDPSGIFDDSSLSQLAIPGEEVLSFVLRRDRLGEQVTVKTIAGAFQAKPYGWDLASIEVVIAWLVGASKLTAIVDGNALKRTEVAAVLRNTQKHSHAVVAPQKVFDGRQVAALRTFCTDFFDEATAAPKDPLELARHASDKLRGKLDELKARVNGSKYPFVEQLAAPIALLEQVVDKPDEWYLTEFGLGDELLDAKESVIDPIQSFLNGGQRAIYDEAATLLAVGTNNLGYLPVGSDTEVKRLLEDPNAFRGNRMTQLKQAADALGKQVDEALATNRATVIKAIEARKTEVLGSAYYENATEDAQQRVIHTVDQVVDRVCNERQIGLIREQGNSFEEETYPALLDQLVSSARPAGDTDDPAPAPPKQTVSVKTITVTGAHGVLETAEDVDRYLDALRSALLSTLNAGKRITL

SEQ ID NO: 1000 - protein, 1213 aa, Salmonella enterica; identical to SEQ ID NO: 703

SEQ ID NO: 1001 - protein, 1223 aa, Enterococcus faecium; identical to SEQ ID NO: 824

SEQ ID NO: 1002 - protein, 1213 aa, Escherichia coli; identical to SEQ ID NO: 660

SEQ ID NO: 1003 - protein, 425 aa, Bacteroides xylanisolvens
MHKIQDLFDPTKQLNRTIESVVTFGANTEQDLSSEIREYVVTDKLHKNYEDVITDLQTAFDDSSKEVGIWVSGFYGSGKSSFAKYLGLSFDKSVMIDGVSFGDKLMSRIQDTAITAMHRTIISRHNPQVVMIDLSTQSVAGKIANVSDIVYYETLKLLGVTKCTDQKVMCFIDLLHSEGKYEEFCRLVETEKNKSWESVESNDLAANLIAANLAPRVLPAYFPDSASFKNINLSSALNEKERFVRLHKLVKEKTGKDKIIYVLDEVGQYVASNVDLILNVQGMMQIFKDEFRGDVWVIATAQQTLTEDNRQAQLNSNELFRLNDRFPVKVDIEANDIKEIITKRLLGKSKDGSDYLKRLFSQNEGLLKNSIHLTLQERSIYNQLLTDETFTNLYPFLPVHIDILLSLLQKLASRTGGSAYVQSFV

SEQ ID NO: 1004 - protein, 788 aa, Escherichia coli
MGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQCLLEAHATSELQNSVLLPMQKARKRAEVSQSIPEILAEQQETKALQMDADKKINLWIDELCKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 1005 - protein, 363 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVICGGRAWVIVTSQADIDAAIGGMSSRDGQDFSKIQGRFSTRLQLSSSNTSEVIQKRLLVKTDEAKAALAKVW

SEQ ID NO: 1006 - protein, 1219 aa, Bacteroides sp.
MHKIQDLFDPTKQLNRTIESVVTFGANTEQDLSSEIREYVVTDKLHKNYEDVITDLQTAFDDSSKEVGIWVSGFYGSGKSSFAKYLGLSFDKSVMIDGVSFGDKLMSRIQDTAITAMHRTIISRHNPQVVMIDLSTQSVAGKIANVSDIVYYETLKLLGVTKCTDQKVMCFIDLLHSEGKYEEFCRLVETEKNKSWESVESNDLAANLIAANLAPRVLPAYFPDSASFKNINLSSALNEKERFVRLHKLVKEKTGKDKIIYVLDEVGQYVASNVDLILNVQGMMQIFKDEFRGDVWVIATAQQTLTEDNRQAQLNSNELFRLNDRFPVKVDIEANDIKEIITKRLLGKSKDGSDYLKRLFSQNEGLLKNSIHLTLQERSIYNQLLTDETFTNLYPFLPVHIDILLSLLQKLASRTGGVGLRSVIRLIRDILVDNHLADATIGQLAGPEHFYDVLHSDMERNSAKEIVISADKAISIFNGDKLAVRICKTIAVMQLLDDFNLSFDNLCALLYNNVGSTFDKSKVREAIERIMDSTSVTLQEIDGKYQFMTNAILSIREERNKIIPRDAEKADVLQEQLKDMLSPAPSVNVYSSKTITAGVELTERNRPYNIHPTTSGLKLNIRFVDGSAFDETHQQLLTESTRQENNRTLYWLCTLAKDKETILQEIVRSQNIKNRHQNETNKEIQAYLRAQTDFADEKKRELNKILREAQANSEVIFRGSPQQVNGETYKTVALKTIAEKVFEKYPLASSNMKGDCVNKLASYGDLTTIPDALNPFKIIKKTDGTIDVSHPAISEIKDYIATLNEVTGSEIMNRFERDPYGWSKDTIRYIVALMLKANIIQIRVAGKNVTVFGDTAVEAMATNNSFNKISVLLNTEGALTTTELLKAAQSMTGLFNSSRVAPVKDQIAKEAYKKIKLYLQKFNRLLPDFEVLKLDGESIVRQAINYAQRIIDSEGGEAAFLLGKDVDCQKAFKYVMDIIKCNEQASLINHLKHINHLANESHTLPEVEQLADYIKHVNDVRQLYHEYIANPDLHLIVSNITDLRNQFDAYLNQACIEFQTQTEKLLDESRTTMKSMPEYAKLDDKQRTQIDTQLDGLSIECTHPSISNLREMINKFVTYYLPSGSIKTIENRIRQYAADNAPAVKVIPTPPTSPQKGATQEDDATKPNKVEEPTYQPKRLQVKRKITTRTELQQVIDQLTSLLGEISDNSPVEFNFNED

SEQ ID NO: 1007 - protein, 1248 aa, Opitutaceae bacterium
MPAIIRDLIRRDITVKVEGVVKVFDRSALATELREYVLTDKIEEELKRILDTYTSVSDSLRRGGHSRDVCGIWLSGFFGSGKSHFAKILGYLLQNDAVTTGSTETCIDLFAKHLTDTSRGRDIRLRLAEVAKTTVARTVAFEIKSRQSLTNANSIGEILIGEFYRSLGYSENFVIARLERRLDRAGLLGKLEAAFQDKHDVAWRTPEGRDDLATVRRRLSKVLPAVDPASFPTEDDALNGLEDAFQYSKLTAEGIADELVAWVDEQKPSGGRSQHLIFVIDEMGTFIGDSNEKIGELNSLAEMIGNKGKGKVWLICTSQQDLEKVVDRTNFQPALIGRLNARFELKPHLISDGINRVIAERILKKHPSRESDLQALYQPSQGLLAQLADLKSTRNLGTLSERAFIDAYPFLPHQIQLAQDIGEALSGFRISGGVRSMISVIMEALQKLAPLPVGRLATFDQVFDALGNDLLSQEYLGASGVKSITDADSRITAPTSLPPSRVIKVLYLIQRVTHVPRTAENIAKLLTESITFDLPALRTQVEQTLTALQQAGYVARDESSGEWKFLNEKERTVEQAIQDMIRPGSSRSITTTAIRQQSIELIKGGVIAKRNLDNYAVTYGITKTAFFYAVALDGEAVDTGPEIEVAFVSPLAPGRKQAIEDLKRENQVAGPKSRKLWCVAALPENLEARLKRYQALLNVTGDKRFTDDPSKDTADALAEKRKERDDLQKTLTRDLHATFSSGTLYYGGKEVALDGTSSFSAELPKAVAQQLPNLFPRFAIADKPVDFTKQLKALLNPSQAALHQVAPDLHLFDTQGSLNKESALVATVLEVIKDLEADGIDAAGARLLEDRDAKGFKGFTRTPFGWPSETLRLVLAACFRVGTLFIERATAAGTTPLYDYKEAFDDFTKIRTFERTIFRLAEASLSVEQLKSASKELISLGVTGTPESGNALAAAIRGLGEKLIEGVRDAALRAEAGLPIGDAILGGEKTLQSPATLKDPTKAVLAFLKVSAEWRALKQGLDELKAFLDANRHKDFETTQKLVAVITDHPLPADAADKAALDQSLADLAAITTAKTVVSRWADYRAARDQVTTVYGAAYHSAYGDLRKRATEAADTVRSGSAYAAAPADKRDAVVAATFDSGGSCHFPEIDVATLPALLAATAKASLSSLANAAKALPAHRAEVEAALRALKSPPPALKPDQKTYTWHPATDLTGRRFTTEADVDSVLSEIGDSLKKRIREGYSIDIV

SEQ ID NO: 1008 - protein, 1229 aa, Glaciecola polaris
MTIINDILTLDLKEDIKNVIDLEDRSETEIQHEIESYIVTEGIGRHLYEFTNQFTSNIKETGVWLSGFYGSGKSYFGKMLGYIIDNQIINGTPARERFIPRLKGVSDAGLIENALRNLDAINSRVVFLDVAKQNTERGLAFTLFANLLKNLGFRDDIYGYMEFDLLLDGKYDEFKTIVQKLESKDWDELKKSNRHVARVMRKVFAEMGYSESDYEDTKSVYSASIEDFSASKFKTELEKYLKFNAEETLVFVFDEASEAISQKKFTLLDLEGISESLSSISNKVWTIAIAQEKLDDVINNANVSRSSLTKVTDRFKTKIHLESTEVDVIIRSRLLQKTEQAKQDLVAYYQKNEGLISDATNLKSSFPTKTETAEDFAVYYPFHKYQFDILQKFLFSSNALVATQIAARGMIITTFDVLRKQMRDKELYSFTPGFAICDEAQTAPPVGLVNKYDTSRKILKENGSSIDGEKLLKTMHLLADSEVVAPTVENITKSYITDITSYYEVKPAIEDALKLLLEAKVLLLSNNNYKITSDLEGKMLEEMKDFDVELFSKKRELIKYLKDYKTFNAIASYNDGSDAFKFSVLSDQDDELAPVGSKHLKITAYSLFNISDDRQDFIEQLKLDTQYQKELITLVPDTSEFSQIDKLIGEVMRYAYMEEKYSNEKDADKRQIIREFEVIREEKQRTLRGLIQDAYHNASLIYMFDEHLLNVDTFKGTIADNQRKMVKNIYTKRLSSQLSDSLVSKIFSTHKESLNKLFTANDFAFFDGHGNFTGDHLKIVEEINAKIKSRYMDGKSLEADLSGAPWGYSYGTLVTTLAVLFRAGRLSVKFNGDTYFSHEQKAVHDAFTNTTKFKSASFKSITATLTAVQKNQAVQLLMELETQDHIGKKVDWNTNDFDLADSIRLMAEHFISAITNLSDTVQDFEELFPKVAGLKQDLQGFAGKVTESNYIEKVEYLLNNSDTFSDAVQAILKAQKFIKKNFPKVKEFKRFIDDVRSELIKADRSDNNIDEAYEEFERLFKLDMVKNFVNLQQQVQVVKDAYYKLVKTASIGMSHEYKVLSGKIEAAFRELKNYPAAPNRLNQQKLDSLKAYAEKRVVGEPVLAFSISCSNSGFSLSDILNYTAQAPLKDSELLIVQSSFITEEPQPEPLPTPQPTPNRDPDGSEPAPAPTPVQSPAPKQPRKVAFKVSSKVMTVQEYKTLLTTQLTALAAAKPDEEIELTIDINSEGL

SEQ ID NO: 1009 - protein, 1215 aa, Bacteroides coprophilus
MNTIKDLFDSSKDINRRIESVVTFADNSEENLKNEINEYVVTDKLHDNYEKVIEELESAFRDSSNEVGVWVSGFYGSGKSSFAKYLGYSFQQSLKVDGISFGEKLMNRIQDNALKTLHRAVIQKYDPLVIMIDLTTEATAGITSTVSDIMYYETLKLIGIKATDPKLMDFISILQEEGKYDQFCELVKAEGKDWEVIQSKKLIANKYAAKFAPVILPEYFSSSEEYNAIKVESVENETDRFKRLCSLVKQKYGKERIIYVLDEIGQYVGGSEDLIRSMQGTMQILKSQFKGNVWLIGTAQQTLTEDNPQAQVNSDKLFKLNDRFPIKVDIEADDIKEIITKRLLGKSPQGKEVLTDIFNRNEASIKLETRLTNMERSLYMKPLTSELFANLYPFLPVHIDILLALLQKLASRSGGSGLRSVIRLIRDLLVDGHLAECALGKMATPDLFYDALHPYMEKNQDFREIVISAKKAIELYSSNPLAVKVCKTIAIMQLLDDFCLSFDNICSLLFQQIGHPLNKPELRALLDEIKDTAGVTLQEIDGRFRFMTNAILSVQDERSRINATDSEKFKVMKELVHDILSPAPSVSIYGSKTISATVELCRGRQNPVLIPGGDIKLNVRFVDASDFEKVHNALLTESTKVENKQTLFWVCTLPQDIELLLIDVVRDETICNNHRHDTNKEIQDYLRAQQADADKNRQEITRILRQSQNNSETICKGSPTSVNGETYKTQALKSFAEQVYNKYPLASRSMSTSVVSDLLAYDDATKLPDSLNPFGIVGDNGVIETGHAAFAEIKDYIASNNDANGGQLSDHFSRAQYGWSKDTIRYLVALMLKAGIIVVRSGAQSFKMFTKNAAEAMKNNTSFSHLGLSLNTDAHLKPAEMMTAMTTLKELYNPQGLTPIPASIAKISLKLATQRRTKVEQLKDTFENLKMAGTSTVSQAVNYLVKIIESEGAEAPYLFAKDKACADALRFVNQVFKAEEQGKVITSIKKIQKRLNDAQRLPQLPTLEILKNQLGEDEQAFNDMMLDPICFNHTAEYADLASRIDNEIEQACMHFYTEATLFINQKNNEIRGSEDFSSLKEEQKQSIEVLMSRIAIQEGKTLELLQEMCNQFTAFYAPLGLFDSLERKVKDFVTANKPAVTTPAEDDDTNRPNESSNETNAESASGANEPIPTVVRRQIKRRLTQRQDVESLINELTRLLPQMDEGVSIDLSFID

SEQ ID NO: 1010 - protein, 1050 aa, Bacteroides sp.
MTLARHPTISSLPMLARPLAKLSITLPVAFIRFASSARMALANPASSSPWKTACVERLLEKNVLLSQRGQFNSFEQFSFINIVGDYTSLANLLASHLNAESKNVISVLDNHYNRLQKTNQFLVIVIDEFGKVLEHAAKNNPEKEMYFLQKFCEYVNDTSKNILFLTTLHQGFGAYAKGLKAEQKQEWTKVKGRIQDIVFAEPIEQLLNLTATHISSADKKPTLNTDKIYNLAVASKFAASTLDANVARALYPMDIVSAYVFTQANQRYGQNERTLFTFLETRGEGTVNDFEASINRLYSLADVHDYIVYNFYSYLQEAHEDSANWSAIKIAIERTEGLNADATTITDAIKIVKAVGLLNIFASSAASIDKQFLIVYASYAMDVCQVGSVIDLLEKNQILRFAKYKSKYILFEGTDVDLEAGLYEAARECKRPDVIAEKVCEYFDDKIALANAHYFRTGTPRYFQYCLTSSPIEYIVSGETDGVINVILPRQEDLVAVKAACTDINGKAILYCIFENTTEIADHLFEIDKLHWVRDYYVADENDKVANREIANLLVHEKSMLNKNIMESLFSDNVTWIFNGKILASITSRKMLAQQLSTICDSVYYATPIYRFELINKHRPTGNMSLARQSYLQALLDHSSEPYLGFEKDKYPPEKSLYLTLLKNTGIHTTAGLGSPTEPSFQPLWDACENFLRSTIGKPHKLGELFTLLEAAPFRLKQGLLYCWIPTYLIIKRDDFALYNSDGTYVPYINKEVLDLILRSPNGFLIKAFAVDGVRRTFFDKYREAINMGSSELSTQSFIETIRPFLTFYKKLNSYARRTKDISPNARKFRDVIAKATDPEKTFFEVLPDELGFKEITLSQNPEAIESFVAVIQEAIRELRNCYSELVGNIEQYLLKTLRLEEVGFSDYHHLIAERYKSVKTELMPVNMRNFQTRLVGNYDDKTTWIEAVSYVALNKPLTEIRDTDKSFLLATLKDMLFQLDDYVEMHKTASEDVIRLHITQNKSKAVTTQVILSEAMRQEVNSLENKLESILSGDNSLDVAALIAILKRN

SEQ ID NO: 1011 - protein, 1193 aa, Bacteroides sp.
MKLEAIYEKDINRTVNPAVSASDFSDKTVKTEIEEYVFTDEIINGLYKILSAIKNRNVSHDGIWINGYFGSGKSHFLKYLDYCLSSQYREMALERLLEAVKLRDPLQIPESKSEVEISDMRDLTIWLKDATVDTILFNIGTVHNIHGDQQRVFLDIFWSELNQFRGFNKFNLALAQHFEKVLLEKNKFDEFKERIKEEGFDWDLQASDLAINELDFILEIGKELIPTLSTDIIRERIIRDDTAVSVETFMNELKSYLADKGDKYRLIFLVDEVSQFIDDRKGLLLQLQQIVTELHKACEDKIWVACTAQQDLSEIVESCQISATSEDYGKIMGRFEVKVSLKGTQPEYITQKRILEKKPTAELRLGELYDKKKNAISAQFQLPTSYNAYQTREEFIGYYPFVPYQFKLIMQVFNSFVNLGYVEKEVKGNERSIIKVTHSTAKQTKDQEVGNFIAFDQFFNAMFQGSLMAKGQRSIQKANDMIQEYSDRAFGQRVVNILFMICNLSETDRLIFPATVDNITCLLMSDVDAQKLSLKNEVQKVLDFLCDKNIIRNEPAKQGVPETYCFYSEDEIEVAQLIKTQVIDNNTMAEELKEIFFAYITPAAREVFYSSRFTVGVNIMGKNFLSNNADINVEFVMDSDQDNPHTYAFSNTNNKMVFFMSELYKENRTLKNDFYWYCQVQKYMRTPVTSELRQKTREEFSKRAKDIYQRKIEKPFREIFDSCPVISGLNILEDLGSGKGPDRYKQVLNRHFANLYPQARLVDSTDMPRNSEELKSKIQRKVEIGDYNELNNTLTEAERQVENYLNRQVNDVNLKDIVTRYAAAPYGWNEICTIYIVNELVRRHLRDFSYNNNPNVERSIIANNILRDQAKFAVRPAQKISQDLINRFVESWKDIFGTVSISSGIDSNELFNQCKTKLAENIQNTENDCKRIARYPFVTVLNDTISELSRWNSEREPKKFFEQIINARQSAKALIDKRKMIGEFITDQLAKYKIICDFVDDNRDNWLFLPESCADTVKSLKSIINEPWPIDKMVPYNKMMRELNAHLEEVKKIKILEIERIYNDIFDRLEKFATSKNVDRNSFAKRDISIMQKKNSSNILMLENNINTSNDFYNEQLDIIIKHIPIPHIPKDKPESKDTKNEIEIVKQTRNVKLNIQTFEPLKSEAEIDEYLQGLKKQLMKFIDNNYEVMVTK

SEQ ID NO: 1012 - protein, 788 aa, Escherichia coli; identical to SEQ ID NO: 1004

SEQ ID NO: 1013 - protein, 363 aa, Escherichia coli; identical to SEQ ID NO: 1005

SEQ ID NO: 1014 - protein, 804 aa, Escherichia coli
MFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQCLLEAHATSELQNSVLLPMQKARKRAEVSQSIPEILAEQQETKALQMDADKKINLWIDELCKKQEAQLRAANEAKRAAESEQTYVVVEKPVIQPVPKKTHLVNVASEMRNATGGEVLETTEQVEKALDTLRTTLLAAIKAGDRIRLQ

SEQ ID NO: 1015 - protein, 363 aa, Escherichia coli; identical to SEQ ID NO: 1005

SEQ ID NO: 1016 - protein, 804 aa, Escherichia coli
MFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELCKKQEAQLRAANEAKRAADSEQTYVVVEKPVIQPVPKKTHLVNVASEMRNATGGEVLETTEQVEKALDTLRTTLLAAIKAGDRIRLQ

SEQ ID NO: 1017 - protein, 389 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLEASRQWVEQLDKNFPLDINNFCQWVKEWLDDNGKNILFMVDEVGQFIGKNTQMMLKLQTITENLGVTCGGRAWVIVTSQADINAAIGGMSSRDGQDFSKIQGRFSTRLQLSSSNTSEVIQKRLLVKTDEAKAALTKVWREKGDILRNQLAFDPTTTTALRPFTS

SEQ ID NO: 1018 - protein, 1208 aa, Thiorhodovibrio sp.
MEIKALFDSNKDIYRTIEKVITYGVSQETRLKAEISEYVVTESIEDQLGRLLDKMEAAMEAGGENEVGIWVSGFYGSGKSSFTKYLGLAFDDRVTIDGIPFLHHLQNRLKKSTTKARLAAVAKKYPAAVLMLDLASEQVAGATMEEVSTVLYYKVLQWGGYSRNLKVAAFERRAQKDGRHEEFLRLFSELTQGQAWADYRNDDLVVDSVMPELAHRLYPNLFHSPSAFSTETSAIIRFENDRVAEMIDIAREASGRDYIIFVVDEVGQYVGSRQNLILNLDGLGKNLKAIGNGKVLFIGTAQQRLTEDDASAALNSQQLFKLKDRFPIQIDLEASDIKEICTNRLLGKSPTGEAEVGRLFDQHGQSLRHHTKLEDARAYGADFDRQTFIDLYPFLPAHFDILLHLLGALAKSTGGIGLRSAIKVIQDILVEGPDGKTPIANQPLGWLATTVTLFDALERDIRRAFVSWHLAVGKVKIRFPDSELHQQIGKSVCVLQILGNLPISRQNVASLMHPSVASPARKDHIDAAIEDLIKDAIVPMGEKDGVLAFHSEKLNEIEQERAKIPLRAIELRRIHNEALKETYNPLPSTQLNNTFSVQTGLKAQAASGIPASLAGERNPIQTLVELVAPTEVETAKTRLTDDSRQKTAKQTIFLLGRTTPEMDELIAEIVRSREIVNKYRNDPDQEVKDYCGAQSDRAARLINELGRQMSNSLIKGSFIFRGELSAVDSFNQDLIEAARKHLAQVAAQVFDRHAEAPIRVSTDLAEKFLRQGNLTGMTTQIDPLGLVKLQGGQGSIDVQHKALTSIKDQIERQGSLEGKRLSDLFADAPFGWSPDTLRYLVAALLVAGEIKLKLAGREITVNGQQAIDALKTNNSFKSVGISLRDNKPPMEMLARAAGRLTSLAGDTIVPLEDIISKTAAKLFPDLQHQFAPLAGTLRTLDLPGADRLEQLASDIKDVLATDASDAVQRLGAETSVLFDSLEWARSLKQAMAQGLETTLHDLRRHLQEISGLPNNGTPGQLRQALSEPIADLEQRLQHPDFAKYATEFASGLTELHTQVRDAVKLMQQDQAQRLLDAEDDLRRLPEWPALSHQDQNNALADLQNLATTASEDLTGLRDLINQDYSIQNEVQDIKRRIQQRGQKILQDRLREEQEQAVKDGQTTICRQQALQPRITSIQDLDQLIRDLQQLRGELKYAAEFELQLHMEQ

SEQ ID NO: 1019 - protein, 1166 aa, Cylindrospermopsis raciborskii
MTLKTIFQKPIDRPIEGVIKADDEASLRIEIEEYVLTNEIEKRLEEFLHAYNNYQGANGVWVSGFFGSGKSHLLKMLALLLENRSVDGIPVLHSFLPKCGENQMLRGDLKKAVSIPSKSILFNIDQKADVISKTEIDALLAVFVKVFDEMCGYYGKHGYIAQFERDLDSRGQYESFKSAYKEVAHRPWEEGREQALLESKNIAIAYGQTVGGDAIAGQGILDKYRNQYKVSIEDFAKAVLDYVEQQGKNFRLNFFVDEVGQYIADNVKLMTNLQTVAESLATKCRGRAWIMVTAQEDMDSVLGEDSRQQTNDFSKIQARFANRMKLTSQDVAEVIQKRLLMKNEVGKNVLSKLYDDQANNFKTLFDFVDGSQTYRNFQDRDHFIQSYPFIPYQFPLFQAAIQNLSAHNAFEGKHSSVGERSMLGVFQQVAIQISEYEEGQLATFDLMFEGIRSALKSSIQQAILQAERHLRNTFAIQLLKALFLVKYVREFKATQRNLCVLMFDRFNCHITDLRKRVEEGLNLLEQETYIQRHGELYEYLTDEEKDVEQEIKNTEVDKRAVAEELEKLVFDHTLKLKKIRSNSQDYPFCKKIDDRLYSRECELTIHIISPFNENAENEDNLCAQSMGRDELVVIIPPEERLMRDLIMYKQTYKYISQNVSITQKDSVKSILTDKNSQNRQRYTDLQQRVHTLLSKSKLILNGSYIEVGGDDPQNRILKGFEDLILKTYPNLQMLRGMVYTEKDLSEALNKPEQLREDTEPEQEVLASIQRNKDLGVRTTLKTLIDKFERKPYGWHHAALLHNVASLCARGKLEVRWDSNLLDGNELLKALTNTRDHMNIILEPQIDFTASQVRALKKLYTDFFNEPAPSGDAKLLGQKTATAISDLIDRLEALSTSHYPFKEKLSSAIARLRTINGKPYAWYLTDLIKQEDELLDLKEQTIDPICTFMNGSQRNIFDCAQAFIEEQEANFLIVNALQEKKVREILADSHCFRGDRMEQLKELVTKLRKEITTRLNREIEDAVAIIESLRSKLVATAEFHVLSSGQQTEIASSFDKYIKVIKNQKLIAVIRDRKSSFEQEEYKRLRQIVFCTQPGVVAEKANQYHTNQEKRLVGNWQEIQSLYVSHRSIQFSFDKEWLADETDVEQYVAVMREALLAEVRSGRRVQL

SEQ ID NO: 1020 - protein, 1188 aa, Microcystis aeruginosa
MTNIIELLTFTSTKFKGELIMQLSRIFEKQVSRPMEGVIKADANDEASLHVELEEYVLTCEVEKRLEEFLSAYNNYTGVNGVWISGFFGSGKSHLLKILALLLEDRRLENSQAIEKFLPKCRNNEILKRDLRKAVAIPAQSILFNIDQKADVTSKTEFDALLSVFSKVFNEARGYYGKQGYIAQFEKELDERGLYTAFKTEYESVAGKPWERGREQVILERKNIAIAYGKVTGASVENSTNILDLYRQDYKLSIDDFSQEVKAFIEQKTSNFRLNFFVDEVGQYIADNVKLMTNLQTIAESLATKCQGRSWVIVTAQEDMETVLGEMGNHRTKDFSKIQDRFANRMKLTSRDVAEVIQKRLLTKNEDGVRILGQIYEQQRHNLPTLFRFSDGSRDFRNFQDRNHFTDCYPFIPYQFTLFQSAIRGLSIHSAFEGKHSSVGERSMLAVFRKVVIAIEGQEIGHLATFDLMFQGIRSTLKSNIQSGITLAEDNLNNPFAVRLLKALFLVKYVEGFKANLQNLSILMLEEFEQDISHLQNRVQEGLNLLEHQTYIQRTGDLYEYLTDKEKDIEQEIKNTELEDNRILDALNNLIFEEILKTAKIRNQEGTQDYQFSRKIDGILYKREYELSIQIITPFFWQHEQEKALQMENMGRDELLVIIPSDQLLIKDLTMYKRTEKYVQQNISVTHQEEVKSILNQKNQSNQQNYEKIKNRLKSLLVQAKLFVSGRELEISSSDAQSRIILGFQKLIAEVYHNFQMLGGVTYKVEQFKHFLEPSQEGLFSNDVKDLSEPEKEVFNFTQKDKEKGLRTSMKSLTDNFQRKPYGWSEGAILCMVAKLCARGKLKVEREGNLLEGGALVEAICNSRNYSNILLQPQQKFTSSQVRKLKDFYEEFFAQPCGDNEPKAIYQKTQAAFKELSQSIQETLSEMDKYPFLSALEPARQTLNDVCNKPYDWYLTDLTEREDELLDLKEDVIEPILSFMQGEQKRIYDRAKLLLETQKPNFSYINSDNLSQLRTVLTDTQCFKGSRMQQVKGLIESVEAEISSEVTREVEQAQEEIGLLQERMGKMAEFSQLSPVQQQEILKSFQDCCDSIAQEDLIAMIRSTRQKFETDTYPRLLSKMTKLTGVDGVSSQATRRVKESETQYIPSQTIKVNFGKAWLADEADVEEYLSAMREALMAEIKEGKRIQI

SEQ ID NO: 1021 - protein, 1151 aa, Vibrio cholerae; identical to SEQ ID NO: 825

SEQ ID NO: 1022 - protein, 1151 aa, Vibrio cholerae; identical to SEQ ID NO: 825

SEQ ID NO: 1023 - protein, 1204 aa, Enterobacter hormaechei
MNIEQIFEKPLKRNINGVIKAEQTDDESAWVELDEYVITRELDGHLRQFFEVYAPATGPGRLQLADKMGVWVSGFFGSGKSHFIKILSYLLANREVSHNGVTRNALSFFEEKIDDALLLADIRKAVQHPTDVVLFNIDSRANVEDGVDAILKVFLKVFNELAGYCGDFPHIAHLERELDKRDQFDTFKAAFADITGSRWEDERDVYLMINDQMAKALSIATKQSEESSRQWIEQLDKNFPLDIKNFCTWVKEWLDIQGNRNILFMVDEVGQFIGKDAQMMLKLQTITENLGVICGGRAWVIVTSQADINAAIGGMSSRDGQDFSKIQGRFSTRLQLSSSNTSEVIQKRLLVKTEAAKPALEAVWQEKGDILRNQLAFDTTTTATLRAYSNSKEFVDNYPFVPWQYQILQKVFESIRTKGAAGKQLAMGERSLLDAFQSAAVQISADGLDSLVPFWRFYSAIESFLEPAVSRTIIQACQSPSLTEFDGKLLKTLFLIRYVDVLKSTLDNLVTLSIDRIDTDKVELRRQIEASLNRLQAEMLISRIDDKFVFLTNEEKEIENEIRNIDIEFTTINKQLSTIIFDEILKNKKYRYPANKQDFDISRFCNGHPLDGANLNDLVVKVLTPLDSNYESYKGVHSNSLLMTDSKDCILICLPDEARTWQDLTMYAQTKAFLSKQSGQRPEQATLLAEKGRENGMREKTLKAQIEGLLAQADVWALGERLDKKSSSPLAIVDAACGYVIENSFSKLKLLRLSTGDVNRETHALLTVENDTQLDLGDMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAAQLMAEIAGEPFNEREEQSLVSHIRELFGRWKSELTVFKTRAESGKNPGQKEIAEGLVLLNGILNEKEEYAVIEKVTAAAGDLEDFSEDWDDLVSFYKNQYATWQRLSTALNGSFKANRNALDKDETAQKLLQELEGIYSKARPYGELHRIIPLIETVETINQRLVEEYRSHALLQIDGHINELKQSMLEMLVPADLQHSLLHPMQQSRKKVEQNGLIPQIMEEQAEVRALQFKANERLNSWVEEQRKKVPVPKKSPQPGIIDPIDKPEPKLKKTIYVNTRKTMERAAGVTTLDNAEQVDKALEQLRKTLMDAINAGERVQLQ

SEQ ID NO: 1024 - protein, 1194 aa, Marinobacter sp.
MTLKSIFLKPVDRPIEGVIKADDEASLRLEIDEYVLTNEVEKRLEDFLDAYNNYEGANGVWVSGFFGSGKSHLLKMLALLLENRVLESQEMDGASTLERFLPKCIDNEILRAGLKRAVAIPSKSILFNIDQKADVISKTQIDALLAVFVKVFDEMRGYYGKQGHIAQFERDLDSRDFYQQFKAEYENVAGRPWQRGREQALLEGANIAKAYAAVTGTDQQSAMGILDKYRSDYRVSIEDFADNVNAYIEKQAAEGGHKEFRLNFFVDEVGQYIADNIKLMTNLQTIAESLATKCRGRAWIVVTAQEEMKNVVGELGKQQGNDFSKIQARFNNRMKLSSADVAEVIQKRLLTKTEEGVNQLSDVYRSQSNNFKTLFDFADGSATYRNFRDRDHFIHSYPFIPYQFALFQSAIQNLSQHSAFEGKHSSVGERSMLGVFQQVAIHIGDHQIGQLATFDLMFEGIRSALKSQIQRAIIQAENHLDGPFAIRLLKALFLVKYVKEFKPTVRNLCVLMLDAFDQDLPTLRKKIEEALSLLEQQTYIQRNGDQYEYLTDEEKDVEQEIKNVEVESSDVADELEKIIFDYVIKQRKIRYDAGPSQNQGQDYTYSRKLDDRLHGREYELGINIVSPFHEHTDNEQMLRTASTYKADELFVLMPSDERLVRDLLMLKRTEKYIKQNISVTQQESVKRILNDKGFQNREREARIKQQVQSLLSKSKLLIGGADVEVPNEDPQTRIIRGFHELIARAYPNLRMLRGVSYSENDISNCLKRAEDGLFGNDATALAESEQEVLAFIQSNNRGGVRTTLKGLLEKFERKPYGWYYAAILCTLANLCARGKVEVRLDGNILEDAELERALRNTHGHNNLVLEPQIEFTASQVRALKAFYEDFFDGPPRSGEAKALGKETGEAFQDMFHQLNPLAAQAGQYPFLSALKPALETLKDVAGKPYTWHLTELSKQEDQLLDLKEDAIDPIRKFMSGSQKDIYNQARSLLQSQEPNFIYVPGDEIEQIRSILNDPKCYKGGRIQQLKGQLDSLKERIDEKVNQTRSRAAASLNTMQERMQSMDEYQLLPEPRKAELNKPFQDLSEHIDGQQIIAVINDRLRFFEEEGYQKVLARMVDLANQKSAPPTDPKQAPGLKGADKPHQVKEPPAEYVHSRNLHVAYDKAWLADENDVDRYLASLRETLLQEIQQGRKVQI

SEQ ID NO: 1025 - protein, 1213 aa, Escherichia coli; identical to SEQ ID NO: 822

SEQ ID NO: 1026 - protein, 1213 aa, Salmonella enterica
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERHAYAFFEDKIKDALFLADINKAVHHPTEVILFNIDSRANVDDKEDAILKVFLKVFNERVGYCADFPHIAHLERELAKRGQYEAFKTAFSTITESSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWQEKGDILRNQLAFDPTTTASLRTYTSEEEFIDNYPFVPWHYQILQKVFESIRTKGAAGKQLAMGERSQLEAFQTAAKQIAPQGLDSLVPFWRFYAAIESFLEPAVSRTITQACQNGILDEFDGNLLKTLFLIRYVDLLKSTPENLVTLSIDKIDADKVELRRRVEKSLNTLERLMLIARVEDKYVFLTNEEKEIENEIRNVEVDFSAINKKLASIIFDDILKNRKYRYPANKQDFDISRFLNGHPLDGAMLNDLVVKILTPKDPTYDFYDNDAACRPYTSEGDGCILIRLPADARTWTDIDLVVQTEKFLRDNAGQRPEQASLLSEKARENSVREKMLRVQLESLIAEADVWAIGERLPKKSSTPSSIVDEACRYVIENTFAKLKMLKPFNGDIAREIHALLTVENDAELDLGEQEESNPDAMREVETWVSMNIEYNKPVYLRDILNHFARRPYGWPEEEVKLLVARLARKGKFSFSQQNNNIERKQVWELFNNSRRHSELRLHKIRRHDESQIRKAAQTMAEIAQQPFSEREEPALVEHIRQVFDDWKQELNVFRAKAEGGNNPGKNEIESGLRLLNSILSEKEEFALIEKVTTQANELLDFSEDREDLVDFYRKQFSTWQKLGAALNGSFKSNRSALEKDAVAVKALGELENIWQMPEPYKHLNRITPLIEQVQNVNHQLVEQHRQHALERIDARIEESRQRLQEAHAVSELQNSVLLPMQKARKRAEVSQSIPEILAEQQETKALQTDAEKKINQWIDELRKKQEALLRAANEAKRAAESEQTYAVVEKPVIQPVPKKTHLVNVASEMRKATGGEVLETAEQVEKALDTLRTALLAAIEAGDRIRLQ

SEQ ID NO: 1027 - protein, 1241 aa, Lactobacillus casei
MQIRDLFVKPIDRNIQGVIKVGQDADANVKQELDEYVVTRELKGHFDDFFAAYEKSINHDTDEMGVWISGFFGSGKSHFLKILSYLLEDRKVDGKSAIDYFKEKINDQMTINRIELAAQQPTDVVLFNIDSKAKTGAKSDDNAIINVFLQVFNEMQGFSSTNFWIAEMERQLVAQGKYDAFKDKFTELDNTHMDWTVGRDHAIFKKGTIKDALVQVDAYSEEDAQGLMDQLTTSYQVSIEDFSKLVAAYIKKTGKRVVFLVDEVGQFVGESTQRMLNLQTVVEDLGAATHGKAWVVVSSQQAIDTITDKISGQDFSKIQGRFATKISMSSANVDEVIRKRLLAKTEPATTQLAADYEANAAAINNMIDFDDGVDRPKFRSGEDFAATYPFVPYQFNLLQNVLTAVRTHGSDGKHLSEGARSMLSLFQESVEAIMDQQDTALVPFSLFFEGLRQFLDHTHSIVIAHAVDNDTVDPTHEEDNFNVQVLKALFMVKYLKDFDATLNNIVTLMIDSVDTDRVELQKKVQNALAILRQQRFVEKNLDNYEFLTDAEQEVNQAISREEVLPGEMEDRMGNFIFDPKTGMTNKYTYPKLKGRYNFTLNQYVDETPQGRTNNDMTIQVITSLDGANNRNEANLLLLSMDPSKHKIVVDLPSTDDYLGDLRRAEQIGKFVMLGNAHADARFNFIKEQRTAERQQLLVKARERIMTALEQADVYVAGHKIEGGKDFQGRFTDGLKMLVDDTYRSLGLIDAAKSSSDITQILDQDNESAVSTQENERAVQAVYSWLQQTMQKDKHVTLQAILNNFKAIPYGYIEDDIEWLVAKLLADGKIQANLQDQVLSPVNPAYRSQDIANFLTKKQYAEQISIQVKKDINPRYLREMKDVADQVFNKRSFSAAQPDLMVAELKEKIAKDNGTLQFFDQKNSSFPGHELLKKGSKMFSELLAINDAETFYDKIHTRYDDLLQWADDMSDKGIMDFYFSDQQQTIWTRGLDDIARYKASHDFFTSTALAEDYQQLNKLLNEDRAGRVIQEIDGVHRKFVDTFAKIMDDHQKQVTDKIQAVNEKAKQRINDSSTGDDFKQQRLATLTEQIKRIMTEAEEAPDLTRLEAKPAAADAVLRRITQSLENEEQRLAEEQKLAEKERLEELARKKAAEVEKVSPKPSSDEESIKLVDPLPAPGPNPAPQPEPAASVVIQTKYLEADQLPIEREWSISSEDDVNWYVEKLRQALLDQVKENQITKFTL

SEQ ID NO: 1028 - protein, 1223 aa, Enterococcus faecium
MLIKDIFAKPIDRNIQGVIKVGQAKDENVQQELEEYVVTKELQKHFKTIFDAYQRSINTPTDKMGVWIQGFFGSGKSHFLKIISYLLANREINDKKAIDYFKEDGKIKDPLTLATMERCSQINTDVILFNIDSKSDAGGKKDKNGIVNVFLKVFNEMQGLSTIPHLADFERRLIKEEKFDAFKAAFEEINGAKWQEERHEFDWIQDDIKEAALKIDFMSEAAIDNFLEKASGNYLISIDDFANIVKSYLDSKEADHHIAFLVDEVGQYIGGNRELTLQLQTVVEDLGRICEGKAWVLVTSQEAIDHVTNFDNNSDNDFSKIKDRFATTVSLSSANADEVIKERILKKKEFANDSLALQFETVQTELKNKLLFVDSPELKLFQDAENYAEVYPFIPYQFNLLGQILTEIRNHSYQGSNLSSGERSLLAMFKEAAERNKENDTTSLVSLDQFYYSLERWIDTAISRVITQATNNSHIQRPTDIDNFNVNVLRILFMIKYVDQAIKPNVENITSLMIRNINEDRLETKKRVEEALDLLIKENFVRKNLDSYIFQTDEEQEITREIKNQNITDSDLIVELSKRIFDGVLDRNSFAYEKLGMSGGNKFKNRYTFTYAQVLDQRPYKQAGNAEMTVNFISPYSDLAGQEAELALKSSRNLLFVELPSDKEFKDDIAMYARMNLYLTTTYSSVVKNFDAIRSEKSGELQELSASINDQLNELLKSAKFFYNGAEIQLTGSDFKAKFQSALQKMAEEVYHKLNQIDAPKEKEDILYLVKESKNEIIEDPSNEQAVQEIFNFINDQKRNHLTITMKTIRDRFETKQPYGFTELDVEWCIAKLFMSGKIDLLYNNVQISRMDDPNSIVMIIQKRRESEKIKIEPSAVISPKAKKLVDEIGRELFQSRNIVDENNNEHTMENFKKYLKGQLDNLRSYFDLQNTYTYPSAYEYEQIKKYLEVIVQTSDVEDFFYTIKKYRDELFDWAETYDKIKNFHKQNSTQKKIWENAQDKIRLIEKSRRQTSSQEIDQLIHEMKTILKKADPYSDMMKLNELIQEFIEQYNQLLELESQEILNKLTEEKQATFKLLEGKDFKDQFVPIVDQEFQELKAKIEQANTIDDLVFLSLNVAEQYLIFNQRFDNEENRRRQEEQARKQIEAANLIRETEKDEIDSAAKAEEIAIVKPTIQQKTVPMRTLNVHVKTIKSAADIDELTAEINQKLKEQLQENTEITIQF

SEQ ID NO: 1029 - protein, 1229 aa, Glaciecola lipolytica
MTIINDILTLDLKEDIKNVIDLEDRSETEIQHEIESYIVTEGIGRHLYEFTNQFTSNIKETGVWLSGFYGSGKSYFGKMLGYIIDNQIINGTPARERFIPRLKGVSDAGLIENALRNLDAINSRVVFLDVAKQNTERGLAFTLFANLLKNLGFRDDIYGYMEFDLLLDGKYDEFKTIVQKLESKDWDELKKSNRHVARVMRKVFAEMGYSESDYEDTKSVYSASIEDFSASKFKTELEKYLKFNAEETLVFVFDEASEAISQKKFTLLDLEGISESLSSISNKVWTIAIAQEKLDDVINNANVSRSSLTKVTDRFKTKIHLESTEVDVIIRSRLLQKTEQAKQDLVAYYQKNEGLISDATNLKSSFPTKTETAEDFAVYYPFHKYQFDILQKFLFSSNALVATQIAARGMIITTFDVLRKQMRDKELYSFTPGFAICDEAQTAPPVGLVNKYDTSRKILKENGSSIDGEKLLKTMHLLADSEVVAPTVENITKSYITDITSYYEVKPAIEDALKLLLEAKVLLLSNNNYKITSDLEGKMLEEMKDFDVELFSKKRELIKYLKDYKTFNAVASYNDGSDAFKFSVLSDQDDELAPVGSKHLKITAYSLFNISDDRQDFIEQLKLDTQYQKELITLVPDTSEFSQIDKLIGEVMRYAYMEEKYSNEKDADKRQIIREFEVIREEKQRTLRGLIQDAYHNASLIYMFDEHLLNVDTFKGTIADNQRKMVKNIYTKRLSSQLSDSLVSKIFSTHKESLNKLFTANDFAFFDGHGNFTGDHLKIVEEINAKIKSRYMDGKSLEADLSGAPWGYSYGTLVTTLAVLFRAGRLSVKFNGDTYFSHEQKAVHDAFTNTTKFKSASFKSITATLTAVQKNQAVQLLMELETQDHIGKKVDWNTNDFDLADSIRLMAEHFISAITNLSDTVQNFEELFPKVAGLKQDLQGFAGKVTESNYIEKVEYLLNNSDTFSNSVQAILKAQKFIKKNFPKVKEFKRFIDDVRSELIKADRSDNNIDEAYEEFERLFKLDMVKNFANLQQQVQVVKDAYYKLVKTASIGMSHEYKVLSGKIEAAFRELKNYPAAPNRLNQQKLDALKAYAEKRVVGEPVLAFSISCSNSGFSLSDILNYTAQAPLKDSELLILQSSFITEEPQPEPVPTPQPTPNRGPDGGEPAPAPTPVQSPAPKQPRKVAFKVSSKVMTVQEYKTLLTTQLTALAAAKPDEEIELTIDINSEGL

SEQ ID NO: 1030 - protein, 1217 aa, Oribacterium sp.
MQIKDMFAKKIDREIQGVIIVGQGEETNVAQELEEYVVTRELQKHFADFFSSYKKGINGNTAKMGVWISGFFGSGKSHFLKILSYLLDNKQVGDKRALDYFIDDKKIIDPMVLADMKLAAETPADVVLFNIDSKSESNGKQNKDAIVNVFLKVFNEMQGFCGSMPHVADLERRLAEAGIFDEFKAAFEDEYGDPWEESRQDFDFIQDSVVDALVSIDFMSEVVARNWCEKAMAPYTISIEDFAKRVKAYIDRQGKNRHVVFLVDEIGQYIGDDSKLMLNLQTVTEELGKECMGKAWVIVTSQQDIDSITKVKGNDFSKIQGRFDTRLSLSSANVDAVIKKRILDKTETAAQALRLLYEQKATIIKNLIVFNDGVEKKLYANENDFAEVYPFVPYQFNLLASVLTSIRTHGASGKHLSEGERSMLALFKESAAKLKNCEMGVIVPFHRFYDALENFLDHSHKGVISKAYENSYINPDNKEEDVFAINVLKTLFMIKYVLEIESNIDNITSLMIENIEDDRIELKDRVEEALKVLMRQMLVQKNGNLYVFLTDEEQEINNEIEKENVEMPEVITKIAEMIFEDIFTDKKYRYPAFNGRYSFSFNQVVDDRPYKSNQNFDIGLRILTPWYDGGMDDATLRMMSGQGKEVLLVLPNDDEFLTEMRVYLKIERFLRKNTSTQLAKYETIKEAKRVEMRERNANAKLYLTEGLKEATIYVNGDVARVAAKDVTSRINEAIGRLVQTVYHKLSYIDTAMGEAEIRKMMLTTNQLSLQLEGGTEANAHALDDVQGYIAMNSHNHMKTSMKSVKDRFMKAPYGFVEDDIDWLVARLFKRGDLAFTVNGASVNLNNKSEEEIIGYITKKAFVEKLLMEERVRVSEKDKKAVRDVMKEVFHTTVSAEDEDTIMKTFQRYASNMVNEMDKLEVYYKQYDYPGKKVLDSGKRLMQSVVQITSALEFFSYVSKMRESFLDLAEDYEPVKAFFNGEQQTIFMRALDMLAIYDDSKTYIVDADIEAVVAKMRGIVKQDKPYKNIPQLPELREQFMNAYTKVLEAEEAPVLDSIDQSRQRVLEVLNTKEYADQKKEHYQNQFVEIRQGAEHCNNVSSLRSFADKAEALKIRLMNEMDLLDRQIAERKQAEEIRRIEEEAKKQGADVTDTEVAHKVAEQKAQFKVHKTKNVSIKKMTGTSSWRLENTQDVDRYIEELRKTLVAQLDEDTIVNIEF

SEQ ID NO: 1031 - protein, 1151 aa, Vibrio cholerae; identical to SEQ ID NO: 825

SEQ ID NO: 1032 - protein, 1213 aa, Escherichia coli; identical to SEQ ID NO: 660

SEQ ID NO: 1033 - protein, 1213 aa, Escherichia coli; identical to SEQ ID NO: 874

SEQ ID NO: 1034 - protein, 1229 aa, Vibrio cholerae
MTIINQILTLDLKEDIKNVIDLEDRSETEIQHEIESYIVTEGIGRHLYEFTNQFTSNIKETGVWLSGFYGSGKSYFGKMLGYIIDNQIINGTPARERFIPRLKGVSDAGLIENALRNLDAINSRVVFLDVAKQNTERGLAFTLFANLLKNLGFRDDIYGYMEFDLLLDGKYDEFKSIVQKLESKDWDELKKSNRHVARVMRKVFAEMGYSESDYEDTKSVYSASIEDFSASKFKTELEKYLKFNSEETLVFVFDEASEAISQKKFTLLDLEGISESLSSISNKVWTIAIAQEKLDDVINNANVSRSSLTKVTDRFKTKIHLESTEVDVIIRSRLLQKTEQAKQDLVAYYQKNEGLISDATNLKSSFPTKTETAEDFAVYYPFHKYQFDILQKFLFSSNALVATQIAARGMIITTFDVLRKQMRDKELYSFTPGFAICDEAQTAPPVGLVNKYDTSRKILKENGSSIDGEKLLKTMHLLADSEVVAPTVENITKSYITDITSYYEVKPAIEDALKLLLEAKVLLLSNNNYKITSDLEGKMLEEMKDFDVELFSKKRELIKYLKDDKTFNAVASYNDGSDAFKFSVLSDQDDELAPVGSKHLKITAYSLFNISDDRQDFIEQLKLDTQYQKELITLVPDTSEFSQIDKLIGEVMRYAYMEEKYSNEKDADKRQIIREFEVIREEKQRTLRGLIQDAYHNASLIYMFDEHLLNVDTFKGTIADNQRKMVKNIYTKRLSSQLSDSLVSKIFSTQKESLNKLFTANDFAFFDGHGNFTGDHLKIVEEINAKIKSRYMDGKSLEADLSGAPWGYSYGTLVTTLAVLFRAGRLSVKFNGDTYFSHEQKAVHDAFTNTTKFKSASFKSITATLTAVQKNQAVKLLMELETQDHIGKKVDWNTNDFDLADSIRLMAEHFISAITNLSDTVQNFDELFPKVAGLKQDLQGFAGKVTESNYIEKVEYLLNNSDTFSDAVQAILKAQKFIKKNFPKVKEFKRFIDDVRSELIKADRSDNNIDEAYEEFERLFKLDMVKNFANLQQQVQVVKDAYYKLVKTASIGMSHEYKVLSGKIEAACRELKNYPTAPNRLNQQKLDALKAYAEKRVVGEPVLAFSISCSNSGFSLSDILNYTAQAPLKDSELLIVQSSFITEEPQPEPVPTPQPTPNRGPDGGEPAPDQTPVPTPAPKQPRKVAFKVSSKVMTVQEYKTLLTTQLTALAAAKPDEEIELTIDINSEGL

SEQ ID NO: 1035 - protein, 1180 aa, Methanoplanus limicola
MDTKIEDLFYNDIKREINGVIKVDQDDEENVYTELNEYVVTKESLKHIDTFFDRFLKSVTTPTDKIGTWISGDFGSGKSHFLKTLSYLLENKTVRGKSAPEFFEDKISDPEILNTIDKAVNSGTKDVILFNIDSKSGETSERIVDIMMRVFNEKRGYFGDVFWIAELEEDLDKKGLFGNFKEEILKINGNCWEEIRKSYAFEQDDIIEALTNCGFQSREACERMFESDGQNYRITPESFAKDIERYCKSKGRDHKIIFLIDEIGQYIGDDSQLMLNLQSVAEEFGTILKGRAWIIVTSQVNIEATIKRVKDNDKKQDFSKIQARFDTRLSLSSANVDEVIKKRILKKKAGDEEMLSLYYEEKKIILKNLISFSQGSAEMKNYRQAEDFISVYPFVPYQFSVLQKVFEKIRTTGFTGKHLAKGERSMLNAYKESAEKYGSNSVGTLIPFYSFYDTIESFLDPIIIKTVRQADENDNLEEFDCRIIKTLFMIRHVKELQPNLDNIVVLSLTDIDEDKLELREKVAQSLNRLERETLISKSGDTFHFLTNEEQEISREIKDVHIEERKITNEIYEEIFSSGNICPKAIGDYKFSRTVDDIVKNISGADLTVKFLTPLSDEISRGSGQHTLDGSNLSNIDSKDTLLFVFPEDSRFISHIESYLQIQKYLKQSSSTRDDEQIQEILFAKRREAERLKELSLTGISDGVRESRIFIDGREVTTIESKNPKEMIKEGYEKLVENVYSKSDYVTRNFESENEILSLLRSDDLERYGAGRSDTNKLALEEVLNYIAVKYEKKNSVLLSELKEYFMKKPYGWSSMTVSGLLAVLFMSEDIKLRHQKRYLASDTAEMTKYLARKEYSDKVILEIRKKTGAETVSNVKSVLMDVFDKAVVSDKENDLFESAKEIFDEQRGLLSQIMGKYSVEERYPGRKAIEDYNNLLSSLSGVSDPQTFLRKVSDEMGEIEELHSRAGPVIRFFEGKQSEIFGRILGKYENYRRNEQFLDEDARRSLSETERILSLDEPYPEIKRLSGLEARIESSLAESVENLKEEFREELESYKSKLNGEFTYEDYPDRGSNPVNDAFSYSQNKVEGSDDCSLIKLETGRLAELYKKAFRETEEKRKSLKSVQEDFTYESEKRDVEIINKTSVFRTEKIIETEGDLEDYLSAVRSKLKEILKKNSIQVI

SEQ ID NO: 1036 - protein, 1155 aa, Methanoplanus limicola
MVTIKNSEVFFKDPTTYTIPNDGVAKVAPLSKSDKNDWIVARYELENFVCKGSYHEGLRRILQSYLDHLDKASQPAVWVSGFFGCGKSHLVRILDFLWRNIEFSDGTKGRDLCNLPDDVKVLLKELSTETKRSGGIWSAAGTMSAGGGDGPRTDLLQLVLRSAGLPENIEVARVHLWLEECGILDDVREYLISIDKEKDLLHPFVSPKFIEAVIKFHPDYSGDEDPKDVKNDLRREFRTSSGISNTEMVSMLNQIFLMQSENKDKLPLVLIILDEVQQYLTIGDGSDKLLDFQEAVEECCRRFSGKVLFIATGQEALQANTQLQRLQGRFSEKVILESKDVDTVLRETVLLKKESMKPELRSVLDRVNGEISRHISNSKLAHRQEDDRFILSDYPLLPTRKRFWERVLASVDPDGMGNQLRNQLRLVFDGLKDYAGCDIGHFIPADYIYTQNKRYLRQNYILTQNVDDLISRENDGTEKGELRSRICATIFLIQHIDPSYGIKAEPETICDLMVSDLVSGSESLRQSVPLLLEDMHTRGVLAHIDTEYRIQTEEGGVWEGDYQKRRAKFKGDDTRIIDERVKFIKNRMSGILGSVNLIQGESRTPRNVSVTYFGDERPRTGKEIPVWVRNGWDIPEKDVINECAAEGNESSIVTVFIPLEFNDELKNEIAGYLAADRVIDRKGTPNTQDGIQAKQNIETKRERHKARAERIVDDILRDAKVILGGGTVVPGDSVSECIKDASNRAMVRMYPKFDDGDAAGWDKVIRAVAKGEQSPLSKIGFSRDPKEHPVCREILKRLNSEKKGSELLKALGEPPFGWPKDAINAGLIVLVASEYVNVKLNNRPAGAVDLNARNIGNASFEVEDVVLSTNEKFGARKMYAELGLSGKSGKETEEAGLFLEKLNALAKSTGGDAPLPYAAEPPYLSELAGYSGNSLVKELNERREIILSDIKLWKATAELIDSRSKEWATFSRLLDHSEGLPDYDLFDGEAKSVIAGRSLLSDPDPVEPLLSDLRNSIRDYYTAGAGSVNKARKEVTDSLESDSYCRELADDKRESLLKEYGLDDEFTVTVGSDEEIFTQLRKIPVNSLKSRAELTRSYLPKIKERIARMLEPETVVISLKSPVTIKSSEELEDYLLSVKEEAEKALNDGNPVMLR

SEQ ID NO: 1037 - protein, 1151 aa, Vibrio cholerae; identical to SEQ ID NO: 825

SEQ ID NO: 1038 - protein, 1213 aa, Escherichia coli; identical to SEQ ID NO: 660

SEQ ID NO: 1039 - protein, 1229 aa, Vibrio cholera; identical to SEQ ID NO: 729

SEQ ID NO: 1040 - protein, 1151 aa, Vibrio cholerae; identical to SEQ ID NO: 825

SEQ ID NO: 1041 - protein, 1192 aa, Bacillus cereus
MQIQKMFEKEINRDIKGVIKVGQDDDKNIYQELDEYVVTNELLHHMGEFFKSYKKGITGHTDKMGVWISGFFGSGKSHFLKILSYLLENKHVMDENEINKDAISFFNNKILDPMVLADMKLAGNTTTDVILFNIDSKSESDSKSDKNAIVKVFNKVFNEMQGFCGSIPWIADLERQMVKDGRYEEFKAEFEKISGNTWEEAREDFYYEEDSIIEALSKTTKMSEDAARNWYERAEEDYFISIDRFAKRVREYVEAKGNNHHVVFLIDELGQYIGNDSQLMLNLQTVVEDIGTQCGGKVWVLVTSQQDIDSVVKVNGNDFSKIQGRFDTRLSLSSAHVDEVIKKRILLKNEVGKQTLRLLYGDNSSILKNLITFSGDTAEMKIFNNEEDFVDVYPFIPYQFNLLQKVFTGIRIHGASGKHLAEGERSLLSAFQESAMKYAESETGALIPFSAFYQTIEAFLDSSIRTVIIHAQNNSRLNAYDVEVLKLLFLIKYVKELPANLENLATLMIQNISDDKIELKKKIESSLIRLSKETLIQKNGQEYIFLTNDEQDVNREIKNMHVDSAEVIQKIGDVIFNVVYQDKKYRYSPKYHFSFNTIIDDRPIGMQTNDIGLKIITPYFDATTELNDSELKMMSMRESNVILKLPQDTSYLDEMTEILRIQAYLKIKSGTAASQAIEDIKVRKSREANERKDRVHIYITEALKHAQIFVNSQQLDVKEKNPVERINDAFKVLIDNLYNKLHYVKKFIDTAKQLNELLVENTTQLTLSDDNEDANQLAVKEVNDYITRLTTRNQQITIKGITTHFTKQPYGWKDLDIASFIIKLFKGQEIKLQLNSSNLTTSERDLVNYITKRDYVERVVVKKRERISPALMKVVKDLSKEVFEVTALPDDEDGLMNRFKELLVSEKNKINVLLVQYRNTFYPGQDVLQDGKESIEQLLNISDTTSFYNKVKQLQNDFLDYAEDVEPVKAFFETQRDIYDDAVKRLNIFEKNQTYVTDQKVTGFIESISKIVKHKEPYKNIHQLPGLIKEFDELFVELLEKECEPVKNVIESDYQTVLEELNKHEEIKSMFFNKFKNSFDGIKDRLNRVNNFYEAIAMQTESDRLKVRCIDDIANEVERRKPPVTSPCTGTTCTTVIDPIVEYKAKKKTISKNTILRGTKTIENEEDIEAVLDEIRKQLQKELEDASVIKLV

SEQ ID NO: 1042 - protein, 1151 aa, Vibrio cholerae; identical to SEQ ID NO: 825

SEQ ID NO: 1043 - protein, 1247 aa, Salmonella enterica
MIETEFLMQIRELFTKQLDRPINGVVKAEQLDEQIIWTELDEYVVTRELDRHLRHFFETYLPGVSHPDDPSVAGKIGIWVSGYFGSGKSHFIKILSYLLGNKKAVNNGQTKAAIEFFKEKISDPLLYGDIHAAVNRNTEVILFNIDSRADTENKEDAILKVFLRVFNERLGYCADHPHIAHLERELDSRGQYEPFKAKFAELTGSSWEEQRDAYGFCRDEMAKAWAYATGQSDASSVQSMENLESMFTLDIANFCKWVREYLDRSDPSGDSKRMVFLVDEVGQFIGNNTQMMLKLQTITENIGTACGGRAWVIVTSQEDIDAVLGAKKGQDFYLSAKKGQDFSKIQGRFHTRISLSSSNTNEVIQKRLLEKSEDAKNCLAELFSQKGDILRNQLTFDTSTTAELANYSDNVEFVDHYPFIPYQYLLVQKVFEAIRKVGATGKHLSRGERSLLDAFQNAARQQMNKDIGVLVPFHAFYPAIESFLDTNVKRIFEQAAEKASLDPYDINILKSLFLIRYVDLVKSTIDNLVTLSIEEIDTDKVALKSRIEASLQRLENQLLIVRNGDEYVFLTNEEKEVEQEIKHTQVEATEENRQLARLVFEEVMGNRRQYRYPVNKQDYPLTRFCNGHSIDGSQQTDLVLKVISPLDANFNSYNEQSYKALSQEGNGCILVRLSSEKRIWAEFDTWLKTEKFLAGIRGKRPEQEKLLAEKALENTQRRSRLKLLFDDLVKQAQIFALGNELQSKSASVSNMLDEACAYVIENSFQKLSLLQSCGNNPVQELKSVIMADDMAQLNVNLGEQDPNAAAKKEIELFLNVADEKNQPVYLKELLERFSARPFGWNRDEVMLQVTHLVLLGKAALSTPNGDLPLKRSYEHFTSVRSHSTLRIRRVRQHTEQQVAKAAKLAKDIFNKPFESSEKELANKLLDVLGEWQRLIKEFDFKAKDGNCPGKSTLLTGSRLIASLLELGNNSYALIDGFCQQSNEWQDFAEDFEEVEEFFTRQFDIWQQLRRALNDQFKSNRHALEQNPEAAKALAALQAIYDDKSPYSKLRQVGSLIDQLIAINLQLVEQKRAAALEAINATQQGVAPLVADLPAELQNQAMRPFNLLKERVSNSLSLHEIVSLQQEADDEEDKVLELINRYSAELQARLEAEQAAARKKTAEPPNSDAGTLREPDPSDSPTTTANNSAATVVSHKPIPKPIELVSPAELLGASHIFIETEQDIDTYLATLRSRLQQAIGQGKRVRIK

SEQ ID NO: 1044 - protein, 1229 aa, Vibrio cholerae; identical to SEQ ID NO: 1034

SEQ ID NO: 1045 - protein, 1220 aa, Collinsella aerofaciens
MDNTIIRDLFAKDINRSINGVVKVQDSKDGSIRQELDEYVVTRELQRHFATFFKAYGDAIDVSTDKIGVWISGFFGSGKSHFLKMLSYLLENRQIGGKSAIRYFDGKIVDPMVEAAMERACSVSTQAILFNIDSKAGQWKQGDTAPTALLRGFERMFYEARGFYGEDLKLAKLEEYIDSLGKTQEFREAFERVNGESWLQTRDTYSYFEDDVVEVLQSVLGMSEKAAWNWLEGSEDEVLAPDVFAKKVKDYVDAQAAAHGGNFRLLFMVDEVGQFITNDQDPSLMLSLQTIVEELGAACGGRVWVMVTSQEAIDNLSLPVGNDFSKIQGRFNTRLSLSSSSVDEVIQRRVLEKTAPVADMLAQVYEQDAAVLKNNFTFEGGSRSDLAGYANSKDFVASYPFVGYQFKLLPDVMTEVRKHGVKAKHMSTGERSMLSAFQESAQAIQHDQTGALVPFWRFFDTISKDLEHGIIQVVDRAVRAAEDAEGLEPYDVQVLKLLYLIRYIGYVKATAENISIFMIDGLDVDMRALKDRVKESLARLERENYVARQGDTYSFLTDEEQEIAQEIARTPIDNAQVIESIKKRLFDSIYTARKLNRGANDFPFDRYVDGSIHGTSMGGMELYVATMASDLGRADDTELALASSGKAIVALSDEADYWETLVNAAKIRKYAKTRNLQELQPSTRQIVESKMREAAYNEKEADTLLSEAVLHARCAVNGRMVEVRAAKPAQVFEQVLAQLCDVVFEKADYIGAPVTSDSDIRSTLAGNVQAGLAGMDAGNMRALKEVEDYLKVQHQRHLDTAMGDIQRQYQQRPFGWREVDIANVVAQLVVEQRAQVLFGGQTVQANDSRMVALLRKDADKAQVRLRMRMSDRLLCDTGELMRDLFELGTVPSNEDKLVAELKARLEDLREACLAMARDYYTGIKPAYPYPGEDECEKMRSEVADILKDQSESEAFLTTFTKHEDRLLDAKEDFDRVVEFFESNQRTAFDHAKDFLSRTEGIEYVSDDIPNAVENVAKVREILKDPKPYGRIKDLQPLMDPVEDDIKKLLGIRRNEFLCRIESDLQDLQAQAESQKGFVNQAKDAIAEAAAKYESFKNRAHSAQSLNELSVAATNWGNWIVAATNKIYDAVDAARMRMDNERRTTEVTSTGEVVKKVSNKGAASSAPVPAPKPQRKIKTVRRADLAKPSRLLSAEDVERYVDDLRSRLMQALAANDEIRIN

SEQ ID NO: 1046 - protein, 1223 aa, Enterococcus faecium; identical to SEQ ID NO: 882

SEQ ID NO: 1047 - protein, 1151 aa, Vibrio cholerae; identical to SEQ ID NO: 825

SEQ ID NO: 1048 - protein, 1208 aa, Bacteroides sp.; identical to SEQ ID NO: 864

SEQ ID NO: 1049 - protein, 1225 aa, Vibrio cholerae
MKIEQIFSKKLMRDINGVVKAEQKDNDSVYVELDEYVVTRELDRHFRAFFEAYVPSVTQSGASMSGKIGVWISGFFGSGKSHFLKILSYLLENKSVEKDGQGRQAFEFFKDKINDAMLLADIQNAVTKDTDVILFNIDSRANTDDRENAILKVFLKVFNERVGYCADFPHIAHLERELDKRNQYMSFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKRDGEDFSKIQGRFSTRLQLSSSNTSEVIQKRLLSKTEEARTHLIDVFAEKGDILRNQLTFDKTTTASLKGYTDAPSFVDNYPFVPYHYTLVQKVFESIRTKGATGKHLAMGERSLLDAFQSAAKQMKDSGLDVLIPFYSFYAPIESFLEPAVKRTIDQACELDSLTEFDGKILKTLFLIRYVDVVKSTLDNLVTLSIDRIDADKIALRKQIEESLNRLERQLLIARNGDEFIFLTNEEKEIENEIRHTDVEMSEVSNKLSAIVFDGILKGNRAYRYPINKQDFAVSRFCNGHPKDGTTLEDLVIKVISPLDSHFENYSHDQACINHTLEADGCVLVKLGEHKRLWDDLTTFIKTDRFLKQNSGQRPEQEHLLREKQMENIEREKRLRTDFEALFAEADVYAIGTKLPKKSATPSAIVEEAYKYVIENTFAKLNMLKATPGEVLRELQAVLVADDIAQIGLDLQADECNPEATREVEQYVTLKVERNEPVYLRDIVARFGKRPYGWPDNEILLLTARLGLAGKVSFSTQGTDLALKKAYEPFTSVRKRGEIRVHKIRQHDERQIKKAAGLVKEIFSKTFTGSGEKELYELVRDELLAWNEELKSFRTKSQTGHFPGKSQIDDGLALVAGILEQTSSFALIARFLEDADALEEFAEDFEDLDDFYNSQFQTWQALAGALNEKFKANRPALEKDSEALKALTELERIYNMSSPYEQLRHINPLIEQVAKVNSTLVEEKRTHALERVDLRIGRVKEALAEAHAPSELQNQALRPLQMCRQRIEATSSIPQIISEQTEAEGYEDEAYELLNGFIEDQRKKAEAEQRRREIEQKKREEEAAKAGKAAPAPEPVPEPVQPQPLAKRTVTIKPTDAMAKSVTTGFIESEAEVDAYLAALREQLIAAVKAGDRVRIK

SEQ ID NO: 1050 - protein, 1225 aa, Vibrio cholerae; identical to SEQ ID NO: 819

SEQ ID NO: 1051 - protein, 1151 aa, Vibrio cholerae; identical to SEQ ID NO: 825

SEQ ID NO: 1052 - protein, 1223 aa, Enterococcus faecium; identical to SEQ ID NO: 882

SEQ ID NO: 1053 - protein, 1250 aa, Fusobacterium sp.
MSDLTIKSILQKDIERKINGVVKADSNEKDTIITELNEYVVTEEIRKRLIKFFDKYVDSINSPTEDMGVWISGFFGSGKSHFLKMIGHILENNTYDGKTVVDFFKEKIDDAILMGNIEKAAEIPTDVILFNIDNVSDQDTHQNKDSIALAFLKKFNEYLGFTRDDIEIAEFERRLWEDGKLEEFKKAFEEESGKTWKDANRNLDFHSDDFIDVVEKLEIMTRESAERWLERDIVRSINAESFRDIIENYLKMKDPKHRVVFLVDEIGQYIGDNSKLMLNLQTLVETLGVKFKGRVWVGVTSQQDLGSILNNSEHRKNDFSKIQDRFKTILSLSSGNIDEVIKKRLLIKKKIEGEDLEKLFDKNRVEIENLINFETQMTLPLYDSAEDFSETYPFVAYQFNLLQKVFEKVRNMGHSGQHMSRGERSLLSSFQEAGIKVKDKNIRILVPFNYFYESIEQFLEDNVRRPFIHARNEKKVDDFGLEVLKLLFLLKGINGINPTLNNLTSFMIDSIDCDRIELEKKIKKALEKLEREVLIQKDGDNYYFLTNEEQDINREIEREDIDFKKIDEKIDSYIFKEIFTKNSIIMEDTGNKYGFSRTLDETPFSKAGEELAITIFTERAEDYDNVSIVGTRPESDLIIRLPNDDETYRNEIKLFLKVESYIRNKQKDNERESIIRILEIKQRENSIRNRRIKNELERIIGEAEVFIYGQKQDIKTKDAAKKIEESLKALANHRFHKAKLVKKPYDEAEIRKTLSYVFDTNKNGILFDIKKNIEANVNCEAINEVLDRVKLLEKRGDTPITLKNISDYYLRTPYGWGQLTINGLVGELWKYRLINLEESKVLVTDENVATNLLTKLQNKNLEKIVISLREELDPELVKKVNNLLKEIKTLKEETGEVTIDSPKEDLLEILNRKIGIAKRYKIECEHSKYPGKKELSDWIELLEEIILSRDNAEKTLKNFLEMKDEISKEYDKVDRVFDFFTSSKKDRYDEVIQKINKIEEYKDYIGGLKETPAYKTIEEIRNDKNIYERIREFDELITELDKEKDKLIELEKESLRAKVEKYREDFSEKLKDNTEILKKLEEKFNNFLENEVNNSDSSNDMAIFMKSKKLENIVSKFEDEYKNYARKEIEKLESYLNEVAEDKTDIDKLRQSIKSTYNNYKNEIAKSDIRNISATITKAIKDKDDFYAELNGKAKKKERVILRKVSISSKTNIETEDQVNDYISRIEKDIEKLKNEMLEAIRSNKIIDIG

SEQ ID NO: 1054 - protein, 1229 aa, Vibrio cholerae; identical to SEQ ID NO: 1034

SEQ ID NO: 1055 - protein, 1206 aa, Aurantimonas manganoxydans
MTSMNIADLFVRPIDRQINGVIKADQDDAKSVWQELDEYVITQELDRYMREFLSAYLAPETLSRSGDAACRNGVWVSGFFGSGKSHFIKIISYLLENRSVEQDGVSKTALDFFRTKIVDPMFAADIEKATRIPTDVVLFNVDSKASSNDERAILQVFIRVFNEKLGYCADFPYIADMERFLERKGKYEAFKAAFEKETGSPWIEERSAVRFHEDALIGAIAEVLGKPRTEAGEWLDKYEKDFQPTPENFAHWVAEYLDRQGPDHRIVFLADEIGGFIGRNGKMMLNLQTITENLGTVCKGGAWVVVTSQANIEAILGEMRSTVEEDFSKIQGRFKARLSLSGSHADEVIQRRLLGKTEPAKDELKTNFGMNGEILRHQVTFRDNRMTLRSFDGEDDFVRHYPFIPYQFQLVQKIFDASRTHGMTGAHLAKGERSMLDAFQTAAVYSASKPVGALIPLHFFYPAIESFLEDIVRRAINGVRTNPSLEPFDSEVLKTLFLIRYVDEISGNVDNLVTLFLDRIDADRVALRKAIEASLRRLESETLISRNGENFFFLTDEERDIGKEIKAIRLNPGEETSLLGNLIFDDTLQSVDRGLFTYKPIKSNLDVMRFVDDAPRSALKDKAIPLKIVTPLADNYEDFADATVTMRSHDEVLVVLGNEKDLARDVYDYLKVEKYATQKMDGTQSESVKRIVRARQHENTERRKRLHQTIEALIRDARIYVNGRRLDPKATTADAIVVEALDYYIANTFKKIGLLVHLSEDPIRDAKVILATSDDTLDLKDEDPNKAALDEVLDHVGLIEKQSKQPILFDIAEHFNKRPYGWGLRETALLVVKLFRRGSADLLMNSERLDRSQLASEIEGQNKWRKIVIQRRKMLDETTLHSARQLAKDIFGRMPGVGEDAIAEDIRLNLTNWQDNLKSWGALADDGEFPGKSAIAEIEGIIAPIMQKRGSYELIEAFVTAKADLTGLFEDYEDLSDFHSSQRPAWDLMRKAVMDFAVNEKEIEKDEAAAKALTSIKDILALEAPYSRIQDASALIATVTEANRILLEKRRNHAYGIVDPLIAKIKAELDDVSSGSDLRNRSLHPIQTIRKRIETSPSISAIFMAQTEAREAYDDAFEMIGNSVMKVAEPVRQPETVGGGPEGGVPYGKLPEPPVVVFKPKRVIQPASLVSADGYLESQAQVDDFIDRLRSRLSEAVSKNERIEIR

SEQ ID NO: 1056 - protein, 1177 aa, Sinorhizobium meliloti
MTTFRDIFEKPVDRAIEGVIKADDEASLRVELEEYVITNEIERQLEKFLDAYNNYGSANGVWISGFFGSGKSHLLKMLALLLENRDIGGIPAYELFKQKCEHNEILAADLRKAVSISSKSILFNIDQKADVISKGQTDALLSVFQKVFDEMGGYYGKQPHIAQFERDLDSRGVLEAFRQAYRSVAAKSWERGREQALLENANVAKAYAQATGANPSEGEGILMRYRQDFRSSIEDFAEKVKAYIETQRPGFRLNFFVDEVGQYIADNVKLMTNLQTIAESLNTKCRGRAWIIVTAQQDMASVIGDMNQRQENDFSKIQARFANRMPLNSADVAEVIQKRLLKKTESGIGSLSDLYHRESNNLKTLFDFTDGSIRLENFRDRDHFIHSYPFVPYQYPLFQLAIQNLSQHNAFEGKHSSVGERSMLGVFQEVVVRLADLSVGGLATFDQMFEGIRTALKSNVQQSVLIAEKNLGDEFATRILKALFLVKYVKGFKPTARNVAVLMLDRFDTDLTKHRRRVDEALSLLEQQTYIQRNGELFEFLTDEEKDVEQEIKAIEVDTAEIAKELEALIFDGVVKSRKLRHEASSQDYAFARYLDGRLLGRDYELAINVITPFNEQSANAEATAMRTMSRDELAIVLNADNRFVSDLMTFKRTDKYIRQARSVAQQPSIERIVREKGEQNNIRQRDLTLKVRALVGDSRLFVRGQEIEVRSEDALARIERAFQTLVDKVHVNLGMLRGVAYSENEIGRFLTHGNDGMFGEDGANLTDAELEILNFAQSNSRNGIRTTVKAVVERFERKPYGWSYAAILCTTASLLGRGKIEARADGSPLEGDALLRGLQNAHALGNIVLELQMEFTPAQTRKLKEFYRDFFDAQPAGTEGKSLGIETAEAFGALKTELAVLEGQSSRYPFLSTLGQLQDALREVTGKSYAWYIQDLGRHMDRLLDLKEGVLDPIRRFMGGGQKTIYEEARSYLADQSANFGYGGEEQAGAIQEVLDDPNCFKGNAIQQIKGALDALRAEVDNRLSAERKTAISDVEELRTKLRALPEFASLAEPGRREIEAVFKTVLDAIETSKLIAVIRERVSGFRASGYPAVLGRVTAPPPLKKDDEDDKPRGFRDSGTGTRPVPTQPEYVAASALRVTYAKPYLADERDIDTYLNTLRETLIAEIRAGKRVTV

SEQ ID NO: 1057 - protein, 1179 aa, Sphingobium yanoikuyae
MATFLRDIFAKPVDRSIDGVIKADDKASLLTELDEYVITNEIGARLEQFLDAYNNYDTANGVWISGFFGSGKSHLLKMLALLLENDEVEGLRAVEIFERKLAGNPMLAGALRKAVSIPSRSVLFNIDQKADVISKADVDALLAVFQKVFDEMCGYYGKLPHIAQFERDLDSRGKLDAFKAAFAQSSGKPWERGREQALMEGKHIAAAFAEVTGDEVKDILGQYRKDTKVSIEDFANMVKSWIDAQGPRFRLNFFVDEVGQYIADNVKLMTNLQTIAESLNTKCKGQAWIVVTAQQDMGSVIGDLTAQQENDFSKIQARFANRMPLNSQDVAEVIQRRLLAKTEAGQITLGNLYDAEENNLRTLFDFGDNSFKFRNFSGKDQFVASYPFPNYQYDLFQRAIMGLSQHNAFEGKHSSVGERSMLGVFQEVAKKLADTPVGGLATFDLMFEGIRTALKSSVQQSIQLAEKNLGDDFAVRVLKVLFLVKYVKEFKPTARNISILMLSRFEADQTEQRRNIEEALSLLERQTLIQRNGEVYEFLTNEEKDVEAEIKAIAVDPAEIERQLDELAFGAILRHGKIKHAGTGVDYAFTRKLDGHSLNREHELSVNIISPFSDDSDAPDVVRSNSMASDEMIVLLGRDVRFTRDLVLWLQTVKFARQVTSGDAQPGRDRIIAEKRDQNTRREKELVQRLRGLIEDARLFVRGAELEIGGEDPQDRLVKGFQVLVDKVYTSLPVLRGATYTEADLGRAGRVDGGLFGGEGSGLTEAEQDVLNHAQAQMRLGTRVSVKALVEKFGAKPYGWPSIAVLCLTASLVARGKLEARADSALLEGDALVQGLRNSHALGNILLSPQIEFTAAQIRKSRELFQELFDLPASGNDARSLGAEWQTQLRKLLGDVEQESRAIAAYPFAAALDPLRTLLDGMRDQSATWFITGPIGQEDQLLDAKEDVFDKVRNFMRGPQKAIYDEVRSFLTRQEQNLGYAEGAAADKLRQVLEDPQCYKGTAIQELKTDFYALKERIEQTVLAERNTVITAIDGVAEKVVQTSEFGALPPEQQARIRKELADRKTGLAAQGLIPALRNLATEVRSNLLADTLTRIAELTPAPTPMPAPQPAPSGGVAEPQPAPYVPPAPAKPQYIKAQSITVPFAKTYLEDEDDVTRYLDEMKKTLLAEIGAGKKVIV

SEQ ID NO: 1058 - protein, 1223 aa, Pseudomonas fragi
MSIKDIFFKELDRPINGVVKADQSDDATVHQELDEYVVTNELEKHFRSFFESYGTDLNDPSIANRVGVWISGFFGSGKSHFLKTLSYLLANIEARDDQGNARKAVSFFDASKLRDATIRADIDKAVANSADVILFNIDSKASSNDAGNPILNVFLRVFNEHQGFSGDHPHIAHMERHLAQRGVYERFKQAFNDSTGMDWTEERDGYQFYQDDIEQAVAAALDLSAEAAHKWFEDSEQTFSVSVENFCNWVREYLDTQPAKHRVLFLVDEVGQFIGSDTKLMLTLQTITENLGTICKGRAWIIVTSQADMDAVLGELSASKANDFSKIAGRFKTRLSLSSSNTDEVIQKRLLRKTPEAEVELRALWEQKGDILRNQITFDRSGPTLKNFDGPESFINNYPFAPYHFQLVQKVFEEIRKVGATGAHLAYGERSMLDAFQMAAMAIADKPLGALIPMYSFYRAVEGFLDTAVKRTIDQAGESSVLDAFDVQILRTLFMIRYVDLIKGTLDNLVTLSIEQVDEDKLALRRNIEETLQRLEKESLITRNGDEFVFLTNEERDITRKIKATEIAGSEENKALSDLIYKDLLKDKNKFRYSVNKTDYSMGRYLDGHSLEGRYEHDLRVEVISPLDLDYALYGEAGCINKSNEAPAGMALFKLPDSKDFFTELRTWLKTNKFIRLNDDGSQPELSKILAERGRENQERKKRLRLLLEELAERAEVYAQGQHLKLNSNNIVSKFDEACQYLLENTFTKLGYLRVLQQEPERELHAILHTNDIGQLGLTLDGDEGNPQAIKEVEQFISLRASGNERLLVADIIERFSKRPYGWPDGEILLVLGRLAASSRISFHAAGPSMPLPDAFEYLTNSRKRREVSVQKKRQTDEGLLKQARNLTQELFNALGPAGEKELFEYYCVHFGNWRTNLEKYKATVSAGRFPGKESIEQALLSLQRLLSNTDSVDFFKAVVDNKEDLLDLEEDYRDLHEFFTNQLHTWQQLQLALRRFDKNKPALDKDEKARKALAELKAIEQNTTPYGQLHQVATLVETVESINAAILAEKRQHALARVDEKIAQLQSEIAKSGIETAELSNRLLRPLQLVKADLETETSIANIYMLQTQTADERLNDGVFDLERAIQAEVERLQKLQEEQAKAAQAANTANGVKEDRAPALVPTSKPVAPPKPVVEVAATSVFNKLGNGLYLESQSDIDRFIDVLKVELESAVKQNKRIRIR

SEQ ID NO: 1059 - protein, 1241 aa, Lactobacillus helveticus
MIQIKDIFAKDINRDIRGVIKIGQDSDDIKQQELEEYVVTDELKRNFTRFFDAYDKSINNPTDEMGAWISGFFGSGKSHFLKILSYLLENDTVKGRQAIDYFLQDGKFDDDHLADAINKATSVPTEVALFNIDSKADSNAANNDNSILDVFLKVFNEQLGYSPIAVVADMERWLDSIGKYEAFKQAFADLATTDHSSWVELRKNYALMSTKIKTALVNCGALDETDANNYVQTLLTKKFSIDATAFAKLVKNYLDKKGNDAHFVFLADEVGQFIGDNNSRMLNLQTIVEQLGVQCQGRAWVVVTSQQQMDEVASNFSKYERDFSKIQGRFNTLINMSSANADEVIRKRLLTKKPLVSDQLADIYSKEQYSINNKINFSDAIKRQKFDNAQEFVENYPFIPYQFSLLKEVLTAVRQHGANGSHMSDGERSMLGTFQEATKRYENDELGRLVPFSAFFIGMKEFLSHDHQVVFDRAQTDRYVNKNNEDYCFNIQVLAVLFMVRYVDNYPSTLENIVTLLLDSVDQDRQALTAEVKDALNVLMRQNYIQKKLDTYQFLTDSEREVNEAINAIEVDDRKVAQKIGSYLLTSNLIDAKYTYPHMKNQYIFEFNEYIDEMGLNRLSNNLNIQIISTLIADDYREIDFQQKASDGKNIIIVLKDDDRYIENYRHIEKINAYLQKPESRSDDKKQEIAFNRKAESKQVEEATQKMIKDDLIDADIYVLDDVLPKGSNFESRLEQAKKEIIDSNYRNLHYLTAVKTDQDILDTLKGKNKNDLFSDDEQAIKEIINYISVQASNMNNVSLANVIKRFGEIPYGYKPTDIAWMVAKAFVNGKVKFYFNNEQISLTSAQEDPKGTQRYLIGKNNIAKLTIKPVKEISMRQKRDAKDFVNDILDMRLTVDENTTSEQMADDIKNKTKRFVDCLNALMRKKYNFDTPYPGHKLLAEGVHDLNAIVNVKDSDRVFQIISDHLDDYEDWHEELEDKAILEFYGDVEQTSSQQAIWNKAHRYLDRYNYAKSMIEDQDLIGIAQKIKGCLENDNFNNTIPKLKELNTQFADKYNDIIQEAYDKIEAQIQISLDVIKKRIAESDFPEDKDRELNDMAENVFNTLLQKAKEYSNSASEDAYVSLVGLKNNIDGQTNEQKENIARVSSELAEQARKEQELREKKTAAEENDKKEPVSVAPVSNKTKPIIRVKSNKSKDITELVHEDSWKITNEEDLDKYLAELRKNIKQELQHTDILNVDFK

SEQ ID NO: 1060 - protein, 1151 aa, Vibrio cholerae; identical to SEQ ID NO: 825

SEQ ID NO: 1061 - protein, 1177 aa, Faecalibacterium prausnitzii
MFVEDINRKINGVVKVDEDENKVLEQELNEYVITRELKRHFADFFNTYAEAFDEPTADTGVWISGFFGSGKSHFLKMLSYLLENKEVNGIRTVERFRKKFEDDPGTFMQVDRATKGETETILFNIDYEGSINKDKTAVLRVFAKVFYNHLGFFGSNLKVAMLEQYITQQGKMDEFCRLIEEKKGKPWTEVRKAFAFNGKFIKPALAEALDISEEDANNWFNDKSATELSVSQLVEDINAYVSTKPANFRLLFMVDEAGQYVGTDTDMLLNLQSLVEKIGSECRGKVWVVCTGQEAIDEIIKVRADEFSRIQARFKTRLSLSSSSVDEVIQKRILKKTPEAERTLDAVYEKESSGMRNLFSFTNAMPDIKGFSGPAQFAEDFPFVPYQFLIMQKIFVEIRKHGNAGKHFSGGERSMLSGFQEAAQKVEKQNEFALVPLFRFYDTVHSFLDGSIRNVIDRCSKAVENHDGLEPMDVDVLKLLYLIRYVNEDIPANLDNLVILMADDIRLEKVAMREKLRGSLDRLIGQNYIGRTGDTYNFLTDEEQDIQKEINLTQVDTGAIVGDIAKIIFGIIYDAKKFRYGKCDFPFDQMVDNTMYGIATGGMRLRFLTAASDATEKTEFRLMNSSKGSEAIVVLGDTPYYESLEASMKIRKYVKQRNVSQMPKSAQDIIRGQQEEAAKYEAEASKALVEAIENAKFYADGEHLDIKSGNAKAKIDQTMEYLVSHVYSKLDLIGKNADTDADILAVLSGADYILPEADPNRDAEAAVEEYLEMQAMHHLPTSMADVQSKFSSIPYGWKEIDIAYVVARLIVNQKVTIKYAGTTIQPDNAKLPDMLRKKSEVGKTSISKRVVVSATKMKAVRDLLRDYFDVMDVPADEDGLVKFIADEFGNQLQHYNKLNEKYDDTHKYPDQTIVHNAITATQEVLNQKKDNIALIDYLLKKEDDLFDQKDAMGNVETFFKSQIGTFDDAARLEHEMQADLDRIAQNAAAYDALNKIRLIITVPPFGQKFNYKRIPELNGLMQTVRTAHDQMLDDKRSEILETVRQCMEATHTAANGDPKALDIVRKSDAFFDGYKAKIANCKSLALLDGMIIPLSQYKDETVSSIEIALAPPTPKPVVTKKDVNIPAVKPKKVKSYSRQILFPAKTLRDDADIDAYVEKIREQLRNLLDGCDEIKLN

SEQ ID NO: 1062 - protein, 1226 aa, Acinetobacter sp.
MNIKELFYKPLDRAINGVVKADQNDNTTVYQELDEYVVTNELEKHFRDFFQSYGTDLSDPSIANRVGVWISGFFGSGKSHFLKTLSYILANKVARDAEGNERSAAEFFDESKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPDSFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLQRLEKESLITRNGDEFLFLTNEERDITRKIKATDLAASEENKELANLIFKDLLRDQNKYRHQANKMDYQIGRFLDSHSLDGKYESDLKVEIISPLDTEYNLYTEAYCIGKSTQAEGQILFKLADDKQFFNELRTWLKTNKFIRLNDDGTQSDISRILADRGRENQERKKRLRVRVEEMLLEAESYALGQHLQLSSSSPITKLDEACRYLLENTYTKLSYLQVYQQDAWRELNAVLTVDDMAQLGLSLDGGQSNPKALQEVEQYIALRATGTERILVSDVVDRFAKRPYGWPDAEILLLVGQLAAMGRISLQLNGGSLQLKDAFEPLQNSRRRRDVSIIKKRQTDDQVLKQARQLTQDLFSAMGPATEKELFEFYTQHFNNWLANFKSYKSKTDVGQFPGKKVIEKSILTLERLLANSDSFDFFKAVVENKDDYLDLEEDYRDIHEFFTNQMPSWQQLQQALRHFEKNKQALGSDEVAKKALSELHRIFTLESPYGLLNKVADLVRTVESINEQLLTEKRNQAIEHIDDKIKQLEAEIKNSGIATAELSNKLLRPLQLLKTDIEVETSLSTIYMLQTQTAVERFDEVLYELESEVRTEIQRQTKTAQLAQSKAESVTNTATTSSPDTSTPAASPVQPVTAVVPPKPVVEVDVASIYSKTSSSVYLETEESVDQFVDALKAELKKIVSDKKRVRIR

SEQ ID NO: 1063 - protein, 1202 aa, Bacteroides sp.
MQLQDLYIKSINRPVNPAVSATKFDKETIDIEIKEYVFTDEILNGLYRILNAIKNNKPYDHVGIWIDGYYGSGKSHFLKYLDYCITPETRDVALERLLDAVKEIDPFDGKHNLQFEFSQVQDIASWLKTATIDTCIFNLETSYNAATDKKKAFLQVFWDEFNGKRGLNKFNLTLAQLLEKPLMERGLLEQFKEVIAEMGGDWNNPSEAADLVDQALEMVVDAACELNPQFDRNSLYNHIDKRDYAISIDRFGMELADYIKDKGEDYRLILLADEVSQFINKERDRYLNLQEIITKLSESCHNQVWVACTAQQDLSEIMDDCNIGEEKDKEGKIKGRFEVKVSLKGTQPEVITQKRILEKKPEVKTYLAAMYEQQQGAFSLQFKLPNAYKSYDTETDFIDFYPFVPYQFKLIMQVFDSFLALGYVAKEVKGNERSIIKVIHTTAKAPNNAQAEVGKFVSFDELYNNMFEEGLQARGQKAVDNAIRIARTYTDPKLAVRVANVLFMVCNISQTDQLVFPATLDNITTLLINDMTTPRLNLKNEVEKVVDFLCDNNIIRREQGRQGAPDFFSFYSEEEMKVAELIKSQTADNNLQAGELKEIFNRYLKGLKNKEQYKTRSFAVGMTINQRNYLSNNPDVVLEFMMDDDYDAPEQLALQNQTNRLVYYVGPQFRANARLRNNFYWYCKVQSYMTANPATSDENAAVREEFKKRASEVMTGIIEREFQKILDTCPLVSGLSVIDDVELGNKKGNDRYLAAIEKHLSGIYTKAGLVDLPQIPRNSDKLKIAILRPVNPGDYEGLNDSLTEAEHEVEIYLNKQYEELNVGDVVAKFSKAPFGWDGICTLYVVNELVRRHRRDYSYSNNPNVEVSIVANRLLSETNKFTIRPAITISSEVINGFIAAWKNIFGVSESFSTTDSTQLFRLSREKENVRSVENVVARYKQHYKDNAAYSFSAPLDEMVTLLEGWLAERDPLKYFRRVIDEQQQARTLFDTCKEVVQFVQDQMGNYKDVLHFVRDNRDNFSFVPIELHEAVTQLMGIENAAWPIGIRTYMKLRNTLAGAIDAKRTELRKQIAEEYAKTYAQLEQGCKENEVSTSILSDQEVIVKLKTQPDSIPVLQTNLDTNTFFAEQTAKILAAKPKPKPTVGDDKNKKEEIPAKKYPTQVALSTRTTLPIGSEADVDKYLAQLKKQLMAHIDKGETVMIIK

SEQ ID NO: 1064 - protein, 1225 aa, Proteus mirabilis
MKIEQIFSKKLTRDINGVVKAEQKDNDSVYVELDEYVVTRELDRHFRAFFEAYVPSVTQSHGDMSGKIGVWISGFFGSGKSHFLKILSYLLENKSVEKDGQGRQAFEFFKDKINDAMLLADIQKAVTKDTDVILFNIDSRANTDDRENAILKVFLKVFNERVGYCADFPHIAHLERELDKRNQYASFKDKFAELTQSTWEKERDAYDFYRDELSEALAHASEQSLESAKAWVEQVENNFPLDIRNFCKWVNEYLDRTGDRNLLFLVDEVGQFIGKNTQMMLKLQTITEDLGTYCGGRAWVVVTSQADIDAAIGGMDKSDGEDFSKIQGRFSTRLQLSSSNTSEVIQKRLLSKTEEARTYLIDVFAEKGDILRNQLTFDKTTTASLKGYTDAPSFVDNYPFVPYHYTLVQKVFESIRTKGATGKHLAMGERSLLDAFQSAAKQMKDSGLDVLIPFYSFYAPIESFLEPAVKRTIDQACELDSLTEFDGKILKTLFLIRYVDVVKSTLDNLVTLSIDRIDADKIALRKQIEESLNRLERQLLIARNGDEFIFLTNEEKEIENEIRHTDVEMSEVSSKLSAIVFDGILKGNRTYRYPINKQDFAVSRFCNGHPKDGTTLEDLVIKVISPLDSHFENYAHDQACLNHTLEADGCVLVKLGEHKRLWDELTTFIKTDRFLKQNSGQRPEQEHLLREKQMENMEREKRLRTDFEALFAEADVYAIGTKLPKKSATPSAIVEEAYKYVIENTFAKLNMLKATPGEVLRELQAVLVADDIAQIGLDLQADECNPEATREVEQYVTLKVERNEPVYLRDIVAHFGKRPYGWPANEILLLTARLGLAGKLSFSTQGTDLALKKAYEPFTSVRKRGEIRVHKIRQHDERQIKKAAGLVKEIFSKTFTGSGEKELYELVRDELLAWNEKLKSFRTKSQTGHFPGKSQIDEGLALVAGILEQTSSFALITRFLEDADALEEFAEDFEDLDDFYNSQFQTWQALAGALNEKFKANRPALEKDSEALKALTELERIYNMPSPYEQLRHINPLIEQVAKVNSTLVEEKRTHALERVDLRIGRVKEALAEAHAPSELQNQALRPLQMCRQRIEATSSIPQIISEQTEAEGYEDEAYELLNGFIEDQRKKAEAERRRRELEQQTREEEAAKAGKAAPAPEPASEPVQPQPVAKRTVTINSTDAMAKSVTTGFIESEAEVDAYLAALREQLIAAVKAGDRVRIK

SEQ ID NO: 1065 - protein, 1213 aa, Bacteroides sp.
MSKIKDILSIELENDIKNVIDLNSQNEEDIKDELDGFILTESLAKHLSDFLDVFCSNMKESGVWLSGFYGSGKSYFAKMIGFLIANPVIKGTPMRDRFMPKLIGLKNKEIIENQIRSLDKTDYQVTLFDCAKVDSSYGISYMAMSHFLLSLGFLSNWIGMMEFNLMLENKYDKFLATVKEQNAGKDWYDIRKKMSAVTALKKAILTFMAEDEYEETRKLIDERIKTYDATKLKEDLSLYLEHYQEKKIVFFIDEMSEALSQKKINLLDLEGLSEALSSLGNRVWTVGIAQQAFNDVLNASGLNIHQLNKVEARFKTRIPIAAEEIDTIIRKRLLAKTDSGKEQLESYYDKNNGMIQDITHIAGVSLNATKDEHTYADYYPFYEHQFKLLQYFLFGSRDTVTSQIGTRGMLVSVFDVLKKEAMTEADVFTHVNATQLCRQAEENIPEALRMRYEQADNHISKEGMKYVEGRALLQTIHFLEKANAYTTIENITKSYVRRPEDYYSVLAEVKKALEILVERNVLITSGNQYRITSQIEQQIIDDMNSFSAEVYRVRAEITKILKQQKIIKVSQTLTSDGQAIPFCVESSLGENFVNAGGKYMKVSFYDVFHEDYAQLVASVKQDTQSQKGIISIIPSSVYGTEIFNRAQELLKIDYIETKTYHTADEKKVVNNIVSTKEEKMKFLTELINKSYTEGTAVYLFNTYQLTDANYQKEIESLQRKMFGNIFYKRLGASLSDSLAVKVLTASSTQLTTMFGGSEEFRFFDSAGKFIGENLSVSTEILEKCKSYCTGDKLEEELSAPPTGYKFGTILTAVAALFRGNKLIAKFNGEDFHSVSDALEAKIFDNTRNFAKASFKAVMKSLSYNDRQEIVDILKEDCQYKKITGENAPSYNLNDFELVDCIRTLSKRMMDKVKDKIMGDDEMELLFKRSVQARNVFSQYTAAVTEANYIATARTFLQEADDYIKAVEQVQKDLKFIDSEFKAIEEERAFIQNVTEEFDKTENDMNLIRGKKEQFEEAREKDLVANAPLMKKLTQDIKDIYYEVMKHKAELLSEEVIALLTMTDELKSQIDQYPKEWNSRLYRKIEELEKSWKRYATIHVNLKEWSVKCSNTGMLLRDIEYKITNLSMVKQEVSLWDTEIITQDPAPKKTDIPKSPDAPIPEDKPAPQPKPIQRNMKAKLPKGTASVAEYRSWLKQQLAMLNMFGEDDILNFDN

SEQ ID NO: 1066 - protein, 1213 aa, Salmonella enterica; identical to SEQ ID NO: 703

SEQ ID NO: 1067 - protein, 1223 aa, Pseudomonas fuscovaginae
MSIQDIFSKELDRPINGVVKADQSDDATVYQELDEYVVTNELEKHFRSFFESYGTDLTDPSIANRVGVWISGFFGSGKSHFLKTLSYLLANIRARDAQGNTRNAVTFFDVNKLRDAMIRADIDKAVANSADVILFNIDSKASSNDAGNPILNVFLRVFNEHQGFSGDHPHIAHMERHLTQRGVYERFVDVFNESTGLVWAEERDGYQFYQDDIEKALAQVLALSAEAAHKWFEESEQTFSVSVENFCHWVREYLDAKPAKHRVLFLVDEVGQFIGSDTRLMLTLQTITENLGTICKGRAWIIVTSQADMDAVLGELSASKANDFSKIAGRFKTRLSLSSSNTDEVIQKRLLRKTAEAETQLRALWGQKGDILRNQITFDRSGPTLRSYDGPESFIANYPFAPYHFQLVQKVFEEIRKVGATGAHLAYGERSMLDAFQMAALSIANKEIGALVPLHSFYRAVEGFLDTAVKRTIDQAGENTVLDTFDVQILRTLFMIRYVDLIKGTLDNLVTLSIEQVDEDKLALRRRIEETLQRLEKESLITRNGEEFVFLTNEERDITRKIKATEIASSDENKALADLIYKDLLKDKNKFRYSINKTDYSIGRYLDGHSLEGRYEHDLRVEVISPLDLDYALYGEAGCINKSNEAPTGMALFKLPDNKEFFTELRTWLKTNKFIRLNDDGSQPELSKILADRGRENQERKKRLRLMLEELIERTEVYALGQHLKLSGSNIQSKFDEACQYLLENTYTKLGYLKVLQQEPERELHTILHADDIGQLGLTLDGEEGNPQAIKEVEQFITLRASGNDRLLVADIIERFSKRPYGWPDGEILLILGRLAATSRITFHAAGPSLPLPDAFDYLSNSRKRREISVQKMRQTDEVLLKQVRNLSQDLFNALGPAGEKELFEYYRGHFKTWLGNLNNYKSKTDVGRFPGKEVIEQALLSLQRLLSNTDSVDFFKAVVDNKDDYLDLEEDYRDLHEFFANQLHIWQQLQQALRRFDKNKSALEKDDKARTALLELQTIEKNVAPYNQLNKVAGLVEAVEAINAAILTEKCEHALAHVDEKIAQLQTEIAKSGIESAELSNRLLRPLQLVKADLETETSIANIYLLQTQTADERLHDGVFELERAIQAEAERQQKLQQEQVKVAQAANAACGVKEDSAPSLTPTPKPVAPPKPVVEVAATSVFNKLGNGLYLENQSDIERFIDALKAELESAIKQDKRIRIR

SEQ ID NO: 1068 - protein, 1186 aa, Lachnospiraceae bacterium
MAQELEEYVVTKELQKHFADFFAAYKKGIEGMTPKMGVWISGFFGSGKSHFLKILSYLLDNKSVGNKHAYDYFVDDKKITDEKILSDMRLAASTPSDVILFNIDSKSESSGKQNKDAIVNVFLKVFNEMQGFCGSMPYLADLERKLNDDGKFEEFKKSFENEYGETWEESRSDFDFIQDSVVDALADISFMSEDAARNWCEKATTSYTISIEDFAKRVRSYIDKKGNNHHVVFLVDEIGQYIGDDSKLMLNLQTVTEELGKECMGKAWVIVTSQQDIDSITKVKGNDFSKIQGRFDTRLSLSSANVDAVIKKRILDKTETAAETLRLLYEQKATVIKNLIVFNDGVEKKLYANENDFKEVYPFVSYQFNLLASVLTSIRTHGASGKHLSEGERSMLALFKESATECKDDEVGILVPFHRFYDALENFLDHSHKGVISKAYDNTAINPLNKDGDVFTINVLKTLFMIKYVDQIESNIDNITSLMVENIDDDRIELKSRVEEALKVLISQMLIQKNGSLYIFLTDEEQEINNEIAKENVEMSEVITKIGEMIYEDILKENKYRYPSFNGRYSFGFNQNIDDRPYKSNQNFDIGLRILTPWYDVKEDATLRMMSGQGREVIVLLPDDDEFLNEMTMSLRIERFLRKNATSGQLAKYENIKKSKHDEMNERNANARLYLVESLKDARYYVNGDIARLSAKEVSTKVNEAIGRLVQIVFHKLSYIDTAMGEADIRKLFNTGNQMKINGGTVANIHATEDVLSFISMNSKGHMKTSMKTVKDRFMKAPYGFVEDDIYWIIAYLFKVGDIAFTLNGTSVNLNNKSVDEIINYITKKAFTEKLLMEERVRVSEKDKKEVRDVMKEVFHTPIVPDDEDAMMADFKRHANDMINELKDIEINYIKYNYPGKKVIDDGKRLFQSAIQINDALEFFGHISKMRDFFYDFDEDYEPVKAFFKGGQKEIFSRAIDKLRIYDDSKTYIVDTLEDTVKKMRDILKMSMPYKEIHKLPELMEQYQDAYNKVLDEELHPICESVKECRTYISDTLNEKEYANEKRQKYLAGFDELLNEAESSTNVSTLRGLEDKAKALMTRLLGEMDMLDEQIAKKKQAEIEQSLKEKAGQMGIDVDDDQVKKSIEEQSKQYKVKKTKNIPIKKMTGTMLWRLESKEDIDRYLSSLRERMLKELEEDTVINIQL

SEQ ID NO: 1069 - protein, 1229 aa, Vibrio cholerae; identical to SEQ ID NO: 729

SEQ ID NO: 1070 - protein, 1222 aa, Roseburia inulinivorans; identical to SEQ ID NO: 912

SEQ ID NO: 1071 - protein, 1213 aa, Salmonella enterica
MNIEQIFEKRLDRNINGVVKAEQTDDASAWIELDEYVITRELEGHLRHFFESYVPATGPERIRMENKIGVWVSGFFGSGKSHFIKILSYLLSNRKVSHNGTERHAYSFFEDKIKDALFLADINKAVHHPTEVILFNIDSRANVDDKEDAILKVFLKVFNERVGYCADFPHIAHLERELAKRGQYDAFKTAFATITDSSWEKERDSYYFISDEMAEALSQATGQSVDASRQWVEQLDKNFPLDINNFCQWVKEWLDENGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDAAKPALAKVWQEKGDILRNQLAFDPTTTASLRPYTSEEEFIDNYPFVPWHYQILQKVFESIRTKGAAGKQLAMGERSQLEAFQTAAQQISPQGLDSLVPFWRFYAAIESFLEPAVSRTITQACQNGILDEFDGNLLKTLFLIRYVDVLKSTLDNLVTLSIDKIDTDKVELRRRVEKSLNKLEREMLIARVEDKYVFLTNEEKEIENEIRNVEVDFSAINKKLASIIFDDILKNRKYRYPANKQDFDISRFLNGHPLDGAMLNDLVVKILTPKDPTYEFYSNDAACRPYTSEGDGCILIRLPADARTWTDIDLVVQTEKFLRDNAGQRPEQASLLSEKAKENSVREKMLRVQLESLIAEADVWAIGERLPKKSSTPSSIVDEACRYVIENTFAKLKTLRPFNGDIAREIHALLTVENDAELDLGELEESNPDAMREVESWVSMNIEFNKPVYLRDILNHFARRPYGWPEEEVKLLVARLARKGKFSFSQQNNNIERKQVWELFNNSRRHSELRLHKIRRHDESQIRKAAQTMAEIAQQPFSEREEPPLVEHIRQVFNDWKQELNVFKAKAEGGNNPGKDEIESGLRLLNSILSEKEDFALIEKVTSQANELLDFSEDREDLVDFYRKQFATWQKLGAALNGSFKSNRSALEKDAVAVKALGELENIWQMSEPYKHLNRITPLIEQVQSVNHLLVEQHRQHALERIDARIEESRQRLQEAHATSELQNSVLLPMQKARKRAEVSQSIPEILAEQQETMALQTDAEKKINQWIDELRKKQEAQLRAANEAKRAAESQQTYVVVEKPVIQPVPKKTHLVNVASEMRKATGGEVLETAEQVEKALDTLRTSLLAAIEAGDRIRLQ

SEQ ID NO: 1072 - protein, 1213 aa, Acidovorax sp.
MIIRDLFQKPIDRPINGVIKADQMDAASVWQELEEYVVTKQISEYLRRFFDAYLAAIDRPHDAAITDRMGVWVSGFFGSGKSHFIKILSYLLENLQAQNPETGEKRSAAQFFDHHKIKDAMLQADIQRAVQGTADVILFNIDAKADSKTDRDAILQVFLRVFNEKLGYSGDAPHIADMERHLVSKGALDAFKAAFAASNGSTWEQERDAVDFLRDDIVAALAQALKMTPESAGQWFDRARDDFRINIENFAKVVNDYLVTRPASHKVIFLVDEVGQFIGANSQLMLSLQTITEQLGTQCKGRAWVIVTSQEDIDAAIGEANKAKSQDFSKIQGRFHTRLSLASSNTDEVIGERLLSKTEAAHVLLRDAFASKGDVINNQLSFVGNAVSLRGYKDAAEFVACYPFAPYQFTLLQKIFETIRKVGATGKHLSRGERSLLDAFQSAAVRNAPNGINVLVPLYDFYPSIESFIDGMAKRSIDEAPLNPALQPYDSQLLKAMFLIRYIPDIVKPNIDNLATLCIDQIDADKLALKRQIQESLARLEQQRLVSRNGDQWFFLTNEERDVAREIGHVDVSAAEKARLLAEIVFDEILGSQTKVRHRDTKSDYEFNRLLDGAPWRQASHALSFEVLTPLGDDYDKLHSAKCILRSSEGAGRALVRLAEGERLDIELATYQQIEKYIVSPKADQATPSLKRILADRKDENRERRQRLVHQLSELITAGDFYALGQPVQIKASSPATVLDELLNYLITNTYSKLPYLKVRQADPIAEIKAVLSAGDLAQHALALNGEAGNPLAVQELRDYLQLAASQSRVLLSDVVDRFAGIPWGWKPEWETVLLVARLFMAGEIKLMLEGSDLDPASAADPLTKSARFKQVSILKRKTADATILRRARELYKDLFSQLGREDEDSLVADYRTRLGDWQSDLKSYAHTAATPHHPGKATIDAALARIGQQLAIRDSFAFIEALLSAKDDWQDASDDIHDLVNFYKTQITAWRKLLAALSQFADNREALNKVPQAATALAELTQIRDNPQPYALVNRIEPLVATVTSVNEQLAQEKREKALLSIDDKLAEVQKQLAASAATPELSNKVLKPLQDLKARIAGLTGIAQILYLQSQGGDAMDEAITLIEAAVAAAAAKPTTTKVASPGDTTQPLQTGKPNALVSPAPAPKTTRVVRAAEFSNQPYLETEAEVDAYLTRLKSELLAVVRAGQKARVQ

SEQ ID NO: 1073 - protein, 1147 aa, Desulfonatronospira thiodismutans
MLNRQVYFKDPSTWSLVNQGVAKVDEDTTPDALKVLRYEMETFVCDGQYEKGLEQILHSYLRNIDQGAPEQPGVWISGFFGCGKSHLVKILKSLWTDTVFPDGATARGIARLPDSIRTHLKELNVQGKRQGGLHAASGTLGAGARGSVRLALLRIIFKSVGLPPKYPVASFVIWLKREGIYDQVRSIVEEEGHNWDEELDNFYVAEGLHQALTRVKPHHFPSPSSCVETLINLFPNVEDISNDDMLKTISKALTREKKFPLTLVVLDEIQQFIGDSSQRSMEVQEVVESCCKGIGGKLLFIGTGQTAITGTTNLKKLEGRFTIRVELSDADVETVIRQTVLAKDSNAIPVIEQAMHKNLGEISRHLSGTAIGHMHEDIDALTKDYPILPVRRRFWENTLRVLDQTGTDSQLRNQLSMIHKAIQTNLDHPLGNVIPADYLFFDAAERLLQARILPRKVHEKIMRWHSGNDDERLTARACGLIFLLNKLTAANQALGIKSEPDTLADLLVEDIAQGSGGLRSRLPGLLDDCSLLMKVGQEYRIQTEESAAWNDEFQNQFHQLANETHRVEAEREDRIRRKFGEITGRLSLLHGSSKVARNIHPVFEPSLPADCAQRICLWIRHGWETDENSIRAEAREAGNKSPTIFVFIPKRSADDLRRNLLSCKAAAATLDKRGNPGTSEGIEARAAIKTIMDNSEIRINELLDDAFSGARVFQAGGTEILGGNLQEMIIEAAENSLKRLYPQFDLADHTGWEKVYSNAGKGSPDALKAVGFEGEPATNPVCKAILGYIAGGKRGAEIRNRFESPEYGWPRDAVDGGLQVLLVAGLVRAEDERGNTVHPRELERKAIGKAVFKVESATVTTPQRIQIRKLFQKMGISSKPGEELSHVPEFLQKLSELASSAGGEPPMPEPPDTSFLEDIRLSSGNEQLLAIYNLRDELSRHIDTWSDLSQGISRRMPQWRVLKNLSHYAHPVEDAEIILTQVQAVEQNRQLLEEPDLVEPLISSLTQVLRQELNRLKQAWDQEWEKGEARLEKDENWHRLAREQRHELRNQQGLVEASIPSIQLDSTDSILNTLNTAGISALKDRIAAMPGRYSQMLMEAARMLEPEVQEVALPSSILKTEQDVDEWLTQARKKLLEQLKSGPVIPG

SEQ ID NO: 1074 - protein, 1214 aa, Oribacterium sp.; identical to SEQ ID NO: 834

SEQ ID NO: 1075 - protein, 1208 aa, Magnetospirillum sp.
MLIKELFEKPIDRPINGVIKADQIDDGSKWQELDEYVITRELDNHLRKFFDSYLRSIDASGDPETAGKVGVWVSGFFGSGKSHFLKVLSYLLENNTVSMGGETKRAVDFFDGKIHDAMLAADIKRAVAAETDVILFNIDSKADTGNDDPILTVFTNVFNERLGYSPDHPHIANLERHLGAKGKLDEFKKVYREIAGGEWVDERDAFFLNSDSIKTALARVLGQSEDSFEKWLDNPEVAVNLSPDNFAAWVKQYLDSKGPKHRVVFLVDEIGQFIGQDTHMMLRLQTITENLGTVCGGRAWVIVTSQEDIDAVLGEMRSAKSNDFSKIQGRFKTRLSLSSADVHEVIQARLLDKTANARDALVGVYKDKADILKNQLSFTNVGMTFKPFANDDHFAKVYPFAPYQFQLVQKIFEAIRRVGATGLHLAKGERSMLDAFQTAAKDLSSANVGVLAPLYLFYPSIESFLDTTVKVTIDQAGDNASLEPFDNLVLRTLFLIRYVEEIKGNVDNLVTLFIDRIDADRLAIKKQIEASLQRLERETLVRRNGEDYFFLTDEEKDIGRGIKGIDLHGGEEVKELGRMIFEDVLGGNRKHRFEDTKKDFLFNRFCDQHPYGTRTDDDLAVSAITPLSEDYDDWNEARCLMKSNENGGQVIVKLPADRKLGQELRTYLQTDKFVARTNNGGLPASTVRILQDRAAENRKRLDNLTVHLGELLKNAEFYAAGSKVAVKGGSGDAAIRQSMDYLIRNTFTKLGFLKHIIQDQTALLNEIKAVLNAPDTADQKLKLEGDEGNAQALKEVLAFVSLMDSTSKRVVLHDLIESRFGKRPYGWPEWEVLRLVARLVAAGELSLSMDGALLTRDKIFEVVKTPNKWRSIVVIKRQTVDASLLQQARNLGKNVFAKMGPDGEDALYEFLREQCESWQTNLSGYLKLAETGNYPGKDAIDIGLKLLKLILTEKDSYGFIKRFVTLKVEFENLSDNVSDLDTFYGTQQPTWELLRKKHGEFIVNRKELDHNQDAAAALQQMEVILAHVAPYPLIKDISGLVSKVAAINDEVVNKRRSHALGQIDQHVSEVKDALDHIAASPELRNKCLIELQKLRLTAEKQTSIAHIHQAVAEAVDAKDDALDVIARYVPPKPPADPVTPAGGDTTVAVATKPKVVAPQPVFKKPRVVRPAEMKSGYLKTQADVDAFLGKLRKELEAALAAEEPIEIR

SEQ ID NO: 1076 - protein, 1213 aa, Escherichia coli; identical to SEQ ID NO: 660

SEQ ID NO: 1077 - protein, 1151 aa, Vibrio cholerae; identical to SEQ ID NO: 825

SEQ ID NO: 1078 - protein, 1226 aa, Acinetobacter baumannii
MNIKELFYKPLDRAINGVVKADQNDNTTVYQELDEYVVTNELEKHFRDFFQSYGTDLSDPSIANRVGVWISGFFGSGKSHFLKTLSYILANKVARDAEGNERSAAEFFDETKIRDAFIRADIGKAVSHHADVILFNIDSKASSNDDGNPILNVFLRVFNEYQGFSADHPHIAHMERHLSQKGVYERFKQAFEESSGMSWLEERDGYQFYQDDVETAISQALNLSAEAAHKWFEDSEQTFSVSVENFCQWVKEYLDSKGPQQRMLFLVDEVGQFIGSDTRLMLTLQTITENLGTICKGRAWIIVTSQADIDAVLGEMSSSKANDFSKIAGRFKTRLSLSSSNTDEVIQKRLLRKTPEAEALLRSVFEQKGDILKNQITFDRSGPTLKNYEGPDSFIHNYPFAPYHFQLVQKVFEEIRKVGATGAHLAYGERSMLDAFQMAANAIATDEVGALVPFHRFYTSVEGFLDTAVKRTIDQAGQNKTLDGFDVQMLRTLFMIRYVDIIKGTLDNLVTLSIEKIDEDKLALRKRIEESLLRLEKESLITRNGDEFLFLTNEERDITRKIKATDLAASEENKELANLIFKDLLRDQNKYRHQANKMDYQIGRFLDGHSLDGKYESDLKVEIVSPLDTEYNLYTEAYCIGKSAEAEGQILFKLADDKQFFNELRTWLKTNKFIRLNDDGTQSDISRILADRGRENQERKKRLRARVEEMLLDAESYALGQHLQLSSSSPTTKLDEACRYLLENTYTKLSYLQVYQQDAWRELNAVLTVDDMAQLGLSLDGGQSNPKALQEVEQYIALRATGTERILVSDVVDRFAKRPYGWPDAEILLLVGQLAAIGRISLQLNGGSLQLKDAFEPLQNSRRRRDVSIIKKRQTDDQVLKQARQLTQDLFSAMGPATEKELFEFYLQHFKNWLANFKSYKSKTDVGQFPGKKVIEKSILTLERLLTNSDSFDFFKAVVDNKDDYLDLEEDYRDIHEFFSNQMPSWQQLQQALRHFEKNKQALGSDEVAKKALSELHRIATLESPYGLLNKVADLVRTVESVNEQLLTEKRNQAIEHIDDKIKQLEAEIKNSGIASAELSNKLLRPLQLLKTDIEVESSLSTIYMLQTQTAVERFDEALYELESEVQAEIQRQAKAAQLAQSKAESVTNTATASSPATSTPAASPVQPATAVVPPKPVVEVDVASIYSKSSSSVYLETEESVDQFVDALKAELKKIVGDKKRVRIR

SEQ ID NO: 1079 - protein, 1226 aa, Acinetobacter baumannii; identical to SEQ ID NO: 904

SEQ ID NO: 1080 - protein, 1205 aa, Magnetospirillum sp.
MLIRELFEKKIDRPINGVIKADQTDDASKWQELDEYVITRELDKHLHGFFNSYLKSIDAPGDPELAGKVGVWVSGFFGSGKSHFIKVLSYLLENKMVSMGGESRRAVEFFDGKIQDAMLAADIKRAVNADTDVILFNIDSKADTSKDDSILTVFTNVFNERLGFSPDHPHIADLERRLDAKGKFGEFKAAYREISDCDWVSERDAFHLNSDSIKTALARVLGQSEDAFEKWLDNPEAVFNLSPDNFAGWVKQYLDSKGPKHRIVFLVDEIGQFIGQDTHMMLRLQTITENLGTICGGRAWVVVTSQEDIDAVLGEMRSAKSNDFSKIQGRFKTRLSLSSADVHEVIQARLLEKTPAARDALVSVYKDKADILKNQLSFTNVGMTFKPFANDDHFAKVYPFAPYQFQLVQKIFEAIRRVGATGLHLARGERSMLDAFQTAAKDMASEKVGVLVPLHRFYPSIESFLDTAVKATIDQAGDNASLEPFDNLVLRTLFLIRYVEEIKGTVENLVTLFIDQIDADRLAIKIQMEASLQRLEGQTLVRRNGDEFFFLTDEEKEIGRGIKGIDLHGGEEVKALGEMIFDGVLGGYKKHRFEDTKKDFPFNRFCDQHPFGTKGDGDLAVQVITPLSEDYPDWNEARCLMKSTEDGGQVVIKLPDDRKLGRELRTFLQTEKFISRTNDGGLPASTVRILQDRAAENRQRQDNLTVHIGELMKNAEVFAAGNKVTVKGGSGDGAIRQSLDYLIKNTFTKLGYLKHICPDPQTEIKAVLNAPDTADQKLKLDGEDGNAPALKEVLEFVRLKDSINQKVILHDLIEGRFGKRPYGWPEWEVVLLVARLVVAGELSMSMEGALLTRDKIFEQVKTPNKWRSIIVIKRQTVDAALLQQARNLGKSVFSKMGPDGEDALYDFLREQCEKWQANLSGYLKLAETGKYPGKDAIDAGLKLLRLILAEKDSYGFIQKFVTLKAEFQNLSDDVSDLDTFYGTQQPTWELLGRKYAEFVVNRKELDHNPDAAAALQQMETILGHAAPYPLIKDISGLVSKVTAINDALVVKRRSHALEKIDQHVSEVKEALDHIAAPPELRNKCLSGLQKLRQTTEKQASIAHIHQAVAEAVDAKDDALGEIEAYVPPKPAAKTPPPVTPGAGGEEPTKTKAEPPTPVFKKPRVVRPAEMKSGYLKTQADVDAFLGKLRKELESALAAEEPIEIR

SEQ ID NO: 1081 - protein, 1213 aa, Escherichia coli; identical to SEQ ID NO: 660

SEQ ID NO: 1082 - protein, 1151 aa, Vibrio cholerae; identical to SEQ ID NO: 825

SEQ ID NO: 1083 - protein, 1219 aa, Bacteroides sp.; identical to SEQ ID NO: 1006

SEQ ID NO: 1084 - protein, 1151 aa, Vibrio cholerae; identical to SEQ ID NO: 825

SEQ ID NO: 1085 - protein, 1213 aa, Escherichia coli; identical to SEQ ID NO: 660

SEQ ID NO: 1086 - protein, 1229 aa, Vibrio cholerae; identical to SEQ ID NO: 1034

SEQ ID NO: 1087 - protein, 1179 aa, Methylophaga aminisulfidivorans
MKLRAIFDKKVDRSIEGVIKADDEASLKIEIEEYVLTNEVENRLGIFLDAYNNYEGANGVWVSGFFGSGKSHLLKMLALILENREVDGTNTLDLFLPKCDDNEILKGDLKRAAELPSKSILFNIDQKADVISKTQMDALLAVFVKVFDETCGYYGKQGHIAQFERDLDSRDLFQKFKDAFESVSGKHWHIGREQALLESANIAKAYAEVSGSDVETAKGILDKYRTEYRVSIEDFANQVNQYIDRQEPNFRLNFFVDEVGQYIADNVKLMTNLQTIAESLATKSRGRAWIIVTAQEDMNTVVGEMNKQQSNDFSKIQARFANKMKLTSQNVDEVIQKRLLMKNDDGVQLLSNIYHIESNNFKTLFDFADGSQSYKNYKDRDHFIHCYPFIPYQFGLFQSAIQNLSAHSAFEGKHSSVGERSMLGVFQEVAIQISENEVGRLATFEMMFEGIRSALKTKTQQAILKAENQLDDDFAKRLLKALFLIKYVKEFKATVRNLCILMLESFDDDVAALRKRVEEALNLLEQQTYIQRNGETYEYLTDEEKDIEQEIKNTEIESADVASELDKLIFDEAIRLRKVRYDENGQDYAFSRKLDDKLQGREHELAVHVISPFHEHAENEQMLITNSTYKADELFVLMPADDRLIRDVKLYKQTEKYIKQNISNTQKETAKRILNDKGFQNKERYADLRLRVKTLISKAKLLVAGNEIEIGTEDPQTRVIQGFHNLISRSYPNLKMLRGITYSENDISRCLKPEESLFENDAIGLAESEQEMFAFIQSNNKGGVRTTVKSLVDRFERKPYGWYYAAIICTLAKLCACGKIEVRSDSHLLEDDDLSRGLRNSAGFGNMVLEPQIEFTASQIRGLKDFYEDFFDAPAKLSEAKSLGQESAKAFAELINELKVLSARASQYPFLNALTPVVSSLEEVSGKPYTWYLTELKSQEDALLDMKENTIDPVRKFMSGPQREIYDSARQFLQKQDANFAYIDDEQIKTIQNTLAEPECFKGNRIQQIKRSVDELQEKIDNTLKSEREKATDRVNELKDKLTNTDEFSSLDEQQQVQLTQEFDEFINEIISKTLIAVISDTLRRFEDETYNRLLSRAMFWSQPQPEPVKPYPPTTGGATTPVEPNEVKEPQIQIINSKSIKVNYQKPLLASETDVEGYLESMRDALMEEIRQGKRIQI

SEQ ID NO: 1088 - protein, 1213 aa, Escherichia coli; identical to SEQ ID NO: 660

SEQ ID NO: 1089 - protein, 1151 aa, Vibrio cholerae; identical to SEQ ID NO: 825

SEQ ID NO: 1090 - protein, 1193 aa, Photobacterium sp.
MSMKLEQLFSKQVDRTIEGVIKADDDVALYLELDEYVITDEVAKRLDIFLDAYLNYQGANGVWVSGFFGSGKSHLLKMLALLLENNPIEDITPLEVFLEKRPLNEGGIFANDLKRAVTIPSESILFNIDQKADVISKTEMDALIAVFVKVFDEHCGFYGKQAYIAQFERELADDGLLEDFVSIFKNISGMEWEKGRARAKRMGDSIDKAYNKVSAQSVTGILDKYRADYRLSIEDFAEQVQSYIATQKEGFRLNFFIDEVGQYIAGNTKLMTNLQTVAESLATKCKGQAWVIVTAQEDMSSVLGEASQKSENDFTKIQARFKNRMKLTSQDVAEVIQRRLLEKKEELVPTLSDLFHQQENNFKTLFDFADGSQTYRNYRDREHFIQSYPFIPYQFTLFQSAIQNLSLHSAFEGKHSSVGERSMLGVFQQVAIAIKDHQLGELATFDLMFEGIRTALKTAIQQSIIKAEKQLDNMFAIRLLKALFLVKYVKEFKPSVRNLCVLMHDSFERDIPSLKLEIEEALNLLEKESYIQRNGEVYEYLTDEEQDIEQEIKNTEVDNSVITSELEKLIYDAVLKTRKIRWEENKQDYSFSRKLDDNLSGREHELAINVISPFYDKLVPLEKHKVDTVYVDEVRIVMADSERLYRDLILYHQTEKYSVHATKSTQQDSIKRIIAEKRSYNAERLLQLKQLVAKLIGTAKYYVAGQDLELTGDDGQSKIIKAFGELIKRTYPNLKMLREVSYSENDIPGILTKAEQGLFGDETQLPESQQEMLSFIQSNSRGGVRTTVKSLLEKFEGKPYGWSFAAVLCTLAHLCGRAKVEVRESTNLLDDADLAKALKSTPLHGSLILEPQVEFSQSQIRKVKEFYNDYFDKVAHATEVKALAKEVQESFVEQSNAIDKLLALSEQYPFIRALSPILAELQALKAKPYTWFMSELVSDEDKWFDFKENTIDPIIKFMKGPQKGSYDKAKQLLTTQKPNLDYVSSSNGKSAYQHITDALVSQDIYKSSTIVQLKANTESLAKELNELLVKERALAISSVESLKKKLTGFDEYQALDQSKQASLASAFDTAIGKLNEQSLIAMLRDEVRRFEDQKYSSLVQQLMTWSQPAPELVKPKHSTTKQPEAAGNVSDKPSQEKAGVEESTAAPQTITARNMKVEFHKPWLANEQDVEQYLEEYKKALLAAINDGKHIQL

SEQ ID NO: 1091 - protein, 1151 aa, Vibrio cholerae; identical to SEQ ID NO: 825

SEQ ID NO: 1092 - protein, 1250 aa, Fusobacterium sp.
MSDLAIKNILQKDIERKINGVVKADSNEKDTVITELNEYVVTEEIRERLTKFFDKYVDSINFPTEDMGVWISGFFGSGKSHFLKMIGHILENNTYDGKKVVDFFKDKIDDAILMGNIEKAAEIPTDVILFNIDNVSDQDTYQNKDSIAVAFLKKFNEYLGFTRDDIEIAEFERKLWEDGKLEEFKKVFEKESGKTWKDANRNLDFHSDDFLDVIEKLGIMSRESAERWLERDIVRSISAESFRDILENYLKMKGPKHRIVFLVDEIGQYIGDNSKLMLNLQTLVETLGVKFKGRVWVGVTSQQDLSSILNNSEHRKNDFSKIQDRFKTMLALSSGNIDEVIKKRLLIKKKIEGEDLEKIFDKKRVEIENLIHFEKTMTLPLYDDNKDFSETYPFVAYQFNLLQKVFEKVRNMGHSGQHMSRGERSLLSSFQEAGIKVKDKNIGILVPFNYFYESIEQFLEDNVRRPFIHARNEKGIDDFGLEVLKLLFLLKGINGIEPTLNNLTSFMIDSMDSDRIELEKKIKKALEKLEKEVLIQKDGENYYFLTNEEQDINREIEREDIDLKKIDEKIDSYIFKEIFTKNSILMEETGNKYNFTRTIDETVYSKSGEDLAITIFTERADDYDNVAIVGTRPESDLILRLAKDDETYRNEIKLFLKVESYIRNKQKDNERESIIRILEIKQRENKIRDRRIKNELERLIGEAEVFVYGQKQDIKTKDASKKIEESLKALANHRFHKAKLVKKSYDEAEIRNILSYVYDTEENGILFDIKKDVESNINSEAIKEVLERITLLEKRGDTPITLKNISEYYLRSPYGWGQLTINGLVGELWKYKLIDLQESKVLVTDENTATNLLTKLQNKNLEKIVISLREEIDPELIKKVNNLLKEIKTIKEDTGEVTLDSPKEDLLEILKRKIGIAKSYKIECEHSKYPGKKELTDWIDLLDEIILSKDNAEKTLKNFLEMEDELSKEYDKVDRVFDFFTSSKKDRYDKAIEKINKIEEYKDYIGSLKETNAYKTIEEIRVDKNIYERIREFDDLISELDIAKDELIEIEKTSLKEKVEKYKKEFSEKLKDNPEVIKKLEEKLNEFLEKEVNNKDNSNDMAIFMKSKKLENIVNNFEEEYKNSAKKEIEKLENYLNEVAEDKTDIDELRKSIKSTYNNYKDEIAKSDIKNVSITIAKAIKDKEDFNAEINGKAKKKERVKLRKISINSKSNIESEEQVKDYISAIEKDIEKLKNEMLEAIKNNKIVDIG

SEQ ID NO: 1093 - protein, 1221 aa, Clostridium perfringens
MEANLGSMFYKKIDRPIKGVIKVGQSDEENVKQELEEYVVTRELSTHIDKFFEAYKEGILGITDKNGVWISGFFGSGKSHFLKILSYLLENKKIDEKRAVEYFNDKDLDNFTLGNMKQAGDISSDVILFNIDSKSDSDSKSNKDAIVNVFNKVFNEMQGFCGSMPWLADLERQMCKDGVYEDFKREFEEISGTPWIEAREDFYYEEDSIIEALAKTTKMSEEAARSWYDKCQDNYSLSIDKFASKVKEYCKSKGANHHVVFLVDEIGQYIGDNTQLMLNLQTVVEDLGTKCEGKCWVIVTSQEGLDEFTKVKGNDFSKIQGRFNTRLSLSSANVDEVIKKRILRKKDWATSHLKVLYDQKESIIKNLLTFTSDTAEMKLYKDSDDFAEVYPFVPYQFNLLQSAFNGVREHGASGKSLSKGERSLLGAYQQVAIEYMNKESNILIPFSAFYSTIETFLDSSIRSVIMKAERNDKLEEFDIEVLKLLFLIKYVKEIKANIENLATLLVDDIDISKKELKDKLNDSLKRLIRETLIQKNGDEYIFLTNDEQDVNKEIDNIFIETGDVVNKIGEIIFDDIYGEAKFSYSRKYIFSFNRAVDDRPRGSQNNDIGVKIITAAFDLNGVGDQFALKQLSVRENNVIVDISKDSNYFEEIENVLKIDSYLRVKSGSKSSIAIEDIKTKKSREREERLKRAKFLIEEDLKTCDIYANGNLLEIKEKNCVDRINEGLKSLVDSKYNKLNYVKEFKNGIDDLYGIMDKRVNQLSTLDMDQNRLAVEEVRNHIEQNSTRNLPITVKSVLTKFSNAPYGWKEIDIQGIIVTLFKNQDIKVIYNSEVLSPNNRDVVLCVTKKDRVERVSLKIREKVPNKYVDNLKDINSELFGFSSMPSDEDGMMNLFKDQCKTELNKIDAMLSCFGIMSYYPGEKTLKKGKGLFEEILSIGDTLEFFKTVYELDDDFADYIEDIEDIKKFFFNKENGRIDTNTNKGEQRKIFDDAIKTVNNYKINEAFIVDEDVDSIIKSIEVILRMTKPYGKIKDIPVLIGKYNDKIVELLEIKSEPVIEFIESCKKEVLETLDNEEVKEKFYNNILEEFNSQIEKVEHSKSFMELSSMKEPAENLRLKWIQKIITENEVIKRREERKLAELTSTRGIGEEEHKNSYGNDTEVPVDTVKPVEIIQVKTKAVSVRELVKGEKIIKNEADIDAVIESLRKKLKNELEENTIINLI

SEQ ID NO: 1094 - protein, 1184 aa, Actinomyces neuii
MKLAEMYAKDINRTIDGVIKASEDEHVRLEVEEYVFTAEIKNGLSRILEQYTSPHPKSNGVWISGFFGSGKSHLLKMTSFLLGDVQGSSSVSRDFVAEQFLQKASQDAFLQASLKKAAAIPATSLLFNIDAKDDKAQSSKNLALLGVFYREFYRACGYYDRDLAVARLERDLDSLHKLAQFKEAFTQVSGGKRWEDARKAALFANGDAEAALAQIGSPITNPIKTYRDNLALSAEGFAEEVRDWIDRQGPTYRLNFFIDEVGQYIGTDTKLMLSLQTVTEELFSKCQGRSSVFVTSQEQLSSVLGELADRRGDDFSKIQGRFDTQVNLSTQEVEEVVSKRLLTKTDQASAALRQVYDAHQAEFESAFSFPNWEKTYRNYPTAASFVDTYPFVNYQFDMFTQTMIGLSSAGAFTGRHSSVGARSLLGVAQQIAKDIQNKQVGVLASFDQFYDGMDQSLNSDIKLNVQRAVAQFRDSNPLAIRVLKTLLLVRYVQNFPKDPKNLRVLLRRDLDEDVAQLEADIEEALKQLERQVLVQRMPNGTYEYLTNEEQDIKREIDSMPVSNSQVWDYVKSAIVSALGSDATKYRYPDSKMDLNVGMFVDDTQVGGEQQIAIRYYTPNAGVDEGIVAQRSVGSQKDLFVLLDLQVDHYTEIETWHKTNDYLRRNSTSAQGSASRFIVEHKANNAERNASLQKDIADSIRNARFFVNGLEVSPSSRGNAKDAVRTALGRVVATVYNRIGEVKPFLSWTESNIGLALQDDEGGIFTSPEVATLSSLANEVAQWINTTRQREGKSTYVSDAVEHYHGAPCGWPAAVTLAIIARGVRDNKLEVSHNQAPVPRTQLAQLLATRSEHKSLLVEQKKTYDRSQVARLLTVANDLTNAWPQMQQAAEAPKEVTKYAYKVIEEMRQVAESDFAFAAQADQVIGAFEPFSVTHNVDFFMDGQNMASLEELLDVKEDFVEPVGEFFRKHLPLAEKARQLALSPENYDLPGADAQLPGQIQALLESPNLYNLVPKLKAATEDLERAQRALAEEQHRLIEAELAHAVEGVQASQQWQQASEASRERVGNAIAEFEKLVASSANSAQLSSLQLKLNAAKTSWVNELMRVSPVPAPAAAAQGDAAASPAAEPARQPAQPKQPRAKSISSFLGSSSLATISSTQELDEYLGQLRVQLADFIDDGGVVTL

SEQ ID NO: 1095 - protein, 1223 aa, Enterococcus faecium; identical to SEQ ID NO: 824

SEQ ID NO: 1096 - protein, 1213 aa, Escherichia coli
MNIEQIFEKPLKRNINGVVKAEQTDDASAYIELDEYVITRELENHLRHFFESYVPATGPERIRMENKIGVWVSGFFGSGKSHFIKILSYLLSNRKVTHNGTERNAYSFFEDKIKDALFLADINKAVHYPTEVILFNIDSRANVDDKEDAILKVFLKVFNERIGYCADFPHIAHLERELDKRGQYETFKAAFADINGSRWEDERDAYYFISDDMAQALSQATQQSLESSRQWVEQLDKNFPLDINNFCQWVKEWLDDNGKNILFMVDEVGQFIGKNTQMMLKLQTITENLGVICGGRAWVIVTSQADINAAIGGMSSRDGQDFSKIQGRFSTRLQLSSSNTSEVIQKRLLVKTDEAKAALAKVWQEKADILRNQLAFDTTTTTALRPFTSEEEFVDNYPFVPWHYQILQKVFESIRTKGAAGKQLAMGERSQLEAFQTAAQQISAQGLDSLVPFWRFYAAIESFLEPAVSRTITQACQNGILDEFDGNLLKTLFLIRYVETLKSTLDNLVTLSIDRIDADKVELRRRVEKSLNTLERLMLIARVEDKYVFLTNEEKEIENEIRNVDVDFSAINKKLASIIFDDILKSRKYRYPANKQDFDISRFLNGHPLDGAVLNDLVVKILTPKDPTYSFYNSDATCRPYTSEGDGCILIRLPEEGRTWSDIDLVVQTEKFLKDNAGQRPEQATLLSEKARENSNREKLLRVQLESLLAEADVWAIGERLPKKSSTPSNIVDEACRYVIENTFGKLKMLRPFNGDISREIHALLTVENDTELDLGNLEESNPDAMREVETWISMNIEYNKPVYLRDILNHFARRPYGWPEDEVKLLVARLACKGKFSFSQQNNNVERKQAWELFNNSRRHSELRLHKVRRHDEAQVRKAAQTMADIAQQPFNEREEPALVEHIRQVFEEWKQELNVFRAKAEGGNNPGKNEIESGLRLLNAILNEKEDFALIEKVSSLKDELLDFSEDREDLVDFYRKQFATWQKLGAALNGSFKSNRSALEKDAAAVKALGELESIWQMPEPYKHLNRITPLIEQVQNVNHQLVEQHRQHALERIDARIEESRQRLLEAHATSELQNSVLLPMQKARKRAEVSQSIPEILAEQQETKALQMDADKKINLWIDELRKKQEAQLRAANEAKRAADSEQTYVVVEKTVIQPVPKKTHLVNVASEMRNATGGEVLETTEQVEKALDTLRTTLLAVIKAGDRIRLQ

SEQ ID NO: 1097 - protein, 1151 aa, Vibrio cholerae; identical to SEQ ID NO: 825

SEQ ID NO: 1098 - protein, 1151 aa, Vibrio cholerae; identical to SEQ ID NO: 825

SEQ ID NO: 1099 - protein, 1240 aa, Fusobacterium necrophorum
MKNCLIQSTFQKDITRKINGVIKADSKEEDVIVTELSEYVVTEEIQKYLNIFFNRYVDSLQSPTEDIGVWISGFFGSGKSHFLKMIGRILENKEYQGKKVIDFFEEKIQDAILQKNIEKAAEVPTDVILFNIDNVSDQNTQQNKDTIPIAFLKKFNEYLGFSRDNIKIADFERMLWEKGKFEIFQKTFAEISGKIWKEEYRNLDFDADDFLDTIEKLEIMSREAAIRWLEKESDISISAESLADLLEQYLKKQSKEHRIVFLVDEIGQYIGENSQLMLNLQTLVETLGVKFKGRIWVGVTSQQDLGNILGKARERSNDFSKIQDRFKTMLPLSSANIDEVIKKRLLEKKQLQQEELESLYDKTRIYIENAITFDKTGMTLALFEDRKDFAESYPFVGYQFNLLQKVFEKVRNMGYSGQHMSRGERSLLSSFQEAGIRVKDMEVGSLVPFQYFYQSIEQFLEDNVRRPFIHAKNERGIDEFGLEVLKLLFLLKGIKGITPNINNLVSFMVDSVDCDRLALEEKIKKALGKLEQQVLIQKDGEGYYFLTNEEQDINKEINQELINEQDVYKELNTYIFGQIFTSPTVTMEDTKNKYNFSQKIDEIPFGKIGGQLDILILTPRSDEYDNIAILGYRDGYDLILRLPEEMTYWKEIQQSLRIASYVQKTLRGSIREVVHQILQMKQQENSKRKQRIQSEVERMLSEAEIYIQGQKVNITTTQADKRIAEALKAVARHRFNKAKLIQKPYYESEIRNVLSYEYDAGTNLFDIKKDMSTNPNYEALQEILTYITLHTSRGNVITLKHIVEYFSKKPYGWEIFSIHGLVAELWIYKQIQIEESKNPIHNAEELKILLVKSQSKTEERLVISLREEIDTELLQKVNNLLKKLFGPEKEVSVDQQKKDILEILKKKIDLPKMYSRECESGVYPGKKELQEWIDLLEEILFSKEKTEKLLKHFLEMEEELLEAYDNQGVVLDFFRSSKKKKFDEGLEKRKKIKEYEAVIGSIQETKPYQDLVDILTNKSPYNQIKHIDALLEEIQVEEEKLILEEKNMLLQRIEEKAKEFSILFQERDAMLEKTIEKLKAFKNKIEKTDDLSIFFSLSDWNKVLSSIEMEYRKNIQEELRSFEKAAFEVTEDKTDVKELVEDIRNTFHAYQEEAKSNDVDQLEQLIQKAKKDQEGFILQGNGRAKKKERVQFRKIRVAEKSNIETIEAVEEYISKLENEIQSLKEKMLQAIRENKIVDIQ

SEQ ID NO: 1100 - protein, 1151 aa, Vibrio cholerae; identical to SEQ ID NO: 825

SEQ ID NO: 1101 - protein, 1152 aa, Xanthomonas vesicatoria
MNKGKQMLNRDIYQKDPSTRKLVNEGVASVNDEKTNQALSVLRYELETFVCDGQYEKGLEHILDVYLKNIEQAEQPAVWVSGFYGSGKSHLVKMLRALWVDSAFDDNATARGIANLPQGVSDQFKELSTQAKRHGGLHAASGTLGSSSRDKSVRMALLGILFKSVGLPEQYPVARFVMWLQHEGIYDAVRGHVEKSGFDWNEELDNFYVAEGLHEALVKAKPNLFTSPASCVETLNNLYPYVQDVSSGDMLKAIRQALTRDGKFPLTLVVLDEVQQYIGEDSQRSIDVQEVVEACCKNIGAKMLFIGTGQTAVTGTSNLKKLEGRFTVRVELSDADVDAVIRQVILAKKPEAKAPVEKVMQTNLGEISRHLAGTTIGHRADDIQFFPQDYPILPVRRRFWENTLRVLDQTGTDSQLRNQLSMIHKVIQTNVDAPVGSVVPADYLYFDAADKLLQSRILPRKVHEKTMVWVKGTDDQRLMGRACGLVFLINKLASSNNEIGIRATVDTLADLLVEDLTQGSSALRSKLPSVLDKCELLMTVGDEYRIQTEESAAWNDEFLSQRNSLANEAHRVDAERDDRIRRRFGEMVRKLSLTQGTSKVTRDIFPVFDAQLPGDAAEKVCVWVRDGWSIDENSVRADARQAGNQSPTVFVFIPKRSADDLRHYLIDFKAASATLDKRGVPNTAEGTEARSAMETTKQTAEGKIRELLQEAFSGARVFQGGGNEILGTDLQDMTLEAATNALQRLYPQFNIADHAGWPKVYEKAQKGAPDALKSVGDDGEPAKNPVCKAILAFIAGGKKGIDIRKNFEGATYGWPGDAVDGGLQVLLVAGLIRAQDEKGQTIDPKDLERKVIGKTMFKVESATVSAAQRIQIRKVLQKVGLIAKQGEELAYVPQFLVSAQELANRAGGEAPRPARPVTTTLEEIRLTAGNEQLLALYNQRDELSAAIHTWTDLAERIDKRMPAWNTLKRLLAQADGVSGAEVLVAQVTHLEQQRQLLEEPDPVTPLVASLTQLLRDELNRLHTDYQTRHKNGMARLDADTNWKQLEPEQRNSLLVAQKLTLTDAPKVQVANTDEVLATVDRLSLSSFADRVAAIDSRFDAVLVAAAELMEPKAQFVKLPSRTIKTDEDIEAWLLDAKQTIAQALKNGPVILH

SEQ ID NO: 1102 - protein, 1214 aa, Lactobacillus zeae
MEIKELFKRPIDRNIQGVIKVDQDDDANVRQELEEYVVTKELQRHFADFFSAFNESLHGPTDDMGVWISGFFGSGKSHFLKIISYILSNRPVNQKPAVDFFDDKINDPMVLNDMHAAAAAKNKVILFNIDAKAKDNSGTDQQSILKVFMQVFNEMQGFTDVDFWIAELERKLTDAGKFDAFKEQISSIDPKHQSWEELRDAYYFNKGTIQAAMVASGYASESNAEGFIEQLSTPYEISIEEFADCVSAYTKKTGNRVIFLADEVGQFIGDSVQRMLNLQTIVEQLGTKTHGKAWVVVTSQQAIDKVTDIASGQDFSKIQGRFKTRIAMSSTNVDEVIRQRLLTKTEPAENLLESKYEANAASINNAIDFDDGISRPKYNSGRDFAQNYPFIPYQFDLLQDVLTAIRENGSEGKHLSEGERSMLSLFQESAEAMMTSEDNVLAPFSLFFEGLDQFLDHTHAIVIQRARESAKVNPDHEDNPFTLQILKVLFMVKYVKKFKATLNNITTLMIDKVDVDRVVLKKRVSDALTILVNQEFVENNLSDKTYEFLTDAEQDITRDIKNQQIESGDISRQISDYLFEGKSALNGAYSYPKLNGRYIFNFDKKIDNVDSVQHRNPLTVHVVTPLDGDFQNETDFLQASSGIESNAVLVALPATSDYIDQVRRALKIEHFVNTNPTGRDERYKIMVDARQGERVQLLKQANIQMTNALDDADVYVGGRKIESEASFKNRLDAAMKLLIDNNYRKLDYINAAKSEKDIQDLFDPDRLSIDEGDNRQALDALTDWLIQENQNNTHVTMTSILAKFRGIPYGYTEEDIEWLLAKLVTDGKLKMFFNGSPINTLSDGISSKAMTEFFTKKQKRTNLAFQVRPEIPANKIKKMREVAAEVFDKKTFDSDNEEQMASELKAKIQSDLKNLQDFENLDQRFPGHVLLQTGIRMSKDLVTINDASVFYDYVFKNADRLEDWHEDYIDDGIRDFYFSIPQREIWEQGLEAVRNYQQSRDFLSDGDLKEIAKQLETALKSQKLRKETVPSIKELRAQFNELFIQAFDKEAAKYLAEIEELKKRGLDRLSDSGLEATTQEKLKQEFVMVIDRIAKEGQDATTINALAVKPAQARSQLEQLTGRIADMTAKLAVKPPVVKPKSDDSGEGTNPELVTPKVQVKKAERIVKMRQLLDPGDYKLEDSEDIEKIAALFKQRLEAKLSSEQNQVIKLEID

SEQ ID NO: 1103 - protein, 515 aa, Bacteroides ovatus
MHKIQDLFDPTKQLNRTIESVVTFGANTEQDLSSEIREYVVTDKLHKNYEDVITDLQTAFDDSSKEVGIWVSGFYGSGKSSFAKYLGLSFDKSVMIDGVSFGDKLMSRIQDTAITAMHRTIISRHNPQVVMIDLSTQSVAGKIANVSDIVYYETLKLLGVTKCTDQKVMCFIDLLHSEGKYEEFCRLVETEKNKSWESVESNDLAANLIAANLAPRVLPAYFPDSASFKNINLSSALNEKERFVRLHKLVKEKTGKDKIIYVLDEVGQYVASNVDLILNVQGMMQIFKDEFRGDVWVIATAQQTLTEDNRQAQLNSNELFRLNDRFPVKVDIEANDIKEIITKRLLGKSKDGSDYLKRLFSQNEGLLKNSIHLTLQERSIYNQLLTDETFTNLYPFLPVHIDILLSLLQKLASRTGGVGLRSVIRLIRDILVDNHLADATIGQLAGPEHFYDVLHSDMERNSAKEIVISADKAISIFNGDKLAVRICKTIAVMQLLDDFNLSFDNPMCLVIQQRG

SEQ ID NO: 1104 - protein, 706 aa, Bacteroides ovatus
MGSTFDKSKVREAIERIMDSTSVTLQEIDGKYQFMTNAILSIREERNKIIPRDAEKADVLQEQLKDMLSPAPSVNVYSSKTITAGVELTERNRPYNIHPTTSGLKLNIRFVDGSAFDETHQQLLTESTRQENNRTLYWLCTLAKDKETILQEIVRSQNIKNRHQNETNKEIQAYLRAQTDFADEKKRELNKILREAQANSEVIFRGSPQQVNGETYKTVALKTIAEKVFEKYPLASSNMKGDCVNKLASYGDLTTIPDALNPFKIIKKTDGTIDVSHPAISEIKDYIATLNEVTGSEIMNRFERDPYGWSKDTIRYIVALMLKANIIQIRVAGKNVTVFGDTAVEAMATNNSFNKISVLLNTEGALTTTELLKAAQSMTGLFNSSRVAPVKDQIAKEAYKKIKLYLQKFNRLLPDFEVLKLDGESIVRQAINYAQRIIDSEGGEAAFLLGKDVDCQKAFKYVMDIIKCNEQASLINHLKHINHLANESHTLPEVEQLADYIKHVNDVRQLYHEYIANPDLHLIVSNITDLRNQFDAYLNQACIEFQTQTEKLLDESRTTMKSMPEYAKLDDKQRTQIDTQLDGLSIECTHPSISNLREMINKFVTYYLPSGSIKTIENRIRQYAADNAPAVKVIPTPPTSPQKGATQEDDATKPNKVEEPTYQPKRLQVKRKITTRTELQQVIDQLTSLLGEISDNSPVEFNFNED

SEQ ID NO: 1105 - protein, 788 aa, Escherichia coli; identical to SEQ ID NO: 1004

SEQ ID NO: 1106 - protein, 363 aa, Escherichia coli; identical to SEQ ID NO: 1005

SEQ ID NO: 1107 - protein, 788 aa, Escherichia coli; identical to SEQ ID NO: 1004

SEQ ID NO: 1108 - protein, 363 aa, Escherichia coli; identical to SEQ ID NO: 1005

SEQ ID NO: 1109 - protein, 917 aa, Coprobacillus sp.
MIIKEMFKQDINRPINGVIQVEQEQKEVIKQEVQEYVITSELKKHFNHFFDKYSESFSTPTDNTGVWITGFFGSGKSHFLKMLSYLLENKEIDGRNTVDYFREKFDDELSFMSIEKSTQVLTETILFNIDVEGSISKDDTAVLRVFAKMFYEHLGFYGKDLKLAKLEQFISKRGKMDEFKNIFEEKNGESWIHSREDYAFWEDDIVDTLVEVLGMSQESAHHWFDGTETADISIGQLVQEIKEYVESKPKGFRLLFMIDEAGQYIGTNTSLLLNLQSLIEKLGSTCRGQVWVVATGQEALDDMIKLRTDEFSRIMARFNVRLSLTSSSVGEVIEKRLLTKTDQAYENLSMVYDNNDSVLSNLYSLQTQKKDLKGYQSPSEFARIFPFVPYQFIIMQDVFNEIRKKGHAGKHQSSGERSMLNGFQESAQKIENRDEFALVPMYYFYDTLHSFLDTSIRSVIERAEKASMNEQGLNEFDVNLLKLLYLIRYIDDIPSNVENITILMADDIRVDKQEFREKVKKSLEHLINQNYVSRNGDVFMFLTDEEQDIARDIKNTDVDTSMIVSRLGDLIFNDIYKPKKYKYNKYDFAFNEGVDQQVIGATYNDVMKLHFMSVAADPNELQELRLITNSKNAEVICVLSDSYTYYEAMETAEKIRKYIKQINVSQKPASIQKIIQDKQNEARRLEIQVIDDVKQAIVEGKYYIAGEVVTLQGNDAVAKINKALEYLVEHTYYNLNMIDAFYDNDADITAVLNGTKTFLAGMEPNKQACDEIEKYLELQANMKMPTSMFDIQQRYARKPYGWRESDIAGVVAQLLVGQKVIIKYAGQNIQTNDYRMVGYLRKRSEVGQVRISKRESINASKLNQTKTFLREYFDVMDLPNDEDGLITYIITNFKTKNSIDFSVSFYNYHEPSIYPCL

SEQ ID NO: 1110 - protein, 253 aa, Coprobacillus sp.
MKLVNDVLKNQSDSIALIDSIVNLQDDLLDNKDDMKAVEEFYHSQITLFENADKVLVQTTREMDYYNDDEDVNQAIHLIKEVVRYDDNYNYSRIPQLNGAIATIKNAKNILLESKKQELLALIDQCFSEIDTKAKEDNIKLAGLLNQARVNFDSKKDEISNLNDLITLEAKKQKIFEDTNKYIRSMDKALKPDTATPPKEPTTTTTRRVKEYYRQVIFPTKTIKNEADIDLYLDELKTKLMNLISDGDEVKLK

SEQ ID NO: 1111 - protein, 1231 aa, Natronorubrum tibetense
MTDTTLESLFARSPTRELEEVQKVNEVGQAERDIDEFYETDSARKVLTELGEVVNSTGSQPRFRYVHATFGSGKTHLLKLIGIATGEIEGLETVAPKLSSQFSGFKEFRDRLNSSHIDHLVPLFMNLLDRDKVRDSTLSLLIYEELGNQLNYPTDPLWLLEWAWTLEIEHGLWEAVRSVEHDGMSIEEAAQDKAALRPWLYEALPEMDETDGTPYATKDGVRESIEQATGRISTEAFTPDELVERLDRTKRYLQESGETYEFLIGLDEVAIYVGDQQHRYREFLETVDTLIADINPPILGTGQWSLRDMQQDFMGEVDPEAWYTNEIPLRGADTEIIVRKRWLRKSDSGANTVHDLLERAPDFELELADASEYTDVGEPVEAYPFREHDLWLLREVMQSLKKEDLEVDREYVQGRALLILVRSLFTSFDWSQKEPGAVVAWDEIYDLIERETTDIPGWAKDQIQKVENTTDEMGVSVAKVLYLLGQVDAVPTTKENITRLLVSSVDTDIDQLESDVEEALKALMEDNFVRTDESVQPQTYRILSKEIVEFWDQIHREAAGLPQHQVRYNIEDLLREADRGRLTADDSLRTRNIDGISDAPYTFRYTVLDQVDSSPEPRFDGVVARVLAADPDTIEESRTRWQEANVGDQGVEDVLIVIELSEGLRESIRHLIALDKLLEPGASAELRIEQQQEEETVEDEIEELLYGAKLYTPDHNTTRGTYLSNIDSVLADAVREKFENRKTLDTRLQEVDDARTLFEFFNGNGTWPFSSDDAEMLGVKTVPREISDGWAEEFLNDYAGEELVSGETVLEEIAGRRGKYLGTPREALAALLITLAAANKIEIRRDGVRIEDPGEIGRVMRRLSDIRDIDIGFDPVDIEGSSNLKAVYQSLRGFAPQGNDPTAWLSNLASWAEKNSSGIRNICARVDLEFDEEITLDALRDVLEPGMAGGELDDAVLTESPVPTQAEWFHKAEPLFEGEEPLWDEFNSTLETMRSLYPDAAITYKMEDAVDGSRIPSKESLTKHQTEAQDFRTSQISELYHLLTGTAPEADSISELCSAVEQALLDQDIIVEIDTVTETIPGVNFESLRELDEIAESAADISESDIASGNAVSEASQLEEARGLLEDQPDGPLYNQLESRYEELNSEHSEAFITKQVKRALSGPDLVTPSRAEALVKQADAKLQSTDDDDDDDEDDDDQDDDGPSVDELWADVTEPGDGTIVVIDTEEGDR

SEQ ID NO: 1112 - protein, 1233 aa, Natronorubrum tibetense
MTPMDDLFEKQDATFEESIRIDRKFEEDEDRAAHRDQLYRHYLDTYHITDASETFLRDFFTRIHGHDEEMRKGANHWLYGYYGSGKSHLLTVLNLLTASADLAEEDREEVWNRLDSDSAYSDLFDTWSSMLDEYRLVPLPINLLKYQSVREQSFSEIILQAVYQARGLSNRLDVAFFEEWYQNQGTWDQRDELTKEVLKDEGVPNADQYSWDDVQQYRTLSDLVLEELVERETGTADGLADIQRQDIGQRMAVEAVESYRQDLEAESEKPVKIVLLVDEVTLFIGGDYQRLSELNALAESIDTIGEGNIQMVATAQSQIEDVRPGLAAKQLDFGILKDRFPHQYHLPSHHVGEIVQRRLLEKTEEGADWVESEALTARVHPTSTFVYSEVGQNTEPPLNRVKENEFVQFYPLLPYQPALFLEILSNLRNELADSTKSIFSGTARAILAIVAGLRDRWMRDESKDELSLISLVDFYDLIQYELEDIIPNEIEVLEEIEADEDTTDFDLKVAKAVLLLSYVPDSVPQNDANIAVAVMDDLNGQPRTTVRNQVQNSLENLDKYIRPNTAEDGPLLRITDREEREIIEEARKNRKNPDWDEIITAFDNELWADISPRLNLPTSVPYGGDGDNYPISYNFSIDGQPLDGADEHESSLEATVVIRGVRPDVDSKKINEGTIYWSVKEDGLENLRSQLIEWWSFHEATAETETPDTIARDVDDAADRVKSKLASALKDGSYKVESQEPRGLDSAVKECINRAYPLFFHPVMLEVDQSYLSELKRLNDDEEYPEWAQKIDVPTPDAEVSTMGTIAKEIRGAVGRTLVDHDNEMGLPALFENITEETPFYGEVKPAVTAVLWGLCRAGEFRPIAEDGEALSADELLTLSQQMEIKLRTAPSSTSLKEQFIDAGIIDPIQTVDEGIVALEELNESVKRQARTLAETTEVSTETELESDALVSLVASFSNALSELADSAESRADAIAADDTDWEEIIDQVASDEEWLTAVEDRWDSRESYLLQLDGLLRFRELEIDWLSQSFYDALDQLSQQLENESGREWWTQEGWQSFDQSLDARLTAISALEEDWSAQVAETNAKSLVTELEGHQWLIPPLQLPEHSVHDGFQSGYLRPLRHFRDTHESIQVCISALTNREPGTHDERTLKRALGTVSSTTDWDSLTEDRVDTYREKYETVEQLVGGTRPEEIEGVGVLFGDESALKGQFERLVKSRKPTIEQIDGGVIIK

SEQ ID NO: 1113 - protein, 1280 aa, Haloarcula argentinensis
MSDTHIHDIFQQSPTRELEEVQKVNARAQAENDVREFYETASARDVLTTLGDLVDKYPHEQPRFLYISATFGSGKTHLLKLIGFAADTESEFTDLGEELANRWPGFQSFRQSVADSHVDRLKPVFLNLLNRDASQEPPLPYLIYEAIGRELGYPTDPNWLLEWAWQLDMNHDDCWERLQQVEHDGQTFEDVYDERASLRSWLYDAVPTLEDSPFASREEVKQSIDDAIAEVDPDEFDPEELVDRVEAAQASLSTPETETELLIGLDEVALFIGDGRHRYREFQETMEALTELGVGPNPPVIGTGQYPIERIHGEFDDTAVTEQPWYGAQEPLEGADTEIIVRKRWLQKDVEGGQAVETALRELPDLTLDAYTDIAGADPDAIESYPFREYDLGLLRTVIQQLMPRGRVTEKEYVQGRALLILVRSLFTRFEWGDKQVGALVTWDELYDLLVEETTYVPLWVQEMVENKLVPSAGGDENAFSVRVAKALYLLNQVQSSVPSTPANLARLMVTSTDESFESVRDDVESALSALLKDRKVLTETNDRGDEEYLLVSEEQEDILTRAKTRAQQIPSHRLSAKLENSIREGSDRLLSAGSRHEVDFEGERKVPLRFGYSVLDPIEKAPTPEFDAVRVRLVANRDAEVSDQVAAWQATNEGRDGGEHILVAVSLQQSTIDRLRDVMGMQEVLSEETDTYPDLESDHRDEQRALESAIRESLKEADVYVRTGGTRGRYEDAFDQVVQTEVQSVFSGTRFVLTNGITEVDDAKLMAQFFRGVADWPLTSEDAVTLGVDTDRAELADGWCREFLNEYVDTQSLRAEDVLTQTVQRGGAYRGTPQESISALLITLATANEIALRRDDEYITEPEEIGRAVRNKTNLTEVQIRFESIGDIDPERIRETVKTLIGEEPDGTDPDAWLSALAEWVDENSVLVKRVIRGVSREFGDGASLDELETALQPALEGESLETDAFASETVEQQSERFARASELFQPSEDGQSLWEQFSQRTVEMKRRYPGPDITGEMQAVVGGDEVPAADRLRTLLEDADTHRRTVVRAQYERITGEPPTDEEPESMVSSLATWLYAHDGSSKETADRVAVEFDGVTIDDLYDLFETAWRGDSFSEEALVDPTVVQQARRYERARRLLEAPGSEASLWSQLRDASKRLAEDHPNHPVTADVNEMLTRSQPPSVDDVEQLLDAAENPFKIDERLAELAEELQSEHPDHDITDEIVDAVEGIRSPSEERVGELIEEAEQVLAGVDEQLRRIQETIDDLPDGAVVLIESLD

SEQ ID NO: 1114 - protein, 1227 aa, Haloarcula argentinensis
MTDEGWFAADVGSDFEESVRIDREDDGRDHRLDSIETYHVTEESEDFMSDFFSRLLGRSEDMRSGANYWLYGYYGSGKSHLLSVLRGLLDSEWLRQRDEVWEQLTDGRELDTLESTWSSIHDEYEVIPISVNLLKHQGQKKLSFSEIVLRSAHTSKRLTGAEGGLSSQLDVAFFEDWYRTTDAWDDRTPNTQTALRSTVDSPEKYDWEDVQQYTALADAVLPTLFEQETGTVDGLDDLMPSDLDPQAMVERLEQLRSDREAELGRPVKLVLLLDEVSLFIGTDFDRLTELQTLAESVDETGDGDIQLVATAQAKIEDVQPQFAARGADFSIVKDRFPHRFGLPSRHVGEISTQRLLKKSEAGREGTERVLDRTSNEPETLLVYSGIEQNTDPPLDNIDRERLIEFYPFLPYQPPLFLEILSNLRQEAHDPAKSIFSGTARAILALVHGLLQEWIEAGNETNVISLVDFYDLIEPELDDITPQDVGVIEEIEEQYEAGELEEIDVDVAKAVLLLQHIPDTIPMSERNLAVAVLSDLDGPTQFQMENRVEDSLQRLRKFIRPTHDETGPKYAFTHPEEREIIEAAEENLDNPDWQSIIEAVDRYLWEDIVRDLSLPTSAEYGDTGEQYPVRYGFSIDGIELGTTVDAEDALDVEVAVEGISPAGTDVDYDGDPLEWTIGQDGLDDLRDSLIEWWSLRDAVGDHTLPQSVERDLSDRGARVQSKLAGALNSGAFDIKDRGDQIGGMGTGVEEYLDVNYPDDFHPVMLQVGDEHLQELRGLSAQDPLPVWAQQIDVATEDPETHGGSIQNNVRAFTGRQLKQRGGNLAMATILDGIVKKKPIYEDAPPALCAIIWGLCRKGDFLPVDETGDSLELDAVIDLNKLTTTRLKIAKSGDVRGTLREGGFIDSTETIPDGIVRLQSANDTLAGRIGSLVEDVKLVAESDIQTQAVRILLESFVDALEAEQQSAIDRREAVKSRDTDWEDVVEATNNAQEWYDDAEEVWSLRLPALTRIDAQLTLAQQSYDWLTEECDTASQTLRESIDDYEGEWWTHDGWDRFNDAQTTVPALDDAIETAWDSFREETGADGLVEELQAHPWIQPLSEFGSNVRPAFESEYITPLRRAASWHEDVSDAVSTVISGTTNAEADDFIRATNTLLDSEPLAVVAGSDIGELRDTFEELQTLVGEQSPTDIAAIGVLPSDRGPLDSELERLVEHHDLSIERTETGVIIR

SEQ ID NO: 1115 - protein, 1198 aa, Halosimplex carlsbadense
MLKLIGLVADSESEFAHLGDELAQQWPGFDNLARSIDESHVDRLKPVFLNLLDRDASKEPPLPFLIFEAIGRELGYPTDPNWLLEWAWTVDMEYDGVWDALIAAEQNGQTFEDVLEERASLRRWLYETLPSLSETSGTDLDRKSGVKASIERAEEEVDPESFDPGELVDRVEAVTDALNESGPQTELLLGLDEVALFVGDSRHRYREFEETMEALQHGPNPVVVTTGQYSLPATRESLIGEPADDHWTHQQVPLEGADTEIIVRKRWLQKDGSSSDRVSSLVSSMPDLSLETYSAVESADPDPAESYPFREYDLTLLRKVMQELITQGRATDRDYIQGRALLVLVRSLFTKFGWATAEEGALVTWDELFDLLVEETTYVPLWVQEMLDNTLIPTFDGDESAWEVRVSKALYLLNQTPAVPATPENLGRLMLDDVHSSVDETVDNTESALNTLVDKRKVLTETNDKGDEVYTLVSEEQESILSRAQTKAEQISPHQLSAWLETRLRENDDFFRSDSSVHEADVGDERLVPLRYEYSILDPVGRAPTTEFDAVRIRVLADDPDTVTDQVETWKDVNDGRAGGEHILIAIDVPETTLDRIRNVLGMGEVLEAETETHEELEREHRTDKRRLESSVGDLLESASIHTVHEYRGERPGVLEEVVEDQVQSVFGSTRKVLSRPLVEVDDAKGLAKFFRGSGEWPLADSDAVILGVDRADRRIGDSGWCRDFIDQYESQSAVDVETLLQQTRTSNGDYRGTPQESIAALLITLATSNEKVALKQDTDYVTEPAAIGRQVRTKSGLTSLQVRFGVDTINPKEIRTVVSTVLGHEPDGDDPDEWVTELATWVDEQSVLVKRTFKGVSREFNVSLESLESALSPAYSGGEISTSDLVEDGVKSDAETFADARELFAVEGDEKSLWTQFSETLELVESLYPSATITSRMQTTAEGGSVPTKETLTTRIADATGHRIDVLSEQHRRITGRTIDVSDPAEICADLSAWVRENEPTVKTLFEDATDAFSGISFDHLEQVFETAWAADQIEEEALVASSARQQAKAYEKIREILDGDSSPWNQLEAARETLRADHPDSPTTAAVDTVLDSSRPPSLQRIQQLIDEADDPKPPDADDDVWAELQRVAEDLRQELPNAKVTDEVTTVVDADERPTEERSEELLSDAKTILERMRTMQEELDGLDDDEIVLIDKVE

SEQ ID NO: 1116 - protein, 1248 aa, Halosimplex carlsbadense
MDLQGRCQLMVDASWFEDLPEDFEESVRIDRDERDHRERAIQSYHVTADSQRFIRDFVDRTLGQADDMRTGSNYWLYGYYGSGKSHLLTVLDGLLDSDWLDGRYDDVWDNLTQVAEDDDVDQLRDHWRTIHDEYYVIPVSINLLKYQGQKQRSFSEIVLRHAHQDPDLTGVDDDISKGLSSQLDVAYFEKWFRTTDAWPERQTRAQDALETVAAGPSGYDLDTENLWEDIQRYNALADVVLPKLFEEVNETRDGYTDLQPSDIDPEEVVTRLDQLRAEREEELEKPVKLVLLLDEVSLFIGTDFERLTELQTLAENIDDIGDGDIQLVATAQAKIEDVQPKFAAHGADFSIVKDRFPHRYQLPSKHVGDIAKRRLFEKSDQGESRVDEVLETASVKPTESLVYNEIKQNTKPPLDSIDEDALVEFYPFLPYHAPLFLEILFNLRREATDPAKSIFSGTARAILALMHNLLQRWIEDGKPDHVITLVDFYELVKPELREILTQDMRVIEGSDTTRGIADEVEDGNLEEFDLAVAKAVLLLQHVHDIVPLNEGNIAVSVMSDLNGRSWISTQNRVEESLGRLQKFIRPTEDESGARYRFATQEERLIYDDTEANEENPDWDAILHALDEHLWERIIQDLALPESVPYSDSGDEYPVAYKYRIDGEDFETTTEAEGGLEVSIAVLGVHPDYPSDNGDGETLYWEIDTDGLEDLRKHLVEWWALRDAISTHNAPSAVERDLERRASAVKSKLVSAMQSGSYTVKDRTDIGSLSKAVQTAVDVGYPDDFHPMMLQVDEDRLQELAELSTEDPLPAWAHTIQVPSSDPTASQGKKTIQSNVMALTGRQLKDKEDGLNLNTVLDGIADKKPFYDDARPALCAIIWGFCREGRLVPIEEDGNTLENSVVLDQNRLSTTRLKLLPREPIGKLLEKGGFKETTETVADGLINLQEANQQLHSALTGLREDIQLIADTDIRSKAVRSLLESLADELSERIDATSDRLAVVRSQGDGLGDAIEQTNDEQEWLDEVVDVWNRRLVSLYRFDVHLLLGDNEFEWIDENAQSLVEEQRDALATFEGRWWTTEGWKVLVGETATGLSDELQRSWDEYVDDQGLGAFVERLEDHPWIVDATELPTSVQPAFERTYITPLRELRRWYHTIEETVSVLGADDEDTLVSAADDVSAVESREEAIDDDIAVLESRLERFSTIVGDLEPDEVDRIGALPDDRQAINQRLERLVENRELDIETVDSGVIIR

SEQ ID NO: 1117 - protein, 1207 aa, Rhodopirellula sp.
MKIKELFAEDVTRSIPPVVYFHQHLPEHIESEVREYIITGGWNEDHPNYKRVPDGIHEQYVKLLRGITRELDKPGGPDLPNAWISGFYGSGKSSFAKLLGLSLDGKSLPDGTSLSEAWLARNKSQRRQEMVDAWGELRAKINPISVVFDVGAKARDNEHVHAVAIRQLQERLGYATKDPIVADFELKLERDGLYDHFQEIAEAQLGKPWSEVKDTSMVDQSFSLVMHHLDKQKHIDPLSWSMAYAGKAPPGRSAEEATADIGDMLRFRADDATLFFVIDEVSQYSQFNKDRTDKLRAFATSLGSTLRGKVWMLALGQQKLDEGAGDDVLVWARDRFPPQLRVHLSATNIRDVVHRRLLQKKTEHVAMLKSAFDEHRPELKLFAYGCSEVTADEFVEIYPMLPGQIDLVLQITSALRTRSNRAPGDDHAIRGLLQLLGDLFSDLKLAEAEFGKVVSLDQIYEIQKTALDSDTQSSMSRIMNKCVEIKADLALRAAKAVALLELIQESEPTTPEMVAKCLYDRLGVGDQVSEVKGALELLRSHGLLGYSDKLGYKIQSSAGEEWDRERRDGGASVDKVGDYVFAALKELLATIEKPKLNDRPFPVSGLFNNARLHDDAKIFNPNDPTCVTIDFRYLPNEDRGESDWIRQSDESALKNRLVWVCGDNETVREEVRELARSEAMVKKYRPRRENLSVQKRTCLNEEEIKLEDGTRKVKKAVEECFRAGTFYFRGDKYEARSQGEAFSTAANRCATRIIKDLFGMFDGTVVSPAEVEQLLQADLVGVSTKFMRDELGILDLDGARYEATCTGVVPVRIQEKIARDNGVSGSLLLSDFGGAPFGYRPELIKACVAGLIRGSKVKAQLSDGGAEINSWRDVGMQELFTSAQAFRRADFFPADEGDINPGQLNKIRKFFNDEFNLKLGRDIGEIADAVETQFHPLNRKLNDVVGDLKKLSVAVPIPPEFETLQRAIEKCLAKVRHAKPTVQQLLKNLDALREGIRKVNVYRSELQDDLIGKINDAGEVMRYQFKQLEDLGPFDAEVAEAAERIQSHLKTDRPWMDASELDSDVELLREAYKTQRRELLGAQEVGADAARGTVKKRPGFSTLSSDHSAIVLREFDSAVTSTDEDAVSPKLIDLRDSFQARLGRCEVAANRKLDEILSETSDKILRPVALNYTNRVINDETDVDKLLAEIRKELMEQLEAGVKVRIV

SEQ ID NO: 1118 - protein, 1222 aa, Pseudanabaena biceps
MLVKDIFARDVTRDIAPVVYFHEQEPAKLWEEVSEYIITGGYAENDPRHTRTNQGIHEQFVRLLKAIAQDLEQPNRSGTTLPAAWISGFYGSGKSSFAKLLGLALDDRQMPNGQKLADALLSRDDSPKSTEFKEAWQKLTKRIEAIAVVFDIGSLARENEDIHQVAKREIQKRLGYCKTSNYVAEHELKLEIDGRWDAFLECAITTIGKPWEQIKNSELAEEDFSLILHRLEPEKYIEPMSWIDSRAGSRTGLGSAVDETTKAIAAMLNRRAPSKTLFITIDEVSQYIHQNDNRMLKLQSFVEDLGQKLKGRVWLLATGQQQLEDGIDQGNIGKLKDRFPPRFRVHLTPANIRDVVHKRLLQKSPVHEAELRNLFQQHRSDLKLYAYGCENISEEDFLEVYPLLPNYIDLFMQITSSLRLTSTRVKGDDYAVRGLLQMLGELFRTQGLGDRKLGALVTIDAIYEIQQTALDVDTQNTMTRILGDREIVGDQLALKVAKAIALLQLIQESQPTTAKLISQCLYDSLGVGNNEPEIQIALDKLRDRGHITYSEKLGYKLQSSAGQEWQRERDSEGVNDEKMTAILMEKLKVLIGDTENPKYKGRSFRWQAYFSDERQRKDERLISPNDVATAIVDLRYIRDDLKEDVTIWIAQTGQEAYRDRLLWVVGNISDIPELARRQVRSRQMISKYQGRFAALSPNKQRLLIEEQSEADRLDSILKEAISNAFVRGSFYFRGRQLDAQGLTFSSLLQHTAESILPDVYPHFQDMAIAPSELEQLFKKQLSGVSQKFMERELGILSLDAGKYVPTCNGEIPTLIYEAIARNNGLAGSSLLTIFGSAPYGYASDLVRACLLGLLRANKIRIRTENQQMISSYADVGVEDLFKKERDLKKAEILLSTESDITVRDRNAICKFFNDYLQVELDREKEAIADAVFKYFPYKASLLRELEGKYNRLPLRLQDVADQNYDDRHQLPDSLQKLQKALTDCCQSRQIEDTVRAVKRHLEVLQDGMQRLSIENSELTNEAIAQVKKAHDVYIHCVEQLRGMGKLADLEPMAIALRQQLQAERPWRDLTSLTPSIEAIALRYREVRHDLLDAQYLQLEAVAARVKTRHGFARLSEEKADYVIRPIRQAEIKTTIDALYPTLIQLRDSAIRQLEQAEMEANATLDRLISEETQEQVLTLDVLTDLRNRELRNPDEVNALVDTFRDRLLKQLENKKNIRIRLI

SEQ ID NO: 1119 - protein, 1244 aa, planctomycete KSU-1
MKYSELIHFEPIETTIQLRDTDKLEEAKKLISTFVISHEMAEKLESIVFPQLQFEQPLDNKGILVVGNYGTGKSHLMSVVSAIAEHAHLVSFLKNPQVSNAASIIAGKFKVLRAELGSTTMDFREIICSQLEESLSAWKIDYKFPPRDKISNHKDAFEEMMSTFHQKYPDHGLLMVVDEFLDYLRSRRDHDLILDLNFLREIGEVCKHLKFRFIAGVQESIFDNPRFSFVAEVIKRVKDRFEQILIARHDVKYVVSERLLQKTADQHAKIREYLIPYAKFYTNMNERMDEFVRLFPIHPDYIDIFERIKAVEKREILKTFSLLMKQILNMDVPEDRLGLISYDSYWNMLKENASFRTIPEVREVLECSAKLENLVNTGYPRGKNKEFALRIIQGLSVYRLAVGDIESPVGLNAEGLRDALGLFDPIVVELGGDAADDLRGEVETALRLISKTVNGQFISATERDEMGRPGGQFYLDVKKTVDYDAQIIRRAESLDSQTLDRYYYEALKRVMECTDYTYVTGYRIWQYELEWRERKVMRTGYLFFGASNERSTAVPQRDFYLYFLQPNDPPRYKDEKKSDEVFFKLTGIDETFRENLRSYAASLDLSSISSGQSKTIYESKAKGFLDNVVKWLQEHITTAFEITYQGRTKQLLEWAKGLPPKKGTDGGNNFRDIINAVAGFCLEKHFADQSPEYPFFSILITGSNRAQAATDALKWIAGGAKTRQGTAALDALGLLDGEKLDPYKSKYVNFIREVLGQRGQGQVLNRGEVFKKEHDVEYMVPDRFRLEPEWVIVLLAALVYSGDIVLSIPGKKYDASNLNQLIATPLEDLVNFKHIERPKEWNIPSLKALFELLGLTPGMAQLITQGKEEPVQELQRVVSTTIENLVIALQNLHGGMIFWGKPVLTESQKEAYTSHLNSIKTFLESIQAYNSPGKMKNFRYDVNEIKAQHVGIQTLLELKKLQDLVAEFGPMASYLSSAETVLPDTHQVVTRMRTYRESVFSQIINQFKQNPIQVRQQIMQEFLELKKIYKRDYITLHARARLGAHEDKRKAELLCNKKLENLQNIATINLMNRQQLINFQNRLAGLKTCITLIEKEIEFTPTCPHCEFRPSTEPNPLDVKAILSNMDRELDNIVDEWTQTLLANLEDPTIQENLSLIKSTQRKLVDNFLKNRQLPDKITHEFIDTLNEILSGLTRIVVKMEDLRNVLVSGGSPVTIEEIERRFEDYIASLTKGNEANKVRIVIE

SEQ ID NO: 1120 - protein, 1232 aa, Bacillus cereus
MLKYGDLIKFEAVESVVQLKEANDIDYAISLLNTYVISDNMAEKLTNEIIENIQFDRWVDNKGMLIVGNYGTGKSHLMSVISTIAELPGASEHLRHKEVAEKAKEIEGKFQVVRAEFGAVTMPLRDIICHELERGLERMGIDYTFPAADRVTNNKEMFYEMMELFHEQYPDKGLLLVIDELLDYLRGRKEQDLTLDLGFLREVGEVCGKSRFRFISGVQEMLFDNPKFSFVADSLRRVKERFKEARIVREDIAFVVSERLLKKNDEQKALVREHLSKFTKLYNGLAEDMEMFVNMYPIHPSYLETFEKVNIAEKRVVLQTISKEIKKLLMLEVPEDATGLISFDRYWQYIEEDSSLRTNDNVKLVMNKVEMLKGCIQTGVKRQYKIMANQLVDALAVYRLTTDDLKTPIGLTSESLRDKLFISHPMLLELDEEASEFLTTMIESAMKDLMTAASFQFVSLNKDNGQYYIDIAKVTAVDELIQQRGEGLTDNQLDSYYFQVLKQATEVADTSYVSGYKIWLHEIPWIDRRVKREGYIFFGAPNERSTAQPERDFYIYMLQPFEEPKFKDEQKEDEVFFRLIKKNDDFINLLRLYSGSCEMYKDTTTNRHLYKPKMDDYLKKLVKWLKENFVEAFEIVYRGKHADVLEHGFFLPSNPDTLIQIIDSVSQDLLSQWFEVKYSEYPTFRKLDKSFVTKSNMQTYVKDALDYLNGKKTNQGEAILNGLVLLDNNGNVTARNSGYAKWVLELLNQKETGQVLNQNELIEVINTVQGTPDQRLTKQFAMEPELLAVVLASLIQSGEIVVTVNGTTYEAMNFAEFVRLPINDLTYFSHIKRPSGLPVPAVQALIDMFGGEQIDFTNLDAVDFSIKRIISRAKEETNKTVEMVANIRNRFVIWDGQLFSLEEKEEKITKLNSLNEFLQGLQIYNTRAKMVNLKYDINRIEEEKENLEIVHGLEKLQQKINEYTKVADYLMKARYIVSPSQEWIDAVDVSLGNLSISLKNGEDCSREVAELERLKKEYIEHYMVLHQTARLNATENKKKSELLKDPRYDALNTLASKISFLPHQAFDDWQMSLKALKDCYNLTVEKLQHMPECPNCRFNPREEQNKAKPSLTQLEDQLGELLNSWTETLLTNFNDSIVKESIDLLESEQKCLMNELIQNQAFTIPISLNLINAINVVLKGIHKEHIEMGQLLKVFGDGNPITVDEARKNFDMLLKGLIGTNETNRIRLTVKK

SEQ ID NO: 1121 - protein, 946 aa, Clostridium thermocellum
MSERMEEYVNLFPIHPSYIEVFNKIYIIENRHILKNISEIIKRILDNEITEDSPGIVSFDSYWTFIKDNFSYRTDANIKEVVEKSGMLEDIINRSFPKRLYKPLALQIIYALSVHRLTTGDISIRAGLTAENLRDDLCLYLKGMPDQSSDTLQSLIQTVLKDIMTTVSGQFIEYNADNGQYYLDLKKDIDYDEKITQRAAFMDDDSLNNYFYDVVYYCLEWDQKEYVDNFKIYEHRLNWMSHNIFRSGYLFFGTPESRPTAQPPEDYYIYFIPPYGNESYTDNKKEDEVFFLFKPNEEFKNTLKLYGAAQILKGLAEVKNKPAYQSKAEVYKKELTKYLSENKNTCFEVVYKGEKKQLLEVMGKLYKSTNPFKETIDLVASICLDEYFAKKYPEMPKFKIQITSRNRVEIIRAGIDRFAGRKSQQANALLESFGLLDGDKITVQNSKYAQYFIKELEKIPANEVINFSDIYTEVPNKDEYYIDKQFGISYALLPIVLLALVHTGHAVITLRNGTTLTASDLEILPKIQATDIYEFKYISKPKDMRLVELVKLYELLELPAGLINNPAQREAGLGRLLAKAQETANIAVRANSKLNGDFELWGEPLIAEHIASDYKAAAKRVLDMLGNFQSRFNTVAKLNNFNYTMEQIEQLGKDITASKTVLEYEKFRNECLANVSYMMNLERMELGNTLRAAIETAKESFRKIRDNIPEDMSGEAAAADVNELLTKVKNQYIDIYFSEHQKRRLGVSDGRRKGELVSSVKLANLKRLREINSIFSAHKLDNIEKELAGLKVCYELTPEMLKTSHFCPKCHFLMNEEDIPVKGRLDEIEERIDNLLDEWTNTLYNTVTDPTLIEQKQYLSPQQCQVIDEFINTKRLPEKADQFFITAIKDLLQGFEPVAIAADELIDRLSALGPCDIDTFQHKLKELVDDYIKGKDKEKLRIIIKR

SEQ ID NO: 1122 - protein, 1231 aa, Lachnospiraceae bacterium
MKYSELISFSPIESTLQLVQSNSNKAEEINNIKTYVMSEGMAQSLKAPVIDQLQMDEVVDNKGALVVGNYGTGKSHLMSVISSIAKDADNLQYLQNKAFAKDMECIAGKFEVLRIEIGGVTMSLYDILSGYIQDDFDKRNVDFEFPEQSTVHNPKKVIQDMMMAFAEKYPDKGYLIVVDEFLSYLTSRDERQIVLDLEFFRALGEMCSKSKLRVIFGVQEKIFDNPRFSFVSDTLKHVSDRFTQLIITKEATSYVVSERILKKSPEQKALIRKHLEKFSNLYTGMSSRLEEFVDLYPIHPSYIDVFNKIYLIENRHILKNISTTIRDIFNTEVPENAPGIISFDDYWPAIKSNGLLKSDVTINRVVTASGQLEDIINRAFPKPAYKPLAIKIIYALSVHRLTTNGLDVQFGLTAENMKDDLCLFLTMPEQDADFLLSLIKTTLKDIMTTVSGQFIIFNDGNNQYYIDVDKVVDYDEKIKQKASVMAEGELNRFFYQLVYGCLDWDAKQYVPGFEIYQRDLNWDSHNIFREGYLFLGLPGERSTAQPERDFYIHIMPPYSATAIAVKNLEDEVYFFFKSSDEFKELLGLFAAANSLAQISEGKDKDAYLNKAGMVRKRLIKYLSENKNTCFEVQYKGQKRQMIEVLKDRYNRDMDFKDTVDLAASVCLDEYFDSIYPEFPAMKTKITRKNMAENARQAFDYFAGRKTQPAALMLQSFGILDGEKIRPEGSKYAAYYIDQLKKLPPQGVINYSDLFELKFGDVFEDKKFKISFLFTPIVFLSMVYAGYATMTLKNGTVITASNLDEVPRLGVMDLYEFKYLSRPAQISMVELKKLFEVLDINGALLDNPNDREEGIKQLLAKAQEISNSSVLAVRKLQEGFELWGEPLANAQQVDRMQKACTAVRDEFSNYAAKYNTPAKLNNFSLSGEQVDVLAEQIALIKTIAEYVTFKTDCSAVVSYIANIEFLDLGAVLKQELEAGKTAFREIRDSIADGTSGETAAQKVTTELDKLKEKYITMYFEEHKKKHLDIEDAKRRGKLQESIELANLRKLRSIEILSGAKLTAIEQDMAELKVCYELIPVELKTSHICPHCHYTYGDKAKNVAGQLDNIDIRIDDLVAEWTNTLLNTISDPIVVSQKEYLSAEQQKAIDEFISFKALPKRVDDHFVNSIKALLLGFEPVVIDTEDIIAKLDELGPCDVTTFKNKLSSIVESYIQGKDAAKLRIVVKRKDSEV

SEQ ID NO: 1123 - protein, 1239 aa, Enterococcus faecium
MLYKELVNFEPIDSVIQLTDANSTEKAMHLLDTYVISDRMAETINEIIFKQLQYTRPEDNKGLLVVGNYGSGKSHLMSVISTIAEYEGASKHIANKEVAEHAKQIEGQFKVIRFEIGGVDRPFKDIIISQLEKGFIEMDVNFEFPEDDSKLTNNKEWLLEMMDAFNTKYPEKGLLVVVDELLDYLRSRKELEMTLDLGFLRELGEVAYDSRFRFMAGIQEMLFDNPRFYYVADPLRRVKERFEQVRIVKEDIAYVISQRLLKKNDLQKAKIREHLTEFSKLYDRLSENMETYVELFPIHPAYLSTFENVHNIEKRIALKTITNEMKKIINNEVPIDDPGLVSYDSYWTYIEEDPSYKTIPEVREVMDKVSILKDRINSAFPSTKRRYQKMSIRIVNAMALNRLTTDDIYSKVGMTSDELKDDLFLTIPGQMDMLLEDPDPAGFLKTNIDVAIKTIMETVSYQYISVNEVNAQYYLDLKKDIDVDSLIADRAEIIEADTMDRYYFDLLQNAIALDDLTYISGYKIWSYELPWEQRRVMRKGYLFLGSPNERSTAQPERDFYIYMLRPFNTVNYKDEKRSDEVFFKLNLEDDYFEKTLRKYAAAKEQYIETTQAQKPLFKAKYDSYYKQLNKWLFEHFVDVFKVVYKGKEGYLSDFGMFLPQEDTLKAMVNYASAEFLNDAFQEKYPDYPTFKEYKPGYLTNDNIKTSASDALQFLNGRSTKTGKAILNGLVMEDSAGKVTAESISSSGFSRWILEMLEEKGNGKVVNNKEIYDQDALRGTGDRRLSKEFKLEPELVVVVIGALLYAGKLEISVAGTNYTAMNYREFAAENIEILSNFDYIKKPSGLPINEINAVLNLFDEYAPNFDEKILEGYIRRLSSKSIEEVSHTLNTIEMVKKGFSIGGTEVMDANTRQDTIMRLTSYKDFCEKVQRYNTVAKMKNFSASVTEISEQEENKKLIDSIEQMKKDVDEVGTLVTYITQATYNYGLESDWTKNAQEAINAVVEAVKKGAGFKSQMDDLKEIKEHYIDEYYDIHQKSRLTSKEEINRDGLLNSVEADVLATLKANIDILPGQQLIDWVRELRATRACFSLTKAELEQYPTCTHCNFEIGKTDRNSKLVVSNGKEKLTGIYENWMEILVSSLQQGDIVENRELLNNEEKVEINQFIATKELTFPISPQFLNTINNLFKGFEKVEITEAELVKAMGDGSPMSVNELEGRIRQLIAELTEGKEKNKVRIMFKR

SEQ ID NO: 1124 - protein, 1228 aa, Caloramator australicus
MRYNEIVNFEPLESLIQLLDANQKEKAINLVKSYVMSDSMAELLNEVVIPQLQFDNIMDNKGIFIVGNYGTGKSHLMSVISSIAEDRELLQYVDNEKFKIEAEKIAGKFEVLRIELGSVYTNLRDIILKKEIEIDLKNRGIDFIFPEMNEITNNKESLIEMMAKFEEKYPDKGYLIIIDELLDFLKTKREHELILDLGFLRELGEVCKNTRIRIIAGLQESLFDSPKFSHVKDKILQIRDRYENIIIRREDIAYVVSKRLLKKDERQKAYIRQHLQKFTHLYNNMVNTLETFVDLYPIHPKYIEVFQNIYIAEHRHILKTISLTIKKILNEEIPENDTGIISYDSYWDHLKEMTAARTDVQIREVVDKSKTLENIIDSSFTKPVYKKYAIKIIKALSVHRLTTGDIYAPIGITIENIKDDLCLNIIESPEIDEEFLLSTISTILREIIKTVSGQFISYNENNGQYYLDLKKVVDYQAKIVEKVEMLSEDHLNRYYFKLLLKLLEWEDITSSVPGHQIWEYKLLWTDKNVERKGYLFLGNPNERPTAQPPRDFYIYFLRLFEYNDWKDQNKEDEVFFIFNVINDDFENQLKLYAAANELAIASPGNSSDKRTYLDKAKEFEKGIINLIKNNILNCFKIRYKGQEKTILEAIKIKTIGEKSFKEIIDVIASNYLSSYFNQIYPDYPKFSTIITFNNIEQATKAALNCIAGKKEELGLRVLDSLGLLDGERVDPSDSIYAKHYLDLVSDLAPGMVINKKDLFEKDKSEDEIDKKFKLEPNFVVVILASLVYSGDIILTDAVNKEYDSTKLNELASANLYNIIEFKYIKRPKDIPIEALIKLSECLGIPGHIKNPARRVEAITDILKEVDTIIKDIFYVKEQINKGIYIWDCVPQMIERKKDTYLDKLNKFKEFLDSLKIYNTPAKLKSFKYTADEIEENFKPNKILKDIKFILEFREKIQVYVEYLKTADAFIDDSIFKEIIDKVKNKIKEAMNDLSKLNEDYINEILEDLKKAKNRYKEVYLDEHKKYRLDINADNKKAKLLSSKEFDNLRKLCQIKDIFNSKKFDDISKKFSSALTCFNLTNDDIERNVICPHCKFNPKDNNKVLVYGLMDSIEEDILNTLNDWEQQLLKALEDSIIVENMKYLKSDEKREIEEFISNKKLPEIITISFINAINQLMDGFDKIEIKSENLKDIIPKGPITVDEFKDAIDKYINNLLKGKQKDKVRILIK

SEQ ID NO: 1125 - protein, 1240 aa, Pseudoalteromonas marina
MKKYNELIQFEPVTTTIELEDSADHTKAEKLISSYVISEKMKSKLNDTIIKHLQYDEFTDQKALWIVGNYGSGKSHLMSVISALAEFPDLIDKVTNEEVKECAGQIAGKFKVIRFEIGASKMDLTDIITFQLTKGLEDLGVNYEFPPMDQITSNHKQYIEEMMLAFHAKYPDHGLLLICDEILDYFRSRNNQQLPLDMAMLRVLGEVIEGTRFRFIAGVQEAIFADPKLSFISKEVKRITDRAVEVVIVRDDIKFVVAERLLKKTAQQKEWIREYLQKFTPYYEKMNERLDEFVHMFPVHPDYINTFERVRIAGLEQRQVLRSLSNHMETLKSHDVPEDVPGIFSYDTYWHELSSEPSMKTNPEVGQVIETGETLVERIEQAYPTPGEKDFAKRLVAGLAIHRMAVGDIYKEMGATAAELRDSLCLFIPTVDVLPGEKSKNLENHIVTVLKKIRKTVNGQFFSKNKANDQFYIDLKKTEDFDAIIETKAEQLANDNINGAYRAAMLEILEQTDTQQVHTMWQHELKWIDRNVNRQGWLFLGSPNERETAKPQRDYYMYFIQPEDAPKQKKEHIREDEVLFVLKNRDETFDRYLKYYAASVELRALATGSAKNTYKLKADDYLRDMQKWIRNHIADAFEVKYNGQSKPIMDWLKGTSVRDITGISANEHGNVKDIFEAVASYVFEGYFQSLAPEYPKFSQWITGDNMQGAANDVLISLSSGARTKRATAVMDALELLDGEKLQATKSRFSATVLDVLKAKGHGQVVNNGELLEKVNANLYFKPDTYRLEPEWLLVILASLVYSGELELSVVGNNITASNADLLKSLDFNDLVNFKHIQAPKDFNTSAIKALLELLDMNEGLAISIQQGDDGIVREMGDKIEQKVKSLVTDSQAVKERLLLWGQHVLEDNEAGLLTEKLTSAKTFLEEMQRFNTPGKLKNLKATPEDIALQKENLIAWNDYKQLELTVKEFSDITNYLSKAQLVLAENDDWQETVKSAQQELRQGLADKDVRQSTEFKQKMLKQLANAKQSYITRFVALYQRAHLTLAENKTKTKLMDDDRLATLSLLSGIALLPGNQVKDWREDWAKLQPATAIDSKVLGVDPNPVSFNPRTEKYLAPASDRLNRLDEQLDAMLTEWTSTLQTNLADPFIQLDLMKSEQKAEVTAFINSGCLPEPLTKDFVEEVNKVLDGLVAVSITSEELVANLGKGTPQSIDDVRKRFEQLIAERCKGQDIDKVRIVIE

SEQ ID NO: 1126 - protein, 1224 aa, Desulfotomaculum nigrificans
MKYSELIHFEPIESVVQLRESNQKDYAMQLLDTYVISERMADAINEIIIEQLQYHRQADNKGLLIVGNYGTGKSHLMSVIATIAEQKGVSDRLTNQRVATKAKEIEGQFQVIRTEIGASTMSLRDIICGYIEDHLADIGVDYKFPPANQVRNNKDSFIEMMAAFQEVYPDQGLLLLVDELLDYLRARKEQEIILDLGFLREVGEICRTTRFRFIAGVQEMLFDNPKFQFVAEQLRRVRERFEQVQIVREDIAYVVSQRLLKKDDHQKALIREHLQKFTTHYEKLNERLEEYVALFPIHPAYLATFEKVMVAEKRVILKTISNEMKKLLAQEVPANQPGLISYDSYWPYIENDPSLKSNPDIREVINKSKILQDRIQNAFTRPVYKPMALRIVQALSVHRLTTGDINAKLGVTSEELRDTLFLYVPIPEEDSTFLRTTIETVLKEILKTVSWQFISFNEANGQYYLDLGKVEAIDDLIEQKAEGLTPDQLDRYYFDALTLVTDSAKNTYVTNYRIWQHELPWWERKVTRMGYLFFGAPNERSTAQPPRDFYIYMLQPFDLPKFKDEERADEVFFGLKHKDEKFLRILSLYAGAKELSATAASGTKHLYEARATDNLKLLTQWLRENLLTAFEVTYRGTTKKLVEWVSILPPQASVREIIDAVAASCLSSYFEEKYPDYPHFSKLNLPLTRENLPGYVQDALKNIAGAQTKSGMAILDGLVLLENEKLTPRKSGYARWILEKLAVKAPGQVVNQSELVETIYTCQGSPDVKLTTEFKLEPELLVVLLAALVYSGDIVVTISGTTYDAMKLDQLIKLPLEDLREFSHIKKPTGLPIRELQELFDLFGIPHGLLQQNALAKGIEELHKQTNNKLIDTVNILQVVRTGIPCWDGVILSPAEQQQYKEKLEVFKTFLEVVMVYNTPAKLHNFKFTVDQVAEQKAALDLLKKLKELQQRVNHLSPHANYLVTAQQHLPLDHQWQADVEAALGELLQALKEGQPYDAQLQQIRELKKQYQDYYMSMHTRSRLNAAEGNQRNILLNDPRVAALKQLSTIDLLPDTQLNLLLGRITALQECWKLTKNDLEYQAICPHCKYRPKEEPGVIKNLNQLAEKLQDLLDDWTKTLLNNLNNQEVKKNISLLKPEQQELINTLLTKQEFTLPIDVKLVHAIKELLQGIERVEVTLDDLKEMMGNGSPLTVEEVRIRLEKLLKDRIGNQATNRVRIMLAHK

SEQ ID NO: 1127 - protein, 1247 aa, Dethiosulfovibrio peptidovorans
MKYGELIQFDPIESVVQLRDADKKSAAHQLVDTYVISDEMAERMVRIVIPQLQFEQPVDNKGLLVVGNYGTGKSHLMSVVSSIAADASLLDSLNHESVKSDAEKIAGKFKVIRTEIGATTMSLRDILVAELEEHLENMGVSYLFPDSGTITSHKRVFEDMMSKFGEVFPEQGLLLVVDELLDYLRTRKDQELILDLNFLREVGEVCKDLRFRFMAGVQEAIFDSPRFAFVADSIRRVKDRFEQILIARNDVKFVVSERLLKKTTEQQAKIRDYLTRFAKYYGGMNERMDEFVRLFPIHPDYIDTFERVTVVEKREVLKTLSIGMKGFLDKDVPDNEPGLIAFDSYWNTLKQNPSFRAIPEIRAVIDCSQVLESRIENAITRKQYKPMALRLIHALSVHRLTTGDIYAPMGASAEELRDRLCLFDPLIAELGSDEPDKDLQTHVETVLREIHKTVSGQFISFNADNRQFYLDLKKTDDFDALIDRRAESLGDAQLDRFYYEALKRVMECQDSTYVTGYKIWQHELVWQDHKAARTGYLFFGAPNERSTAVPTRDFYIYFIQPNDPPRFKDDKVSDEVFFRLKPSKDTGEEFQTSLKSYAAALDLAGTSSGHAKATYDAKANGFLKKLVQWLQKHMLEAFEVTYQGRAKSMTEWAKGKSIRDISGLSPHETINFRDLVNTIAGVCLAPNFENQAPEYPFFPVLITESNRAQAAQDALRAIGGQNRTKQATAVLDALELLDGEKIAPYKSKYISFILDIVKAKGHGQVVNRNEIIKDDHGLEYMNPDSSRLEPEWVTVLIAALVYSGDIVLSIPGKKFDATGLQQLAATGMDELIRFKHIEQPKEWNLPALKSMFELLGMTPGMAQLITQGKEEPIQDLQQAVGKLVKRIVMTQQALREGLSFWGLDLLAGTDLANQVSGLDAAKTFLESLQAYTSPGKLKNFRYSMDEVKAHEKAVKALDDLDALRKFVMDHSPTASWLSTAEGVLPPEHNWVNRMKNTRQDVLEMLNQTDLTKLANQSQVIGAKLQQLKKDYIVVYIGLHTKARLGVNDDKRKAALVEDHRLQTLLKLAGVDLMPRQQLIDYQNRLAGLKSCFALTEGNLDTTPVCPHCGFRPSVETGVAQGSQMIDQMDNDLEAMVGNWTSTLLANLEDPITQANMNLLKVDDREPLEAFIKSGELPVPLDTNFVHALKEVLSGLVKVSVKAQELQKALQIESGPATPTEIKKRFDDFIDQLTKGQDPANVRIVMEG

SEQ ID NO: 1128 - protein, 1246 aa, Kingella denitrificans
MAKNMKYGDLIQFEQIESVIQLLDAERPDEAKKLVATYVISDDMAERISKLMVPQLSFDDSVDHKGVLIVGNYGTGKSHLMSVLSLVAEDAAYAPMIRHPKVAEAVAPIAGRFKVLRIEVGGLQMPLRQIITLQLERFLEKIGVDYTFPTADKELNNKDSFEEMMAAFAEKFPDQGVLLVVDEFLEYLQSRRDHELVQDLAILRQIGEVTKHLKFRFVAGVQEAIFDSVRFQHVADSMRRVNERFTQILIDRQDVSFVVSARLLKKTADQQNKIREYLTPFAKFYGSMNERMDEYVRLFPVHPDYLKTFEQIHFTEKRGALKTIEAAILAILDQDVPTDKPLFISYESFWNTIKANSVLRADPNIKEVMRVSEVLESRVQQAFTRPAYKSMALRVINALAVHRLTTGGDIHVPIGPTAAELRDALCLFQPGVEDMPGDPAENLLSMVQTVMREVLKTVNGQFISKASDTEQYYLDLKKDIDYDAQIEKRAEALSNDALDRAYYSAIKTLMECSDDLRYPGFQIWQYQIEWQERRVERMGYLFFGAPNDRPTAQPERDFYIYFLQPFDKPKFSDNNLADEVFFRLKSPDEDYKRYLSQYAAALDLASTASGGAKTIYQSKTQDSLQSMSKWLQERQMTAFEVTCQGKTKTLQDWFKGVSLRDRARLGPDERINFRDVVNIVSGLALDQRFVDLSPEYPTFSVLVTEANRKQLIGNALRALAGGTRTKDALAVLDALELLDGDRVDPANSRYAQEVLNRLKAKGHGQVLNRSELLSGTSDVEYFAPIKYRLEPDLLVTVLGGLVYSGDIVLSITGDKIDSGKLGQLAERSIEELKQFKHVEAPKEINLAVLRALFELFDLPSGLTQKASQGDTEPVIKLQEKVSALVPRVLKAGSDLQQGKLGFWGQNLLREEEAKDWHERLDSLKKFTESLAPYNTVGKLKNLRVTQEDLDGQKKNLEILAAVERLLELVVELGSTASYLSQAEMVLPAEHPWVKQAEAARKALQEKLSQDRTAEHAAEYRQTLNQLKKDYITAYIASHSKARLGVAEDKTRNALRKDDRLLALRVLAGVSLMPTSQLTAFEESLNGLKSCSSLDEPTLMTAAVCPHCQFRPSAEQLELIPAAKRLHKLDDDLDQLVANWQQTLLENLEDPFTQDSLGLLPPTSKKLIDAFLASRKLPDPMTSEFANAVQEALSGLEKITVKGDEIKQALLQGGSPATPDDLRKRFDTFMNERCKGKDATKLRFVIE

SEQ ID NO: 1129 - protein, 1241 aa, Alcanivorax hongdengensis
MQYGDLIQFEPIESVIQLLDANRPDEAKKLVATYVISDDMADRIAGQMIPQLSFDESVDHKGVLIVGNYGTGKSHLMSVLSLVAEDDAYVPMLHHPKVRDAAGAIAGKFKVHRIEISSQMSLRDIITQELEAFLENHGISYSFPPADKVVNNKAAFEEMMAAFHDAHPNQGVLLVVDEFLEFLRSRKDHDLVLDLSFLREIGEVTKHLRFRFVAGVQEAIFDSSRFQHVADSLRRVNERFTQLLLARQDVSFVVAERLLKKTADQQHKIRGYLTPFAKFYSNMNERMDEYVRLFPVHPDYIGTFERLVFTEKRGALVTLRDQIQAILESPVPEDRPGLIGFDQFWKTITDNSVLRSDPNIGPVLKVAEVLGERVQKAFTRPAYKAMAIRAINGLSVHRLTTGGDIYVPVGPTAEELRDTLCLYQPGIEDLGGEPSDDLLTAVQTTLREIVKTVNGQFISKAPDTEQYYLDLKKDVDYDAQIEKRAEALSDDALDRAYYSALMQLMECTDDHAYVTGYKIWQHQVEWQDRRVERNGYLFLGAPNDRPTAQPERDFYVYFIQPFEPPRFRDEAKADEVFFRLKDPDADMRRYLSFYAAAQELASTASGAAKSVYLDKTKDALRDMSKWLQDKQMSAFEVTYQGKAKRLQDWAKGVSMRDKLRLGPDERANFRDIVNVTSGLALGTHFADLAPEYPTFSVLVTESNRKQLINNTLKTLAGGTRTKDAVAILDALEMLDGDRIEPTRSKYAQEVLARLQAKGHGQVLNRSELISGASEVEYFAPVRFRLEPDLLAAVLGGLVYSGDIVLAVTGDKIDSGKISLLVERGMDDLTHFKHVEAPKEINVAVLRSLFELLGLQPGLAQMATQGKEEPVKNLLDAVAQQVQRVLTIGTDLQNRLSLWGQPLLREEELSDRRSRLEALKGFLESLSPYNTVGKLKNLRITQADIDTQKKNFDVLASVEKLRDLVAELGSTATYLSQAEMVLAPDHPWVQQTQTARKEILSKLIQDHGAQHAAEYRQRLAALKKDYIHAYVADHSKARLGVAEDKTKTALRKDPRMATLRALAGISLLHPSQLTTFDDKLDKLKSCAALVESELNTNPVCPHCGFRPANEQSDWIPATNVLKALDDELDQLLDSWQQALLDSLEDPIIQANFELLKDKQRTLVESFLKAKSLPDPVTPEFIAAIQEALSGLEKVVITAEDVKTALVSGGSPAKPDDLRKRFENLINERCKGKDASKLRFVVE

SEQ ID NO: 1130 - protein, 1234 aa, Bacillus cereus
MLYQDLLQFEPIESIIKLTDANMEEHANNLLKTYVISERMAEQLNDLIIEQLQFNRVLENKGLFIVGNYGTGKSHLMSVISTIAERENVSQYITNPSVAEKAKEIEGKFKVIRIEFGAVKTPLRDILVHALEENLAKWGVDFCFPPVDQIINNKEALEEMMGLFNEKYPDHGLLLVIDELLDYLRGRREQELALDLGFLREVGEICAKTRFRFIAGIQEMLFGNARFNYVADSLRRISERFIQVSIVRDDIAYVVSQRLLKKTDEQKSLIREHLKQFATLYTRLNEDMETYVNLFPIHPAYLTAFERVNIAEKRVALQTISSEIKKIINTPLPEGSPGLISYDSYWNYIQENATNRSDANIRVVIDKHKILKDRIENAFPSKKKLYQPMALRMINALAVYRLSTEDIHDKVGLTATELRDDLFLHPTISMDFLLEEDDASDFLKTSIEATIKIIQETVSYQYISTNESNGQYYLDLKKDIDVDSLIQAQAETIEDDKLDHYYFNLLQKAMELDDNTHVSHVKIWKYNLAWEAHHVMRPGYLFFGAPNERSTAQPERDFYIYMLRPYDKVTFKNEHKPDEIFFEYNRSNEDFDKYLKLYAAAQDLAIDASPATKKLYTSKVEEYQKKLFKWLIENFDSTFEITYKGKQSTVADLRMYILSNPTVKQIIDTTAEFYLTDWFELKYENYPSFGKIQGTLTKDNMETYVRKALQYINGEESKMGADILNGFVLLDAKNKVSIKQSGYTKWILSLLEAKGHGQVINHSELIETIHIKGTPDLQYTKQFSLEPELFVVLLGAMISAGAIEVTIEGKTYNALNLHEYIQLPLNKLTQFSYIKKPTGLPITEINAIADLFNEPLPNYEEDTLTRVIIRVTEKENNKIAETLSILQLVKKGIPTWDGQLLNNAEIQEQTKLLEEFKEFCEGLKRYNTPAKLHNLKYDLATIEAQREALERLEGLLKLDSQLKDISQLANYLRVAQLNMGNQSDWSTRVEEVLDEIQFALKQQQDISKELSQLNQLKQEYIKLYIEAHDQSRLNASENLRKTAFSNDPRLKALKELASRISILPKEEILKWEKALAELKACYHVSEDKLQHTQICSECKFSPKDITTNEKVILQKLEEELPVIYENWTETLLTNFNDAAIKENITLLSAEQQILIEEFINRKDFTLPIDVRLSQAINDLLKGIDKVELSLTDIEQMMANGHPLTVEELRKRFEDMLTKTVGTAPSNRVRIMLKK

SEQ ID NO: 1131 - protein, 1218 aa, Nitrosococcus oceani
MNTYVISKEMAERLTQLVIPQMQFDQPVDNKGLLVVGNYGTGKSHLMSVVSSLAADASLLEELNHASVRDAAAQIAGRFKVIRTEIGATTMSLRDILVAELEEHFEKLGVEYVFPEAGTIISHKRAFEDMMAKFGEVFPEHGLLLVVDELLDYLRTRKDQELILDLNFLREVGEVCKDLRFRFMAGVQEAIFDSPRFAFVADSIRRVKDRFEQILIARSDVKFVVAERLLKKTAEQQAKIRDYLMPFAKYYDGLNERMDEFVRLFPVHPDYIDTFERVTVVEKREVLKTLSMGMKGILGKDVPQDEPGLIAFDSYWNTLKQNASFRAIPEIRAVIDCSQVLESRIENALTPKNYKPMAVRLIHALSVHRLTTGDIYAPMGASAEELRDRLCLFEPLITEMGSDEPDKDLQTHVETVLRKIHTAVSGQFISENKDNRQFYLDLKKTDDFDALIDKRAESLGQAQLDRFYYEALKRAMEYQDATYVTGYKIWQHELVWQEHKAARTGYLFFGAPNERSTAVPQRDFYLYFIQPNDPPRFKDGKVSDEVFFRLKSTDEEFQTALKSYAAALDLAGTSSGHAKATYESKANGFLKKLVQWLQKHMSDAFEVTYQGRAKSMTEWAKGKSIRDLSGLLPHETINFRDLVNTIAGVCLAPNFENQAPDYPFFSVLITGNNRAQAAQDALRTIAGQNRTKQATAVLDALDLLDGEKIDPYKSKYTKFILDAVKAKGHGQVVNRSEIIQDDQGLEYMNPGGSRLEPEWVSVLVAALVYSGDIVLAIPGKKFDATGLQQLAATGMDELARFKHLEQPKEWNLPALKALFELLGMTPGMAQLVTQGKDEPVQNLQQAVGKIVKRIVMTQQTLREGLSFWGLDLLVGTDLASQTSGLDEAKGFFESLQAYSSPGKLKNFRYSAPEVLAHEKAMKALDELDALRAFIMDNGPTASWLSTAEAVLPAEHDWVDRMKTTRQDVLDAFKQANLTELTSQSQSPLSGIGAKLQKLKKDYTVAYIGLHTKARLGVNEDKRKAGLLNDPRLQTLRKLAGIDLMPRQQLTDYQNRLAGLKSCFALTEQNLDASSICPHCGFRPAVETGAAVGSQMIDQMDTQLDAMVAAWTSTILSNLEGPITQANMDLLKIDDREPLEAFIKSKELPVPLDSNFVHALKEVLSGLVRVTAKAQELQQALQVTDGPATPVEMKKRFEEYIDQLTKGKDPAKVRIVMEG

SEQ ID NO: 1132 - protein, 1246 aa, Methyloversatilis universalis
MAKNMKYGDLIQFEQIESVIQLLDAGRPDEAKKLVATYVISDDMAERISKLMVPQLSFDDSVDHKGVLIVGNYGTGKSHLMSVLSLVAEDAAYAPMIRHPKVAEAVAPIAGRFKVLRIEVGGLQMPLRQIITLQLERCLEKIGVDYTFPTADKELNNKDSFEEMMAAFAEKFPDQGVLLVVDEFLEYLQSRRDHELVQDLAILRQIGEVTKHLKFRFVAGVQEAIFDSVRFQHVADSMRRVNERFTQILIDRQDVSFVVSARLLKKTADQQNKIREYLTPFAKFYGSMNERMDEYVRLFPVHPDYLKTFEQIHFTEKRGALKTIEAAMLAILDQEVPADKPLFISYESFWNTVKANSVLRADPNIKEVMRVSEVLESRVQQAFTRPAYKAMALRVINALAVHRLTTGGDIHVPIGPTAAELRDALCLFQPGVEDMPGDPAENLLSMVQTVMREVLKTVNGQFISKAPDTEQYYLDLKKDIDYDAQIEKRAEALSDDALDRAYYSAVKALMECSDDLRYPGFQIWQYQLEWQERRVERMGYLFFGAPNDRPTAQPERDFYVYFIQPFDKPKFADNNLSDEVFFRLTGLDDDLKRHLSSYAAALDLASTASGGAKAIYLSKAQDFLRAMSKWLQEKQMTAFEVTYQGKKKNLQEWAKGVSLRDRARLGADERINFRDVVNVISGLVLGQRFVDLSPEYPTFSVLVTEANRKQLIGNALRALAGGTRTKDALAVLDALELLDGDRVDPANSRYAQEVLNRLKAKGHGQVLNRSELLSGTSDVEYFAPIKYRLEPDLLVTVLGGLVYSGDIVLSITGDKIDSGKLVQLAERSLEELKQFKHVEAPKEINLAVLRALFELFDLPSGLAQKASQGDTEPVIKLQEKVSALVPRVLKAGSDLQQGKLGFWGQNLLREEEAKDWHARLDSLKKFTESLAPYNTVGKLKNLRITQEDLDGQKKNLEILAAVERLLELVVELGSTASYLSQAEMVLPAEHPWVKQAETARKALQEKLSQDRTAEHAAEYRQTLNQLKKDYITAYIASHSKARLGVAEDKTRNALRKDDRLLALRVLAGVSLMPTSQLTAFEESLNGLKSCSSLDEPTLVMAAVCPHCQFRPSAEQLELIPAANRLHKLDDDLDELLANWQQTLLENLEDPFSQDSLGLLPPASKKLIDAFLTSRKLPDPMTTEFANAVQEALSGLEKIAVKGDEIKQALLQGGSPATPDDLRKRFDTFMNERCKGKDATKLRFVIE

SEQ ID NO: 1133 - protein, 1209 aa, Thermoplasmatales archaeon
MVKVKELIDFVEIKDVIDIDSDIDSTEGKKNIVKDYIISDNLKEHILDVAENISKPKHKSVQIIGGYGSGKSHLLAWFVSILENKELIDNITNDGVKKRFKEVLDREFAVVQFELQPGVSALSDFFFDRIEQQLNDKHDIEVPKRDSSKVEDFKKDIKDIIDAVKRKDPKMGLVVVIDEISDFLKQKTMQQIHRDMQFLRILGQVSQSLDFLFIGAMQENVFSNPKYVGEAVSFGRVAERFHIVTISREDIKKVISERVLKKDSGQREQIDKLLSDFKRMFSPINSEPDKYINLYPIHPSVIDVFSDLPYFEKRGVIQFATVWVSKILDCEFPKFVTYDSVFDEINSKHHVRNLDEVRPVIDIIETLDSKIELVDKDKRDDARRLIKALAVLKLHGKSADNGATPEELANILLITSKTIKNTDRIIVILDKLREVTSGQFIAKTENNYYYLNPEQSIDYDEVVKRKMKTLPEGMENEELLKILKYTDLIEADLAESYVRSFKDSCPWSDKKSFRLGNFIFDDGSDQVKSDDLDFNLVVQSPYVSSSKLDSSKETAILSIKYSDELDDALKYLAATKLLINENYAKSVMIKKQNTCSDDARNLILQKMIDSEIEIDGSKKKVKSIISKEPDNIDEFFHHVKENVFNDYFSSTYSKYPKFLNQISYENVKGEVESTINELLSKSERNLFSNAKNILSSLDLMDIDGNIDTSNSLYVKVIVEELEKNKGKNVKIDDILEKLQKPPFGLDVEVIYLVFVVLTYNGEINLRKRGGGTITSSDLKDVFNIGISAFRDIPYATLETEFPIDSVIKLFRALKLNQGYVRNIKDRTKAVQEFRLKTLELKESLDIIFRIFQEISSKPDPIIDKQELSKKIDELDTFPIGDFLEVKTVNDFRKVEYDDKQIDSISKNLELIQNIKGFIDDYNGFINREYLYMKNSMEWMNSNPVIFNDSDKKALNEIRVECRPLVEETNNVLNSEQRRILKGKLQQYKKKYVDLYFMKHKTTIGDSIHWERLENVSKSNELKRLRDMKAIRCIAPLNLIKLEEKLLSLSKARCTNLTEDHLKENYLCTWCRFPETLKNIKDINEEISSMQESLGIISKQWNETILSEVENYSDNVKLLSTPEKKIIQDIQSKKSLPDDIEQDAITALNNLFSELSEIEISPKEVIDFIFSESSVLDFETFSNKLDEYKDKILETGDKKNIRIKRMESQS

SEQ ID NO: 1134 - protein, 1244 aa, Pseudomonas sp.
MSTAMKYGDLIQFEPIESVIQLLDANRPDEAQKLVSTYVISDDMAERIASLMIPQLSFDESVDHKGLLVVGNYGTGKSHLMSVISLVAENADYASKIRHPKVAEAAAAIAGKFKVHRIEVSSQMSLRDIITYELERFLAKHDVSYAFPPADQVVNNKASFEEMMAAFDETHPGKGVLLVVDEFLDYLRSRKDHDLVLDLSFLREIGEVSKHLRFRFVAGVQEAIFDSNRFQHVADSLRRVKDRFTQVQLARQDVSFVVAERLLKKSVDQQEKIRAYLTPFAKFYSSMNERMDEYVRLFPVHPDYLKTFEQLVFTEKRGALVTLRDQIQAILNDVVPKDRPGLVAYDSFWQTVKSNSVFKADPSVGPVINVSDVLESRIQQGFTRPTYKAMALRIIHALSVHRLTTGGDIYVPVGPRAQELRDSLCLYQPGLEDMPEPAEDLLSFVVTALREILKTVNGQFISKAADTEQYYLDLKKDIDYDAQIEKRADVLSDDSLDRAYFGAIKQLMEQADDNCYVTGHQIWQYQIEWQERRAERDGYLFFGAPNDRPTAQPERDFYIYFVQPFEPPRFRDESKADEVFFRLKGLDDEIRKHLAFYAAALELANSTSGAAKGIYQGRAQDFLKAMSKWLQEKQMSAYEITYQGKKATLQDWVKGISLRDRARLGSDERINFRDVVNVVSGLAMSQQFAETAPEYPTFPVLVTKANLKQMVGSALKALAGGARSKDANAMLDALEMLDGDRIEAGSSRYALELLKRLKDKGHGQVLNRSELLVGGGEVEYFHPIRFRLEPELLVIVLAGLVYSGDIILAITGDKIDSSKLNLLAERSQDELKNFKHLEAPKEINVAVLRSLFQLLGLTPGLAQMAVQGSEEPVNQLQTKVTELVNRLLSATTDMQNRLSFWGQSLLTSAEAADWRARLESLKGFIEGISPFNTVGKLKNLRISSDDINVQQQNLLVLESVERLLDLVSGLGAIAAYLSQAEMVLPSEHAWVKQAQAARTSILGKLSQNRTAQHASEYRQALSTLKKDYLNAYIGLHSKARLGVVEDKTKAALRKDPRLANLRTLAGISLMPTSQLSAFDQRLDSLKSCHQLTELELNASPCCPHCSFKPANEQLQLGVAASALAQLDDELDQLLANWQQTLLDNLEDPTIQANLELLKASARELIESFVVSRTLSDPITLAFVSAVQEALSGLEKITVSGTDIKQALLSGGSPATPDDLRKRFEVLLSERCKGKDASKLRFVVE

SEQ ID NO: 1135 - protein, 1232 aa, Bacillus cereus
MLKYGDLIKFEAVESVVQLKEANDTDYAISLLNTYVISDNMAEKLTNEIIENIQFDRWVDNKGMLIVGNYGTGKSHLMSVISTIAELPGASEHLRHKEVAEKAKEIEGKFQVVRAEFGAVTMPLRDIICRELERGLEKMGIDYTFPAADQVTNNKEMFYEMMELFHEQYPDKGLLLVIDELLDYLRGRKEQDLTLDLGFLREVGEVCGKSRFRFISGVQEMLFDNPKFSFVADSLRRVKERFKEARIVREDIAFVVSERLLKKNDEQKALIREHLNKFTKLYNGLAEDMEMFVNMYPIHPSYLETFEKVNIAEKRVVLQTISKEIKKLLMLEVPEDATGLISFDRYWQYIEEDSSLRTNDNVKLVMNKVEMLKGCIQTGVKRQYKVMANQLVDALAVYRLTTDDLKTPIGLTSESLRDKLFISHPMLLELDEEASEFLTTMIESAMKDLMTAASFQFVSLNKDNGQYYIDIAKVTAVDELIQQRGEGLTDNQLDSYYFQVLKQATEVADTSYVSGYKIWLHEIPWIDRRVKREGYIFFGAPNERSTAQPERDFYIYMLQPFEEPKFKDEQKEDEVFFRLIKKNDDFINLLRLYSGSCEMYKDTTTNRHLYKPKMDDYLKKLVKWLKENFVEAFEIVYRGKHADVLEHGFFLPSNPDTLIQIIDSVSQDLLSQWFEVKYSEYPTFRKLDKSFVTKSNMQTYVKDALDYLNGKKTNQGEAILNGLVLLDNNGNLTARNSGYAKWVLELLNQKEPGQVLNQNELIEVINTVQGTPDQRVTKQFAMEPELLAVVLASLIQSGEIVVTVNGKTYEAMNFAEFVRLPINDLTYFSHIKKPSGLPVPAVQGLIDMFGAVQADFTNSNSVDFSIKQIISKAKEETTRTVQMIASVRDKFQIWDGQLFSSEEKEEKIKKLNSLSEFLQGLQVYNTRAKMVNLKYDINRIEEEKEHLAIVYQLEKLQQKINEYTKVAYYLSKAKYIVAPSQEWIDDADVSLDNLSIALKNGEDCSREVGELERLRKEYIEHYMALHQTARLNATENKKKSELLKDPRYDALNVLASKISFLPRQSFDNWQMSLKALKDCYNLTVEKLQHTPECPQCRFNPREEQNKSKPSLVQLEDQLGELLNSWTETLLTNFNDPIVKESIDLLESEQKRLMNELIQNKAFTLPISLNLINAINAVLKGIHKEQIELGQLMKVFGDGNPITVDEARKNFDMLLKGLVGTNETNRVRLTVKK

SEQ ID NO: 1136 - protein, 1224 aa, Treponema primitia
MKYADLISFNPIESVLAIAEANDKSQASNLVKSYVMSDDMAEKLQINMLSQLKLEDVVDNKGVFLVGNYGTGKTHLMSVISAVANDADNLAFLQNKKFADYAKNIAGKFEVLRFELSAVKTSLRQIVLSRLQEDLKGRGLSFSFPKEDETISNKDVLKSAMELFSSKHPDKGYLIVIDEFLDFLGGKDDHAVRYDLGFMRELGEIVKETRLRIILGVQEKLYDNPNFSFVSQTINKIKDRFEQVVIRKEDTAYVVAESILKKTADQKAIIREHLQKFTSLYSNMDSRIEEYVDLFPIHPSYIDVFNKIYMIENRHILKNVSEIIRRNLDNILSDESTGVISFDSYWSFIKENNALHTDPNIKEVVDKSGKLEDILNRSFPKKLYKPLAVQIIFALSVHRLTTGDTSIRAGLTSENLRDDLCLYLPGMPDQTSDTLQSIVQTVLKDIMTTVSGQYIDSNPDNGQYYLELTKDIDYDEKINQRAAVLADDSLNNYYYDLIYSSLEWDIQEYVPGFKIYEHALNWQSHNIFRKGYLFLGTPVDRPTAQPPRDYYIYFIPPYGTSTWNNEKKDDEVFFFLKPNESFKNDLKLYAAALLNRDFADDKNKAQYQGKAEIFKKKLLHYFSENKNTGFEVIFKGEKKQPLEIIQAKYNKDSTFVQTIDLIATICLDGCFSTLYPLTPLYKTNITLKNLSDTVRSGIEYIAGRKTQIGAAFLDSFGLIDTDSVSIKNSKYAQYYLQKLEALPEDTVINFTDIYENISAEYIDKQFKISYDILPVVFLSLVYSGKAVLSLKNTIITASNIENLVKTPGADINEFKYLSRPKDVQLTELAHLFDVLGLQSALILNPATREKALDKLLAEAKVLTDKAVIAASKLNDNFELWGEPLSPSHIAAEYKISTKSVSDTLGNFHARFNTVAKLNNFTLSTGEIDKLAKDIGNVKIVGEYETLKAETYPNVLYMVNLESIDLGAAIRGEIEAAKEAFRKIRDAIPQSLDGITGAQQINETLSKVKEKYINLYFEEHKKKRLNNSDAKKKGDIIASPNLTALKQLRKISILSTSKLDTIEKELASLKVCYELTTDMLKTSHFCTKCNFMLGAQDLPIHGKLEELSDRIDTLLAEWNTTLLNTVSDPLVLEQKQYLSADQQKCIDDYIAAKKLPQTIDQFFVNAIIALLHGFEPVTIPAMDLIDKLDALGPCEVEKFKVEITGIINSYTEGKDKSKLRIVIKR

SEQ ID NO: 1137 - protein, 1235 aa, Bacillus methanolicus
MLRYSDLIQFEPIESVVQLRDADDKERAFHLLDTYVISDRMAEQLDDIIIEQLQFDRVVDNKGLLIVANYCTGKSHLMSVISTIAEQSGASEHIKNERVAKKAKEIEGKFKVIRTEIGAVAMSLRDIICQALQQGLANLGIDYTFPRAEEVTNNKDMLYEMMELFHEQYPDQGLMLVVDELLDYLRSRKEQELTLDLGFLREFGEVCSKTRLRFIAGIQEMLFDNPKFQFVADSLRRVKERFQEVRIVREDIAYVVSERLLKKDEKQKALIREHLSKLTSLYHRLGEDMETYVNLFPIHPAYLETFEKVNIAEKRVVLQTISREIRKLLTEEVPENETGIISFDRYWQYIEEDSSLRSNPNVKEVMSKVRTLKDRVQNGLKSPNYKPAALRIVNALAVYRLAVDDINSPVGLTSGELRDKLFLNIGMLLDLGDEAADFLKTRIEATLKEIMTAVSFQYISTNQENGQYYLDVKKDIAVDDLIEKRGEELTDNQLDRYYFEILKQATEVADNTYVTGYKIWLHEIPWENRRVKRQGYLFFGAPNERSTAQPERDFYIYMLQPFEPPKFKDEEKADEVFFRMTKKDDRFVHLLRLYGGAREMSNDAAATTKRLYNDKAASYLRSLVTWLKENFVEAFEIQYRGKKGSVLEFGMFLPGNATLIEIINTVAEGLLSQWFEEKYKDYPSFRKLERGYLTKDNMATYISDALSYINGRKTSQGEAILNGLVLLDQKGDLNVRASGYARWVIEKLEEKGHGQVLNQNELIETIYTVQGTEDVRLTQEFRMEPELLVVVLGALIQQGEIVVTVDNKTYEAMNFGEFIKLPLSKLTHFSHIKKPSGLPIPAINALIDMFDIGKGNVTDESWLEFAIKQIISQSRQAVEKTVKMINDVRNKFHIWDGPLFSSDERAEYIAKLESLKTFLEGLQVYNTRAKMTNLKYSVSDIEQQNENLKIVTKLEQLQQKIHEYTKVADYLSKAKLVMSTNREWLESVDVALDNLAIALKENSDCSSEIRELEKLKEEYIQHYLQLHHQARLNATEENKKKALLNDKRYLALKELVSRIDLLPRQALDEWNKNIQSLKACYQLTREQLQHSPICPNPDCKFNPREEGVVQRYSLEQLEERLDDLLNTWTETLLTNFNDSAIQEGISLLSAEQQQLVNDFIQKKQFDLPIDIRLLEIINDLLKGIHKEEIHIDQLVKMMGDGNPLTVDEVRRNFEMLMRAIVGNNQPHRVRIMVKK

SEQ ID NO: 1138 - protein, 1241 aa, Vibrio scophthalmi
MKKYGDLIQFESVTANIQLKNSSDHDKATGLVSSYVISDKMSQKLSNVIIEQLQYEESVDNKALWIVGNYGSGKSHLMSVISAVAEFPDLASHISNDVVRSASDKIAGKFKVIRFEIGASKMALTDIVTQNLTDGLADMGVDYEFPPMTEISSNHKPYFEEMMATFHEKYPDHGLLLVCDEMLDYFRSRNEQELPLDIAILRVIGEVIDGTRFRFMAGVQEAIFDSTQLEFLSKEVKRIRDRAEQVLIAREDIKYVVAERLLKKDAQQQEWIREYLQKFTPYYDKMNERLDEFVRMFPVHPDYINTFERVRMAGLENRQVLKSLSRQMKELMEDEVPQDVPGIFSYDTYWNELSSEPSMKTNPEVGQVIETGELLVDRIDQAYPTPGEKEFAKRLVAGLAIHRMAVGDIYAEMGATAAELRDSLCLYLKNIEIMPGDKSKNLENHIVTVLTKVRRTVNGQFFSKNKTNDQFYLDLKKTEDFDAHIEAKAAGLSPDSINSAYRAAMLEILEQTDSQQSKTAMWQHELKWLDRNVSRPGWLFLGSPNERETAKPQLDYYMYFIQPENPPKQKKEFIREDEVQFVLKNRDEEFNQSLKNYAASVALRALATGSAQHTYKIKADGYLGEMIKWIRANIKDAFEVQYNGKSKPIMDWLKGASVRDITGIADSDHGSVKDIFEAVASFILEGYFQSLAPEYPKFSQRITEDTISVASKDVLSYLAGGAATKRATAVLDALELLDGDKLKPRRSRYAQAVLEVLAAKGHGQVVNQSELLEAVYARLYFKPGTYRLEPEWLLVILATLVHAGELELSVVGKVITASDVDALKGLDFNTLLDFKHIQAPKDFNVSAIKAVLELLGMNEGLATSIQQGDENVVRTMGQEIEKLVKYLVHDQQLVKHRLMLWGNHVLAENEATLLADRLGKTKTFLESLQRFNTPGKLKNFKDSAESIVEHAETLKEWNSFKQLSEVVDSFAEYAQYLKEAQLILEDNDEWQSDVRDAALALRNGIEDKTTRLELSFKQEHLANLQQLKKAYTQRYVSLYQSARLTMEQDKEKAALIGDERLQTLEAFSGISLLPAEQVKQWRSDWASLQVAESIDPKTIELTPNPVNFSPRSEGSKASASERLVELDTQLTEMLSEWTQSLKSTLADPFLQLDLLSEVQRGEINAFISSGSLSTPVSKEFIAGVNEALAGLEEVKISTMDLVASLGKGTPQTLDDVKARFEELLNTHCKGKDSSKVRIIID

SEQ ID NO: 1139 - protein, 1250 aa, Thiorhodovibrio sp.
MKYAELIQFDPIESVIQLRDADQSSTAQQLVSTYVISDEMAERLTSLAIPQLQFDQPLDNKGLMVIGNYGTGKSHLMSVISSVAADDSLLDGLKNASVREAAAQIAGRFQVIRTEIGATTMSLRDILVAELEEHLDKLGVDYVFPDASTIVSHKGAFEDMMARFAEVFPDQGLLLVVDELLDYLRTRKDQELILDLNFLREVGEVCRNLRFRFIAGVQEAIFDSPRFAFVADSIRRVKDRFEQIPIARNDVKFVVAERLLRKTTEQQARIREYLSPFAKFYGGMNEQMDEFVRLFPVHPDYIDTFERVTVVEKRQALNTLSAGMKDILTRDVPADQPGLIAFDRYWKTLTHNRAYRSIPDIRAVMDCSEVLESRIENAIARKHYKPMALRLIHALSVHRLTHGDIYAPMGASATELRDRLCLFDPMVEELGSDEPDEDLKTQVETVLREIHKTVSGQFISYNADNHQYYLDLKKTDDFDALIDKRAESLGQGQLDRFYYEALKRVMECQDATYVTGYKIWQHELTWQERMATRAGYLFFGAPNERSTAVPQRDFYLYFIQPFDPPRFKDDKICDEVFFRLKGTDEDFQTALKSYAAALDLAATSSGHAKATYEAKANGSLKQLVQWLQKHMAEAFEVTYQGRAKSMTEWAKGKSIRDLSGLSPDETINFRDLVNTVAGVCLAPSFENQAPDYPFFSVLITGNNRAQAAQDALRAIAGPAGKQQPTKQAASVLDALELLDGDKIDPYKSKYSKFILDAVKAKGHGQVVNRSEIIQDDHGLEYMNPGGGRLEPEWVVVILASLVYSGDIVLAIPGKKFDATGLQPLAATSIDELIRFKHLEQPKEWNLPALKALFELLGPYGTTPGMAQLVTQGKDEPVQNLQQAVGKVVKRLVMTQQTLREGLSFWGLDLLAGTDLASQASGLDEAKGFFESLQAYSSPGKLKNFRYSAPEVLAHEKAVKALDELDALREFIMDHSPTASWLSTAEAVLPAEHDWVNRMKTTRQAVLDALKQADLTELASQSQSIGAKLSTLKKDYSVAYIGLHTKARLGVNDDKRKAGLLNDQRQQTLLKLAGIDLMPRQQLTDYQNRLAGLKSCFALTEQNLDASPICPHCGFRPSVETFASAGAQMIDQMDTQLDAMVAAWTSTIISNLDDPITQANMNLLKIDDREPLEAFINSKELPVPLDSNFVHALKEVLSGLVKVTVKAQALQQALQVTDGPATPMEMKKRFEEYIDQLTKGKDPAKVRMVLE

SEQ ID NO: 1140 - protein, 1241 aa, Ectothiorhodospira sp.
MRYGDLIQFEPIESVIQLLDANRPNEAKKLVATYVISDDMAERIAKQMIPQLSFDESVDHKGVLVVGNYGTGKSHLMSVLSLIAEDAAYVPMVQHPKVAEAAGSIAGKFKVHRIEISSQMSLRDIITQELEIFLEKQGVSYAFPPADKVVNNKAAFEEMMTAFDEVHPGKGVLLVVDEFLEFLRSRKDHDLVLDLSFLREIGEVTKHLRFRFVAGVQEAIFDNSRFQHVADSLRRVNERFAQVLLARQDVSFVVAERLLKKSADQQHKIRTYLTPFAKFYHNMNERMDEYVRLFPVHPDYIGTFERLIFTEKRGALVTLRDQIQAILDDEVPTDRPGLIGFDKFWETVTSNSVLRSDPNIGPVLNVAEVLGERVQKAFSRPAYKAMAIRVIKGLSVHRLTTGGDIYVPVGPTAEELRDTLCLYQPGIEDMGGEPADDLLTTVQTTLREIVKTVNGQFISKAPDTEQYYLDLKKDVDYDAQIEKRAEALSDDALDRAYYGALMQLMERTEEDTYVTGYRIWQHQVEWQERRVERNGYLFLGAPNDRPTAQPERDFYIYFIQPFEPPRFRDDSRTDEVFFRLKGLDDAIKRYLACYAAAQELASSASGGAKSVYLDKAKEALRDMSKWLQDKQMTAFEVTYQGKTKTLQEWAKGVSMRDKLRLGPDERANFRDIVNVTSGLALGTHFADLAPEYPTFSALVTEANRKQLIGNALKALAGGTRTKDAIVILDALEMLDGDRIEPTRSRYAQEVLSRLTAKGHGQVLNRAELISGATDVEFFAPVRFRLEPDLLMAVLGGLVYSGDIVLAITGDKIDSGKLSLLVERALDDLKTFKHVEAPKEINVAVLRSLFELLGLPSGFAQMATQGKEEPVKELLEAVAKLVNRVLTVGTDLQTRLSFWGQSLLREEELRDWRSRLEALKSFLESLSPYNTVGKLKNLRITQADIEAQQKNLDVLSAVEKLRDLVAELGSVAGYLSQAEMVLPSDHAWVQQAQAARKDILDKLAQDKSAAHAATYRQQLAALKKDYINAYVAQHSKARLGVAEDKTKTALRRDSRITTLRALAGISLMPTGQLTSFEDKLDKLKSCASLVEAELATSPVCPHCGFRPANEQADLLPAANVLKALDEELDRLLEGWQQTLLDNLDDPIIQANFELLKASQRELITAFLASKTLPDSVTPEFVATIQEALSGLEKILVTGDDIKQALLTGGSPATPEDLRRRFESFMTERCKGKDASKLRFVVE

SEQ ID NO: 1141 - protein, 1222 aa, Clostridium papyrosolvens
MKYSQLVQFDPIETVVKLKDADSKGEAERLVKTYVMSDSMADSLIGVVIPQLQFEQTVDNKGVFIVGNYGTGKSHLMSIVSTIAEDASLLDYIKHDKFREHAKSIAGKFEVLRFEIGASKMNLRDIIVRKLESDLKQRGIDYKFPPLEEVTDNKQYLVEMMGLFEEKYPDKGYLIVVDELLDYLGSRKELEIKLDLGFLREIGEVSKNTRIRFMAGVQETLFDNPGFSFVAKTILKVKDRFEQIIIRREDISFVVSQRLLQKNNEQKAWIREHLQKVSSMYKNMADRIEEYVNLYPIHPAFLETFEKVYIAEKREVLKTITLTIKEMLDSEVPNEEPGLVSYDAYWSYIKNSPSKRTETEVKDVIDKSGILEGIIQHSFTKPQYKPIALRIIYALSVHRLTTGNINAPLGITVQNMKDDLCIYDPLLPEKEEDFLITTIETIMREISNTVSGQFIEYNQENEQYYLDLKKDIDYGAKIQQKADLLDEDSLNEFYYKLINISMEWNAQEYITGFEIYEYDLIWEDKNVEREGYRFMGTPNGRSTAQPPRDFYIYFLPPYGTDNSAYIKNEDEVYFEFMCDAGFTNLLKMYSAAHKMASISSGDSKNSYLKKAEDYQKDAIKWIRQNINQCFIVSYRGESKTILSWLKGKRIGDKSLKEQVDMAAASCLDVWFNEQYPDYPKFYITVTHNNYNQLFKAAMDYIAGKKTDTGSKILDSLQLLDVENISPKNSVYAKYFIDLINHLPQGKVLNRSEIIERINEEVEYDKRFKLEPIWIALIMSSLVYNGDITLAAGGKNFDATMLKELAAENTMNLIEFKHCDRPKDVPVAVLKKLFEILGLPPGQIVNANTRDVAVASMLVKIDEYIDKALKATLFLNGDISVWGKPSMESYKVDNYKESIKEFKNFLDGLKIFNTQAKLKNFRHTEEEIDKQGAALRLLVDIDKIKDLKSKIEANTAYLSGAEIVLKDQSWIDKVNALKLKLETVLKNLDNIDEDFIRVFNSELSGLKDEYRNVYMELHKKNRLDLNGDNAKKKIMQSKELNNLKKLTAIEDILPVVKLNGITEKISRLRTCYNLTQQDMEGKFMCPHCQFNPSENNQPVHGVIDSVEDDIEKIYKEWTEIIVSSVEDPMVKENIGFLKAEQQNVISKLLETRKLPDVIDGNFVSGVNTLMKGLEKVEVLVEDMKKAISGDGPVTVEDIRARFEKYVRDLTKGKDESKVRIILK

SEQ ID NO: 1142 - protein, 1253 aa, Thermoanaerobacter ethanolicus
MKYGDLIQYEPIETVIKLKDADKIDEAKRLVKSFVVSEGMADSIINICIPQLQFDETIDNKGIFIVGNYGTGKSHLMSVISAVAENKEMLDYVSHEELKKEMGKIAGKFKVLRFDIGAVNTPLRNIITKEIEKDLARYGIEFYFPPIDEVTNNKDAFMEMMSKFEDKFPDKGYLIVVDELLDFLKARKEQELIRDLTFLREIGEITKSTRLRFMTGVQETLFDNPAFNAVAQTVLKMKDRFEQLIIKREDISYVVSQRLLKKNDRQKAWIRSHLEKFSPLYKSISSRIEEFVELYPIHPMFIEVFEKMFIVEKREVLKTISHLMRELLDKDVPEDEPGIISYDSYWKFLRDNPSLRAEPDIKRVVDKSVAVEDLIEHSFTRPQYKDAALRIVHALSVHRFTTGDIHTSVGITVENIKDDLCLYIKMPEIEEDFLITTIETIMKEIMKTLSWQYISYNPDNQQYYLDMVREGINYDAKIQEKAEILSEDIFNRHYFELLIKVLDWNAPEKVPNMRIWEYSLTWNEKNVKRYGYLFMGYPDERSTAQPPRDFYIYFLPPFVGVNYNKKYILNGKEDEVFFEFVNTDEEIIEKIKKYAATMELSELSSSDQKKIYEDKANGFQKDITKWIRDNVSKCFNVSYKGETQSIIYWLKGKTANYDTIKSYIDEAASSCLSLYFSEKYSEYPTFYTKITEANLNEVFKSAMNYLAGKKTETGKKVLQSFDLILGDDIVPGNSKYANYFLNELYKLPPGKVLNREDIIENVNGEDIDKRFKLEVQWVVLLLSALVYSGDIILRIKNKVYDATTIEALANMNVGELIDFDSFERPRDIPVRELKTLFTLLGLPSGLVTASLSKPEEAIRQMVAKSEELAKKVVTVNQFVVSNKTIWGKPVFDEFEIRDYKDLLNNFRDFLDSLKAFNTPGKLRNFKYTEEELKEKFKTLETVKKIEKIIDFKNEVEELVKYLSSAEQQLPEEIELKQNINEMKNEVERFIKQIDTKESEDIKRLTRELEELKIEYIDLYLEYHKKHRLDYNGDERKKKIMASDLFNNLKKLKDVGIFPVNKFSEIEDILASLKTCYSLTEKNMEIETQCPNCGYSIKSGEVPVFGKLDEIEDKIENLYMEWTKILLDNIEDPMIQERMEILNKDQQKVIRDFLNKKELPEKVDNLFVSAVKDLIAGLEKVEIEINKFISAITYDGPVTVDEFKKRFLENVDFLIKGKDKDKVRIIIIGMCKINKNNHDKKPKYVLHTIYSNQH

SEQ ID NO: 1143 - protein, 111 aa, Thermoanaerobacter ethanolicus
MRYGELIQYEPIETVIKLKDADKIDEAKRLVKSFVVSEGMADSIINICIPQLQFDETLDNKGIFIVGNYGTGKSHLMSVISAVAENKEMLDYVSHEELKKRWERLQENLKF

SEQ ID NO: 1144 - protein, 1126 aa, Thermoanaerobacter ethanolicus
MGKIAGKFKVLRFDIGAVNTPLRNIITKEIEKDLARYGIEFYFPPIDEVTNNKDAFMEMMSKFEDKFPDKGYLIVVDELLDFLKARKEQELIRDLTFLREIGEITKSTRLRFMTGVQETLFDNPAFNAVAQTVLKMKDRFEQLIIKREDISYVVSQRLLKKNDRQKAWIRSHLEKFSPLYKSISSRIEEFVELYPIHPMFIEVFEKMFIVEKREVLKTISHLMRELLDKDVPEDEPGIISYDSYWKFLRDNPSLRAEPDIKRVVDKSIVVEDLIEHSFTRPQYKHAALRIVHALSVHRFTTGDIHTSVGITVENIKDDLCLYIKMPEIEEDFLITTIETIIKEIMKTLSWQYISYNPDNQQYYLDMVREGINYDAKIQEKAELLSEDIFNRHYFELLIKVLDWNAPEKVPNMRIWEYSLTWNEKNVKRYGYLFMGYPDERSTAQPPRDFYVYFLPPFVEANYNKKYILNGKEDEVFFEFINADEEIIEKIKKYAAAMELSELSSSDQKKIYEDKAKGFQRDITKWIRDNVSKCFNVSYKGETQSMIYWLKGKTANYDTIKSYIDEAASSCLSLYFSEKYSEYPTFYTKITEANLSEVFKSAMNYLAGKKTETGKKVLQSFDLILGDDIVPGNSKYANYFLNELYKLPPGKVLNREDIIENVNGEDIDKRFKLEVQWVVLLLSALVYSGDIILRIKNKVYDATTIEALANMNVGELIEFDSFERPRDIPVRELKTLFTLLGLPSGLVTASLSKPEEAIRQMVAKSEELAKKVVTVNQFVVSNKTIWGKPIFDEFEVRDYKNLLNSFSDFLDSLKAFNTPGKLRNFKYTEEELKEKFNILETVKKIEKIIDFKNEVEELVKYLASAEQQLPEEIELKQNINEMKNEVERFIKEIDTKESEDIKRLTRELEELKIEYIKLYMEYHKKHRLDYNGDERKKKIMASDPFNNLKKLKDVGIFPVNKFDEIEKVLASLKTCYNFGKENIKTEVLCPNCGYSIKSDEVPVFGKLDEIEDKIENLYKEWTKILLDNIEDPMIQERIEILNKDQQKAIRDFLNKKELPDKVDNLFVSAVKDLIAGLEKVEIEINEFISAITYDGPVTVDEFKKRFLENVDFLIKGKDKDKVRIIIK

SEQ ID NO: 1145 - protein, 1241 aa, Nitrococcus mobilis
MRYGDLIQFEPIESVIQLLDANRPDEAKKLVATYVISDDMADRIAKQMIAQISFDESVDHKGVLVVGNYGTGKSHLMSALSLIAEDAAYVPMLRHPKVAEAASSIAGKFKVHRIEISSQMSLRDIITQELEVFLEKQGVSYAFPPGDRVVNNKAAFEEMMATFDEVHPNQGVLLVVDEFLEFLRSRKDHDLVLDLSFLRELGEVTKHLRFRFVAGVQEAIFDSSRFQHVADSLRRVNERFTQVLLARQDVSFVVAERLLKKSADQQHKIRTYLTPFAKFYSNMNERMDEYVRLFPVHPDYIGTFEQLIFTEKRGALVTLRDQIQALLDDEVPTDRPGLIGFDRFWDTVTSNSVLRSDPNIGPVLKVSEVLGERVQKAFTRPPYKAMAMRVIKGLSVHRLTTGGDIYVPVGPTAEELRDTLCLYQPGIEGLGGEPSDDLLTAVQTTLREIVKTVNGQFISKAPDTEQYYLDLKKDVDYDAQVEKRAEALSDDALDRAYYSALMQLMERTDEHAYVTGYKIWQYQVEWQDHGVERNGYLFLGAPNDRPTAQPERDFYIYFIQPFEPPRFRDEAKADEVFFRLKGLDDAIKRHLAFYAAAQELASTASGAAKAVYLDKAKDALRGMSKWLQDKQMTAFEVTHQGKTKTLQEWAKGVSMRDKLRLGSDERANFRDIVNVTSGLALGTHFTDLAPEYPTFSVLVTESNRKQLIGNALKALAGGTRTKDAVAILDALEMLDGDRIEPTRSKYAQEVLSRLKAKGQGQVLNRGELVSGPTDVEYFAPVRFRLEPDLLVTVLGSLVYSGDIVLAITGDKIDSGKISLLVERGLDELKQFKHVEAPKEINVAVLRSLFELLGLPSGLAQMATQGKEEPVKELLDAVAKLVNRVLAVGTDLQTRLSFWGQPLLREEELRDWRTRLEALKGFLEGLSPYNTVGKLKNLRITQEDIDAQKKNLEVLSSVEKLRDLVAELGAIAAYLSQAEMVLVADHTWVQQAQAARKEILDKLADDRSAQHAAEYRQRLAALKKDYITAYVAQHSKARLGVAEDKTKSAMRKDPRIVTLRALAGISLMHPGQLTAFEDKLDKLKSCASLIESELAASPVCPHCSFRPANEQGDFLPAANVLKTLDDELDRLQQGWQQALLDNLDDPIIQANFELLKAVQHDLIKGFLVSKALPDPVTPEFVAAVQEALSGLEKILVTDDEIKKALLAGGSPATPDDLRKRFESFLNERCKGKDASKLRFVVE

SEQ ID NO: 1146 - protein, 1295 aa, Saccharomonospora glauca
MSTNEVYLRDVLDIPESVHAGDFKVELTGGFTQVEARVAEYVVTDQLRQAFDKALSIVRAAVRDGTSHAAYLHGSFGSGKSHFLTVLHAVLNNHPAARAKPGLQPVIADHDDWLRGKKFLMVPYHLVGATDLDSAILGGYVNTVRALHPDQPTPPVYRADAMLDDARRYREAKGDAAFVDWLSIGATTPVPAGSGVDDEDDDDLDLDLDLGTAEEGADTGDTGWTGEQLDRAFTAPAGDPVRDRLVQALLSGPMSSYVRGASGDAEAFLPLENGLAIITRHARDLGYDGLILFLDELILWLQAHMSDRQFVNNQVSKLVKLIESGDASRVLPIVSFISRQRDLSKLVGEDVTGAEVKELERQVEYLAGRFDTVSLEDRNLPAIIKERVLKPRPGGREILDAAFAGIESAKQADRDVLLDSAGATGADWQDFRDVYPLSPALLNVLVALSGALQRERTGLKLLQEMLRRRRDDMKVGELIPLGDLWDVLADGAGEAFTDRLRREAEAAQRFYAKARAWLVDRHGEHTQQFRATDRLVKTLILAALAPQVPALTRLTGGRLAALNHGSLRARTVSAGSLAVTRLRELQAEFGELRHEGDEDPVFRLQLSDLDVEPYLDAVGERDTVGARRLWLRQQLWSELGIKYTDDFVCEKEIVWKGTRRTAEFVFANVRDEHELPDAQFLPSTPGRIRFVLDYPFDDTGDYTPRHDAERIHRMRRNDVTAATVVWLPHFFSAQKSAQLGRLLKINYLLERDRLDDYAGNRSADERVKIRHQLEAQRDTLESQLTASLRQLYGIAGGDDTTIGAPVGEDGHVMSLHPGHQPRLAGGAGFQYNALALADSLFDTLYPKHPNFDPNGNRKAVTPGELRTVYDWITKAMEDGSRRVVVDRNHLALVRRIVHPLELGEVSDGPLNVSTEWRRRIEQAATQRGVTGDLRVEDIRSWITEAGYTGLDKLVVNLIIATYALLADRTWTLHGSVLRQPPELDKIGPGHALRAQRLPEAAEFATARERAAALFGVVVPDTRFARNINRLAEGVRAKVAELETPVNGVRRMLDRHADALGLAGRPDARRVVATRDAADLLAALSAAADDTDLVNRLARASYDTVDTVLATTMTAAPKLADALRDVEWSLVSSVRGFAGRGDLIGNRADALLDELAHTAEADEFTRPLAPVLTELGSKAVALVSEAARLAAVVNPGPSPEKTPEPVPEKTGERPSPPDGQAGADTVSLTDNGQPAVSRREPAPRRAPRRVRAGAAEGELAALLDGVRAEIRDYAREHPGAEIEVVWRTVGGEDSAG

SEQ ID NO: 1147 - protein, 1256 aa, Rhodococcus triatomae
MFPGATSNARTLRQTFDIPVSHGTNDYVLRLSDSVAEDQLAATVDSYVVTPAIAEAFDQALSVVEESLRTGENKAAYLNGSFGSGKSHFMAVLHGILGHSPKALSVPELQPIVAKHPKIADAKLLRLTFHFLDSATIESALFEQYLRQIGTLHPDVLPPVLHSAGGLFTDADNRRAEVGDDKFFATLNTTGGSAASTGTVNWAALGASAGTWTADTYAAATAPHADPAERSRLQQALMASYFTSYSRNTDWLSLEDGLAVIADHAQSLGYQGVVLMLDELVLWLTFLITERDKFNAEVQKITKLVETSRGRLAVPITSFIARQHDLSRWVAGGAESGATQQAVEQAFAHQAGRFGDVKLGDENLPFIAKKRLLEPVDGEAQAALDAAFARLDRNPGVWDVLLDGVNTDDQHRGSDADAFKLTYPFSPALIATLRALSGQMQRERTALKVMQQMLQDSADRLTIDHVIPVGEAFDYIIDSANSTPINDAAAQTFKTARTLWTEKLRPLLFRNAGVDEATPDADVPPGLRADIRIAKTLLMSAVAPNVPALKQIDASRLASLNHGSVVSLIPGDQVGQITNKVKQWAAEIPEVSVTSDANPIISVTLESVDYERIITRAQGEDTDGRRRELMRTLLGEHFNVVGAERTLDDAMLRTVIWRGTERPIEVVFGNVRDRGYLSDDRFRPATQGALRLIVDLPFDDPGHTIAEDHDRIEELLRTGQDRFTIAWLPNFFPDKVVRQLGRLVVLNYVLTGDRWATYANELSEGDRIAARTILEQQQSQVRGQLGNAIQVAYGTASGAKFAESQPPLRSLHAGFVAQPPIGNTLGEAVDRLIRDAFDALYPDHPDFTPADKLITRRDLNTVLTRLREAQSQSDGRIALDGGTRGDRDTARRVVEPLALAKVNETHLIFGPEQFTAWQTRITQELARLAIDEHGDVDIDVLRTAINASGPKRGLTPDVVDLIAAAWAAQTKRSWFLHSSPTPEAMIGDIRRGTTLRLEELPDRQTWSDAVRRWTMWTGQNVNDYLTAANLATFAEQVREYARSTFTGRGHFVNALGQAYSYFELSADQGRYALAADLLDLFEIRLARATNLELVAAVAGAELRGTDTEASKSLSTADQVERVLLRYPPTRWDVLKNGAAGGDARAAQAKAILTDLQKAVLAQELTQSLDSAFTTADRARDAWLEALVEVKPPVVTPPPPPKPGPDVVVLPPPAPTTPQTFTVRGANAQSIVEQQLQALIATYPDDEFTVTITRKQS

SEQ ID NO: 1148 - protein, 1293 aa, Saccharomonospora cyanea
MSTNEVYLRDVLDIPESVHAGDFKVELTGGFTATEARVAEYVVTDQLRGAFDKALGIVRAAVRDGSSHAAYLHGSFGSGKSHFLTVLHAVLNNHPAARAKPGLQPVIADHDDWLRGKKFLMVPYHLVGATDLDSAILGGYVNTVRALHPDQPTPAVYRADAMLDDARRYREARGDAAFVDWLSIGATTPAPAGSGVDDEDDDDLDLDLGPAAEGADLGDTGWTGEQLDRAFTAPAGDPVRDRLVQALLSGPMSSYVRGATGDAEAFLPLENGLAIITRHARDLGYDGLILFLDELILWLQAHMSDRQFVNNQVSKLVKLIESGDASRVLPIVSFISRQRDLSKLVGEDVTGAEVKELERQVEYLAGRFDTVSLEDRNLPAIIKERVLKPRPGGREILDAAFAGIESAKQADRDVLLDSAGATGADWQDFRDVYPLSPALLNVLVALSGALQRERTGLKLLQEMLRRRRDDMKVGELIPLGDLWDVLADGAGEAFTDRLRREAEAAQRFYAKARAWLVDRHGEHTQQFRATDRLVKTLILAALAPQVPALTRLTGGRLAALNHGSLRARTVSAGSLAVTRLRELQAEFGELRHEGDEDPVFRLQLSDLDVEPYLDAVGERDTVGARRLWLRQQLWSELGIKYTDDFVCEKEIVWKGTRRTAEFVFANVRDEHELPDAQFLPSTPGRIRFVLDYPFDDTGDYTPRHDAERIHRMRRNDVTAATVVWLPHFFSAQKSAQLGRLLKINYLLERDRLDDYAGNRSADERVKIRHQLEAQRDTLESQLTASLRQLYGIAGGDDTTIGAPVGEDGHVMSLHPGHQPRLAGGAGFQYNALALADSLFDKLYPKHPNFDPNGNRKAVTAGELRTVYDWITKAMEDGSRRVVVDRNHLALVRRIVHPLELGEVSDGPLNVSTEWRRRIEQAATQRGVTGDLRVEDIRSWITEAGYTGLDKLVVNLVIATYALLADRTWTLHGSVLRQPPELDKIGPGHALRAQRLPEAAEFATARERAAALFGVVVPDTRFARNINRLAEGVRAKVAELETPVNGVRRMLDRHADALGLAGRPDARRVVATRDAADLLAALSAATDDTDLVNRLARANYDTADTVLATTMTAAPKLADALRDVEWSLVASVRGFAGRGDLIGNRADALLDELAHTAEADEFTRRLAPVLTELGSKAVALVSEAARLAAVVNPGPAPEKAPEPVPEKTGERPSPPDGQAGADTVSLTDNGQPAVSRRESAPRRAPRRVRAGAAEGELAALLDGVRAEIRDYAREHPGAEIEVVWRTVGGEDSAG

SEQ ID NO: 1149 - protein, 1264 aa, Gordonia polyisoprenivorans
MFPGTASGPAHTLREVFDITESAGRNDYVLKLSDSVGDAQLTQTIDSYVVTPALAEAFDVALGVVDEGLRTGENKAAFLDGSFGSGKSHFMAVLYAILGHAPQALAVPELQPIIVKHSAIEQKKLLRLTFHFLGAETVESALFSQYLQQIATLHPDTAPPVLHSAGGLFTDADNRRAADGDEKFFATLNGSSASTGATVDWGKANVSVGVWNAETYAQASAADADPAARARLQQALIGTYFTSYSRNTDWLPLEDGLAVIASHAQGLGYQGVVLLLDELMLWLSFIISERERFNGEVQKLTKLVETSRGRLALPVISFVARQFDLTRWVATGTDSGATQQAAEQAIRHQAGRFANVVLGDENLPYIAHKRLLKVRDAQAQQWLDAAFAAIDRNPKVWDVLLDGVNTDDVHRGSDSAAFTLTYPFSPALIATLRSLSGVMQRERTALKVMKQMLEDNADRLTVENVIPVGEAFDYIIDSAGSTPINDAVAQSFKTARTLWFEKLRPLLFTQAGVDPDTADADVPAGLRADIRIAKTLLMSALAPNVPALKQIDASRLASLNHGSIISLVPGDQVGQIVTKVRRWAADVPEVTVSGDANPIFSVTLESVDYERIIERGRENDTDGERRKLMRELLSEYFGVAGAQQTVDGAYLRTVTWRATSRDVEVVFGNIRDHGYLSDEAFRPSREGVLRMIVDLPFDEAGHTTAEDHDRIDALMRTATDRFTICWTPAFFPEKITRQLGRLVILNYVLAGDRWASFANELAEADRPAARSILQQQQSQLRSQLGSAIQVYYGVASTAGADAALFADQPPLRSLHEGFVAQPPIGTTLGEAVDRLIADAFTALYPDHPDFTPADKLITRKELSMTLDRLREAQSDPEGRLALDRSDIQTVRRIVSPLGLAKTSETHLIFSADQFAGWRTRITQELGRAGVSTDESGAASDSEVPVEAVRTAIVTSGPRRGLTDDVIDLITGAWAAQTRRSWFLHGSAVAEPALGDFRRRGLALRIEQLPDRQVWVSAIARWTTLTGRRVNDFLTPSNVAAFAGDVRAYASERAVRRTRLARALEKAYSARHLDGGARLSTATALDGLFAPELATLNNLEIVARVADADLGGATDVQASRALGTEGAVADAVEAFTFRRLEPLLTCAGTESETEDGRDAASIVAELDDALVSHELTIPLVAALARVGQRRDAWVDRRLSQRPAVVDDPQPTPPPPPPGPRAFQMEVSDPSGFSTVERKLAELLAAHPGTTFTVTVTESTGATAAR

SEQ ID NO: 1150 - protein, 1234 aa, Amycolatopsis azurea
MAEEVYLRDVIHMPEEVNRGDFKIDLTKGFTATDELVDNYVVTDQLRGAFTQALALIRAAVRDGNSHAAYLHGSYGSGKSHFLTVLHAVLNGNKTARDKPELRKVVAEHDEWLAGRNFLMVPFHLIGSVDLDAAILGGYVKHVQDTMPGKPVPAVFRDDAMLVDAKNLREAVGDVKFAEMLGTEDAKPSDLDDLEPIEGAAPSVWTSLELDKAFGAQPGDPRRDALVSALLSGPMASYARGALGDKDAYIPLENGLSVISRHAQQLGYDGVVLFLDELILWLQGYLSRRDFVNVQVNKLVKLIESGDSDRPVPIISFVSRQRDLGTLIGSDIMGSEVSNLEQQVQYLAGRFDTISLEDRNLPAIVKERVLKPLPGKDHLLDAAFKNIESTKSNVKEALLDANGATHADWSDFRDVYPISPALLNVLVALSGALQRERTGLKLLQDMLHRRRTDMKLGDLIPLGDLWDVIAEDATAAFTDKLRTDAEAGQRFHRRVRRYLEGRYGSTTDARFIADERLVKTLLLASLAPDVPALTRLTGQRLAALNYGSITSRTAQPGDLATTRLGDLKTEFGELRSDGDENPVFSLHLSDLDIEPLLDSANDEDNTANRRKWLRSQLWEAMGVKDTGVFVSEREIVWRGTKRTAEFVFENVRDPQSMPDFQFRPSLDGVIRFVIDYPFDEPGRSPRQDAERVEELKQHGHAYPTLVWLPAFWSEQRFNQLGRLLKINHLLERGRLEAVAANRSAEDRIRLRTQLEVHKENLTSSLRGVLTQLYGLSRGDESNLIDPEGEPGRVLSMFPQHTPRLHVGAPFEYNMFELADSLLGAKYPNHPDFDPKKERKAVTVGELRTALNWITKAAEQGGRVELEKSNLALMRKIVHPLGLGEVHDGPLTLSNEWRQRIEQHAARMQVAGDYSVDDIRRWLEELDYKGLDKPVENLIISVYALLADRAWVRETIPQDAPDVGNIGPGWALRAQELPTEDEFEAARNRAGTILGVSAPAARFTRNITKLTNSVLEQVREHENAVHRLHEALHKHASELGIETSSPRVVATRAAADLLAKLFGISDSTKLIRTLAQLPDPDNDGVLARTISSAQSVLSALDAADFELLRTIQPYLDRSDGIRDRTERLMADIAETAQADEQTRQLGPMLHGFRAIALKIIQDATAAAGAPPAPPPPAPTPTPTPTPQQTRRVTADATPAKLTETMAAVQQSVSEFAKEHPGQEIEISWRVVDGKA

SEQ ID NO: 1151 - protein, 1224 aa, Marinobacter sp.
MTLIKDLIAIPEKVQRGDFVLNLSSGLAEAAISQTLEQYVVTPQLQKSFDDALSFIKSTVVDNQKRQKGAYLHGSFGSGKSHFMAVLNLLLQGNAQARAINELAPAVAKHNDWLQKTNILLVPYHMIGAASIEAGVLGGYARHIKNLHPSAPVPGFYMSDRLFRDAQQLRANIGDEVFFATLNRGATAAEDDGWGDLAEGWNAVSFGAVVKDQGSSDDKARLVGDLIGTFFTSMADMANSEFGGYVDFDEGLRIMTEHAKALGYDAIVLFLDELILWLASHLSDQRFIANNIQKVVKLVEVSEQRALPMVSLIARQRDLREFVGDQYNGAEQESLSDSLKYWDGRFHTITLEDRNLPVIAERRLLKPINAAAKAEIDDAFKSMDSSLRKEVQEILLTNTGDRDMFRQLYPFSPALVQALVALSSALQRERTALKVMLMLLVDQRDSLELGGCIPVGDLYDVIASDAEPFSDAMRLHFDNAKLLFERKLLPLVEEDHNLKLEQLDELPADNPAKRAFVNDMRLLKTLLLSALVPEVECFKQLTPNKLAALNHGTIKSPIPGREAQTVLSKCRKWAGRVGEIKISDDTNPVITIQLSGVDTESILEQAKINDTDGARRKLVKDLVFDAFGVQDDNQLFIEHSVQWRGTRRSVEVMFQNIREISDNTVFEARGDDWKMIIDFPFDQGSHSPADDKARIQNYEATGNATQTLCWLPYFFSQNAQRDLGTLVILEHVLKTNDRFNSFSNHLSPVERAQARTLLDNQRSQLRQRMRDYLMGAYGAAQAVAGSIDTSMPLDEHVFSLEPSFTPQLPVGSNLQAAFEHLLDQALAFQYPDHPQFETELKQADLAKVMEQLRRAVHATNGRIDVDSPLRSLMRCIAQPLKLGDMHERHFIFKDDWPKHMARELARDGSTGDPVMVKRLRAAIDQPSPKGLPEMVQNLLILVFAEYGQYAFSLHGADFDPTMKELPDNLVLTKQELAEPKVWQQAVDNASAIFGLVINKLRTANHQNLLEKKVLEEVKRRLEHSQNLADELRLALAKVGQPLTCNRMRNAEYACSLMQLLQSKQGAELTAALADIQPVTNANALAKSIASAASVAQAVQDNNWQLLDTAWRSSSAEAEGIKQRVCHALASDELVVALQQALRQAQTDATALITRNAQPAAPDDSAAVVRANPDTPARRVVTRAQQSGLTGPQAKVLFAEIEKELLEGYVLDVSYSIVRANGAEE

SEQ ID NO: 1152 - protein, 1273 aa, Saccharopolyspora erythraea; identical to SEQ ID NO: 798

SEQ ID NO: 1153 - protein, 1295 aa, Streptomyces turgidiscabies
MAQQQPLLRDVIDIKENISTSDFVLSLAEATTPEGAQNALKDYVVTERLLENFDEALALIKSSLDGHRSKAAYLHGSFGSGKSHFMAVLYALLSGDPAARARTEFDPVLTKHEWLTTDGKRFLLVPYHMLGAKALEQRVLGGYVTHVKKLHPDAPTPQVYRTDSLFADIRANRATYGDEAVVRGLGGGDAGDGETDEWGEGFAWTPQLLDTALAAEENHEGGTPLNLRNPSTPAELRAKLVNDAGTNLFPGFARNAIENEHGFISLDAGLSVIAEHAKSLGYDGLILFLDELILWLATLIHEQKFVAREASKITNFVEGGDARRAIPVVSFIARQRDLRELVGEEVSGAAEASIQDTLNLASGRFDKITLEDRNLPQIAHARILKPKDADAEQLVDAAFEQTKRVGTQVWDTLLGSEKGTTGADAESFRLTYPFSPAFMDTLVHISSALQRSRTGLKLMGELLADHRNEIRLGQLIPVGDLYPVISKGGDKPFTDSLKVVFEAADKLYKTKLRPYLLSSYDITEDDVEQYVNRPESITDPQRTNRCRMFVGDNRLVCTLLLSALAPSVPSLAELTIRRLGALNHGSVLAPIPGAEVGIIKNKVAEWAARFPEIKETGTDANPGVRLELSGVDVDSVIANAQVNDNPGNRVALARRLLSKELGVEHGQLSDLLGFTWRGTSRTAEIVFGNLADEDELPDHDLMPQEDGRWRIAIDLPFDEGEYGPREDAIRMQRLRERQQGERSRVVAWLPAHLSAQRFADFRRLVVIDKALADEHRFDTQYAGHLNADNRSRAKGLLETQREALLKQVRGAFKQAYGLAQKQAADVVPDFDDHLVPLPDVDGLTLSFGQSLHDGIRHVAGKLLTHQYPAHPDLDVDGTGIAVKSADTRKVFTHVRAAAEARDGRVEVPAVDRKLMQRIAGPLRLGQQKEAYFELSRYWADHFRQLASAQGSTGDLSLITLTDWTDKPDPRGLPEFLARLVVAAFAEMDDRVWVRGGTVLDPAPELSAIKDHDALRSQPRPAETDWDTARQRFETIFGAKPPALRRGRMINQFARQIVEAARTYRDHAADLVHQLEAHASFLGLDQTADSGRLALARRSLQLLDAVMAEAGKGAAGAKKTVEALASFDLGDTSADRYGTSIKQARSVAEAIASAPWSTLELAAGLGPEGAALLDSLRNVARDDQRTADLRDALARTQREVVALVKRSQAVAQPPAPVAPQPTADDLDLGRPTSDPRIPFTPPATPTPASSSSGSARTAGGRRTTVARAAADLQAELSELAARHPDATIEITWKVVE

SEQ ID NO: 1154 - protein, 1233 aa, Gemmata obscuriglobus
MTLLRELIDIPEHVRKGDFVLRLSEGVVDPAGTLGEYVVTPELVRCFDQALDFIRAAVTGRTSKATYLHGSFGSGKSHFMAVLHLILQGNAQARGIPELAPVIAKHNDWLAGKRFLLVPYHMISGAHNSMESGILGGYADFIRRTRPDAPVPGVFLAKGLFEDAQRQRRRDGDEKFFAELNAGRGNEQASGWGDLESSWDAARFEAAIDADPGSEERTRLVSDLVGTFFQSYASVAHGGREAYLSLDKGLCVLSQHARDLGFDALLLFLDELILWLATRSVDLDFVKREAAKLTTLVEAQTPDRPIPVVSFVARQRDLRKLIGDHVAGAERLNFSDSLDWQEGRFSTITLEDRNLPAIAEKRVLKPVSEAAKGELDAAFEKTAKVRDVVWNTLLANEGDKRMFRQVYPFSPALVQTLIAVSSVLQRERTALKVMRQLLVDQRDSLQVGDLVPVGDLFDTVAHGDEAFSAEMAIHFENAKRLYHQKLLPVLEKQHGRAEELEQLPWENPKRVAFRNDDRLVKTLLLAALVPGVETLRGLTAERLAALNHGTIKTPIPGREAQEVLRRVKTWAAGVGEIRVGEGQNPTITVQLTGVDTEAILAKARGEDSAGNRRRRVRQMLFEQLAIEDPDKLFFTYGFRWRNTERACELIFADKHVRDLPDTSLESEDGWRLVIDVPFGEPGHGPRDGIGRLQQFRHAHPNGTRTLVWIPNYFSQDALRDLGLLVVLEHILAGERFSGYASHLNPQDKLAARNLLENQSSELRQRVRHHLEAAYGLDALLPGSLDATQELEPHEQFQSLKSGFDPQPPAAATLRAAMEQLLDQALADDYPAHPRFEAEVRAGNLRKVYDVASQAARREDGRVEVEKTLRPLLRQIANPLLLGEMGPDATHFVLGQHWKNHFTRKISQAGGAALTVGQLRKWTDDPKPMGLPKEAANLVILVFAEQTNRTFFLHGGATDATLSNLSDALELREWKGPSEAVWDAAVRRGGSIMGVAVSPLLKSNNVSSLANQVKAKATECRPGLQLYARRLRERLTPMRLADSPRLKTAQATATLAERLAAGDGDGLVGVLATAEVATSEAAMSTCLGRAAELAVALDSFSWEILDAVSKLDGSQRAAADEVVRTVREALAADEHAVALAPTLKEAQSKAVRLLTARPPAPPAVPPPAVPPPSDPPVVVTPVPVTPKTVLRGEKAGLTLEEAQTQLDRLKEELSAGQTVTVSMAWKVESGGPGT

SEQ ID NO: 1155 - protein, 1231 aa, Rhodococcus ruber
MSILLRDVIDIPERIGADDYVLRLTDSTDDDAHIRATVEAYVLTDSLKDNFAVAISLISDAITKNTSRGAYLAGSFGSGKSHFMAVLYALLSNHPALRTERFRDLTDRYDANIAGKKILSLTYHFLGTKSMEEAIFRGYVDQIRRLHPEAPLPALHVSDTLLADAEHLREKMGDDRFLSGLGGDSADGDDAWGGLVSDTWTLERYRAGLVARAESEERKELVSALVRNYFSSFLEQAEYVDLDRGLSVISEHARELGYDAVVLFLDELILWLIFYVRNNEIFSRESQKITKLVEGSGNPRPIPLVSFISRQMDLRKWLADAGASGAEQDATDRALQYQQGRFRTIELGNDNLAEVANIRLLQPKNADAKQILDDAFRSVTRSPDVWDVLRDSMNTTEEHRGASEQEFRLTYPFSPALVATLRELASVMQRDRTALKVMQRMLVERRDTLTTADLIPVGDAFGPIVDGDEPIDGVASTLFKAADSLYHDKLLPLLLTRHQVTQEQLDTDPDSVPAGFRAHDRIAKTLLLSAIAPKVPALRDITASRLAALNHGSIKTRMKGGEARVVLGVVREWSKDVPEITVSEGTNPIIRVQLSNVDYNSVLERIRGEDNTGKRKVLIRTLVHQALGVDTKQDDLAGGATRTVIWRGSRREVDVVFGNVRDASSVPEQNFDNRPGTWRLVVDYPFDEGEFSAADDIARIDRLLAGGDRHTIVWLPKFFSDEARQDLALLVKLDWLFGGTGDRWQENTDHLSPADRAQARGILENLYRGTLNAFQRLLEQAYGIEAPDPKYFVDDPGHTEILVSLSKDFSPKLPTALNLRDAFDKVVDQAFAALYPNHPQYPSPDDEVTTRHYEIVRGFVEEAVADRQGRVPTAGAERKVAQRIAAPLKVGKATEDHFLFGEDTFAYWAGELDRAAAEADRVTVGALQHRIDAVSPAWGLRPEARDLIVAAWALLRKRAWFEAGAPVPAPPLGRMRESIELRAEELPEQAAWDAARTTATYLLGYTIPRTFLTGANVADFAQQVRARAGEKTSDLRQLVDRLADAHSALKLDVTDTDRISVARALVDYLDTLAATGGNVALIDLLATTPVPGSAESAGRMRTEAAHDAAALRGFQWKLIGALLTGAETGGERGESARVIVKKLEELITTPGVSLADEFNRTETRVVEWVVSERVDDDPDDDGDDDTSGGEVVTDPEEVLLDDIVDIECVAKRLRAAHKKHGKRLHVKWWVE

SEQ ID NO: 1156 - protein, 1231 aa, Mycobacterium xenopi
MASRAHAQNTKGRNVMTTLLRDVIDIPERVGSDDYVLRLTDSTGDDQRIAAALNEYVITDSLRDNFFAAIDLVSDALARNTSRAAYLTGSFGSGKSHFMAVLYALLGNHPAVRTSKFTDLTGRYDGALAGKKILRLTYHLLGAKSLEQAVFRGYVEQITRLHPDAPLPAVHLSDKLLADAENMRAQMADDDKFLAGLGSGSGADDEWGGLVGGGWDLPRYQAALAASPEDPERRDLVSALAGSYFKSFAETADYVDLDRGLVVISEHAKSLGYDAVVLFLDELVLWLAFSVRDTEFFARESQKITKLVESSGRNRAIPLISFISRQMDLRKWFADAGASGAEQEALDRAFHYQQGRFREIGLGDDNLAEVAHARLLAPKDDAARAVLDEAFANLTRRAEVWEVLRDSLNTDEHHRGASEAEFRLTYPFSPVLVSTLRNLSSVMQRERTALKVMQRMLVDRRDTLTVDDLIPVGDAFDYIVEGGDPIDAHAAAMFKSATELYHTRLLPSLLEKHSVSREQLDDDPASVPAGFRAHERIAKTLLLSAIAPRVPALRDITAPRLAALNHGSIRSKLAGGESRVVLGVVREWAQKDVPEISVSDAANPVIRVQLADVDYQSILERIRGEDNSGRRRVLVRRLVHEALGLSSRQDDLSGDATRTIVWRGSRREVDIVFGNVRDPGSLPEQSFDNRPGTWRVVVDYPFDEEGYTSKDDIDRIDRLLTTGDRHTVVWLPRFFTDAAMADLALLVKLDWLFTGGGERWNEYSDHLSATDRAQARGILENLRSGTMTSFQTLLKQAYGIEPADPKRITAESQQYDVLTSLSRDFQPELPPAATLGDAFTKIVDQAYTATYPNHPAFEPADEELTARHFETVRDYVEQASAHRDGRVPTNPGNDRKIVRRIAGPLRVGKATEDHFLFGEDTFAYWAHELDRAAQQAQPLTVRVLQDHIDGISPAWGLRPEARDLVICAWALLRKRAWFEAGSAITPPPLGRLRPSIELRAEELPAQQAWDDARANASKLFGYTMPRTYLTGANVAEFAAQVRAKASDAVTELGHLIDQLQPAHSRLGSTPGAGDRLTVAVALRDFVENLSTTTGNVAVIDAMAAVTLPVAIETAGQIRNDAARDARALRNFKWPLLQTLRAGADRAGEAGDSARAIQRSLQDAIAVPGRSLSDELASGEDKLVTWVVEDQPKSPAGELTVSSPQELSSLQSQLAQALSKHGKTIHVRWWVE

SEQ ID NO: 1157 - protein, 1384 aa, Micromonospora sp.
MPRRWVSWCSVGTSIRNTRRPDSCSGRSRSRCSICRCVPSSDDRHLSGIRLLLAFPVAAPATQLICGFSDEWRNCAPSVHCGYVDRTTIWPSGAVPEQTHQWVACRAPWGGFGGTPVTLLRDLIDIPTSVGEGDFVVKAAEGADLSRYVVTDQLRDNFVDALRRIGHAVTTGRSQAAFLHGSFGSGKSHFMAVLREVLAHNPEARKVRNLTGPVVAADPWLPGRKFLTLTLHMLDARSVEQAILEGYLRHVAVAHPDAPVPAVHRSDALLENAAGLRRTLGDDKFFAALGGGATAPGAAVGLAAMRASKEGFNPQRYAEAAAQPPGTKERDALVSALTQAFFSGAVHSAEYLDLDTGLAVITRHAKALGYDAIVLFLDELILWLSGRIADYTFVNTEGAKLNKLVESADAARPLPLVSFVARQRNLEDFLGPQVGGTEREALAHVMRSLQGRFGEIVLADTNLPEITEKRLLKPNDDTARAVIDNAFAAVRHNGEVWETLLLGAQYGDAGIGSDATAFRQLYPFSPALVATLVALSQALQRERTALKVMTELLVERRETLRVNDLIGVAALFDPLVLHGELPDRPKLRQQFEAARTLYLRKLRPILLTVNGIDEEKAASHTQFQLDDKLVKTILLGALVPDVPALHNLTAAKLHALNFGSISSPIPGYENTMVLNRLKRIRQDAGELHLTDDHDPVVSLKLYTVDFDKLLDLVPHNETSAGVRQQLLRELISAEMGLAGSEGSHGELQQPREWRGRRHIVQVKFGNVRDTDAMPIAALLAPGESWRIVIDYPFDPQDYPRSADRARIEELPRGSNTVFWLPLYLTDDMMSRVAQLAKINYLLGVGGAGERLNTLAADWPKADRQQGRVYLLQRQSQLRDGLITALKQAYGAASPQPSDVHDDTVGVLHTLAEGLRIGDPRGGTLADAFRNLTAELLEWSYPGTPALPVDEKPLTRGDLAKVLEYAKRAAADPTRGVSVDSQADQRVLRRICNPLQLGEMVDHRYVLAITTCHWSRHLLQEAAKEDYRDHFPVHRLRDWLDVPKRRGFDRDLQNLIIAVFALEQQLSWYDNGVKTSVGAVNGVEDRLELRHPPMPGEDAWKAALEFGQPFFGVVLPRFRTPANLADMAKDMREVARTYADSTRTLVASLEAHAVPLGLDLNAPTGRLATARRVAELLTQIAGERDDVVLVEVVAEGEDRLAGLDGQAASGVFKQAQRLTSALAGTQWPLINAVEQRAGSDPRARALLDRLRAAARDEHHGSDMVKALQEAVAAAAALLAEHNPPVPPNPPVLPDPPVVDRDSAIVTPPFVPPTGGVPSSGDPNPLAVIPVQRKPADPLLPPPAARRVTVAEERELDRLVGELRAEVTAGRRITVAWQVEESEQPS

SEQ ID NO: 1158 - protein, 1336 aa, Saccharomonospora xinjiangensis
MSTNPVYLRDVLDIPEDVHAGSFKVELTGSIKQVEARLAEYVVTDQLRDAFDKALGIVRAAVRDGSSHAAYLHGSFGSGKSHFLTVLHAVLNNHPAARAKPGLQPVIADHDDWLRGKKFLMVPYHLVGATDLDSAILGGYVSTVRALHPGKPSPPVYRADAMLDDARRSREAMGDAAFVRWLTIGSDPATGGPGAAADEDDDDLDLQLPGEDTDTGWTGERLDRAFSAPAGDPVRDQLVQDLLSGPMSSYIRGATGDADAFLPLENGLSIITKHARDLGYDGLILFLDELILWLQARMVDRQFVNTQVSKLVKLIESGDAGRVLPIVSFISRQRDLSKLVGEDVTGAEVKELERQVEYLAGRFDTVSLEDRNLPAIIKERVLTPKPGGREILDAAFASIESAKPADREVLLDAAGATGADWQDFRDVYPLSPALLNVLVALSGALQRERTGLKLLQEMLRRRRDDMKVGELIPLGDLWDVLADGVGEAFTDRLRREAEAAHRFYAKVRAWLLERHGGADNQQFRATDRLVKTLILAALAPQVPALTRLTGPRLAALNHGSLRARTVSAGSLAVKHLRELQAEFGELRHEGEEDPVFRLQLSDLDVEPYLDAVGEQDTTGARRIWTRQKLWEELGIKDSGDFVCERDIVWKGTRRTAEFVFANVRDEQELADAQFLPSTPGRIRFILDYPFDDSGDYTPRHDAQRIHRMRRSDVTAATVVWLPHFFSAQKSAQLGRLLKIQYLLERNRLDDFARTRSADERIKIRHQLEAQRDTLESQLVAALRQLYGISGGDDSTIGAPVGEDGHVLSLFPGHKPRLAGGAGFAYNVLTLADGLFDTMYPKHPNFDPNGNRKAVTSGELRTVYEWITKAMEDGSRRVVVDRNHLALVRRIVHPLELGEVTDGPLNVSVEWRRRIEQAATQHGVTGDLRIEDIREWIAELGYTGLDKLVLNLIIATYALLADRTWTLHGSVLRQPPELDRIGPGHALRAQELPGATEFATARDRAAALFGVVVPDTRFARNINRLAEEVRGKVAALEAPVNGVRRMLDRHAAALGIPDGTIASDKSTVSGESTVSGESAASDAPRIAPRIAATRDAAELLARLAAANDATDLVNRLAGATFGTRDTVLAATISAAPALLDALNAVEWSLVTSVRGFAGRGDLVGNRADAMLDELVHAATSDEFTVALGPVLGTLKDRAVALVTEAARLAAVVEPSPAPPAAATRSAEEGTGEQRADAVSLTDNGRPGVSGTAPEAAFTPASTPASNPASNPASTPAGAPAEAPAGRKARRVRASAAERDLATLLAGLREEIRDYARAHPGAEIEIEWRTVGGEDSAR

SEQ ID NO: 1159 - protein, 1229 aa, Bradyrhizobium sp.
MHELLNLPEAVRKGDFVQDLTGGISNPERTMKDYAITSKIVQTFEHALSIIGSALRDGRSQAAYLHGSFGSGKSHFMAVLDLMLADHPAPWSRGELHALRSKNDWIGKKKLLQLPIHMLGAQDMESKILGSYVAWVAKNHPDAPTPAIYADQGLFDDARDLRRRMGDEKFFEELNGGVKQAASGWGKLAEARKWDAAAFEAAAGAQYVGEADRDAQSPRAKLFSDLVRTFYKSWTAQQGRFVDLDTGLGVMSRHAKSLGFDAIVLYLDELVLWLAGNSSDLPFVGREVQKMVKLKEAQDADRAIPIVSFIARQRDLSQFLGEQAQGAVRNELSRNLSHHDGRFETVTLADSNLPAIVAHRVVRPKDRSAAEKLADDFAKTWRAAGQAQSVLIGSEGDEADFKKVYPFSPALIEALVALSDCLQRERTAIRILMELLVHHLPDLETGRVVPAGDAFDALAESEDPIDDPVMKARFDRARDLYRESFLPIIRRQHNTDNPAACQRLRENHDRRLGCSGCQQMMCRNDNRLAKTLLMAALAPEAKPFKGLTVKRLAYLNHGTIASPIPGAEMQVVAQRIRDWASQVGALRLGEQADPEVNIHLAGVDLQPILAQAAEADTAGARKNTMRRLLFQALELESDGTVAEAELSFHGTRRKGRVRYGNVREMDDTTLTCPREHEWQLIIDYPFDERGHGPDEDLRTVERYRDTRSPDAPPNPTVVWLATFFSHALDRELGDLVVLEHILDGDSRKYLGHLRVEDQPTTRADLASLRAQKESLVKRTLAQAYGLAMAKYSPHLDPSRTVDEHFIPLLSDFEIRAVLAGTMKDGYRQVVDTLLSKRYPHHPRFDGPVSASRMERVGALLEKLLDERDRRMNVEKGERNDLRAYADPLGITETGDVAVLLNERPFKEIEQQRQQGGIDTPTVSNVRGWLDPQRTRGLPTEVQDMLISLYASWSGRTFRRDSKNYPQPRPGQLPDDVELLRPDLPTPAEWSDALNRAGELFGIAIGGRSLSARNLSAFADKLKEKLRAVGDAAELPAALESKIRDWAEPENAHRLATAHASAALLQQLSHGDGASLVRDLASFTPKTSVPAMGRNFTTAAASKRLLQEDARWIVLRQVKGLVGDAERGQRAKLLLQDLATLLETDEVNKMLADGLSELTRRADELLYVPTDWGLQESPVSEEVVLESSNDLGDAKAAAKMLRELAARIEVEGKDASRVMIRLTAWKRRPE

SEQ ID NO: 1160 - protein, 1227 aa, Burkholderia thailandensis; identical to SEQ ID NO: 783

SEQ ID NO: 1161 - protein, 1234 aa, Planctomyces maris
MTLIKELIDIPERVQKGDFVLKLSEDIDRPDVVLDHYVVTPELATCFDSALSFIGNSVQNRSSKASYLHGSFGSGKSHFMAVLHLILQGNTAARSIPELAAVIQKHNAWLGGKKFLLVPYHMIGAHDMESGILGNYVDFMRRTHPEAPTPPVYLSASLIEQAQNERENYGDEPFFKRLNNDQGASSGGWGDLESVWTAESFEAAAAADPDSEPHLKLVSTLLKTVASSHAEVVSQRGGNFVRFDKGLSLMSQHAHSLGYDALILFLDELILWLATQSADLSFVRSEAAKLTNLVEAQSAERPIPLISFVARQRDLRELVGDHVPGAEKLSFSDSLDWQQGRFDTITLEDRNLPAIASKRVLRCKNDSARRELNAAFDKTARIKDNVMNILLTHEGNQEMFRQVYPFSPALVQTLIGVSSVLQRERTALKVMLQLLVDHRETLELGELIPVGDLFDVVAHGDEAFSPEMGIHFDNAKRLYHLKLLPLLEKEHNIHHEDLEDLPYNDPTRKAFRNDDRLIKTLLLSALVPNVESLRALNAEKLAALNHGTIKTPIPGKEAAEVLRRFKHWSGSVGEIRLGDESNPTITVQLSGVDTESIIEQVRREDNQGNRSRLIRQILFEQLGIQGEGQFEQFHEFTWRNTKRVCNVLFRNIRELPDSSLDNESADWKLVIDFPFDEPGHGPRDDLSTLQRFMQSHPEGSRTLCWVPSFFTADSQKDVGMLYLLDFLMTGERFSEYSSHLSPQDRQSAKTILESQRNQLRQRVKNNLDAAYGLDRHASESIDSTHDLELNEHYASLKPGFTPQPPVAANLSGAMENLLSQALEHEFPAAPLFEGEIKKSTLNKVYELILPATQTTDGRLAIDKTLRPLLRQIAVPLQLGEMGIDATHFVLGHHWKSHFSKKSAETGSEQSVTQLRKWIDDPKPMGLPKEAQNLVILIYAAQTSWTPFLHGAPFEATIANLPDACELRPISLPTENEWQRAQALAASLFGYSGSSLLSAGNVNSLSEACQSKAVETRKACQSYCQNLKQHMTDLEITAESTDRMQTAVASQILIENLSTAKPEEIVSLLAEATIVTSETAMGECISKAARLEGQLNATNWESFELLQKLPPNFHSASKQILVDLKETMMSDEHVLDLGPALNTAQARAMRLVSQAIETPPTPEGETTTAETPTDNDSPPLPTSGAAAQIIDQGTKQGLTLSAAEEILSELKARLKPAQQARVNVSWVIEEGGSQK

SEQ ID NO: 1162 - protein, 1294 aa, Streptomyces gancidicus
MAQPPLLRDVIDIKESISTSDFVLSLAEATTPEGAQHALKDYVVTERLLENFDEALALIKSALDGHRSKAAYLHGSFGSGKSHFMAVLYALLSGNPAARARTEFDPVLTRHEWLSTDGKKFLLVPYHMLGAKALEQRVLGGYVHHVKKLHPDAPTPQVYRTDSLFADIRAMRANMGDEAVIRGLGTTGADDGEEDEWGEGFAWTPQLLDTALAAEENHEAGVHLNLTNPSTPAELRAKLVNDAGTNLLPGFTKNAAEDEHGFISLDAGLSVIAEHAKSLGYDGLILFMDELILWLATLIHDQKFVAREASKITNFVEGGDARRAIPVVSFIARQRDLRELVGEEVSGAAESSIQDTLNLASGRFDKITLEDRNLPQIAHARLLKPKDDEAAKLVDAAFEQTKRVGPQVWDTLLGSEKGTTGADAESFRLTYPFSPAFMDTLVHISSALQRSRTGLKLMGQLLADHRDEIRLGQLVPVGDLYPVIAEGGDKPFTDSLKVVFEAADKLYKTKLRPYLLSSYDITEDDVEQYRNRPESLTDPKKLNGCRMFLGDNRLVCTLLLSALAPSVPALSELTIRRLGALNHGSVLAPIPGAEVGIIKNKVAEWAARFPEIKETGTDANPGVRLELSGVDVDSVIANAQVNDNPGNRVALARRLLSEELGVEHGQLSDQLHFTWRGTARTAEIVFGNVADEDELPDHDLMPQEDGRWRIAIDLPFDEGEWGPVEDVNRIQRLRERQQGERSRTVAWLPAHLSAQRFADFRRLVVIDKALADEHRFDTQYAGHLNADNRSRAKGLLETQREALLKQVKGAFKQAYGLAQKQAADVVPDFDDHLVALPDVDSLTLSFGQSLHDGIRHVAGKLLAHQYPAHPDLDPDATGTAVKPADTKKVFVHVRAAAEARDGRVEVPAADRKLMQRVAGPLRLGQQKEAYFELSRYWADHFRQLARSQGVTGDLSLITLTDWTDRPDPRGLPDFLARLVVASFAEMDDRVWVRGGTVLDPAPELSAIKDHDALRSQPLPAETDWDTARQRFETIFGAKPPALRRGRMVNQFARQIIEAARDHRDHAADLVHQLEAHASFLGLDQTADTGRLALARRSLELLDALTAEAGKGAAGAKKTVEALASFDLGETSADRYGTSIKKARAVAEAVASAPWSTLELAAGLGPEGEALLDSLRNVARDDQRTADLRDALGRTQREVVALIKRTQAAATPPPAPVAPQPSTADGQSLDTPTSDPRIPYTPQETPSSGSGGTARKSGRRSTTVRQAAADLQAELAELAARHPNATIEITWQVIE

SEQ ID NO: 1163 - protein, 1243 aa, Gordonia amicalis
MFPGSSTPARTLRETFAIPKSHGTNDYVLRLSDSVGDARLASTIDSYVVTPALADAFSAALGVVEESQRTGENKAAFLDGSFGSGKSHFMAVLYAILGRAPHALAVPELQPAVTAHAALGQAKLLRLTFHFLDARTIESALFDQYLRQITTLHPETLPPVLHSAGGLFTDADNRRAEVGDDKFFAALNGGSGTSGATIDWGKVGAASADWNAESYASATAPDAEPTERARVQQALISTYFTSYSRNTDWLPLEDGLAVIADHAKSLGYDGVVLLLDELVLWLTFLISERERFNAEVQKITKFVETSRGRLAVPIASFIARQHDLADWVAGGSDAGATQQAVEQAFAHQADRFGKVVLGDENLPFIAHKRLLQPLNSDASAALDEAFVRLDRNPQVWDVLLDGINTDDRHRGSDADAFKLTYPFSPALIATLRSLSGQMQRERTALKVMQQMLEDNADRLTIDNVIPVGEAFDYVIDSANATPINSTIAQTFKTARNLWSEKLRPTIFRNHNVPETTPDKDVPTGLRADIRIAKTLLMSAVAPNVPALKQIDASRLASLNHGSVISLIPGDQVGQITNKVKQWAAEIPELSVTSEANPIISVTLESVDYERIVNRAKGEDTDGRRRELMRELLAEHFRVQGAEHTVDNALLRTVVWRATEREVEVVFGNVRDHSYLPDEAFRPSRDGALRLIVDLPFDDPGHTTGEDHDRVEQLLRTGQDRFTVTWLPNFFSDKVNRQLGRLVILNYVLTGDRWAGYSNELSDADRAAARSILQQQQTQVRGQLNNAIQIAYGVAAGAEFPDGQPPLRSLHAGFIVQPPIGNTLGEAADRLIGDAFSALYPDHPDFTPPERLITRRDLNLTLSRLREAQSTADGRIALDRGERETVRRIVEPLGIARTSETHLLFGPEHFSAWRTRLTQELSRSAIAEDTEVPIGLLRSAISPAGSKRGLTDDVVDLVAGAWAAQTKRSWYLHSTSVDEPAIGEFRRYLTLRIEPLPERQLWLDACRRWKTLTAQGINEYLTAPNVSAFAQQVHDYAAAGRDDRARLVEALSRAYQFLEIDAGERLTAARALDELFGATLNRLDTLTLVDTLARANFGATDLEASRSLTQAGALGEAVGGFELNRLNVLRSASEADNDRGRQAAAILAALKQAFIEHELSRPLSEALRTASIARDKWLEEGVTQPSTPLPPKPEPRADPPARPDTIQLVVSSTSDYSVVEQRLTELLRNNRGTKYTVTITPEQP

SEQ ID NO: 1164 - protein, 1246 aa, Mycobacterium intracellulare
MTESALLREVISIPERAGTEDYVLKLTEGVGQGRLDATINDYVVTDDIVKAFADALDLVAAAIGDGGSRASFLSGSFGSGKSHFMAVLYALLGQNPTARARAELASVIAAHDNQLQGKKILRLAFHFLDAQSIEQCVLGGYVAQLRALHPEAPLPAVHKSDQLLHDAEKLRETMGDDAFLAGLNNANGAGSAAGSVWNKVLNEGNWTAVSYDAARAAAPGSRERQSLASALVKAYFTAFTSGAEFVDLDTGLAAMSEHAKSLGYDAIVMFLDELVLWLAFRVRDAEFFGREAQKITKFVEANNVRAVPIMTFVARQLDLRRYFAESGGGVGAEQDALDAAFRHQEGRFRTIVLGDDNLPYVAQKRLLRPVSDSARATLDEAFARIDRTPAVWDVLLDGAGADGGQRGADQAAFRRTYPFSPALVSTLRTLASAMQRDRTALKVMQQLLVDQRDHLTVSDVIPVGDTFDLVVHGNQAITADMQGRFRNAKDLYDNKLRPLLLREHKLTDVEARALPPGHAFRTDDRLVKTLVLSAVAPEVPALKEITAGRLAALNHGSIVSPLPGQEASVVLTKLRRWSAEIPEIHITSDARNPVIRLKISEVDYESVVEKARGEDSEGKRRQLIKSLVWEAFRLEQVEDDVTGVNRQNRVWRGSRREVEIVFGNVRDHTWLAEETFKAGKDTWRFVVDFPFDDQGHSVRDDDKRVDDLSQRGLVTNTVVWLPHFISAERRNDLGRLAILDWLLSGPGDRWQNMSNDLPVADRPQARSILENQRDALRERLRRVIQEAYGAAKPTPGNLDLDEGHDRVLRSLNPEFNPQAPVGHDLAAAFSNLVDQVFTTSFPGHPKFEPADSEVKTNDLQRVFEAVQEAHQDPDGRVYIEPAKREALRRIGNPLGVGHMGETHYLFGADRFPWSMKFARAMGSAGIDMNDPVTVGTLRRWIREEQPGSGLRPEVVDLVISAWAVQQGRAWYRHGSALTPAPKLGQLTDEVELRPEPLPSAEDWEAAVRRAATLLGVTCSSFLTGASVAELTSGIRDQLASHSSAARALPGTLAQAYEKLGIMADADVPGRYSTATNVATLVANVLAQRDNVAFIRTFASTSLPGTDEAAARSLLTASSVTSSLEEFNWDRLNPLLNVENQNDVRGTKAKASLDRLRSALVADELAEGISPALQRADNDAFAWLASAAAPSSSPVPGPTPAPPPQPMARGKREISTRADIAWVTADIEAFVDEHGGENVVVEWRIEP

SEQ ID NO: 1165 - protein, 1226 aa, Phaeospirillum molischianum
MTLIRDLIAIPERVHSGDFVLQLSDGLTRPEETVRDYVVTPQLKTCFDDALAFIRSAIDGRKSKACYLHGSFGSGKSHFMAVLDLLLSGNLAARSIPELAEVVVRHNEWTQARRFLMVPYHMIGATSLDAAVLGQYAEHVRKLHPEAPVPGFYIAESMFEDARNLRTTLGDNEFFDRLNEGHVATGGSGWGKIAGGQGRWDNDSFALAMLEGPGGEERQRLIGDLIRQFFRQYATVAHDFVSLDDGLSIMSKHAKSLGYDAVILFLDELILWLATRAADPAFVSNEGAKLSKLVEAANADRPIPLISFVARQRDLRELVGDTLAGSLQLQFNDVLRWWEARFAKINLEDRNLPIIANKRVLRPVSEEARATLAEACDQTLKARQDVVETLLTSTGERDMFRLVYPFSPALVQTLIAVSSVLQRERTALKLMMQLLVDRRADLELGQLIPVGDLFDVLATGDDSFSDAMSIHFENAKKLWRMKLLPILERQHDIAWDQPEPADRARNLRNDARLLKTLLLAALVPEVESLKVLNAVRLAALNHGTVKSPIAGGEGRVVLQKLRGWAAEVGEIKISDGDNPTISVQITGVDTDPIIDYGRQYDNPGNRRRKIREALFQELGLEVSGDLFATFAFTWRGTRREILIGYDNVRELSDDRLSGDSDRWTVMFDYPFDSANYSSADDLVRLSSFRERGQAAAVLVWLPSFLSQKAQDELGRLIIVEELLKGDRFNEAARHLSPTDREQARSLLQNQRSQLQQRLRTCLHAAYGIENEPRDALGSSPIDPAQQVQSLDETFQPILPVGRDLKSALEQLLGQLHEYLFPAAPRFEAEVKAAVLKKVQIEVEKALSESEHRVLVADKGMRQLLLGVAGPLKLGTMGSTHLTLDVLWRQHFSRCQAADGVETITVASLRRWIDVPERMGLPKDAQDLIILTYAGQTNRTFFLRGIPFAAGLGTLADDAELREQALPPQVQWDEAVDRASKLFGLTIPRLLNAANAHHLTEEVRKKARDSRPAIDAYAASLATRQSVFGPAASPPSDVRAPARPAGTTNRSITAKSCQALLKALDESADDALIQRLAEASLQTSDTAMAQTISRAQALDEVLRGDAWRVFEALRKLSDERASEARTILGRLAQALGADEHVVALRSSIQDDHGKAVELLTASTTAQAPSPPPPSAPQPLKGRVIEKNVVTGIKAAEVRSVLTDLADRVAREPASRLDISWTLVRDED

SEQ ID NO: 1166 - protein, 1222 aa, Nitrococcus mobilis
MTTIGDIFDIPDGVHQGDFVLRLTEGLRSDRRRQTLRQYVVTPQLVRCFDQALALIGGAVTGNSSKGAYLHGSFGSGKSHFMAVLDLILEGDADARAIPELASVVSKHNRWWQGGKFLVVPFHMIGAESMESAILGGYAAHVRQHHPDAPTPGFYRSEGLLADASRLREQMGAERFFAALAGNDAGGGWGAIGSGWDADSYAVAAKAPPEDIEHQRLVGDLVDAFFAHLRSDTGAGDYVSLDRGLAVLSRHAQSLGYTAVVLFLDELILWLASHSQDQAFLNREGQKVSKLVEAGEAGRPIPIVSFIARQRDLRELVGKAVPGAQQLAFADVLQWWEARFDKIVLEDRNLPAIIERRLLQVQGPEQKRRLHEAFEQTARVRREVLDILLTHEGDKRMFEQVYPLSPALVQALVALSSLLQRERTALKLMLQLLVSNRDSLTLGDVIPVGDLFDVIIDGDEPFTPAIKNLFDRAREVWTRKLAPLLEAEHGVSDQAIHEGTAAPEITRRYRAHAGLLKTLLLSALAPDVEALRNLTPLRLAALNHGTIRSPLPNAEATTVLAKMREWASHAGEIQISPDAANPLISLQLSGVDVEGVLENARSIDNSGNRVRTVKELLFSDIGIDTQTTTMLAPEYAWQWRGTPRRTEILLHNVRQCSDDNFRPGDDVWRVVLDYPFDEDEHCTPADDRARVDTFRERGESVRTLVWLPSFFNERAMSDLGRLGVLNHVLSGNRLEEYGAHLQPAERSEARATLKNQRDQLEQRVRDALKQAYGIAQGMDSAIHTTHSLDEHFQSLYGGLRLQPPPGGSFKQSLEHLLDQALDGQYPAHPKFEIEVKRGGLRRAWGVLEKAVDSPDGRYGMERSQRDEIRRIVQPLKLADCGEGHLALSDHWRNHIERLMAGKGVATPTVRQLREWLDEPRPMGLQDDIADLVILTWAAQTGRSFFLHNSPLPGQIGNLNRECELREQTLPPEDRWRCAVQRAAEIFGEAGSGAGRNAGNVATLAQALEAHAKERLAALRDYQRALEKRLRDWEMGSAGARALTAAASLDLAVALTEGDSSNRISALAAARIETSAAAMGTIMARAPALAQTLRSPQWDVIDLIRRRADKDTKVSAIVDTMRAALGADEHVTALEQQLGAQHRLALQSMEQPTTPTPLPPTPVTPTPKTPAPGTRQVCRNAAAIGGIREALREVEQALADDPELRADIDCRLYHPQASTESKS

SEQ ID NO: 1167 - protein, 1380 aa, Frankia sp.
MTRPSPSSQPQPLLREVIDIPERTSDSDFVLKLVEGVTDTATLSSYVVTDRLVGNFDEALGLIAQAVSTGSSKGVYLHGSFGSGKSHFMAVLHAMLRGEPAARTLDDRLTDVLGKHDAALAGKRFLLVPFHLLTSKSIEQRVLGGYADHLRVLHPQAPIPAVHRAGALLDEARSVRAKVGDATFLAELNRAGSGGPGGAGADADRATGAGADEDEDPWGDAGWTAAELDAVLAPGAPTDSEDRRLLISDLLSTWFANTFRDLREDAEGFVSLDAGLTEIARHAKDLGYDAVILFLDELILWLANNMGDQAFVSREVQKVTNFVEGGLGARPIPVVSFIARQRDLRELVGDSIAGDVRLSFLDVLTLADGRFDKIILEDRNLPLIANRRLLKPRDADAGAAIARAFDTTAKVRAEVWDTMLGGSDQLGADRDAFRLSYPFSPAFMDTLVHVSSALQRNRTALKLMRQLLVDHRDDLRLGQVVPLGDLWDVITRGADTPFTDVLKAEFDAAQKLYTRKLRPYLLDAEGLDEDTLARVRRAQATTAGGATTAGGAAVDPALATKVRRFTADDRLAKTLLLSALAPSVPALRNLTPRRLSALNHGSITSPIPGGEAGLVGKKVERWAGQFGEVKYVPVDGGDPGVGLELVDVEVDSILNSAVAYDNGGNRRTLVKRLLVEELGVTVTGDVYGDRLDLVWKGSKRSAEVIFGSIRGADLRDDQFAPVDPDAWRLVIDYPFDDAGDGPVYARARVERMRGAGAGHRTVCWIPADLTATRLADLGMLVRLDHLLTGSGHRFDSHAQHLSADDRQRARGVLKSRYDALLTKTRTVLRSAYGLTSKDEQDVTADFTDHLRALWPGLNPTLPLGASFRDALRRLVGDLLADQFPGHPDLDPDQTGTAVKPAELKIVLGYVTKAAEADGGSVEVARADRIPMRRIAPALGLGVMHEVRFELGREWVDHFTRQAAQAAAADSAGVAGGTAGGGGAEPGELLVADLLGWIDVPKVRGLADDVANLIVAAFAEQTDRAWYRHRGHLPTPPELTAITKDMALREQPLPDAADWATAVDRAQAIFGVLPPALLRGRLLRGFVDELVGKTHSRRAACQELVSVLEARATELGLDPRTGAALASTAPTAASGSGSTESLGDPEADGSAAQGRLRTARAARDLVVALDETRVATEIVRRLARADLAGPARRLAVSISRATEVATAVRAAPWDVFVVIAGLGEPYRSEADEILDALRAAAAADELTSPLATALGNARSEATALLRRATAVPVARTPPDPRPAIIQPPAEVPGTPSIDTDRIGVTGGGTGTGGGTGGGSGEGGGVGGETGTVDTDRVPVGDTGGVRTWRVRLGGLENALAELRAHAGDRPGEVEIVWRPQP

SEQ ID NO: 1168 - protein, 1224 aa, Pseudomonas stutzeri
MTLIKELIEIPEKVQRGDFVLNLSSGLADAAISQTLEQYVVTPQLQRSFDDALSFIKSTVVGNQNRQKGAYLHGSFGSGKSHFMAVLHLLLQGNSQARAINELAPAVAKHDEWLQQTNILLVPYHMIGAASIEAGVLGGYARHIKHLHPDSPVPGFYMSDRLFRDARQLRSNMGDANFFATLNKGAAAAEDDGWGDLSNGWDAASFDAVLNDQAGADDKARLVGDLIGTFYSSMADMANSEYGGYVDFDEGLRIMTEHAKALGYDALILFLDELILWLASHLSDQRFIANNIQKVVKLVEASEQRALPMASFIARQRDLREFVGDQYNGAEQQALSDSLKYWDGRFHTITLEDRNLPVIAERRLLKPINAAAKAEIDNAFAAMDAGLRSEVQEILLTNQGDRETFRSLYPFSPALVQALVALSSALQRERTALKVMLMLLVDQRETLELGGCIPVGDLYDVIASEAEPFSEVMRMHFDNARHLFERKLVPLLEEEHNLKLDQLLELPVNDPGRRAFTNDMRLIKTLLLSALVPEVECFKQLTANKLAALNHGTIKSPIPGREAQTVLQKCRKWAGRVGEIKISDDSNPVIAIQLSGVDTESILEQAKIHDNDGARRKLIKDLLFEAFSVQDDNQLFIEHPFAWRGTRRTVEVMFQNIREISDFTTFEARGDDWKVLVDFPFDQGNHSPASDRARIQEYEATGNATQTLCWLPYFFSQSAQRDLGTLVTLEHVLKSEDRFVSFSKHLSPLERAQARTLLDNQRSQLRQRIRDYLMGAFGAAQPIPGSLDDSVQLESQVYSLEPGFTPQLPVGSNLRAAFEHLLNQALSFQYPDHPEFDGEVRLADLGKVMEQLRRAVHATNGRIDIDTPLRSIMRSIAQPLKLGEMHERHFIFKDDWPKHMTRELAKDEYAGDPVTVKRLRSAIDQPTPKGLPDIVQNLLIMVFAEHGQYAFSLHGQDYEPTLKDMPDNLLLTKQDLAEPNIWKLGVDNASAIFGLTPNKLRTANHQNALEKDVQDEVKRQLGHCEELVTELRGALSRVNQGTQCNRLRNAEYAVSLLQTLQGKQGADLIAALADIQPPTNAMALAKSIVSAASVTQAIQDNNWQLLETVWKSGAAEALQIKQRVSAALTADELVTALAQALRQAQADATSQLTRNVVPPAVQNVPPADTSIKGAGGRKVLEQVQQSGLTSKQARTLFAEIESKLQDGYVLDVSYSIVRMDGAED

SEQ ID NO: 1169 - protein, 1327 aa, Dietzia cinnamea
MAFTPPGATAGSGTSPTLRDVFSIPEHSGTSTFVLQLSDAVTRDELGTTLAEYVVTPSIGDAFDEALALVDSALATGENKGAFLKGSFGSGKSHFMAVLLALLTGDPRARAIAELQQHIADHPRATSSKILALPFHFLGSNSIEDTLFSAYLEHLNRLHPGVTPPVLHMADGLLENAEQMRAEVGDERFFARLATAATGPGGVTSSSSSTPGGLDLAALGGATATNWDRDSYDRARHPAASRAERDALVSALGQTWITSAHTNTDWLHLPEGLSAIAAHAKTLGYEAVVLLLDELILWLTFHFSNREFFGREIQKLTGFVESDQGRMAVPVVSFIARQHDLKAWKDSSIEAGEATKIREQAIAHQEGRFSGIALGSANLPQIAHRRLLTPKNAAAVEALEASFQRLHLSPAVKPVLLDKVNTDDQHRGATEEQFRLTYPFSPVLIDTLVHLSTAMQRDRTALKVMESMLVDLADTMTVDQVIPVGEVFGYIIDGTQKGGTDEAVAARFRTARTLWQDKLRPAVLAQFPDADPSVRDLDQPKGVRAQLRLAKTLLLSALAPEVPGLKALTASRLAHLNHGELVSIVASDAPTRALASVREWNTSVPEITVGTDSHDPLISITLEELPFDEILERARGEDTFSRRRERLRSMLQEEFGIAAIDPQADGARSTRITWRGTNRTVEIVFGNVRDPGSVPDTLIAPVEPGALRVIVDLPFDEEGHGVAEDHARLDRLRTDGHDHFTLAWVPAFLDRKQMDDLGKLVTMDWVLQSEKWLSYTSYLADGDRERVRQVMVTQRNQLAGQLAAILRKMYGIAEGAVFPEGQPPVRSLSSSVVVQRPVGASLREAARRLYDQAFDQRYPDHPRFDTTSALTQKDFAVSLDVLRRSDAREDGRAAFVAAERKSVQLVLGGLRVADVHESHLVFPSATFASFAGQIDRALAETEKSGQTDGVLTVAQVVAAVEKLMPQAGLNRDCTTLLAAAWAESRDRSWFTYGTPVAAPAFKDIQQSHQLREPVLPEQGEWDRAVQAAQHLFGIPERGHLSPTNLTHLAGEVSSKADEFKQSSEDLVAQLSKLEQRLGRSEEGRRLQLARRQTQLLQTLVRKKQHHGEIVAALAAAGEGPGTYLGATTNEASLSITTAEEVAAVARNVTPNLGTLLSGRGRQAPLGSEAAQIVLDLSNGVDAHEFVMHLDTAVTRFEARAQDWINRVIAGGDGSGGGPGGDGSGGTGNGGTGDTGDAGETGDSGGGPGAGDNSGDDSGSGPGGGAGDTGGGPEVGAVRIEGSGPRRSFEARGSQVEAALHRALADLERSYGTGTRFRIEITAEEPRT

SEQ ID NO: 1170 - protein, 1217 aa, Eubacterium saburreum
MQIKDMFRKKIDREIQGVIIVGQGEETNVAQELEEYVVTRELQRHFADFFAAYKKGIQGTTPKMGVWISGFFGSGKSHFLKILSYLLQNKQVGDKHAIDYFIEDQKITNQMVLADMQLAANTPSDIILFNIDSKSDSNGKENKDAIVNVFLKVFNEMQGFCGSMPHLADLERRLSEEGRFEEFKEKFEEEHGDPWESSRQDFDFIQDSVVDVLSDMDFMSESAARNWCEKATEGYQISIEDFAKRVKSYIDKKGNNHHVVFLVDEIGQYIGDDSKLMLNLQTVTEEVGKECMGKAWVIVTSQQDIDSITKVKGNDFSKIQGRFDTRLSLSSANVDAVIKKRILDKTETAAQSLRLLYDQKATIIKNLIVFNDGVEKKLYANAEDFAEVYPFVPYQFNLLASVLTSIRTHGASGKHLSEGERSMLALFKESAMQLMDSEMGAIVPFYRFYDALENFLDHSHSSVLIRAYDNSYINPEKKEKDVFSINVLKTLFLIKYVLEIEANVDNIVSLMITSIDDDRISLKAQVEDALKVLMRQMLIQKNGSIYVFLTDEEQEINNEIEKENVEMPEVITKIAEMIYEDIFSGKKYQYPSFGGRYAFSFNQTVDDRPYKANQNYDIGLRVLTPWYEGGTDDGTLRLLSGQGKEVLVVLPNDDAFLTEMRAYLKIERFLRKNTSVQLAKYETIKEAKRVEMRERNGNAKLYLTEALKEATIYVNGDVLHTSGKEVTSRINEAIGRLVQTVYHKLSYIDAAMGEADIRKMFKTSNQLSLALGNTGESNVHALDDVLQFVAGNSRMHMKTSMKTIKDRFMKAPYGFVEDDIHWLVARLFKRGDLSFTVSGESVNLNNRSEEEIICYITKKQFVDKLLTEVRVRVPENQKKAVRTVMKELFKMTPPADDEDTIIKNFRYYCENRITEIERLEPKYENYAYPGKEILEKGKKRLSALVQIQAPPEFFKTVFDEQDDLMDFGEDYEPIRDFFGSEQLTIFTRALDMLNIYEDSKTYIVDAELEDVVSKMRTIVRMVKPYKEIPKLPELREKFMNCYMRILEEQAEPVKDSINQDRNRVFEVLNTKSYKDVKFNRYLELFKEIMDGVELCNNVSTLRSYADKAEALKLRLLNEMTAEDNRLAKEAAAKAEAEQRRQVEEAKKRGETVKPAEKVTEPQPEYKVRTTKNVSIKTVAKTASWRLESKEDVDKYLAALRENLLKEMDEDTIVNIEL

SEQ ID NO: 1171 - protein, 1229 aa, Vibrio cholerae; identical to SEQ ID NO: 729

SEQ ID NO: 1172 - protein, 1222 aa, Eubacterium saburreum
MEETVMQIKDMFRKKIDREIQGVIIVGQGEETNVAQELEEYVVTRELQRHFADFFAAYKKGIQGTTPKMGVWISGFFGSGKSHFLKILSYLLQNKQVGDKHAIDYFIEDQKITNQMVLADMQLAANTPSDIILFNIDSKSDSNGKENKDAIVNVFLKVFNEMQGFCGSMPHLADLERRLSEEGRFEEFKEKFEEEHGDPWESSRQDFDFIQDSVVDVLSDMDFMSESAARNWCEKATEGYQISIEDFAKRVKSYIDKKGNNHHVVFLVDEIGQYIGDDSKLMLNLQTVTEELGKECMGKAWVIVTSQQDIDSITKVKGNDFSKIQGRFDTRLSLSSANVDAVIKKRILDKTETAAQSLRLLYDQKATIIKNLIVFNDGVEKKLYANAEDFAEVYPFVPYQFNLLASVLTSIRTHGASGKHLSEGERSMLALFKESAMQLMDDEMGAIVPFYRFYDALENFLDHSHSSVIIRAYDNSYINPEKKEKDVFAINVLKTLFLIKYVLEIEASVDNIVSLMITSIDDDRISLKAQVEDALKVLMRQMLIQKNGSIYVFLTDEEQEINNEIEKENVEMPEVITKIAEMIYEDIFSSKKYHYPSFGGRYAFSFNQTVDDRPYKANQNYDIGLRVLTPWYEGGTDDGTLCLLSGQGKEVLVVLPNDDAFLTEMRAYLKIERFLRKNTSVQLAKYETIKEAKRVEMRERNGNAKLYLTEALKEATIYVNGDVLHTSGKEVTSRINEAIGRLVQTVYHKLSYIDAAMGEADIRKMFKTSNQLSLALGDTGESNVHALDDVLQFVASNSRMHMKTSMKTIKDRFMKAPYGFVEDDIHWLVARLFKRGDLSFAVSGESVNLNNRSEEEIIGYITKKQFVDKLLTEVRVRVPENQKKAVRTVMKELFKMTPPADDEDTIMKNFQHYCENRITEIERLEPKYENYAYPGKELLEKGKKRIFALVQIQAPLEFFKTVFDEQDDLMDFGEDYEPILNFFDSEQLPIFTRALDMLNIYEDSKTYIVDAELEDVVAKMRTIVRMAKPYKEIPKLPELREKFMNCYMRILEEQAEPVKDSIGQDRNRVFEVLNTKPYKDTKFNRYLELFKEIMDGAENCNNVSTLRSFADKAEALKLRLLNEMTAEDNRLAKEAAAKAEAEQRRQEEEAKKRGETVKPAEKVAEPQPVYKVRTTKNVSIKTVAKTASWRLESKDDVDKYLAALRENLLKEMDEDTIVNIEL

SEQ ID NO: 1173 - protein, 1217 aa, Stomatobaculum longum
MQIKDMFRKKIDREIQGVIIVGQGEETNVAQELEEYVVTRELQRHFADFFAAYKKGIQGTTPKMGVWISGFFGSGKSHFLKILSYLLQNKQVGDRHAIDYFIADRKISDQMVLADMQLAANTLSDVILFNIDSKSDSNGKENKDAIVNVFLKVFNEMQGFCGSMPHLADLERRLSEEGRFEEFREKFEEEYGNPWESSRQDFDFIQDSVVDVLSDMNFMSESVARNWCEKATESYRISIEDFAKRVKSYIEKKGNNHHVVFLVDEIGQYIGDDSKLMLNLQTVTEELGKECMGKAWVIVTSQQDIDSVTKVKGNDFSKIQGRFDTRLSLSSANVDAVIKKRILDKTETAAQSLRLLYDQKATVIKNLIVFNDGVEKKLYANAEDFAEVYPFVPYQFNLLASVLTSIRTHGASGKHLSEGERSMLALFKESAMQLMDSETGAIVPFYRFYDALENFLDHSHSSVIIRAYDNSFVNPERKEKDVFAINVLKTLFLIKYVPEIQANVDNITSLMIAGIDDDRISLKAQVEDALKVLMRQMLIQKNGSVYVFLTDEEQEINNEIEKENVEMPEVITKIAEMIYEDIFSGKKYQYPSFGGRYAFSFNQTVDDRPYKANQSYDIGLRVLTPWYEGGTDDGTLRLLSGQGKEVLVVLPNDDAFLTEMRAYLKIERFLRKNTSVQLAKYETIKEAKRVEMRERNGNAKLYLTEALKEATIYVNGDVLHTSAKEVTGRINEAIGRLVQTVYHKLSYIDAAMGEADIRKLFKTGNQMSLTLGNAGEPNVHALDDVLQFVAGNSRVHMKTSMKTIKDRFMKAPYGFVEDDIHWLVARLFQRGDLSFTVSGESVNRNNRSEEEIIGYITKKQFVDKLLTEVRIRVPENRKKAVRTVMKELFRETASADDEDTVMKRFQHDCEKRISEIVPLEAKYENYAYPGKEILKNGKKRLSALMRIQAPLEFFKTVFDEQDELMDFGEDYEPVRNFFDGEQLPIFTRVLDMLNIYEDSKTYIVDAELEDVVAKMRTIVRMAKPYQEIPKLPELLEQFTYCYNRILDNKAEPVKDSIHQDQSRVFEVLNTKPYKDAKINRYLELFGEIMDGAERCNNVSTLRSFADKAEALKLRLLDEMTAEDNRLAAEAAAKAEAEQRRREEEAKKRGETVKPAEKVAEPQPEYKVRTTKNISIKTVARTASWRLESREDIDKYLSVLRENLLKEMDEDTIINIEL

SEQ ID NO: 1174 - protein, 1180 aa, Stomatobaculum longum
MIIRDMFYDDINRKVNGVIKVDQDETGVISQEVREYVITKELKKHFISFFNYYGDSFTTPTSDMGVWISGFFGSGKSHFLKMLSYLLENKEIDSVKTVERFREKFADDPATFMLIDNATRYETETILFNIDIEGSINKDKTAVLRVFAKMFYNHLGFYGENLKVAMLEKYIDQSGKTEEFRRIFEEKKGKPWVEQRKAFAFNGKFIVPTLMEVLGMSEADAQNWFSDKSAVDFSIAQLVDDIKAYIASKPKNFRLLFMVDEAGQYVGTDTDMLLNLQSLTEKIGSECGSSVWVICTGQEAIDEIIKVRADEFSRIQARFKTRLSLTSSSVDEVIQKRILKKKPEVTPKLEALYNENDSVLRNLFSFTDSILDIKGFSGSQEFAEDYPFVPYQFIIMQKVFGEIRKHGSVGKHFSGGERSMLSGFQEAAQKVQNHDEYTLVPFFHFYDTVHSFLDGSIRRVIERCQKAAESGAGIEAYDVGVLKLLYLIRYVDDIKSNLDNIVILMADDIRTDKITLREFVRKSLDRLLSQNYIGRTGDTYNFLTDEEQDVQREIKNTPVDTAAIVERIAQIVYGDIYTSKKFRYGKYDFSFDQMVDGVTVGAVTGGMKLRFLTVATDAIEKSDMRLMTESSGQAIVVLGDTPYYESLENAMKIRKYVKQRNVAQLPKSVQDIIRDQQDEANAYDLTAMDALRKAIESAEFFVDGERLTFKGGDAKSKIEQALEYLVAHVYSELDLITQNAESDEDIVRILTGGGQQRLDGMRHNQSAAARVEEYLEMQAKKILPTSMADIQSRYQAIPYGWREIDVAAVIAMLIYDQKVTVKYAGNTIQPRDSKLPDMLRKKSEIGKTMVSQRQSVTVANLKEAKEFLRDYFDVMNVPDDEDGMIDFIINKFTEQKTHYEDLLKGYEGKKYPDKALVQDAVGLMKDVLSQRKDNVALVSAVIKKENALYDNKDAMQNVEAFFKSQVQVFDAASKMLTDLQNELDYLSHEEEANRALNRIRLLVMVQTKFNYKCIPELNTLMATVREGHNRLLATKREELLEIVRQCLEAIHTAAGDNVAARDISAAADTFYTEKQQRINELESLALLDGLIPPMLQQQNTTCSRIEALTKPAPKPVTPPHTGGVAETPKPYAKKIIKTYNRQIVFPTKRLETEADVDAYVEMVRGQLKTLMKNCDGIELK

SEQ ID NO: 1175 - protein, 1213 aa, Salmonella enterica; identical to SEQ ID NO: 703

SEQ ID NO: 1176 - DNA, 2181 bp, Thermomicrobium roseum
atgcgcgaggtatggttcgaccaggacggactgtgcccaccgcgaccgggtaccgtgtcgatcagcgacgacgtctcgtttctcgaagagatcgataccgatcgcccgctcttgatccggggtcgacagcgctgcgagtgggcacgagcgcttgccgacgcacgaaactggcgagtgcacgaagtgcaaccgctcagggaggaacttctcacactctgctcaagcttgaccacggaacaagcagaggaaattgcccagcgtctgggccagcgcttttgggatctcccgcgtcctctaacgctcgctggggtagcggaagcgcttttcggaggagtattttggagacatgaaccgagcgaagagcatgcaagcgcttggctgacatggctggtcgagcgggctccgacaggggtcgatgcggtcctggcacgtgctctcgctggactgtggcaagggaggtcggacggcattaccgagtattgttaccgagtgacgacccgcgaggaggcgatacctatcatcgctgaaaggctgggtctccagccgtcggctttcccccgcgaggaatgggagaagttcccgctggaactacgggaaagcgtggtgcaagcgatagaagaatgggtccggaagcaattgatcgcatcgaacggtgcggcagtcgacaattggatcgcggctggagtatcgccgcgggtttggtctcgaatcggaaaccaggtttctcagtacttcaagcaaaatccccagtacttaacgctcgagcgactcgacgccctgcgaccgtatctttccagtttcgaactggagcggttggctagcttgtgccccagaccggatccgggattgccacctgaggggttcgaggcagtttgtcagtggtttcgggaccgctatctgccgtggcgagagtggactctgtccagcggggatgaggctgcgctggagcgcgcccgtgagatcggtcggcgcttcgcaacctggtgtctggaacagtacccgaagctcggggtcagtccacaggcagggcagctgttcggctgggcacgagtgaacgaattgagaacgcagccggacgacgcaaccgtcacgctcttggtcatcctcgacggctgcagcgtgagtgacgcagtatcgctgcttcgacatgtgcaagcagagaccgaccgcttcaccgttacccggaacgatgtcgtactcacgtcggtacccactgtgacccagttcaccaagcctgcactgcttgagggagtacccccagaccaaatcaggcaagcagatccagacgagacttcgtcacgtctgagagaagtgattgcagccctcgagcgggcagctccgggagcagttgtcacctggcggctcagcgagcccgacgcgagttaccaccgggcgcggactcgggaagacgccaacaacgaggtggatctacggctacggagcattgctagagccttgcgccaaattgctgacgaggtgccagctgccagacggctgcgcgtcgtcctgacgacagatcacggtcgtttgctcggcaaggcacggcgtaccctcaccgtaccaccaggctggcacacgcatgggcgagcagcgtggggaccagcgactggtcaaaggatcaacaccggttttcggatcgaggagagaaccgcgctgctcgatgccgccgcatacgatcttccagccgagtatgcctaccgaattgccttgactgatgaggctttcgtcaccagcgatgggcgcggtggcgaggaatggtttccgcacggtggcctctttccggaagaagtgctcgtgccgtggatcgaactcgagcgcgatctcgcggtgccatcaccagtcgtcgcgatcaagggtgatgggcgcgcgtacgggagcggtacactggtagtgatggtgacgaacgaagcgagtattcctctccagttgctcaaactcgaattggagttccggcagaggagagatatcgtctcaatcacagaaacgattggcccgctttcgcaggtgacgatcacgcgtcagatcgagtcgtggccaacgccgcaagactgtcgagaggcacgggttcgattgacgtatcgattgccgagcggcgcccaccccaccatccaggtcgagaagatcgagctgacgagcaggacactctacgatcagaccaacatcttggaggacttgcaatga

SEQ ID NO: 1177 - DNA, 1950 bp, Pelotomaculum thermopropionicum
atgaactggcgtgaccacattcttaaaaacttacagccaggcgtatcaaggcttactttagcggctgaccccgacggcttgctcctggaagaagatgttctctcggccctaagggaaatggggtttgatgtccttgtttttagtgattccatcacctttcgttatgcgtatgaagcaaactatcgctccaggtgggatcggggcgaagcggtacatttggcagtggtggtacagggcggcccgcaggaattgcgccgcctccccttcgacgtatggcgaaaggggcataagtttttcttcagcctggccgatatctttcccaaactcagctatccggtagttgcggccatggaaaagtcggacctggataagctttacagggcataccaggattacaatggtcctgcgctgggggagaaggcgaccaaggatttcatcttaaaacgcgtttttggcataatacccgaccttatcaattcaccggtcgagctgatgaagatgctgctttcgcggcattgcagctatgtgactgtgccctcgattctggacgaacaccttatccattgtttaagagaaaagagcgtttttaaggactggccgctggaagacatcatccccagcagggaagccttttttgcttttctgcaagaaaaatggcgtcgcttcctggaaagcacggccagaggagagaatttcaccgaggtcccctttgagcattatgacatacgggtgtacatcgacaacctgttcttggaaggcagtttaaggcctgttccggttgcgagtatggaaggtatgcccgcctgggtcctggcaggtgtactcttcgataaacaggctgaggaaaggcgcaggattaaatggctgctagagaagatacgacaagatttgcctggagaaacagcgtcccacagggattggcagcgcctggctgttctgtgggcagaattgcttgtgcttagcggggaactcaatcaggacgtaaaaactgaaactaaaccgcaaattgaggaattgcacgatcaattggaagagcgctttgcgagctggatgctcgtgcgctacggttctttggccaacctttcttacacgtccaaaccggtaatgttgcatcacataccccgttatctggctcatctgcgtgctaaagggatggcaaaaaacattgctctgctcgtaattgacggcctggcgttagatcaatggctggttatccgcaatttcctgagagacaggtgcccggcgtggcgattcgaggaaaaccaggtctttgcctgggtaccgaccttgacttccatctcacggcaggcgctgtttgctgcagagccgcccctgtatttcaaggacactctgacgacaacctcgaaagaaggacagcactggcataaattctgggaagacagtggggtcaggaggggaaatacctactaccgtaaaggtttgggtgacgagctggcaagtgaaatcggagaatttttaggatcacagttcgagatcgtgggtctggttatagataaagtggacagaatcatgcacggcatggagctgggatcagcaggcatgcaccggcaaatcagactatgggccgaacagggttacctgatacagctgattgatcatctccttaaaaacaaatttgccgtgtatctgacttcggatcacggtaatattgcggccagggggatgggccgtttgccggacggggtcctggctgagtcccgcggtgagcgggccagaatttatcattacgaagtttttcgacagcagatgatggaagaaagagaaaacgtcatccgttggcctggttttggtttaccccagggttactccgttctgctggccaggggccggtcagcctttatttctgagggtgaagaagttgtaagccatggtgggatatctttggaagaggttgtcgttccttttgtcaggatttgggaggagcattga

SEQ ID NO: 1178 - DNA, 2199 bp, Halorubrum lacusprofundi
atgcctgcaaccaagaccctcccccagtgcgctcacgacaccatcgagagtgccatcgacgaggcggccgacgacgacccagtcatcctctggtgggacgacggtggctacctccgagatatcgtcgaacacgcgagcacacaactccgctgtgagttccgagcagccgagcagacacccttagaactccgtgcagacgcgccacgcgaccgaaccgtctggtacgttccccagcccagtagcgacgacgtagactggttcaaggacgtcgagcacaccggaggagttgtcgagcagcacatcggcaaactcgccgcccgctgcttcgaaaacgaccgcctccaggccgcgacgattcgcacagcctacgaggacgccgcggagcagagctccgcgagtccccactcgcacgctcgcggggacgccgacgcccgcgagaaggtcgcccagacgctctacgaggaactcgatggcgagggcggcctgccgtcgctccagggcctccagacgaagatcgtgctgaacggccacgacgaccccgtgcagttcgtcctcgaacatggaacacgaaacctccccgatggcgagggcctgctgaagatccgtgacctgctcgtcgacgatggcgtcacggccgtcgagggtgagtccgacgctcggaccatcgtcgaacgaacacgccgctgggcggtcgctgagtggttcgtcgacgaaggactggacaaggccctgctcccgcaggagtaccagccagaaccgagcacagggttcggtgtctccaggcccgaactccggtcgatgctgagcaagaccgaacgaaaaggcgagctggcgaacgtctatctcgaccccgaccagcggttctggcacgacgtcctccgcagctacgacgacccatgggaactcgtcgactgtcccgtcgacgcctcgcttgaacaccgcctctgggacgagtggacccagtcgttcaacgccggcgagtacgagacgtgcgcgtcgcaggcgacacagcgacacgaccgcctcgacgcgacgtatggcgacgttccctggacacaggtctgggaacaggcaatcgacgtcgcgacgctcgcagccgagctggagacctgggaggagcgcggcgacactagcgacgtcgtcgatctctacggcgacgtcgaggacggtacttggcagattgacaacgccgtcttcaacctcatcatctccggcgagccggaggccgggcttcctgaggagcacccagctacggcgacactcgataggctccgttcctcgttgaccgaatcgcgatatctcgagtacctcactgacctcggcgacctcgtcgtcgaccagatcgaagcgggctcgcccttcgtcggcgagaaacacgcccaccagttcttcgccgaggaacaggaacacctccagagcggccagagtgttgcgctgttcatcgtcgacgcgctgcgcttcgacctcgctcacgaactcgccgactcgatccgtcgcgagcttccccagctcgaagtcgacgagagcacgtgggtcgggacccttccctccgataccgaattcggaaaggccgcgctcacgcccggtagcaagttcagcttcaatatcgaactccaggacggggagctcgtccccgagcgcagcgaccgcaaaatcacgaaccaccgtcgccagacactcctcgagaacgacggctggagctacatcatgcaggacgccgaggacgaggtaggctggagcaacacccgcgtcgcctactactggaacgacatcgacgaaaccggagagaaggagctgacggacttcgaggagttgttcagtgaccgcatcgaagcgatctcacgcattatctgcgagaagttacggaaaggcgagtgggaccgagcgtacatcctctcggaccacggcttcgtctcgcttcccaagcacgtcgacatcgacgacctccatccgccggataacgccgaacaggtgacccgacggtgggttgccggaacaggtctcgatgacgacgcaccaggcgtgttgctcgacgaggatacccacctgggctacctcgacgatgatgcgagggtcagtatcctcgccgatccaatccagcggttccggaaccagggactcccggatgcccggttctaccacggtggcattctcccgcaggagttcgtgctgaacttcgtcaccatcacgcaggaataa

SEQ ID NO: 1179 - DNA, 2193 bp, Halopiger xanaduensis
atgcaagcaagcaaatcccttccagacgccgcgaaaagcaccatccgaagcaagttcgaccgcgccgagtcgtcagatccgatcatcctctggtgggacgacgggaactatctcgaggacatcatcgagcaggcctgtaacgaactcggcgttgagctgaaagtcgccgacgaaaccccgctggaactccgtgccaatccggtcgacggtgaacaggtctggtacgtcccacacgtcaaagatcccgaagacgccgagggggagtacgactggttccgcgacgttgagcacacgggcggcgaggtggagatgagcatcgaagacctcaccgtccacgcgttcgagcgcggacaactcgatgcgtgggagctgaaaaccgcgacgcaggcggacgaccccgcgaagcgtcgcgagatcgcgcggattctccacgaccagctcaccggtgggcagctcccgacgctcgaacagctccgcacgcagatcgtcaccggcggctacaccgacccggtcgcgttcgtgctggagaacggctggggcgacatcgacgacagccccgacactatcgagcagatgcaggacttgctcaccagcgagggcgtcgacgcggtcgccagcgaggacgaacccgtggggatcgtcgcggcgacgcgtcggtgggcagtcgccgagtggctgatccacgccggcgccgacgccgaacgcttcccgagggagttccgcgccgagacggccggcgaccacgacctccccgagctcaagtcgcttctaaacaacaccacctcggccagcctcctcgccgaccgctacctcggcgaggcgatctggcccgaggtcgtcgcggacgtcgacgacccgtgggaactcgcggactgtatcgtcgacgccgcgctcgagcgtcgcctctgggaggagtggcacgcgtccttcgacgccggcgactacgagacgtgtctcgagcgcgccgaggagcggtacgacgccctccttggcagcgaagacttccgtggcacctaccgaggagcctacggcccggacagcccgtggacgcagacttgggaacaggccgcggagatcgctcggctcgcgcaccagctcgagacgtgggacgagagcgcgcctgacgacgtcgtctcgctgtacgccgaccccgacgacggcacgtggcagatcgacaacgcggtgctcaacctcgttgtcgccggcgagcccgagtccgatctcccagacgatcatcccgcgaccgccgcgctcgacgacctccgcacccaactccagtcggaatacgtcgagtacctcgaagacctcggcgacctcgtcacggagaccgtcgaagctggcgctccgttcgtcgaggaggatcactcctaccagttcttcacgaaggagtccgacggtctcgaaagcggccagacggtcgcgctgttcgtcatcgacgcccttcgactcgatctcgctcgccggctcgcggacgagttgcgcgactacgtggcgacactcccggccgacgcccccgagtttgccatcgacgaagacgtctggctcggaacgcttccttcggagactgagttcgggaaggctgcgctcacgccgggggagatccagatgttcgacgtctcgctggtcgacggcgagttacagccgcttcgaaacaaccgtcgggtgacgaccaaccgccgcgagtcgctgttgggcggcgacggctggacggtcactcgcgaggaggacgacggctggcagtcgacgcgtgtcgcctacttcaagaacgacatcgacgacatcggcgagaaggaactcagcgacctcgaggcgatgctggcccgacgcgtcgactcgctcgcggagttcatcggcacgaaactcgaacagggcgagtgggatcaggcctacgtgctgaccgaccacgggttcgtcctgctcccggacaacgcgtcgccggagaaaatttcgcgcccggcggaagcatctgactccgggcgccgatggatcgctggggaaaatgtggacgaggattcgcccggcgtgttgctcgactccagctcacgactgggctatctcgatgccaacgtcagcgtccttgccagcccactcaagcggttcagaaagcaggggctcggtgacgctcggttctaccacggcggactgctcccacaggagttcgtgcttgacttcatcagcatcacgcagggctaa

SEQ ID NO: 1180 - DNA, 2604 bp, Salmonella enterica
gtgaccttgcaaaatcaggaatttattgccggccttaaagcaaaattcgccgaacatcgcatcgttttctggcacgatcccgataagcgtttcctcgaagagctggataacctcgaactcgaaaacgtcacgctgcttgatatgaccgaccagtcgcagctggcggttaaaaagcgcattgaaatcgacgagccggaacagcagtttttgctgtggttcccccacgatgcccccccaaaagagttcgactggctattggatattcgtctttatagtacggagttccacgccgatttcgccgccattacgctgaatacattaggtattccacagcttggcctacgcgagcacattcaacgccggaaggcatttttcagcactaaacgtctttctgccttgaaaggcctggtcactgagcaagaaaacgaagcttctcttgataagaagatggttgcggtcatcgctggcgtaaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccgtcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccatcattcatgcgctggtgacgcagcttctggaagagagcaccacgctagaccgtgaagcctttaagaagcttctgtctgaacgtcagagcaaatactggtgccagacgcgtcaggaatactgcgctatttacgatgcactgcgtcaggccgaacggttgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaagcctggatgactatatcgaagcgctgtattccaactggtacctggcagaattaagccggagctggaataaggttctggaaaccgaaaaccgtatgcaggagtggcgtattgcgggcgtaccacggcagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgccgaactgcgttcccagttgggcgtgttacccagctatacccagctgggaatggcggcattgctgccccatgacgagatatgctaccaaccgggtagtggtgacatcgtttatgcggacgggttatccacctcaggtacgcctaaccgcgataccattctgaagaaatataaagggatggcagtaaaatcggacgatctgctgaaatggaaaaatcagcaaggacgagatcttattcgcgattacgaagtcgtttatatctggcataacaccattgatgccatgggtgacagcgcatcgacggaggagaagaccttcgaagcgtgccgtaacgcggtggttgaactgaaggatttagtgactcgtgtaataaaccgtctccacggtacacggattatcgtcacggcggaccacggtttcctgttccagcagcagcccctttccggccaggataaaaccacgctgcagatcaagccagacaatacgattaaaaaccacaaacgctttattatcggtcatcagcttcctgccgatgatttttgctggaaaggaaaagtggcggataccgcaggcgtcagcgataacagcgagttcctgatcccgaaagggatccagcgtttccatttctcgggcggcgcgcggtttgtccatggtggcgccatgctacaggaagtctgcgttcccgtattgcaggtgaaagcactgcagaaaacggctgccgagaagcaacctcagcgtcgtccggtagacatcgtcaagcatcatccgctgatcaaactcgtcaataacattgataaagtcagcctgctgcaaacccatccggtaggtgagttatacgaaccacgtactctgaacatcttcatcgtcgataacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1181 - DNA, 2601 bp, Photorhabdus asymbiotica
atgcaacatgcagatttacttcgcaggcttatggaccactttatccatcaccgtatcgtgttttggtacgatccgaagcaacattttagtgaagtattgcctaagcttgaactggacggtatctctgtgctgaatatgcacggtgcctcattattggcaacgaagaaactgatcgaacttgatcaaccagaacaaaagttcttactgtattttgcacgggagcgtcccgctcgtgagttagattggttgctggacattcgtctctacagcagtgagttccatgctgatcatgcagcgatgatccttagcgatttaaagatccctcaatcaggactacgtgaatatattcaacgtcgccaggatttcttttcagtgaatacacgtattcagacgttaaaaagctggatcacggaagatgaatctgaagactcgttggataaaaaaatgctagcagtagtcgttggtgctaagtcattcgaaacgaaagaaattctctttagcctgttacagcaatatgtcggccaacataaggatgaagaagatagcgcgcttgagaacacgttagcagtgatggagcatttgcaattagcgccggtactttggtggctgctagaacaagaaatgagctaccagagtgaaaagccattgctggatgattttatccttaaattgttttgtaccgatctttggttacaaggtgacaaagcgcatcgagattggctcagcaataatgtactgcccacggcagcgggcaaggcttcggctttagcgttcatggttggttggcgcgctgatcgccgttttagtgaagattatgattttattgcgggtcagctagccggaaaatttgatctgactgagcattatcgccatagctctccctatgcgctacaagagtgtgaaacctttgaagctatcgaacaatttattattaaggctttggttacgcagttactggaagagagcaccaccttggatcgcgtgatgtttaaaaatttgctgtcacagcgtttggcggcccattggtgccaaactcggccagagtatcatgcgatttatgaagctctgcggcatgcggaacgtttgctaaatttacgtaatcaccacattgatggttttaaatatcctgactcttcatctctatggcaggcatataccacagagatttaccgttttgatcaagcctatcgcctcttcaatgagcaagcgatgttggttcatcgcaaaggtgcggatattttgcgagacctcgacggacatatcgaggcgctctataccaactggtatttggctgagttaagtcgcgaatggaaccgactactggatggtgagcaaagaatccatagctgggaattcagcgggataccattacagcggaacttctatagtgacgttgtgaagcgtgaattgagtacttctcaggtcaaacgcgtgtttgtgattatctctgatgctttacgttatgaagttgctcaagaattggctagtctgattaagcgcgaaaaacgctttagcgccgagttgcgttctcaaacaagcgtgttgccaagttatactcaattaggcatggcagcgctgttaccacacaaagaactgagttatttgcctgataactcaggtgttgtttatgccgatggacagtcgacgcagggtattgcccatcgtgatgcaattttacgaaaagttaatggcatggcggtcagtgctaacgaattatttaattggaataatagcgaaggtcgcgacaaaatccgtaatgctgaagtagtttatatctggcatgacactattgacgcgattggtgataaaggggcgacagaagaaaaaacctttgaagcctgccgaaaagcgatcaatgaattaaaagatttagttgctcgcgtgattaaccgcttgaatgctacccgtgtttatattactgccgatcacggtttcttattccagcagcaaccgctatctgaaacagataaaactaaacttcagatcaagcctgaaaacacaattgaggcaaagaaacgctttatcattggccatcagttgccagacgacgcgttctgttggcatggtagattatctgatacggcaggtagtcgtgataacagcgaatttttattgcctaaggggatacagcgttttcattttaccggtggggcacgctttgctcacggcggagcgatgctgcaagagatttgtgtacccatattacaggtgaaaatcttgcaaaaaacgcgggtggaaaggcgacaacagcgactagtgggggtcgtggcgaaaagccaaaatattaaattagtcagcaatattgacaaagtcagttttattcagactgagccagttaacgaacaatatcgtgcacgccagctcactatctatattgttgattcagaaaaccatgtcgtctcagccaaagaaacggtgaattttgatagtgataatcatggtatggagcagcgtgtgcgagatgttacgctgaaacttacgggtaagcggtttgaccgccgacatagttatacgttagttctggaagacagcgaaacccgaacgtattttagccgttatgcggtgactattgatctggccattcaggatgatttcttttag

SEQ ID NO: 1182 - DNA, 2520 bp, Clostridium sticklandii
atggcagaacttaatttaaaacaaataactgacaagttaagctcagagttttcttctgatgttcgtaggcttatattttggtacgatgccagaggagattttgctttagatatagatagtatggagcttgaaaatgcaaagattataaagctagagcctgacaaccagttttatatcaagtatctactagaaagacaagatactagtacaaattacttgatttatgctccatttgcaaagcctagccttcgggataatcatttggcagatactataaagtattcaaaggagttttttgctgatagagcttcacttcttgcagtggatttggggatagatgaaaaatacaagcaggtactacaaaaatatatcaagttttttgcatcaaaagacagaactcaaaagttctatgatttagagatagaaagatttaatcaaagaatcatagaaacagctcttatgagcgtactatgtaagagcaaggtagtttcttttgaagaggtagtaagaactgtaattactgctagggatttggaagataatagatatttacaggagtttgaaaagtatgatttgctcagtgctttctggcagatgtgcgaggagacttttggaggcaatttttcttcgccttctcttgtaaagctagtcaatactatgtttactacctatacttcaaaggtagtcatgagcgagctaccatctgcatggagaaattactgctctcataaatcaggcaatatcattgcttttctagatagtctgatgaatagcatgatttatcgtggggattttgatggtttgtctgatatggtatatagcactctagatggcgaaactgtgctaagtagtgtagatgtatctcagctgatagagctagagattttcaaaaaaaccgatgtttttattttgaagtggatgatagatagattagagcatgatgacctagatgctaggctaaatgactattctatagttgatatatgcaagaaaagaagaaaaatgcattttaagcatgtgtttagctcacattattatatattagaaaatgcttactatttactgaaagaagctagatacaagccagcagaagaactagaagaaataactaaaaactatattacaaaggactatatcatagaccagaagtatcgctatttctattatcattatgataatgtgccagacagctctatttatgaaaatctaagagagctagttgaaaatgtatatacaaatagattcctaaatcctctagctgtagcatttagcagggctttatgtgaaaacaaggctaagataagtcttactagtcagcaggatttttatagtagatttgtaaagaattctaaagagagaacagttgttattatttctgatgcctttagatatgaagtagggcagactctactcaaaaggcttatggaagatgaaaaatgcactgcaagtattcaggctatgatgagcatgattccttcatatactagatttgggatgtcagcacttcttcctcacaagtctctagatatgactgaggattacagggttactgtagatggcaagatatgtgatgatctaaaatccagagagcaaatcctaaagtcatataatgaaaacagcagagccttgcagtttgatgatatcaagggtatgaagatgactcagctcaaggaactatttacagggcaagaggtagtatatatctatcacaatcaaatagatgcaagaggagataagctaaatactgaaaacgaagtctttatcgcatgtgaggaagctattaaagagattcatatgatgattaaaaggcttacaaatgcaaacaacactaggtttctagtaactgctgatcatggctttatatacaaaagagataagctagatgagagtgataagattagtgggtttgataaggagagtgcatttgtagggagaaggtatatagtgtcagctcagaaggtttcatctgagggagtatgcagtatgactctaggtgatgtgatgcgtagtgatgatgagaggactatatcgcttccactaggcactgatgtgttcaaagtagctggtggaggacagaatttcgtgcatggtggctctagcttgcaagaggtgatagtgccagtgctagatgtaaagacaaacaaaggctacactcagactcaggcagtcaagatttctcttatcagcctagtgagtaagattactaatctaaatacaaatctagagttcatccagacagaagctgtcagtgatgtaaataaagaaactaattacaagatttattttatttctgatgataatgaaaagatatcaaatgaaaatatttatgtagcagataaaaaggatattgatgcaagtaagagggtatttaggctgagatttacttttaaaaataaaaagtatgacaagtcaaataagtattatttggttgcctatgatgaaaaaaatgacctagaagtaatacgccatgaaatccagatggacctagcttttgctgatgactttgaattcaatctctaa

SEQ ID NO: 1183 - DNA, 2553 bp, Acidiphilium multivorum
atgcaccccttgaatgagtatatttcgaagcagctcgctgagaagctgaaagcgaggaaggtggtcgtctggtacgatccgcgccgcgaatttgcgccctttataggggaactgcggggcggcgctcggacaagcgacgaagccgtccccgtcgccgttggcggactggctgcgcgtcttgcggagttcgatggctcaatgtttgagctgcgcgcggtcgtggaaccgttcgtctgcgatgacgcgccgagcgagtgggtcatcatctacctgcccggctgcgagcgtgatcggcacggatcagtgctgatggagctcgagaaggccggtgaatgctacgagccgcagcttaagcggctggcgcgcaatgttcttcgtcaacggtacacggacggggtcatcgacgagatgttggcgcccgaacgtgtctcatacgaagatctcgcacgggcatcctctgacacatcatcgacagagccgccatcggttctgaaatccatcttccacggcgcttcgggcaatgacggtatcattgccccctggcttgcgagcgacgggcgcgatgctgaaatcgagtcgaaagaagccacgcgcgaacttgtaaagctcatacgttcgaagctcggtcttgagcttccggacgacgcacctctgtcgaggcttcgatccatcacccttcggtatgttctggccggagaattccgcggcgatttgagcggcgcgcttccgttggcgcttgatagcataccggcgccacggaccagggatgaggaaggcgcggtccgggaactcgcgcacctgcttcgcaccaagttttcggaggcctatcccggcatggccgaccgcgtggaggccgaacttgggctgaacgcggccgccatttccgcaggaaccctcggatcgatcgataccttccgcttcgaggaacgagcgttgctcgcgcactgcggcgacctcgtcgcacagaagaagtttgatcaggccctcgaactgatcaccggccgcgagcaaagtttctggctcgatcgagatgtcggtcgaaaggcgcagtgggaggcctgccgtcgcatggccgagctgggagccctcggcgtggccgttcgggcggcggtcggcaaggcctcagtcgacgccaacggctggatcgacgcctacgtagccaaggacggttggttccgattggatcaggctcaacggcggcttgaagcatgggtcgccaaccttgacgacgagcccgaagagcgcccgctggggatcgtgcgcggcgtctatgaggacgcttgccgcgccatggccgacggcttcacgcgagcgctcgtggcggccaactgggccgtctcgagttgcttgcaccagactaggatttttagtgaagtcgtttctgagcagccgaagcccgtcgcctatttcttcgtcgatgccatgcgcttcgagatgggcgtcgaactctcagagcgactcccaaagtcggtagaagtcagcgtgcgcgcagccgtctgcgccctcccgagcattaccccgattgggatggcggcccttcagccgggggcatcttcaagcttcagtgtggtcgagcagggtggagcactgggggctcggatcgatgacgcgttccttcctgacctaaccgcacggaagaaatttgccgcctcgcggatccccaaagtggcggacatcgcgctcgacgaattgctgagtttgcaaccgtctagacttgctaagaaggtcgagggttctcaggtcatcattgtcaggtcgcaggaaatcgaccacgcgggcgagcgcgggttcactttccaggctcggcaggtgatggacaccgtcatcgataatctcgcccgggccatccgaaagctcgcggcagctggtgtcgagcactgcgtattgaccgcagatcacggccacctcttttttccatctgaccgcgatgaatcgatgcgaatcgagtcgccgggaggcgacgaagtcgaccttcaccggcgctgctggattgggcgcggtggcacaacaccgtctggttgcgtgcgcgtgacggcctccgcgcttggttacgactccgatctcgactttgtatttcccttgggaagtggggtcttcaaggccgggggtgacctggcattccaccacggcggcccatcattgcaggaaatggtcatcccagttgtaacggtccgcatgaagacgagcgcgccggggcgttcgtcctcgggaccagtagcggccatcggcctgcccgaggcagtcaccaaccgcatcttcagcgtggtgatccaactcgacggcaaaaatctctccctgttttcaaccgaactggtggtccgcccccttcttatgtccgccggaaagcaagtgggcggcgtcggaatggccatcgacggcgagttcgatcgctcgacaggctgcgtgaaattggaggccgggaagcaggtcacggtggcgttcttgctgagcgacgagagcgtgccgtcgctccgcgtcgtcatccaagacccgacaactgacgcggagctgtatcgctcacccaccgacatcccggtccgtctcggagtttaa

SEQ ID NO: 1184 - DNA, 2508 bp, Acidithiobacillus ferrivorans
atgaccaaccccaaaatcacgcaggcgctgagtagcctgtttaccaagcagcgtatcatcttctggtatgacacgcgccaggagtttcgcgccgatttcgagacgctggaactgccgggcgtcgaaaaaatcgagctactcaacaatgagttcggcgtgaagtaccgccttctgcgccagcagccggatcaacagtttctgctgtaccgcgaaggcgccgagcccccacccctgcagaactggctgctggacgtgcaactcgccagcggccatagtttccgtaccgatcaggtggcgttgtggcttgccgaactggaactcggtcctgacttttaccaggtgctggaagcacatagcgcgttttttgagtcgggcaagcgccgtgaagcgctgcgcaaaatgctggaatcgggtgactcacacaatctgctgcgccgcaaaatgctggccgtggctgcgggcagcgagccgcgtctggacgccatactggaaaccttgttaggtgatcttgccagaggcgatgaggcccggatcaagctgatcgagcgcagcaccctgacggcctacctctgggagcaaatgaaacgcgcttacggctatacgtccgagcagccggggctgcatgattttgtcattgaactgttcaagacctgctttcagtccggtatcgacccgacctgcaaagccagcctgtctgccgaggcattggtctttctgaagcgctggaaagacagccgctcccatgctcagggctttgaagtgctctccaaacagtgcgccgtcgttttgcagatcgaagacaagctgcagacgctggactatcgccgcctgatgacgctggattactttgagctgatcgaccgcaaaattctcagcgagctggtacgggcggtgctggcccgtaccacgacagcgcaagatctgcagcagtgggtgcgccagcgccgccagagccactggtttgatcgctttaaggatatttatctcgccgtcgagcatgcggcacaattcattcaactgctggacatgacccagttggaaatggattcgctggcagatggggtgcggaaatatgcaaaaaactggtaccaactggatcagcgctaccgcaaattcgtgtttcacctgcgcgagtccggccaggcctccttgttgggcgagctgagtaccctgatagacaatttctacagcaacaacttcctgacgcgcctcaatgatcgctggcagcaacacgtggatgcagtccagcattgggaggctgccccggttctgctgcaacggcattttttcacccgttgtgtgcagccttttctggagcgcaagggcaaggtctgcgtgattatttccgacgccttccgctacgaaattggcgaggagttgcaaagcctgatccggcaggaggatcgcttcgaggcggaactggaaccggctctatccatgctacccagctatacccagttgggcatggcggctttgttgcccaatgcggacctgcagttggtcgacaacgagagtggcgacgccatggtcaatggtcagagtgccaaaggctcagccaaccggggcaaaattctcgctaatgcagtgcccgcatctgccgtggtgctggccaaagacctgatgaacatggatagggacacctcccgcgccctgctgcgcgatcatgaggtggtctatatctatcacaacctgatcgacaaaaccggcgacacccgcgacaccgaagaacgcgtcttcgcggcggtcgaagaaacactggacgaactgcttcggctggtcaaaaaactgaccaacgccaatgccagcaatctgttggtcaccagcgatcatggctttctctatcaaaaccatccgctggaggaaagcggcttcctcagcagcgagccggaaggagagccggtgctctaccatgaccggcgcttcgtgttgggccatggcttgcgggataacgccagtttcaaaaccttcacatccgcgcaattaggcctggccgggacaatggaggcgcaattccccaaatccatccaccggctgcgcttgcagggttccggcagccgctttgtgcatgggggtgccactctgcaggaggtggtgattcccgtcatccgcatcaataaaaagcggcagagcgatgtgggacgggtcgaagtggagattattggtgcgggttcaaaaaccatcactaccggccaactcgccgtggtactgtaccagaccgacgccatcaccgaaaaatcgcagccgcgccgcttgcgcgccggactgtttacgctccagggcgagctgatctccgatcagcacgagttgttattcgattttagcgcgacgcatccgcgcgaacgcgaactgcccgtgcgattcatcctcagtcgtaaggccgacagcgccaacaatcaggaggtagaattgcggctggaagagcgggtggagggcaccagccatttcactacctacaaggcggcacggcataccattcgtctttcgctctccagcgagttcgacttttga

SEQ ID NO: 1185 - DNA, 2625 bp, Acinetobacter baumannii
atgaatttagatcaactaaaacaaggtctggaacaagccttttatactgaacagcatcggattgtcttttggtacgatgcagaacagtcatttactgaagaaatcaaagccctaaagctgaatgatgtccatattctaaatatggcagaagagtcgagtttggcgatcaagctcaaactggaacttgaggatcagcagggtaaatacttgctgtatttcccaagtccagagcctgaaaccgaaaaagactggctactggacattaagctatattctcgcagtttctatgccgatcgtttctcgattatctttaatgagcttgggctacagcaacaaagtttaagagaacatctggctaaacgtgaagaattcctcaaagccaaagcccgtctgagcaccttaaaacgctatatccagtctgatgcagatgcacaggatctggacatggctatgattgcagctgtggtcaaggctgacagtgtcgaactcatgcatatcgttctggcactggcagatgaagtggtacagcagaacctggctctggaagtcaatccggaatcctttgctgaactggaaaaattccaactggtgccagctttaattaccgcattacagacggaaattggttatccagcatcggttgaagaattgaatggggaagcaccattcaagctcggtacgttctttatccggttgatgagcacaggtttctgtgaaagcctgggcgatataccgctatgggctcaagaactggtgatgtcatctgtcagttcacgtgcgacggctagagcctttttgtcacgctggagagacagctccaaatactacccaaccttcgatacactctcccagaccgtggccaatgcactgcggatccaggagaaggtcggggcttttgatctggaacagctgctcgatgtcatgacctttgaagtgattgaacaaaagattattgttgatttggccagtcatatccctgcagcaacccaagctgaactggaacatttcagaacgattatttctacccgtctggatggctattgggcttccaaacataaggatgatgcaacacgccgtaaatatcgcacggtctatacagcgttgcaggcagccattgacctgttcagcctgcgacagcagtttgattccgggttctatttcgactccagtgaagccttgtataaagcctacgagcaggagttgtatcgctttgatatgacctatcgccactacagtacagcctcacaacgagctcatgtcgatatcctgaaaaaactcgatgaagaaatcgaaaattgctattcctactggtttatcgattacctggcgcgcaactggggagagcggattgaagctgaacaacgcttgaatgtctggaaaatagcagatatcccaaatcagcagaacttctatgatacccatgtcagacccctactgggttctgcaacgaaacgccgtattgtagtgatcatcagtgatgctttccgctatgaagctgcagtagaggtgtgtgatcgtatcaatgaaaagcgttattcagaagcgactttgtcttcacagctgggagttgtgccaagttataccacactcggcatggcctcattactgccacaccagactttggagtacaaagagagtgcaggggatgatgttttagtagatggacagtccagcaaaggaactgcagcacgatccaaaattctggcagcctataatggtctagccgtgaccgctgaaacggtaaaaggctggtcgcgtgatgaaggccgtgaagcacttaaagaccatgatctgatttatgtttatcataacgtcattgatgcacgcggtgacagcgtctcgacagaatcagaaacttttatggccgtggaacatgccattgaagagctgaccgagctaagccgtaaaatcttactgcatttcaatatttctaccctgttgatcacagctgaccatgggttcttgttccagcaaagtaaactggaatctgcggatcgttctatcttgactgaaaaacctgccaatgtattgaagagcaagaagcgttatgtgatcggacatggtttgccagtgagcaaagaagcctggaaaggttcaacccaagctacggcaggtacattatctgcgactgatttctggattccaaaaggggcaaaccgtttccattttgtaggaggttcacgtttcgtgcatggcggcatcatgcctcaggaaattgtggtgccggtactgacagtgaaacagctacgtggtgaaaaggctggacagcgaaccaagcgtaaagttgaggtcatttctaccaaatctacgctgaagatggtcaataacatccagaagtttgatttgatgcaaactgaagctgtcagtgaactggtcatgccagtaaccctgtcgattgccatttatgatggggatgtcaaagtttccagtgaagaaactctgacctttgatagcagtaccgactctattgcggaacgggtaaaacaggtcagactgtctttgtctggcactgattttgaccgtaagaaagattacttcttggtgctgaaggacaaagacctgaatatcgaaatgcagcgctataaggtcagcattgatctggcatttaccgatgacttcttctga

SEQ ID NO: 1186 - DNA, 2055 bp, Alteromonas macleodii
atgcctagtatgttgttgataaattacttaattgagcaactcagaaattctgcaaactataataggtcagtacaagttgctccagcggctatattgtggactgatattgataaacaatggcagacagccatgccgtttatcaaacagcatctgcctgagttaatcgaactcggggactataagcccgaagaaaggattggccccgcaatttgggtaaaatgtgctattgcaggaaaactagatgactgtaatttgcctgaagatagaacccctattatctatctacctggagttggtaggaaagagctcagggctatagaatcttgtcctgagtttctgaagcctttagcagaacttcaatatagaggatgttggtgggcttataatacagctggtagagactggactgtttcttcgtttctgacaaacccaaaagtcggtattgaacttgaccttgctaaagacaagaatactcaacaagcaatattgaatgtattacccgacctacttgaaacaccagactctaacctgagaggaaagaaattagaatctgaagattttatttctttggtgctggatgacccaaccaaagatattttaggctggttaaatgatccatgtgagaaacgctctcaatggcaagattctagatgggatatttttgtacagtcatgccaatctcaattttcctttacgccggatgaaaaaagtattccaacagctttaaaactgttatgtgccgcagaaggtcagtgggaagcagtttggcaacggtttgaagatactgctgttaacttaccattgttagtcgaaaagctaaaagctattgaatcggatgatttagcgattgttaatcctgaaaattacctttctgaaaacatgaaagacgaggcggctatcgagtcgcactttttcaatgtaggggagaagccaagagacacaatcagccaagagttaatggcgctatgggaaaagcagaaggataggaaaaattggatttggtatagccttgggcatagcggttggctaaaaattcttgaatacgttattggtgcaattgaacataccgaaattgtatattcgggctctacacctgaaatgatggcaaatcattatcaagaacgtttttggcaggctgatcaatgtgtcattaaggcgatgtctttagctaaagatattcatcagcaagaagttgtagctaagcttctaggtacagtttattcaccttggcttgagcaaacgacactgcgctttcagcaattagtagagcaacatggctaccctggtaataagatcaaagttaaagagagcactgcaaactacagtgttggtggccaggtcgtattctttgttgatggattaagatttgatactgcaaaaatattagaagataaattaaaggataggggccttacaacagagttaaactctaagtgggcagccattccttcgctgactgctacagcaaaagctgcggtaacacctatagctaacatgcttacaggtattgaagagaatgatgattttattccttcagttagtttgagtaagtcttcattcagtagccatcatttaaaacaattactcaatgaaaaagggtggcagtaccttgatggtttggaaacaggtgacccaaaagggtttgcatgggttcagaccggtgatttagatcatatgggtcatgaacagcagagaaagatgcccttgtttattgatcaaatactagatgatgtggttgcaagagttgtgagcctgtttgatgcaggatggatgaacataaaaatagtgacggaccacggttggctctgggttcctgatgggcttcctaaaggtgtattacacaaatctttaggtaaaaaccgccagcgtcggtgtgctattttaaaggataatgttcaacacgatggcatggttatgccttggtattggaacccttcggtatctgtagctcttgccccaggtataacagccttcgtgaaaggcgaccactacaatcatggtggcctttcaattcaagaatgcttgacacctgagctacttttgacaaaaacctaa

SEQ ID NO: 1187 - DNA, 2358 bp, Anaeromyxobacter dehalogenans
gtgaacgcgcccccctctcgccggcgcgctggcgcgccggcacgtgcgcgtaacctcgtcgatgccctggaacagtcgttccttcacgcgctgcgacaggcggagggagaggccgcccctgcagcgctgatctgggccgacacggaaaggcagtgggcgggcctcatggcgcgcctgcagactgcgctgccacacctgttcgtcctcggcgcatacgacgccgcccgacgcacggggccggccatctggctgcgctgcgtggtcgaccgcgtgctcgaggacgtggcgctcgagccaggtgtcgtaccgatcctctatctgccgggcattgcccggcagtcgctgcgtgcgggagacgagtgcccgcgcgagctgcggccgctcgtggagctgcagtaccgcggtcgcgtctggcaccagaagaacggtcgcgattggacggtcgaagcatttctggtgtctgaggacgggctccagttggacgtggcccaggacgccaagacgcgcgatgccgcgctgcgcagcctgccgctactcgcggagacgcctctcgatggcctccgcggtcaccgcctcgaggcggacgacttcgatcgtctggcggtaagcgatcccacacgcgacctgctgcgctggatgggcgcgggtgacgcgcttctcaaggctgaagggcaaggacgctggaaggcgttctgcggtgtctgcacgtcggacttcaagttcgacccggacaagaagtctccggccgacgcggcgaacgcgctggtcgagggcaacggcaagtgggtcaacgtctggcagcgattcaaggaggcgccgaagctctatcccgaggtcgccaagctgctgcgcgacaccgccacgccgctcctccatcgtggaagcgaacgagacgcgggcggcaacgccaaggcggaacaggagctgcgtgctgggctcgcagcgctcgcgaacaagcctcacgccgcagctcttgccgacgtggcggcgcttgaagcggcgcacggcaagcgccgtgagtgggtgtgggccgaactcggcgagagtccgctggccggcgccctcgcccccctcgcgaagctcgccagggcggcggctacgacggtcggcggcgccaccgtggatgcggcgatcaacgcctacgtgaacgagggctggcgctgcgaccgcgccgcacttgaagcgcttgccacagtgaagcagcccgcggacgtggcgctcatccagagcgtcgtgcgcgccctctacctgccgtggctcgacgcctcggcgcgacacttccagagcctgatcgagggcgccgggaacgtcctgcgcgccaaggtgtctggtagccagtacgagaaggacgcgtgcctcatgttcgcggacggcctgcgttacgacgtcgcgggcatgctcgcggagcgcctcgaggcgaagagttaccgcacgcgcctgaaccaccgcctcgcgccactgccaaccgtgacgtcgaccgccaagccattcgcgacgctttcgcacgatcgactcgaaggcggtgaggacgtcatcgacttcaacccgcgcttcaaggacagccctcaagcggctaacgcccagcggctgcgagaggacatggcgagccgtggcacagacctgcttggggatgagattcggcccgcgaagcaagggacgacgggcggctgggtcgaaaccggcaagctcgacgagctcggccacaagctgggcgcgcgtctcgccgcgcagattgaatcggaactcgacacccttgtcgaccaggtcaccgggctcgtcgaagcgggctggacgcgcatccgaatcgtcacggaccatggctggcttctggtgccgggggggctgcccactgtcgccctgcccaagcacctgacggtgaccaagtggtcgcgcgccgccacggtgaaaggcgacgcgacgcccggcgtccccgtttatccgtggtactggaacccgcacgtccgcatcgcgtcgccgccgggggtcgcaagctttgccgcgaacacggagtactcgcacggtggcatcagcccgcaggagtgcatcgttcccgagctcgtcgtagagcgcggaggtggcggtgcgaccgcgtcgattaccgcggtgtcgtggcgtggaatgcgttgtcgcgtgtcggtggcgacgaacgaccctgaggtgcgcgtggatctgcggctcaattggaagcaggcgaacaccagcatcgtggcctcggacaaggaagtcggcccagctggcgaagcgagcctcgccgttgccgatgacgctcacgaaggagctgcggcgaccgtcgtcgtcgtggacggcgctgggagcgtcctcgaccggaagactacgaccgtcggagaagcatcatga

SEQ ID NO: 1188 - DNA, 2619 bp, Aromatoleum aromaticum
ttgagtcatcaacgcatcatcgaagccctgcaggcgcagtttgcgactcagcagcttttgttctgggacgatcccgaaggagagttctccacttgggtcgatggtctgagcctgcacggggtcaagatactgcggctagaccgcacctcagccctgcaggtgaagctcgacgtcgagcactcacctggcacgcgctggctgttctaccgccctgcagccgaacccgatccggcgaaggactggctcctcgatctgcgcctgcggggtcgggcgttccgtgcggactcgaactccatgctgctggacgatctgggcctgacgagccaggccctgcgcccgcatctgaaggcgcgcagcaagttcctgcgggccaaggaccgcgtcgaaaagctgcgtcgactggtgacgccgggtgacgatgccgaggcgctggaccgcaagatgctggcggtgctggtgcgctcggagcaggcggatttccagacgattcttctgcgcctgttgagttcgatggtgcatgagggcgaggcggatctggcaggcgagccgcgtgtttggcaggacattgttgccaacgagctggattcggcgttctgggcgcttgccttgcagacgcttggttacggtgcggatggcgtggcgccggccttcaccttgcgggatctgttgtaccggatcctggtgacggatttttgccggtccttgtccggaaaggcgccggagtcgctgcagcatttcgtgctgccggatcgtatgctggcggccaacgcgtcggtgttcgcagcgcggtggcggaccgacatggcggcttacgaaagctacagtctgctgtcggacgccgttgccggcgagattgcactggacggcgtgctgggtgcgttgccaggtgaggcgctggccgagaccatgaccttcgcggcagtggagcgccgcatcctgaagaacctgaaggatcgcgtgctggctggcccaggcgcgagcgacgaggcgatgcaggcgctgatcgcgcgtcgccgcgatggccattgggcgagtcggttgatggcgcagagctcgagcgagagccgggcgctggcggcgtgctacgacgccatcgaggccggagcggcgttcttcgcgctgaaggcgcgcttcgacgccggcttcagctttgccggtgcggaggcggcgctgaaagcttaccagtccgagctgttccgcttcgaccagttgtatcgacatttccatgaggcagcggagaaggtcgagccgatgggctgggcggtgctacacgaactgcgcgcgcgcatcgaagacacctacacgggctggttcctgccgcagttcggtaccatctgggccaaggtgatcgagggcgagggcggcttgctgagtcactggacggtcgccgggatgccgaaccagcatcgcttcttcgacacccaggtggcgccgctgctgaaggtgggggccaagcgggtgttcgtggtgatttcggatgccttccgttttgaagccgccgaggagttggtgcagcagctcaacagcaagagccgattcaaggccgcactgtcgtcgcagctgggcgtgctgccgagctacaccacgctcgggatggcggcgctgctgccgcatcacagtctggcctacaagatcaacagcaacctcgatgtgctggccgacgggcagccagtgtcgacgctggaacagcgaaacgcacatctggcgaagtacgagggcctggcgatcaaggccgatgagctgctgaccttggggaaggacaagggtaggacgctggtgcgcgagcggcgggtgatctatgtgtatcacgaccatatcgatgccctgggcgacaagcaggccaccgaggggatgacgttccgcgcggtggacgaggccataggccagctttcgcagctggtgagcttcatcatcaacagcttgaacggctcgacagtgctggtcactgcagaccacggtttcatctaccaggaggcgccgctgctggctgcggacaagtcggcgctcgacgcgcagcccgagggcaccctgaaggcgaagaagcgctacctgctcgggcgcggcatcggcacttcgcccaaggcatggtgtggcaacacggcgctgacggcgggcacggccccggagggtagcctggacttctgggtgcctaagggggcgagccgttttcactttgccggcggggcgcgcttcgtgcatggcagcgcgatgccgcaggagatcgtggtgccggtgatcacggtgcgcgagagcgagtccgacaaggagaaggcgcggcatgtggagttcagcctgctcggcgcgtcgaacaaggtcgtcaccaacacccagcgcttcgagttcatccagaccgaggctgtctccgacaaggtgctgccgcgcacggtggtgatcgcgctgcgcgatggcgaccggctgatcagcaacgagcagacgctgaccttcgacagcgcctcgcagctgctcgacgagcgcaagcgctcggtgttcctgaccgtgctcgcgggcacttacgacaagacgcacgactattggctgactgtgcgcgatgccgcgatcaaggtcgaagtgctgcgtgtgccgctgcgagtcgacctcgcctttacgaatgacttttga

SEQ ID NO: 1189 - DNA, 2493 bp, Arthrobacter sp.
atgactgaagcctcgaccgtgaagtcccacctggagcagcgattcaccgagaagcgcgtcgtcttctggcacgacgcagatggcgactacatcaacgacctggattccctcgggatcgacggagtccagatcattcgtgttgcaggagacgagttcgcgatcaagaaccggctccttgagatcgagcccaaggccaagttcctcatctaccgccagggcgctgcccctgccgggctcgacaactggctcctcgacttggagttggcctacggcgtgttcaccgcggacagggcatcgctgctgcagcaggaactcgggctcacggacccaagagtgatcccagtgctcgaggcgcgaacgaagttcttcggcgcctccgcgcgccgccaagcccttgccaagctcctgtcgcctagcgacgacccgacgacgctccaggccaagatgtgcgcagccctcctcaagcagagcgagcacagcctgctcgagatcacgcgcgcactccttctcgaagccgcggagtggacgtcggccaagtacgaggaactaaccgcctatggactcgatgggttctactgggagggcgtcgcctcgatctatggctactcctcagctacgccgaccctcccggacttcgtactctgggtgttccggaaggccatggacaacttcaaggccgatacccccaactcactacgcaacatccgactcgacttcgcggccctgcggtacgacatgcgcagcaaggaggccttggccacccttgccagtcgcgcggcagacgacctggacgtcaagccaaagatcgcagacgtcaacctcggcgagctgatcggcagtgacctgtttgagcagatcgaccagaagatcatcactgacctcgcccgcggagtcgtcgagcaatcgatgaccccgagacaggtcgccgatgtagtccggcagcgccagagcagcatctggatcgaccgataccgcaagctctacaccgccatcgagtcggcctcggagttgctctcgacaatcgctgcccttccggggaccatcgattccttcgacacagggctaaagcgttaccagacggagtggttccggatcgaccagctgtatcgacggttcacctacgccgccaagaccgccgacttccaggccccgctcaccgcgctgcgggctgaagtcgagaagttctacgccaacaagtacctcttcaactttgggactgcctggcagcagaaggtcgacctggtctcggattggacgtcgggatccttccgctcgcaggcgtcgttctacgccggctacgtggcaccgcttgtcagcgacgggcgcaaggcggtcgtgatcatctccgacggcatgcgttatgaggtggccgatgagctcggtgcccggatccgccgagagaacaagttcgaggctgagctgtcggcagtcctcggcgtcctccccagctacacccagctaggtatggcctcactcctgccacactctatcctcgagctgtcccccgaaggcatgccggtctacgccgacgggaagcgcacggatggaacagtcaatcgtgcgaaggtcctggagtccgtccacggtttcgctgtccaggctgaggaactcctcgggaagacccgtgacgaggtgcgtgctgtgctccagcagcaccaagtgatctacgtctaccacgaccgaatcgacgcgactggcgacaaagccgccacggagagccaggtctttgaagccgctgaggagaccctccgcgtgctcgtcgacctagtgaagaagatggccagcgctgacgcgagcaacatcttcataaccgcggaccacggcttccagtatcaggacacgccactggacgagaccttcttcctgtccacgccccctcagggtgatcagatcacccgcacgaaccggcggtacgtgcttggcaagggactgaagcacgaccctgccttcatgaccttccagccagcacaagtcggactcggcggcgagatcgaagtccagatccccaagtcgatccaccgaatcaagcaacccggcgccggcacccgttacgtccatgggggagcctcactccaggagatcgtcgtcccggtggtgaccgtcagcaagaagaagaagagcgatgtgcgcccggtcaacgttgagatcgttcccgaatccgacaagatcacgactggccagctcgccgtacggctctaccaggtcgacccggtgagcgacaaagtccagtctcgcactgtccgggccggcatctacgtcggcgagacggcgctctctaacatcccggagctggtgtttgaccagacttcgacagacaagcgcgaccgctaccagaccgcgacgctctacctaagccaggaggcggacgacttcaacaaccgccccgtcgaggtccgattggaagagccgatcccgaacaccaaccaatggaaagtcttcacgaaggccccatacacgttgaagcgctcgttcacggcagactttgacttctag

SEQ ID NO: 1190 - DNA, 2316 bp, Azospirillum lipoferum
atgagccccaagaccctgctggaggcgatccagcacggattggccgatgcagggaagacagccgatggcgtcgcgccgccggccgccatcctctggaccgatccggacgggcagtggcggcccctggtcgagccactgcgcaagctggtgccgcacctgtatgcgctgggaccctatgacccggaacacaagacggggcctgcgatctggctgaaatgcgtcgtcgaccgcgccttgcccgatctcgacctgccggcggatgccatccccgtgctctacctgccgggggtggcgcgcgcggtgctgcgctcggcggaggactgtccgcccgcccatcagccgctggtggagctgtgctaccgcggccagacctggcaccaccggaacggccgcgactggacggtcgaggggttcgtggaggcggttctggagatcgacctcgccggcgatcaggccacccgcaaggcgttgttgcggatgctcccccgtgtggccaccgaacccgtggtttctctcctcggtcgccgcatcgatgcagagaacctgctgaagcttgacgtggatgacccggtcggcgacctgctgagctggatgagcgagccgggggccttccgccagcgttgcgacgacgggaaatggcagtccatccgccagctctggcttaagacctacggcttcgacccggaagcggacggcgtgacggcagccggtgacaagctggtgaatgaccagtcgccgacctgggcgggcgtttggcggcggttctgtgccgctcccaaactctatccgggcctctccaaggtcctgcgcatgtcctacaaggacctgttcgccgggagcgaccgcaacccccgcttcaatgaggacggcgaggtaaaactgcgggccgggctggaggccgcggtcgacctgccgcatcaggacgcctgcgacaaggtcatcgccctggaagcggagcacgccgaccgacgcaactccccatgggctgaactgggcgagagccccctggcggacgccttgcagccgctggccaaactggcccagatggcgcggtccggcctgggcggcgccaatgccgccgcgatggcggacgcctatgccgccgacgggtggcgctgcgatcgcgcggcgctggaggctctgaccaaggcgatggcgcacaagccgcaagccgggttgctctgccgggtcatccgggccctgtatctgccctggctggatcagtcggcccgccatctccaggacctgctgggggcctcggatacagcggcgtccgcgctggtccatccgttcacgcccgaagccgggacctgtttcctgttcgtggatggactccgctacgacgtcgccatggcgctaaaggagcagttggaggggctgcaacttccctgcaccgcagggcatcgcttcgcgccgctgccgacggtcactgccacggccaaacccgtcgccatgccggtcgggccgatcatcgggccgggcggcgcaccggaggacttctgcccccacctgtccggaacgacggcggcggcaggcgtcctgaagctgcggcaagcgttggagcagaagggcgccgtcatcgtcgcgccggcaagcccgcagggaccggccagagccggcgacgtcggatggtgtgagaccggcaagcttgatgagttggggcacaaactcgacatcgggctcgtccgccagatcgaagacgagttgtccgacttggtcatgctgatcgacagccttctttcggtcggctggccccgcgtgcgcatcgtcaccgaccatggctggctgctcatgccggacgggctgccgaaggtcgacctgcccaagtcggtgacctcggcgaaatgggcgcgctgcgccgccgtgaaggacggcgcctcgccgggggctgcgaccttcccctggtactgggacccacatgtccgcatcgccatgccaccgggggtcggatcctatctggccaatgcggcatacgctcacggcggcatcagcccgcaggagtgcgtcattcccgaattgaccgtttcccgtggcgcggcgcccatctcggccaccatcaagcaggtgggttggcgtggcctgcgtgtccggatcaaggtcgagacctccacgccgggactggccgtggaccttcgccagaagcgaaacaatccgggcaccagcatcgccgcctccgtcaaggagctgaaagacaccggtgaggccagtctggcggtcgaggacgacagcaacatgggcacggccgccttcgtcgtcgttctcgacacggatggcaatgtgatcgcggcgcagatgacgaccgtcggagacgaatga

SEQ ID NO: 1191 - DNA, 2643 bp, Bifidobacterium animalis
atgagtgaactgaatgccgtcgcggcgatgctcgcgaaacgctacgccgaacccggcgagcgcggccgcatcgtattctggctcgacgagaagggcgactatgccgacgatgtgcagtcgatgttcggccccgattcgtcattcgaggcgttacgggatatcgagctcatcatggctgctgacaccccgttcgcgaaccggcacacgatgatgatcaagcatccggaccgcaagttcgccgtctacatgaccggtgcacaacccgcgccaagtgacgactggctgcttgatatgaagctcgcctacgcaccggtcttctccgcggaccggctttcgatgaccctcaccgagatcacacccgacgccccacaggagacgaaggagcagtggctcgccatcatgcgcaggacaccacggttcttcgagtcgaagacgcgtatccacaagctcgccgagcggctcaacgcgcaggatgacacgcggcgtctgcaggcgaagatgatcgccgtcctgctcgacctgccacaagggcagcacagcctgcaggacatctggcgggcactgctcacacaggacaccgaagatgatgacaccggcatccgcaagatcgagcggatgggcttggcgcccttccactgggccggcacggaagccatctaccactaccccgcctccacgcggagcgaagacaacctcactgtcaaggatttcaaactctggctgttcgaccttgcgtggcacggttttaccacgaaatcccacgatgaaagctactatgcaggcatccagcgcgacttcgtcggatggtgcaacaatgtgcagacccgtggcacgatgcgcactctcgcggattcggtcatgcaagacctcggtatacccgccgaagtggatgagatggatgtccatgcgctcgcacagcatggcctattccaggcggtcgatcagcggcttatcatgcgtctgctcgaaaaactcggcaatcaatccatcacggacaccgatgtacagcgtatcgccaatgacaggaagacaatgctctggtatgaccaattcgagcatgaataccaggccatcagcgcggcgggcgctttccgcgcggcgttgagcaaggtcgaggatcctatcgagctgcaatccccacagcagggattcgaatcctatgtctcatactattatcgcgtggatcaggcctaccgtcacttccgtatggcgtttgatcaggccccggatcttgatgcaatcgccatcagcaatgatctggaagccgattatgtgcggttccagctcaatctgggcgcggcttggcagcgtcagctcaatacgatgaacgcgtggcgaatccccaatgtggcggaccagcaggatttcttcctcaacaaggttgagaacggcttcctcaaatcaggcaagaaagtggctgtcatcatctccgatgcgttgcggtatgaggtggccgaggagttcacacgtcgcatcgacacagaaaaccggttcaccgcatcagtgaacgcacagcttggcgtactgccgtcctatacacaactcggcatggcagcgctgctcccccatgaaagaatcacattcaatacgaaatcctcccatgctttggataatggtcttgttctggtcgatgaccatgcctccagtggcaccggtaaccgtgacgccatcctgcagacacgcaacgggcataccatccaagccaaggacctccttgcgatgaacaccggcgaagcacgtgaactggtgaaatcctgtgatgtgctgtacatctaccatgacgagatcgacaaggaaggcgacaaaggcgacgaagacaaagtattcggcgcatgtgaaagcacgatcaatacactcatcaccatcgcgaggaaactgacgaacgcgaacgtcaacaacatcctcgtcaccgcagaccatgggttcctgtaccagcgcagcgaactcgatgcgggcgaatggctcagcgaacaaccgcatggcgacgccgtatggatgaggaagcgtcgattcacgacgggggcgcatcttatacccaatgacgcgtttatgaccttcacagcgcaacaggtcggtctggcgaacccgccagaggaaggcgtcacaatccagctgccgaattcgatcctgcgtctacgccatcagggcgacggcgtgaaatacgtacatggcggcgcgtcattgcaagaagtcgtcgtaccggtcgtctccatcaacaagggccgttcggcgagcggcgataggcgcgcagtaaacttcaccatcctgcagagcacgaatctgatcacgacaggacagatcaccgtggacttcctgcagagcgaaccggtcggcggcaaggtccgcgagcgcatcaccttcgtcggactctatggccgggatgagcacggtgactggacgctaatctcgaacgagacgcccatcaccttcaattccacgtcgaaggaggcagcaaaccggcataaccgggtcacgttcatgctcacgccggaggcggacgccttcaacgggcagccgatcatgctgctgtgccatgagatcgtggcgggttcgagcgcgcgcaggctgttggcgcagaaggcgcaattcacactcaagcgcgatatccaatcaggcgacgccgatctgctggattgggactga

SEQ ID NO: 1192 - DNA, 2499 bp, Bordetella parapertussis
atggaaaaccgcattgcccaggccctgaccaaactcttcgaccggcaccggatcgtcttctggtacgacgccaagcaggagttgcgcgacgacttcgatgcgcttcagcttcccggcgtcgagaagctggagctgatcaacaacgagtacggcatcaagtacaggctgctgcgcgagcaaccggaacagaaattcctgctctaccgcgaaggccctcagcccgccgatctggataactggctgctggacgtccagctggcccatggcgagttccgcaccgatcaggtggccatctggctgtccgagctggagcttggcctggagttcacggatgtggtgcaggcccatgcggagttcttccaggcgatcaagcgcaaggacgccctcaagaagctgctgaaagccgacgacacagccggacagattcgcctgaagatgctggcggtatgcaccggcagcgagccgcgcatggatgcggtggtggaaaacctgctgcaagagctggccgatggccgggacgagaagatcaaattgatcggccggtgcagcctggacggtttcctctgggaacagatgacccgctgctatggctacaagtccgacgcgccgggcatccgcgacttcgccatcgagctgttcaagtcatgctacgccatgggcaccgctggccaggtgaaactgaccggcgacgccctggtgtttctcaagcgctggaaggacagccgtcagttcgaaggcggtttcgagaccctctcgggagaatgcgccgaggtgctcgggattgagcaggatctggccaagcgggatttccgcgagttgatcgagttggattatttccgcctgattgaccagaagatcatcagcgacctcgtgcgggcggtggcagcccgcacggcctcaagcggtaacgtggcgatctgggttcgacagcggcgacaaggccactggtaccgcgaataccggcatctgtacgaggcagtcgattacgccgcccagtttacccacgccctgggcgaggccaaactcgccatggacagcctagccgaaggcgtgcagcgctacagccgcttctggtatcagctcgatcagctctaccgcaagttcacctaccacgtgcgcatgtcaggacaggcgtcgctgatgggcagcctgaccgagcagattgaaaacctctataccaacaactacctgctgaagctgggcgaccgcttccagaccttcgtggatgcggcatcgaagtgggaagccttcccggtgcgtaagcagaaggagtttttcgagtactgggtacggccgttcctgcgcaaggacaacaaggtctgcgtgatcatctccgatgccatgcgctacgaaatcggcgatgagctgctgagcctgatccggcaggaggaccgttacagcgccgaactggaaccggcgctatcgatgttgcccagctacacccagcttggcatggcggcgcttctgcccaacaagacactggcgattgtcgacaacgaaaccggcaccgtgctggtggatgggcaaagctcccagggtacggttaatcgcaccaagatcctgcaggctgcactgaatggccgtggtgaagccattaccgccgaagactttatgcagctggatcgggatggcagccgcgaactgctgaaaagcaacgatgtgctctacatctaccacaatcgcatagaccatactggcgacaagatgcattcggaggggcaagcgtttgaagcggctgagcaaacgctaggcgatatcgtcaggctggtgaagaaactgaccgcggcgaatgccaacaatattctggtcaccgccgatcatggtttcatctaccaacatcgaccgctggacgagagcgactttgccagtgtcgaggcaaagggtgaggtgattctgtaccgtgacaggcgtttcgtgctcggcaaggggcttgctgagtcagccagcctgcacagcttctcgtctgaacagctgggtctttccggggaggtcgaagtccagattcccaagtcgatcaaccgcctgcgtctgaagggctccgggagccgttttgtacacggcggcgcatcgctgcaggaagtggtgatcccggtgctcaagatcaacaagaagcgccagagcgatgtcaccgccgttgaagtggacatcctgcgtggagccagctcggtgattacctccgggcaactggcggtgaccatgtaccaggccgggccggtgacggacaagatccagccgcgtgtgctgcgggctggcatctacaccgaggcaggcgacctgatctccgacagccatgatctgaccttcgacctgagctcggacaacccccgggagcgggagctacaggtgcgcttcgtgctgacccgcaaggccgatgaggccaacggccaggaggtcattctacggctggaggaaaaacacgccgggacttcacattacaaggaatacaagtcgctccggtacttgatgcggcgctcatttaccagcgacttcgacttttaa

SEQ ID NO: 1193 - DNA, 2331 bp, Burkholderia sp.
atgagcgacaccgttttgagtcgcttggctaacgcgctgggcaaggcagcgacaggcaacagccatgcagctgtccccacgacagtcgtactgtggccagacaaggagcggctatgggagtcggtccttgagcgcgccatgacggtgatgcccgagttggtggtactgggctcctaccaacccgagcgacgccgcgggcccgccatatggttgaagtgcgtagttgctcgtagcttgagcattgtgccaactggcgcggtgccagtggtttatctaccgggcgtcagccgtgctgacctgcgcgctatcgaaagctgtgcgcgcgacttgcaacctttggcggagcttcaatatcgtggtgcattttggagccaggccaacgccaaagactggaccccgagcgcctttctaacatcgaagaatggtggtctggggcttaacgtggcgcaggacaaggctacgcaagaagccctcggccaggcgttgaaggctggggtgttgttggaccagcgcgtggacagccttaaggagcggcaaatcaacgccgagtggctttatagtctgctagcgcccaatcccacacgtgacctgcttgtctggttgaacgacccggacagcgcccggagtcggtgggaaggtgttcgatgggacgtcttcgccaagctgtgtaagtcggagtttggcgtcgaccccgtctccgacggagcgcttgtggcggccgagttgttggccaaaactgagggcaaatggaaagcggtcgccgaactctacagggactcgtacaccagctttccaaacgtgttcaacctgctagcgacggtgcagcccccgcagatgggactgtttcctgaccttgataaattggccggttacccgttggctaacgagcagagtgagtccgcgttgcgcattgccctcctggcttgcgctcccatggatgcgcaacaagcgcgcacggcaattctcgacgccgaaaaggagcatggcatccggcgcagctggctatggagccgtatgggtcgttcaccgcttgcggcagcgctggcgcatctgtccaaagtcgcagagcttagcgcgactgttcccattggccaaacgcctgccgagctcgcggcgagctatcagcagtcgggctggcaggttgacgatgctgccctgcttgctctcggttccgtgcacttgaggtccgatgtggacgctgtctcggcggcccttcgcgcggtttacttgccttgggtggaggaagcagctaagcgtctgcaggaggccatcaaggtcgctggcggactgacacccttgtctacggagtcggccggtgaacaaagcgccggcacctgcacgctgttcgtcgacggcttgcgcttcgatgtggcgggccgcctgcgtgagcgtctgtcggggcttggcgagacgagtcttttcacccgttggaccagcctgccttcggtgacagcttccggcaaggcttggtgttcgcccgttgccgctcaggtgtcaggcgccgcggacgctgtggaattcgagcctcgcgtggcctcggacggtaagccgctttccggccacaatttccgcaagctgctggccgagcacggcgtacagtcgttggataagcatgagaccggtgacccgcagggtcgcgcctggaccgagacaggcgacttggaccactacggccacgagcacggtgtacgtttggcgcgcgaccttgaaacccagctggaccaagtggtcgagcgagttggtgagctatgccaagccggttggaagcgcattcgcatcgtcaccgaccatggctggttgttgcttccgggcggcctgcccaaaactgaattgcccaagcaccaagcggaaacccgttggggacgttgcgcggtactgaaagacaccgcccacggtactcccctgacgttcggctgggattggtgcaaggatgtccaggtggcctacgcccccggggtagcctcgttcaaagcgggggatgagtacgcccatggtggcatcagcctgcaggaatgccttgtgccagtactcgagctcaaggtgacggcctccgccacgacagaactgatggtcaccatcaaggcagttacctggaaaggcctgcgatgcgttgttgaagtcgataccacctccccaggattgaaggtcgatattcgcactaagcctgcgctggcaaacacgtcgttagcagcgaatacaaagtcggtcgacggcggcaaggcaaacatagccgttgacgacgatgaccatatgggctcagctgccgttgtggtagtcctcgggccgaccggcgaggtactgcagaagcaagcgaccacggtaggcggatag

SEQ ID NO: 1194 - DNA, 2619 bp, Burkholderia gladioli
atgactagcgcgccgcacacgtttttaccggcgctttcgcgcctgctggccgaagggcattcgctggtcttctggaacgacgccgagggcgagttcgcctcgcagctcgacggcgtcgagctcgacggcgttcgcgtcgtgcggctcgatcaagtgccggccttgcaagtgaaaatttggatcgagcaagagaaggacgctcggtggctgttttacgcgccgtttgccgagcccgagcccgccgccgactggcttctcgacgcccggctgcgcggcaaggcgttcagcgcggacacagcctccattcagctcgacgagctgggcttgaccacgcagtcgctgcgcgcgcacctgaaacatcgcgcgaaattcttgcgcgcgcgcgagcggctcgaacgattgaagcgctggagcgatccgcaggacacggccgaagacctcgaccgcaaaatgctggccgtggtcgtgcgcgccgagacgcccgacgcctcggccattttgctcaaggttttcgcggggcttgcgatggaagcggacgatttgggcgccacgcccaaggcgttggcggacatcgccaccaacgaccttgacgacgccttctggacgttggtcgaacgcgaaatgggctatcgggaggccgagcccgaagcgcgctgcctgcggggcctgctttacgcgatcttcgccacggacttttgcaacggcgtgcgcgcgacgcccgcgcccatggcgcacttgctcatccgcgagcgcgctcgagccgcccacgcgtcggtgttcgcgaaccgttggcgcaaggacatggcgaactacggcagctacgacacgctctcgaagctggtggccagcgacctgcgggtggatgatttgattcgccccatgagcgccgaagggctcgtcgacgcgatgacgttcgagcgcgtggagaagcgggtgattgcggaccttaaaggccgcatcatcgccggcggcggcgccaacatggattcgatccgcgcgctgatcggccggcgacgcgacggccactgggcgaacccgctgctcgcgggcgccaacgactcgacccgggcgctggcggcaagctacgacgcgttggaagcggcggccggtttcttcgagctcaaagcgaagcgtggagccgggttcagcttccccgacgcgccgacggcgtttgccgcctatcggtccgagattttccagttcgaccagctgtatcggtggttcatgcgggcgacggaatcggtggagccgatggggtgggcgctcctgcacgagctgcgcgatcggatggagggcgcctattccggatggttcatcccgcaactggcgtcggcctgggcctcggtgatcgaaggcgagggcggcttgctgagcgcgtggacgctgcccggggtggtgaaccagcaggcgttttacgctcaagtggtccagccggagttcgacagcgccaagcgcgtcttcgtgatcatttccgacgccttccgctacgaggcggctgaggagctcacgcgcgacctcaacacgcgcaatcgggtgaaggcgcggctcgacgcgatgctcggcgtgttgccgagctacaccacgctcgggatggcgagccttttgccccacgaacgcctggcctacaagtccaatgcgaatctggacgtgatggtcgacgcgaagccatcggccacgctcgaacagcgttcggccgtcctcgcccagcacgagggcgtggccattggccgcgacgagttgatggagaaagggaaagagcgcggacgcgagttcgtcaagccgcaccggctcgtctacatttaccacgatcgcatcgacgcgatcggcgacaagcgcgcgaccgagacaaaggcctttgaagcgacggcgcagaccatcaaggagctggccgacacggtcaacttcatcgtcaacagcctcaacggctcgacggtgatcgtgacggccgaccatggctttttgtatcaggagtcggcgctcgaagaggccgatcgatccgtgctcgacgccgagcccgagggcgcgatcaagtcgaagaaacgctacatcctcggtcgcggcatggggagcacgcccaaggcctggtgcgggtcgaccgagcgcacagccggcaccgatgcgggcgagggcagtgtcgacttttgggcgccgaaagcggccggccggttccattttgccggcggcgctcgattcgtccacggcagcgcgatgccgcaggagattgccgttccggtgatcgtggtcaaggagagcgagtcggagaaggttcgcagcaagtcggtggaggtcagtcccctagggtcgagcaaccgtgtggtgacgaacaaacaacgcttcgagttcattcaaaatgaagcgatctcggagcgcgtgctgcccgtcacgttaatattctccattcgggacggcgacacgccggtgagcgacgagcaggcgatcacgttcgacagcgcctcgcccttgctcgacgagcgcaagcgctccgtgatgctcaccatccaggcgggctcccacgatcggacgaaagattactttctcgtcgcgcgcgacgcgaagacgaaggcggaggcctggcgccagccggtgcgcatcgacttggcattcagcaacgatttttag

SEQ ID NO: 1195 - DNA, 2619 bp, Burkholderia vietnamiensis
atgactagcggccaactggcattcttgccggcgctcgcccggctcttcgccgaggggcattcgctcgtgttctggaacgacgcggacggggagttcgccgtgcacgtcgatcaactcgatttgccaggcgtccgcgtagtccggctggaccaaacggcggccttgcaggtgaagattgatatcgagcgcgaacacggggcgcaatggctcttttacgcgccgtttcctgagcctgcgccctcgaccgattggctgttggacgcccgattgcggggcaaggcctttagagcggacaccgcctcgatgcagctggacgagctcggcttgtccacccaggcgcttcgcggccatctcaaacggcgcgcgaagtttctgcgcgcgcgtgatcggctggatcgattgaagcgttggaccgagcgagacgacacggcagaagaccttgatcgcaaaatgctcgccgtggtcgttcgcgctgagacgcccgagacatcgagcatctttttgaaggtgtttgcgggcctcgcgaacgaagggggcgatctggacgccaccccaaaagcgctcgcggaaattgaatcgaacgagctgatggattcgttctgggcgctggcggagcgggagttcggataccgggaggcgacgcctgacgcgcacagcctgcgaagccttctctatgcgattttcgcgactgatttctgcaacaacgtgcgttcgactctggcgccgttgcagcatttgctcattcgcgagcgcgccctcgcggcccattcgacggtcttcgcaaaccgctggcgctcggacatggtcaactatggaagctacgacgctctttcggcgactgtctccgtagacctgcgcgtgatcgatctgattcgcccgttgggcgccgaagatctgatcgattcgatgacgttcgaagatgtggaaaagcgcgtcatcgcggatctcaagtcgcgcatcattgcgggcggtggcgcgaacatggactccgttcgcgcgctcattgcccggcggcgcgacggtcactgggccaacccgctgctcgctggcgcaaacgactcgacgcgagcgctcgcggcgagctacgacgcgttggaagcggcggccagcttcttcgagctgcaggcggcgcattccgcagggttcagcttccccgatgcatcgaccgcttttggcgcctaccggtccgagattttccggttcgaccagcgttatcggtggttcatgcgggcggcggagtcggtcgagccaatggggtgggcgctgttgcatgagttgcgcgaacggatcgaagacgcctattcgggctggttcattgggcagttgggctcagcctgggcgtcggtgattgagggcgatggtggcttgctgagcacctgggcgttgcccgacgtggtcaatcagcaggcgttctactctcggatggtccaacccgagttcgacaacgccaagcgggtcttcgtgatcatttccgacgccttccgctacgaagcggcggaggagctcgcgcgcgatctcaattcacgcaatcgagtgaaagctcggctcgatgcgatgctcggcgtgttgccgagctacacgacgctcgggatggcgagccttttgccgcacgaacgcctggcctacaagtcgaatgccaacttggacgtgatggtggacgcgaagccgtccgccaccctcgaacagcgctccgctattctcgcgcagcacggcggtgtggccattgggcgcgacgagctgatggagaagggcaaggagcgcggtcgcgagttcgtcaagccgcaccggctcgtctacatttatcacgatcgtatcgatgcgatcggcgacaagcgagcgaccgagacgaaggcctttgaggcgacggctcagacgatcaaggaactggccgacacggtcaacttcatcgtcaatagcctcaatggctcgacggtgttcgtgacggcggaccatggctttttgtatcaggagtcggcgctcgaagaggccgaccgctctgtgctcgacaaggagcccgagggtgccatcaagtcgaagaagcgctacatcctcggccgcggcatggggagcacgcccaaggcgtggtgcggctccaccgagcggaccgccggcaccgacgccggcgaggggagcatcgatttttgggcgccgaaagccgccgggcgctttcacttctccggtggcgctcggtttgtccacggcagcgcgatgccgcaggaaatcgccgttccggtcgtcgtggtcaaggaaagcgagtccgagaaggtccgcaccaagtctgtggaagtaagccctctgggttcgagcaaccgtgtggtgacgaacaaacagcgcttcgagttcattcaaaatgaggcgatctcggagcgtgtgctgcctgtcacgttaatattctccattcgagacggcgacacggcggtgagcgatgagcagacggtcacattcgacagcgcctcgccgctgctcgacgaacgcaagcgctcggtgatgctcaccattcaggccggctcgcatgatcggacgaaagactactttctcgtggcgcgcgatgcgaagacgaaggccgaggcgtggcgcgtgcctgtgcggatcgacttggcgttcagcaacgatttttag

SEQ ID NO: 1196 - DNA, 2505 bp, Calditerrivibrio nitroreducens
atggatatcaaagagaaacttttagataaattttcgaaaagccgtattgtattttggtttgatgaagagggtagctttgaagatgaacttgaaaatatatctttagagggaataaacatccacaaggtagaaaataatgaattttacctgaaatatctaatcgagaaggaaaaaccaacggaaagctttttactttattataatcgaaaacaaccaaagattgaagaaaactggctggctgatatcttgctctattctgaaaccttttttgcagatcataaatttttaatcaaagatgaattaaatattagatttgagaaatttgattctttgtataaagactttaaagcatttttcaaaaataaaaaacgcatcaataaattgaaaacatacctttctgacaatccagattataaagaattatcacttggtatgattgccactgtcataaacgctgagaaaaatgatctggaaaatatactatttaaagtgtttgaaaatggtctggatgaagaagataatgaagcattaaaacagctggaaaagtataatctcgattcgatgttttatataattataaaggatcactttaagataaaaaaagatgaagaactaacgctcttaaaacttgcctttttgtttgtttgctcttatatggtacttacagcaccaaatcttgtgagcctaaattcaattaaagagtattttgatctttttgaaggtaaaggtctacaggtggctggccatttcgtggaagaatggatttataattctaaatataatgacctttattcaaccatttcacaagaagtagacaacaaaacaaaaatatcccaaaagcttaaaaatctaagtcttgaagatttagcaaatatttatgctctggaaaatattgaaaatattatattggtaaaaattttgaatgaaaatctggaaaataatatcgatttttatttagatatcattaaaaaaagagagcaaagtttttggtggggaagctataaaaacaattacttatcccttgagaattatttaagattcgagaaaaccttattattaatgaaccttgctgctgatactgtagaaaatttagtcttgtcttataccaaacagttatatttaatagatacatattacagaaattttattttttattacaaaaatagcaacaatgatttgatctttgactactataagaaaattgagaataaatatcagaatgttatgaatttcttaaattcaaaatgggatgatttgcttacatctgattttatacacaacaatcctaaaaaccaatcgaatttttaccataatcatctcgatcaacatttacaaaagtctgaaagaatctgtataataatatcagatgccttaagatatgaaatcggttgtgaattggaaaataaattatattcaagtagggatcgatttgaggtcagcatggattacatggtagccaatattcccacaattactgctgtaggtatggcctcccttttaccaaataagaagattgaaataaaagatgatggcaccgtgttggtggatgataagcctgcaacaaacttaaaaatgagacaagatttattgaagacatttaatgatgattcattggctctcacggaagaggaggtaaactcttgtacaacatcacaacttagagaattatttaaaggtaaaaatctgatctatatatatcaaaatatgatagataaaataggcgatgattatacctctgagggaaacgtttttgacatggtagatcaatgtctgaattcacttgaaaaagttatcaaaaaacttgtaagctcaggtataatcaatatcattgtaacgtccgatcatggttttatctatcaagactcaaatgtagaagaatatcagaaaatagagtttccgtttgacaaaaaaaacatagtattaaatccaagatatgttttgggtgatagtttaatttctatttcaggcagtcatttttttgaaaaaattgacaatgataaaataaaaagaagcaatatcttgattcctaaaagtaccttaagattcaagtcaaccagcggtgcaggtaaaagatttttacatggaggggtcacacttcaagaactaatattacctttagtaaaaataagatataccaaaaagcaaaataaaaaaattgtagattttgaaatgatatcacccacaaaaaacataattacatcaaataaccctaaattcaaatttttacaatccgaacctgtgagtaacaacgtgttgcctttgaaagccagatttggcatttatgacagtaaaaacaacctattgtcaaactttggttacataaactttgacacaagctctgaagacgtaaatgaaaggacaaaaattcttactcttcaactaaagccaataagctttagcaaagatgatgtctataaattaaaagcttatgatgaagataatgacgttttaattaaagagtatgatttcaagatacatattcttatctcaaatgaatttttttaa

SEQ ID NO: 1197 - DNA, 2559 bp, Carboxydothermus hydrogenoformans
atggaacttaatgaggttaaaaagaaacttgaagaaattttaaataaagagcttacggacggcaggaagaggaatattgttttctggtacgacgataatggagaattcaaagaggatatcgatgctcttaatctttccaatgctaaaatacttaaacttaatggcaggaatagcttttatgtaaaatacattcttgagcgggtggacaaagaaagcaactatcttatttatgctccttacagcaaaccgaaagctcgggagaattaccttttggatatccaaaaatacagctttgaattttctaccgatagagctacaatcatcatgatggatctcaatgttactgattattccctgcacgatgctttcaaaaagtacctgaaatttttcaacaacaaggaaaggtatagagcattcaaggaatatgccttatcttcctataccgaagaaatcctggatattgccgtactgtcggtcctctgcaagctgccctatcccgatttggaagaagtactgaaaaccctgcttgcggagtatgcgtatggtgagtcgactctctatgaaaacatcataaaatttggagatataaatgctttttgggagcttgtcaggaagtactatggctataatctggaacaaaaagacctggagaagctttcaatttttctcctgataactgggttggcattctctctaaagagagatctgcccaaacagtgggagccctttgtgtcaccaaagcaaaccaatgtggttgtattcttaagccattttatgggaggaaacagcactaaaaaggcattcaggcttctttcccaaatggtggaggagaagatcaggcttaaagagtatatcacgaaatgggatgttgacagctataaagacagcgatatcttccgcttatttgatgagggtataatccaaaatattcttgacaacctgctttctgatgtcggcgagtttgacaggtacaaagagataataatggatagaagatcaaagcactggttcgaggactatgagaacgaatataatgctctttactgggcctgcgtattacttgaggaatggaaaaaccagaaggataccatcaaagaataccccccacatgatttcttcaagaagtatacggaagaatattacaaggttgacatggcttacagaaagtttatctatttctttgacagattggataacaaagaatggtttgccgcccttaaagaaaagatagaaaacacctatataaatggttttattaatatcctttcaatcaaatggagcaacagtatcgaaacactgcaggaatactggagtattagttctgtcccatgtcaatgggaatttttccgtgagaagatcaaaccgcatcttaataagggagaacgggtatttgtaattatctccgatgccctgcggtttgaagctggaagggaattggcagaaatgctgaacactgaaagaaggggaaccacggaaatttcggctatgcagggggtgctcccctcttatacaaaacttggaatggctgcgctgctgccgcataaaaaaatagagatagattccgattatgaggtttttgttgacggtatttctgttgagggtaccgataaccgaaacatgatattgcaaaatcatgtgaataaaagcatagcagtccagtataaagatatcattgacctgcgcagggatgatttgcgaaagcttctgggtggaaaagaactgatctatatttatcacaacagcattgacgctagaggtgatcactatctgaccgaaagggaagtttttgatgcggtggcagaagcttttgaacagctgaagtcccttgtcaacaaccttgtaaatcatctttccgcaacccatatttatataatttcagaccatggctttgtctacaagcgtggtagtgtagagaagagtgaaaaaacttccatggataagattgaagatgcgtacgaaaacagaaggtttatcttaactgataagcctatggaaatagaaggcacattatcatttgatatgaagtatcttttaggagaggctacacagcttaaatgcattactcctcggagcacaaacagattcgaattaaaaggtgctggtgcaaattatgtacatgggggttcatctctacaggaaatagtgataccagttatatattttaagaatgagcgcggaaagtccgcaaaagatgttcagaaggttcgggttaccctgttaagccttacaagaaaaataacaaacacaatcacctaccttgagtttttccaaaccgaaaaggtaggcgataaaatggtgccgtgcagactgaaggtttattttgctgatgaagacggcaacagagtttcaaacgaaaatattattattgctgacagtaaatcagagaatcctgaagaaagaaaatttagagaaaaatttgtgctgaagaacatgaagtatgataaaacgaaaaaatattatcttatcctggaagatgaagaagaaacggtagagaacatctatgacaggataccttttaccattgatcttgcaattaccaatgaagattttgggttttaa

SEQ ID NO: 1198 - DNA, 2499 bp, Chlorobium phaeobacteroides
atggaaaaccgcatagcccaggccctgaccaaactctttgaccggcaccggatcgtcttctggtacgacgccaagcaggagttgcgcgacgactttgaggcgttgtcgcttcccggcgtcgagaagctggagctgaccaacaacgagtacggcatcaagtacaagctgctgcgcgagcaaccggaacagaaattcctgctctaccgagaaggccctcagcccgccgatctggataactggctgctggatgtacaactggcccacggcgagttccgcaccgatcaggtggccatctggctgtccgaactggagctcggcctggagttcacggatgtggtgcaggcccatgcggagttcttccaggcgatcaagcgcaaggacgccctcaagaagctgctgaaagcggacgacaccgccggacagattcgcctgaagatgctggcggtatgcaccggcagcgagtcgcgcatggatgcggtggtggaaaacctgctgcaggagctggccgacggccgggatgagaagatcaagctgatcggccggtgcaacctggacggctttctctgggaacagatgacccgctgctatggctacaagtccgatgagccgggcatccgcgacttcaccattgagttgttcaagtcctgctacgccatgggcaccgatggccaggtgaaactgaccggcgacgccatggtgtttctcaagcgctggaaggacagccgtcagttcgaaggcggcttcgagaccctctcgggagaatgcgccgaggtcctcgggattgagcaggatctggccaagcgggatttccgggagttgatcgagttggattacttccgcctgattgaccagaagatcatcagcgacctggtgcgggcggtggcatcccgcacggcctccagcggtgacgtggcgatctgggttcgccagcggcgacaaggccactggtatcgcgaataccggcatctgtacgaggcggtcgattacgccgcccagtttacccatgccctgggcgaggccaagctcgccatggacagtctggccgaaggcgtgcagcgctacagccgcttctggtatctgctcgatcagctctaccgcaagttcacctaccatgttcgcatgtcgggacaggcgtcgctgatgggtagcctgaccgaccaggtcgaaaacctttactccaacaactacctgctgaagctgggcgaccgtttccagaccttcgtggatgcggcatccaagtgggaagcctttcccgtgcgcaagcagaaggagtttttcgagcactgggtccggccgttcctgcgcaaggacaacaaggtctgcgtgatcatctccgatgccatgcgctacgagatcggcgatgaactgctgagcctcatccgccaggaggaccgttacagcgccgaactggaaccggcgctttcgatgctgcccagctacacccagcttggcatggcggcgcttctgcccaacaaggcactggcgattgccgacaacgagaccggcaccgtgctggtggatgggcaaagctcccagggaacggccaaccgtatcaagatccttggccaggcgatcagtcaacgggctaccgcctgcaaggccgatgagctgatggccatgaagggcgacgactgtcgggcgctggtgcgcgatcacgacgtgatctacgtctaccacaaccgcatcgacgccaccggcgacaagcgggaatccgaggagcgggttttcgaggcagtggaagagaccctgcaggagctgattcggctgatcaagaagctgacaggggccaacgccaacaacttgctggtgacctcggaccatggcttcatctaccagaaccgcgccatcgacgagagcgacttttccggagtcgatgccgagggtgaacagattctgttccgcgaccgccgcttcgtgcttggcaaggggcttgccgaggcatccagcctgcacaagttcacccccgagcaacttggccttgccggtgaggtggaggtgcagattcccaagtcgatcaaccgcctgcgcctgaagggctccggcagccgctttgtgcatggcggcgcatcgttgcaggaggtggtgatcccggtgctcaagatcaacaagaagcgccagagcgatgtcaccgccgtcgaggtggacatcctgcgcggagccagctcggtgattacctccgggcaattggcggtgaccatgtaccaggccggaccggtgacggacaagatccagccgcgtgtgctgcgggctggcatctacaccgaggcaggcgacctgatctccgacagccacgacctgacctttgatctgagctcggacaatccccgggagcgggagctgcaggtgcgctttgtgttgacccgcaaggctgacgaggccaatggccaggaggtcattctacggctggaggaaaaacacgccgggacttcacattacaaggaatacaagtcgctccgctacctgatgcggcgctcatttaccagcgacttcgacttttaa

SEQ ID NO: 1199 - DNA, 2562 bp, Clostridium clariflavum
atggacctaaaacaaataaaaacattgcttgaagacacatttaataaagaattaagcgaaggcgaaaaacgtcatattgttttttggtatgacgataacggagaattcaaagaagatatagatgaactaaatcttgaaaatgccaagatacttaaattaaacaataataataatttttttgtaaaatatcaattggaaaaagcagatactgaatccaattatcttatttatgcaccttttggaaaaccaagtcctagagagaactacttactggatatattaaaatacagtatggaattttctactgacaaggctactgtcatcatgagggacttaaatatttcagatgatagtttaaaaagtacattcaggaagtatataaaattctttaataacaaggacagatatagaattttcaaagggtatgaaatagaaaggtacacggaagaaatagtagatatgtctgtgctatcagcattatgcagactgccttatccagattttgacgaagttttaagggtgcttttgatggaagaagatttggagaataataagcacctggaggctatcgagaagtttggaagattagatgtactgtggaaacttgttgataaatattatgggtatagtgataatgagcctactcttgagaaactggctatattcatgctggttacaaatgtagcatattgccttagcggtgaattgcctgatacatggagaaagtatgtttcttcaagaaagactgactgtgtagtatttttgagcaacttcatgaaccactccctttactctgctgcttatgacaggttagcaaacagcattgaaggaaaactgaaagtacatgaatatatcgataattgggaaatggaggactatatcaactgtgacatattcaaagcctttgatgaagcaattataaggaaacttaaagagcaactgctatctgatataggtgagtttgaaaggtacagggatattatccaggccaggaggaccaaacactggtatatcttttttaaatcggaatatgagtgtatctactgggcaatagagttatttgactgctggaaggacgttagccagaatatacggcagtatacccctttggagtttgctaaaagatatgcggagcaatattataaactggatactgcctacagaaaattctatacttctttcgatagactgcaaaacaaggaactgctgatggaattaagagataaggttgaaaatacctatgttaacggttatctcaatacactctccattaagtggtccgacagtctggaaactttaaacgggaattggacaattcccggtatgattatgcagaaagacttttataatgcgtacataaaaccatttaaaaatcgtaaagagagggtatttgtcattatttcagatgcgcttagatatgaggtagccagagagttttgtgatatgctcaataaagaaaggaaaggttctactgagattgtatatatgcaaggctgtataccatccagcactcgcctgggcatggcatcccttttacctcataaatctataacaatagatgaggattataaggtatatgtagacggcatatcttcagaaggaacggataacaggaataaaattttgaataattacagccaggaatcaatagcagtacagttcacggatgttattgatatgaagcgggatgatatgcgtaaaatctttggcggaaaagaattgatatatatatatcataatactattgatgccagaggggacaataacaaaaccgaaagagaggtttttgatgcggtagaagaaacatttaaagaattaatgctgttaataaataatcttgtaaataatgttacagcaacaaatatcattattactgccgaccacggatttatatataaacgtggaaaccttatggaaagcgataaaatatcaaaaggttctattgaagatgcttatgaaaacagacgttttgtattaagtacaaatgctttagaattggatggcactttaacctttgatatggagtatttgcttggacctgataccagccttaaatatatttctccaaggggagtaaacagatttaaagtgcagggtacaggagccaactatgtacatggcggcacatccttgcaggagattcttattcctgtaattaagtttaaaaatgatagaagtaaggatagtaaaaacgaagtgacaaaagttgatgtaaaacttacaagtataaccagaaaaataaccaacaccatatcttatttggagttcttccagactgagaagatagaggataagcgtgttccattgaggcttaaagtatattttgtagatgaagaaaataatcggatatcaaatgagaatataattattgctgacagcaagtcggaaacttatgaggaaagaagtttcagggaaaagtttgtattgaagaacagaaaatatgataaaacgaagaaatattatcttattatggaagatgaagaggaaacagtagaaaagatatatgataaaataccgtttattatcgatatagcaatatccaatgatgactttgggttttaa

SEQ ID NO: 1200 - DNA, 2559 bp, Clostridium clariflavum
atggatttaaaacagataaaaacattgcttgaagatgcttttaataaagaattaactgacgggaaaaaacgtcatattgttttttggtatgatgatgacggagagttcaaagaagatattgattccctggaacttgaaaatgccaaaatacttacattgagtgacaataatattttttttgttaaataccaattggaaaaagcagatacccaatccaattaccttatttatgcaccttttgggaagccaagctcaagggaaaactatttgctggatgtgctaaaatacagtatggaattttccaccgataaggcaactgttatcatgagggatttgaatgtctcagaggatagcttaaagagcaccttcagaaagtatataaaattcttcaacaacaaagacaggtataaaattttcaaaagttatgaaatagagaattacaccgaagaaataattgatgtggctgtactgtcagcattgtgccggctgccttatccggattttgacgaagtcttgagagttcttttgatggaagaggactttaagagcaacaagtatctggaagctatagagaagttcggaaggacggacgtactgtggaaacttgcagacaagtattacggatataccgatcatgaaccggatcttgagaaattggccatattattgctggttaccaatgtttcatattccttaagcggtgatatacctgaaaactggaggaaatacatttcttccaaaaaggctgactgcgtggtgttcttgagcaattttatgaaccactccctttactcggaaagctatgacagattggcaaacaatattgaagagaagctaaaattaagtgaatacattaaaaactgggaagtggaagattatatacgatgtgacactttcaaagtttttgatgagacgattgtaaaaaagcttaaggagcaactggtcgctgatattggggaatttgaaaaatatagggatattattcaggaaagaaggacaaaacattggtataatttatataaatacgaatatgagtgtatttactgggccattgacctgtttgacttttggaaaaggacaggcagtgaaataaaacagtattctccgttggagttcatggaaaagtattcgaaggagtattataaaatagatactgcttacagaaagttttatgtatcctttgatcgcttgagtaacaaggaacttctgatggaattaaaggataaagttgaaaatgtatatgtcaacggttatctcaatacactttccataaaatgggctgacagtctcgaaactttaaaggaagactggaaaatcccaggtatgataatgcagaaggatttttacagcacttatataaagcctttcaacaaccgtggtgagagggtttttgtcattatttccgacggacttcgttttgaggctgcgaaggagttttgtgacttgctcaacagggagagaaagggttcaacggagattttatatatgcagggaagtataccctccaatacttcaattggaatggcatcccttcttccccacaaatccatttcaatagacgaagaatttaaagtatacgtggacgacatagattcaaagggtacgggaaaccggaacaaaatactgaataattacagtaaggaatcattagctgtacagtttaccgatattgtcgatatgaagagggatgaaatgcgaaaattttttagcggaaaagaattgatttacatataccacaataccgttgatgccagaggcgacaatgataaaaccgaaagggaagtttttgatgcagtggaggaagcctataaagaattaatggcgttgataaatgatctggttaataatgttagtgctacaaacattgttgttacttctgaccacggctttatttataagcgtgggaatttgacggaaagcgataaaataaccaaaggttccattgaagatgcatatgaaaacagaaggtttgtattgagcaccaagcctttgaaactggaaggtactatgacttttggaatggagtatttgcttgaacccggctcaaacctcaaatatatatctcctaggggcataaacaggtttaaagtgcaaggcgcaggggccaattatgtgcatggcggtacatccttgcaggaaattcttattcctgttatcaagtttaagaatgacagaagcaaggatcgtaaaaatgaattgagaaaggtcgatgttaaactcaccagcataaccaggaaaatcaccaataccatttcttatttggagtttttccagactgagaaaattgaggataagcgtattccgctaaggcttaaagtatattttgtggatgaggataacaaccggatatccaacgaaaatataattattgccgatagtaaatccgaaaattatgaagacaggagtttcagagaaaagtttgtattgaagaacagaaagtatgacaagaccaagaaatactatcttgttatggaagatgaggaagaaacagtagaaaagatatacgagcggataccttttattatcgatatagccataagcgatgatttcggattctaa

SEQ ID NO: 1201 - DNA, 2562 bp, Clostridium ljungdahlii
atgaatttaaaagagataaaaaatgtattaacagaaacgtttaataaggaacttgactgcggaaaaaagaggcatatagttttctggtatgatgaggaaggcgaatttgctgaagatatagatgaattaagccctgataatgtaagggttttaaagcttactgaaaataatagttatgcaataaaatatgaaattgaaaaagttgataagatatcacattttcttatttatgctaatatgcagaaaccatcaccaagggaaaattatctcttagatattttaaaatatagtactgagttttctacagataaaactactgctatcatgagagaacttggggtaaatgatgatagcttaaagggtgtttttaagaggtatctaaagttctttaataataaagaaagatatgcaagctttatgaaatatgaaatagaaaattatacagaagaaaaaattgatatagcagtgctttctgtattgtgtaaattagatgtttgtgacattgaatcggtgataaaagcattgtttgcagaagaattaaaagataacaataaatatttagaggctatagaaaagtttggtgatgtaaaagcattttggagattagctgagaaatattatggatttaatttagaggacaaaaatttagaaaaattaatattattttttatggttacaaatttgagctatacactagatgaagctataccaagaacttggggaaaatatgtatcttctaaaaaatcagactgtatagtattcatgagccactttatgagtcattctgtagattcaaaaatatatgatgcactttcaaataaatttgaagataaattaaatatacagctgtatataaaagaatgggatattgataattacataaaatgtgatgtatttaaggcttttgataaggcaattataagtaaactagtggaacaactgttagatgatattggtgaatatgataaatatactgaaataatatcagcgagaagaacaacgcactttttcaatgattttgaacaggaatatgaagctataaatgctgctgtggaattgtttaaagttaaaaagaacataggtgaatttataagacaatataaagtccaagagttttttgaaaagtatacaaatgagaattatgtaatagataaggcatatagaagattttatgcagcctttgacaaattggaagataaggaagcattggttgaattaagagagaaagtagaaaatacttatgtaaattggtttgtagatgaattatcagttaaatggtctaatgcaattagtgacgaattacaagataattggaatataccacttattactgagcaaaaggatttctacaatacttttataagacagcacgtgattaaaggtgaaagagtatttgtaattatatcagatgcattgagatatgaggctgcaaaagagtttagtgatatattaaatattgaaagaaaaggctttacggaaatatatgctatgcagggggtaataccttcttataccaaattgggtatggcaagtttactccctaacgataagattgaaatagatgataaagcagaaataatagtagacggcattaattctgctggaacagataatagagaaaaagttttactaaaatactctgagaacagtgttgctattcaatataaagatttaatagaaatgtcaagaagtgaatttagaaaaacttttaatggaaagaaattaatatatatataccataattctatagacgcagtaggggatcatgcagcaacagaaagagaagtatttaatgctgtggatgaaacttttaaggagttaaaaactttaataaatgacttgattaataatgttagtgcttcaaatatatatattacttcagatcacggatttatatataagcgaggcttaataactgaaagtgataagacatctaaaaatgcagaagatgcagcagttgaaaagcggagatttataatcagtgataaaaaacaaaacatggaagggacaatttgtttctctatggattatatactaggaaaagacagcggtaagtatgttactgttcctagaggatcaaatagatttaaggttcaaggagaaggagcaaactttgttcatggaggagcaacattacaggaaattgtagttccagttataaagtttaaaaatgatcgaagtaagaatggaaaatcagatacaagaaaagtagaagttaaacttaccaatatctcaagaaaaattactagtgttataacttacttagagtttttccaaactgagaaggtagaggataaaaagataccagtaagattaaaaatttattttactgatgaagaaggaaatagaattagtaatgaaaatataattattgctgatagtaaatctactaaacctgaggacagaagttataaagagaagtttatattgaaaagcatgacatatgataagaaaaagaaatattacttaataatggaagatgaggaagaagcggtagagaatatatatgagaagataccatttattattgatattgcgatatctaatgattttgaattttaa

SEQ ID NO: 1202 - DNA, 2520 bp, Clostridium saccharolyticum
atggcagagcttaacctaaaacaaattacagataaactcaacgcagaattcgcgtctgatgtacgaaaattgatattttggtacgatgcaggcgctgagttcagctcagatattgaatccatagaacttgaaaatgccaaggtattgaagctggagcgtgataatcagttttatatcaagtatttcttggagcgtgaagatactaccacgaactacttgatttatgctccatttccgaagcctgcccttaaggagaatcatcttgcagatacaattcggtattctaaagaattctttgcggatcgagcatctttattagccgttgatttggggattgatgaaaaatataaaccggtgttgcagcattatatcaagttttttggatcaaaagaaaggactcaaaaattctatgagcttgagattgagaactttaacaagagcatcattgaaatagctctaatgggggttctctgtaagacaaagattgtatctttcgaggaaattgttcgtacagtgatcacggatggtgatattgaagataataattatctcacagagtttgagaaatttgatctgcttaaaccgttttggaagatgtgcgaggagacttttggctataccgatgtctctccaacactcaacaaactagtttacgcgctttttgtaacctatacttcaaaggttatccgaacagagcttcctcagtcttggaagaattattgctcttataagtcgggtaacattattgcttttctcgacagtatgatgaatagtttgatcttcaaggagaactttgatgttttatcagacatggtatatagcacactaaacggtgataccatatttgataagctgaatgtaaatgactactcagatcttgagatcttcaagaagacagacatatttattcttaagtggctgattgatcgacttgagggtgaagatacagcagccaaattgaatgggcactcaataccggagttgtgcagaatgagaagaaaaatgcattttggccagatgtatttttcgcattactacattttggagaatgcatatcatcttataatggcagctcgattcgaaccacaaaaatcatcactcgatatttggaagagctatgttgcaaaggatcatatagttgaccagaaatacaggtatttctattaccattacgatcaattggctaataattctccttatgagaatttgagagacttagtcgagaatatttataccaaccgctacctggatccgctgtcagttgcatggaatagggctttttcagagtgcaaaggggacacgggattaataaagcaacatgagttttataataaatttgttcgacatgcaaaagagcgtgtcgtagttataatttctgacgcactccgttttgaagtgggacagactttgcttaagagacttatatcagacgagaaatgcaatgcatctatgaatgtgatgcagagtgtgctgccctcatatacaagatttgggatgtctgcacttctccctcacaaagagttatccatgagtgaagactataaagtgctcgtggatggtaaagtttgcgatgatttgaagacaagagagcaggtgctccagggcttcatacccaatagtcgtacggtgcaatttgatgacatcaaaacaatgaagattgctgatttgaaggaaatcttcactggacaagaggttgtctatgtttatcacaatcaaattgatgctagaggggataagctgaatactgagaatgaagtatttagcgcttgcgaagaggcaatcgaagagattcacacaatgatcaagagattgaccagtgcaaacaacacacgctttattattactgctgaccatggatttctctataagcgagataaattggctgaaagcgacaaaattggcggctttgataaaaaagatgcctttgtaggtagacgatatgttgtagctcgtgaagctgtaactgcagaaggtattggaaccgtaacattgggtgatatattaggcaatcatgatgaacgcatcatttctgttcctatcggaagtgatatctttaaagttgctggagggggacagaatttcgttcacggcggatcatcgcttcaagaaatactgattccagtcattgatgttaagactaacaaggctcacacagagacaaaagcagtaagtattgctcttgttagcctaattcataaaattacgaacttaacaaccaatttggattttattcaaacggacgctgttactgacgtgaataaagaaacaacatacaagctattctttatctccggcgataatgaaaaaatatccaatgacaatatttatgtggctgataagaaggacgaggatgcaagtaagcgagttttccgattgaagttcacatttaagaacaagaaatatgacaagactagaaaatactatttagtagcttatgatgaaaaaaatgttcttgaagtcttaaggcatgaagtacaaatggacttggcttttgcagatgactttgggttcaatctttaa

SEQ ID NO: 1203 - DNA, 2523 bp, Clostridium saccharolyticum
atggcagaattaaacctgaaacaaattatagaccgcctgaatgcggaatttaccggggagacccggaaactggttttctggtacgatgacaaggcagaatttgccgaagatatggagacggttgagcttcagaatgcgaagatctaccatctccagccggataaccagttctatacaaagtattttctggagcgtgtggataagaccacgaattatctgatttatgcaccgtttccgaagccggatgtaagggacaaccatctggaggatacaatgctgtattccagacggttctttgctgaccgtgcctccctgctgtcggttgacctcggtatcgaggaaaagtacaagccggttattgagaagcacatcaagtttttcgccaataaagagcgtactcagcggttctatgatctggaaatcgaaaacttcaatgaagaaaatattcttgtcggtctgctgagtgcagtctgcaaggcgcgtacctgctcttttgaagaggttgtgcgcatcatgttgacggatggcgagttggtggacaatgctttcttgcaggagtttgaaaaatacgatctgctgtctgcattctggcagctctgtgagcagcatttcggatacactgatacaaagccgagtctggaacggctgctggtaacgttgttcgttacttatactggtcgatatgtgcaggcagagcttccggcagcatggaagagctttgtctcctacaagtccggtaatatcatcgcatttctcgatagcctgatgaacagcgtcctgtatcgggacaaatacgatgctctgtcggcgcacgttgccaaagggatgaatgttctttcggcatttgcaggaatgcgagtggacgatttggtggagtgcgacactttccttgccgtggatcaggtgctggtaaagtggctcattagcagacttgtttcggaagatatcggtgcaatcgtaaacggatttaccattccggaactctgtgaaatgcgggctaaaatgcactttggcagaaagaccgggaaaacctatcagatgctttccagtgcatacagcatggtgaaggaagcggattatcatgccgcagatggcttaaagccaatcatcgaccgatatcttgctgcggattacaacatggatcagcagtatcggaaattctactattattacgaccagctggagagcacggaaagctttgagccgcttcgggagctggtggaaaatatctacacgaacgaatatctggcttgtctgctcccagcatggaatgctggaatccagcaggatgccgcattttcggcaattccgttgcagcgggagttttacaatgccaacctgcgctataccaaggaacgcaccgtggtcatcatttcggatgccatgcgttacgaggtcggacaggagttgtttgccagaatgcaggatgacccgaaatgtacggcaaaactttctgtacagttgagtgttcttccgtcttatacaaggcttggcatggcagcacttttgccgcataagacactggagatgacggatgattttcaggtactggctgatggtatcctttgcgataatctggcaggtcggcagcaggtgctgcaaagctataacccggatagtgtctgtgtacagttcgatgatatcaaaaatttgaaagtggcagagctgcgagatgtgctgacaaaacgtcagattatctatgtatatcataatcagattgacgcgcgtggagacaaggcaaataccgaggatgaggtgtttaatgcgtgtgaggaggccgttcaggaaatcatggacttgattcatcgaatctccgtcagcggcaacacctatcattttatcgtcactgccgatcatggctttatttacaagcgtgataagctgacagaaagtgacaagatttctgggaaaagcgcggaaaaagcatttgttaatcgcagatttattgtgtccaaggcggcactggaagatgacggcatcgaccatatgagcatgggacgcgttctggggaatgaggacagcaaggtggtgtcctatcctgtcagcagcaatgtctttaaggtggccggaggcggtgctaactatgtgcatggcggttcctcaccgcaggaaatgctagtaccggtgctggagtttaagatggaacgcggccacatggaaacaaagaatgcagagattgctctggtcagcatcgtccataagattacgaacctgatcacttccatggactttatccagtcggatgccgtcagcgatactgtaaaagcggcaaaataccgcattttcttcctctcggaagacaatgagaaaatctcgaacgaaaacagctatgtggcggacagtcgcgaggaaaatgcacagaagcgtatcttccggatgcgtttcacattcaagaataagaaatacgacaaggacaagcaatattaccttgtggtttatgacgaagaaagcggtctggagcagtggaggcagcctgtcatcatggacattgcctttgcagatgactttggattcggattctga

SEQ ID NO: 1204 - DNA, 2568 bp, Clostridium sp.
atggcagagcttaacctgaaacaaatcatagaccggttgaatgcagagtttacaggagatacccggaaactcgtgttttggtacgacgataaaggcgaatttgcagaggacatggacagtgttgttctggagaatgctaagatttatcatctggagccggataatcagttttatacaaagagatttttggaacgagaagatacaacgaccaattacctgatctatgcaccgttcccgaagccggatgtcaaagataatcacttggaggacactctgctgtactccaagcggttctttgcggaccgcgtgtccttactgtccgttgatctaggcattgaagagaagtacaaaccggtcattgagaagcatatcaagttctttgctaataaagaaagaacgcagcgattttatgatcttgagattgagaactttaatgaagagaacattctggttgggatgcttgccagcatctgccatacccggacgtgctcttttgaagaggtcatccgcgtcatattgactgatggcagcctggaggacaacaagttccttgtggagatagagaagtatgacctgctttcggcattctggaaactttgtgagcagcatttcggctatacagatccgaaaccgaatcttgagaagctgcttgtcacgatgttcgtgacggccacagaacgggaactgtcgggagaagtgccgcagccgtggaagacctttgtttcctataagtccggaaacatcattgcattcctggataatctttcaaacagtgttctttatcgggatcgttatgatgagttgtctgcgcatgtggcgacaggactgaacctgacgactgcgctttcgggatatctccctgaggatctggtggattgtgatactttcatcgcgattgatcagatcatcgtgaagtggattgtggaaagattgactgctgaggacacaggtgcaaagctggatcgttatgatattccgactctctgtgataagcgttcaaagatgcattttgggaggagaacggaaaagacatatcagctcttatccagtgcattccgtttgatagaagcggcgaattatatagctccggagggatttaagaatattattgaccggtaccggaagacagatcatctgatcgatcaggagtatcggaagttctattacgcttttgacaaggtgaatgctttcgaagaaagcagagagggcggcctgggccgtgcgatggaagaaactagtgcttttgagactctgcggtcattagttgaaaatatctataccaatgagtatctggctaagcttcttccgaagtggaacgaaggcatccaagaagagaatgccatgagtgagatcccgcttcagcggaatttctatcgtaggcatgtcttaaattcaaaagaacggacggttgtcatcatttcggatgcgatgcgctatgaagtgggacaggaactgttccgcagaatgcaggatgatccgaagtgcacagccaaaatggatgtgcagctctctgtattaccgtcttatacaaggcttggaatggcgtcgcttcttccgcataatactctgactatgacggatgacttccgtgtgttggcagatgatgtgctgtgtgacagcctttccggaagacagacggttttgcaaagccatgagacgaatggcgtgtgcgttcagtttgatgatatcaagaacctgaaatccatggatctgcggaatatctttacgggtaagcaagttgtatatatataccacaatcagattgatgcccggggtgacaaagcgaatacggaagatgaagtatttgtggcctgcgaggaagcaattcaggagatcatgtcgctgattaccaaaatcaacggcagcgccaatacgcatcatttcattgtgacggcagatcatggcttcatttacaagagagacaaagtgacggagagtgacaagattggcggtgtgagcggcaagagtgcctttatcaaccggagattcatcgtcgcaaaggatccggtagttgatgagggcgtagaattcctgccaatgtccatcattctgggtaaccaggatccgaagattgttttttatccgataagcagcaatgtgttcaaggtggccggaggcgggcagaactttgtgcatggtggttcttctccgcaggagatgctggttcctgtcctggatatcaagatggaacgcggcactgtagagaccagaccggcacagatcgcgctggtcagcatggtgcagaagatcacaaatctgattacgacgatggatttcatccagtcagacccggtaagtgataccgtgaagattgcaacctataagctgtactttatctcggaggataacgagaagatttccaacgagaacatatataaggcagacagccgtgatccggatgctacgaagagaattttccgcatgcggttcacattcaagaataagaaatatgataagaataagcagtattaccttgtcgcctatgatgatacaaccggccttgaaagcttccgccatccggtcattatggacctggcgtttgtggatgatttcggcttcggtttctaa

SEQ ID NO: 1205 - DNA, 2529 bp, Cupriavidus necator
gtgaccattgccgagttcattagagagtgtgtgctgcgtccgcgtctgaaagaggcggggtgcctggtggtgtacgacgccgataggcgctaccgcgagcagtgctttgatctggcggccgacaaggtgcgcgtggtggacgcagccgagagcagcattgaaagccgtgaggcggcgctgctggcgttgcgggaagtgggacaacccaaggcccctctcgagggtgtgctgatctatgtgccaagcaggcggccagaaacagaagaacaaaagcaggcggacccgttcgcactttacgcggagtgcggcgcggtgttcccgcaagacgatggtgacgagtacttgagcctttgcctgcgcgccaggcctgatcacgccacggagattcgtcaggtgtttgctggatcgtcggctgggccgacgtttgccgtgattgacgcgatcggtggtggagtgagttggccgcagctacgcgccaccctgaaggtcgagtccggccgcgaaattcttgcagctttgttggcacctaacgcagcccaggccgaagcgctgaaaggccaggaagggtgggtgcaagaggcccgcgacttcctacgggcaactttagccatgaccgtgaagacacgtggcaagacatgggcagcactggcagacgagctctggcgctatgtattgttcagcgagtttgtcttcgacttgccaggagcattgccagacaccctgaagggcgtgccgcatgcaccgatggaagcccggcctatcgtcgaggaggtgtgcgaccggctgcgtagcgatccgagggcgcgcgctgtatatatcgagcgggccgaggccattgaggcagagttgaacctgtccgagctgtgcggtgccattgatgacctgggcgagcgggacaccttcccatttgaggaacgaactttcctgcgcacggcgatcaagggcgtcacgtccaatgacaccgacgccgcgcgccgtgtgctggcgcgccacaagaattcagtatggcgcggcaagggcgaaagtcaggcgcagtgggagttggtgcgggctggactcagcctggtggaggcctgcgaggactacgagcgccagctaccggatcacgcccgatcccaagccgatctgctcgacttctacttggggagtctgcgcgaggcggatcgacttcaacgtgagtttgaacaagcggtcggcgattttctcgatcaacacggcttgatgcacgaagtgatcagccaagcgcgagcccgttatcgccgcctcgcggaaaaggtgcagggagtgttcgtaaaacacgtcgagaccgccgggtggccaccgaccggtcgcatggcgaatgccgatgcctttgatcgcttggtggctgaccggctcaaggaaagtggtcgcaaggtcgcctacctgatggtcgacgccttgcgctacgagttgggtgtggcgctcgaaaagctgcttgccgaagacggccccgtcgaactgcaagctgcctacgcgcagttgcccaccatcacgctggttgggatggcgagtctgctgccaggggcaaacgccaagctgacattggcactcgaaaatgaatccctgatcccgaagttggcgggggcgccggtaggtaacgtgaaccagcgcatggatgcgtttagaaggcgcctcggtgaccgcttcgatgagatggtgctgaacgatttcgttcgcggaaaagcaaaaattgcggaaactgtcgatctgctggtgctgagatcaacggaaatcgacagccatctggagagcaacccggagacgacgctcagcctcatcccgggcactctcaagctgatccgggtagctctgcacaaactgcgtggcatgggtttcaaagaagccgtgatcgtgacggaccatggtttctttcttaacgcccaagcggaggctggtgacgtctgcgtcaagcctcagggcaagtggccggttaatgcacatgaccgcatgatgctaggtgagggtgcggcggatagccacagtctggtcgtcagtgccgagaaggttggcattcggggggatttcgcacaggtggcgatgcctcgtagcatggctccctaccgatccggtcacctctatttccacggcggggcatcgttggcggaggccgtcgtgccgttgctgattgctcgcctcgatgccgccgaacagccagagctgcgcaaggtgaacgtcgagctgtcgtacaagagcggcgccaaacgaattaccacacgagttcccgttctcgaagtcatactggtctccgaagatatcttttcacaggggatgagtgtcgaaatcctgctagaggcccaggacagcaagggcaatgtggttggtgagccacgtccaggcggtgacgtgaacccggctacacggactgtgacgttgatgtcggggcagcgcaaacagattgcactgcgaatggaaccggatttcgagggcaagttctcggtaaaggcgctgaacccaacgaccttggcgagctactgctcgctcaatttggaaacggattacaccgtatga

SEQ ID NO: 1206 - DNA, 2508 bp, Cyanothece sp.
ttggatctgaatattaaacaagccttaaataagctttttgagcgtcaccgtattgttttttggtatgacaccgaaaaagagttacgttcagatttcgagagattagaattagagggcattgaaaaaatagaaataaaccataatgaatttggactaaaataccgaattttaagagaacaacctcaacaaaaatttctgctatactatgaaggcaaagaaccagaatatttagataactggttattagacatacaattagcacaaggaaaattttgcactgatcaagtttctctttggctaactgaattagaattaggattagaatttggggatgtcgttcagcctcatcgtgagttctttcagtctcgtcaacgtcgagaagccctaaaacaattactccatcctcatgatacaaaaaccaacattcgcctcaaaatgctggctgtttgtactgctgccgaaccgcgtttagataccattttagaacgactcttagaagaatacgcccaacaacaagacgaaaaaattaaactttgcgatcgcgctggtttaactaaatttctttggcaacaaatggaacaagtttatggctatcgttcccaagaattaagtatcaaagactttgtgatagaactctttaaatcctgttatactgccgccgtagaaggagaaggaacactcacaggagatgcccttatttttctcaacagatggaaagatagccgtcaatttgaacaatcttttgaaagtttatctcatcagtgtgccgacattcttaagattgaacaaaaactcaaccagcgatattatcaagacctgatcgaaatagattattttcgcttaattgaccaaaaaattattcatgatctcgttcagttcgttagcaatagaactattgcgactcatgatgtaacaaatattgtgcgtcaacgcaaacaaggccactggtatcgagaatttgaacatttttatgaagccattaattatgcctcacagtttattcaagtcttagatgaagctaacttatcaatcgaatcgctaacagatggtttagaaaaatattgccaatcttggtttaaaatagaccaactctaccgtaaatttatttaccatgtgagtacctctgctaatcctaccttaacagaaaaattaactgaacaaattgaaaacctttatgccaatcactatcttttaaatcttaataattattggcaagtcttgattgatgatattaatgactggaataggatagaatttccttcacaaagagcatttttcagcaaatgggtagaaccgtttctgaaaaaagataaaaaagtttgtgtcattatttccgatgccctccgctatgaaattggggatgagttagtcagtttaattcgtcaagaagatcgttatgaagccaccctaaaagcggctgttaccctgttacccagctacacccaactaggaatggccgctctttttccaaacgagacgctagaaattgtggatcatcctaatgcgattgtttatgtggatcaacaaagctcccaaggaacagaaaatcggggtaaaattctcgaaaaagcctttcaaaagagacaaaaaaaagcaacagttattcaagccaaagatttattagagttaaaccgtgatgaaagtcgttccctatttcgggatcatgctgtggtttatgtttatcacaatcggattgatcaaattggagataaattagcaacagaagaacaagtttttgaggcagttgagaacactttttctgacctcattaagctcattaaaaaactgacaggggctaatgccagtaacttattgattacggcggatcatggatttatttaccaacatagtgcgatcgcagatagtgatttttcgatggtggaagtaaaaggtgataaaattatcaaagaaaatagacgttttgtgattggggaaggactaaaagattccgatggactcagaaaatttaaagcccaagagattggtttaataggagaactagaaatacaaattcctaaatccattaatcgtttgcgaatcaaaggttcagggagtcgttttgttcacggaggcgcaagtttacaagaaattattattcccattgttaaagttaataaaaaaagacgaggggatctttctacggtagaagtagaaattatccgcaactctacttcaagcattacctctggacaattagctgttactttctatcaacaagaacccgtcaccgataaagttcaacctcgtattcttaaaactgggatctatactcaaacaggagagttaatttctgatctccatgaactgacttttgattctccatcagagaatccgagagagcgagaatttcaagtaagattcatcctaaccagtcaagcgaataatattaataatcaggaggtattattacgattagaagaaaaattaactgatacttcccattttacagaatataaatccgtttcctatacgatccgtcgttcctttaccagtgattttgatttttaa

SEQ ID NO: 1207 - DNA, 2526 bp, Dehalococcoides sp.
atgaaattcacttcgttcctgcataaaaaactggccgatcttctcaacgaccgccgtattgtggtctggtatgatgcccagggtgatttcaaggaattcgccgcgtcattcggcgcaccgaactgcgaagtactttccgctgatgcgtccgtcctcaaaatccgccgccgggctgacgaggtctatcggctgatgaacgaatctgaggattcatcggaacgagaaagatacatgctcatttacattcctcgaggtcgtggcgttaccgaggatgagaagatgcgggacccgttcgaggtatacgcgattgcaggtgtagctttcggagacaccgaggatcagaaaatcgaatccctcgcacggcaggcaatgccgaacaaagccgaagagatcagccggctgttccgggaagggaacccggacatcgctctacttgacgaattagagaacacacagaagtggccggttctaaacgaagtgtttcacaccgaaacgccatcggacattgcagcactcgccctctgcaatacagtcaaagccgaggaggtggacagtagaccaggttgcatagcggaacttttgcgattgtttgaggacgtgtttggtttcaagacatcggaacggcgcaaatggaaaactctccggcccaaagcagccgaatatatccttatcagtgagttcctcttcgatttaccggacaggttccctgaagcactcagcgcggtgcctcgtgccagcaatgatgcaaagtctaccgtttatgcagcgtgcgaccgaatgcgcgccgacttaggtttacaggaaacctatatcgaacttgcgggggcgatagaggattcacttcatctttctacaatattgccaggagatcttaaactgggtgggagagatacctttccattcgaggaacggcgtcttctaagcagagcggtaacccacgtcgttttcggagacgcgaccgcagcccgcatagtgaatgaacgccaaaaacactcaatctggcgacacgatcctcagagatcgctggcgtggacagttatagaacgagcaaccgtactgatcgaactatgtactcttgtttcacacggactctcaagcaaaaaggaactcgtaggtttaatcaaggcatatactgaatgcggttggtctaacctcgaccgcgcttcccgattgtttgaagcagctctgactgcctgcccagatgaagacattatcgaaccgatcatcgacccttgccggcgccgataccgcgaggctgtagtgcagctgcaagataatctccttatggcagttcaggcggagggttggcctccggatggagcaccccggcagacccgcatattcgatgaccttgtcgccccactgttagagcgccgcaagaagaccgcctttttcatggtggattcattacgttacgaaatgggacgagatttagccgatgccttggccggcacgggaagcgtcgagattaattacgcggctggcactattcccacagtaacaggttgcggcatggcagctcttatgccgggagctgatggcatgcttaggcttgtcgcgaaagatggcggattggtcccggctgtgggtaatcgctttttgaaaacgtccgcagaccgtatgagattcctgtcagaaatttatggcgatcggtttttcgagacaacgctggatgagatgcttggctcgccgaagaaaattgccgcaaatattaagaatgcggaactcttcgtggttcggactcaggacccggatgccgtggctgaaaacctcgggggatggcgcgcgcgtcgatacctctcagatgtggttggcgatattgcatctgccgtgcgatggttggcatcccaaggatacaatcatatcgttatcagcgccgatcatggccatatgatgctacctgagattcctccaggtgatgtggttcaaacaccgcccggtggatggctggagaataaacggcgatgccgattaggttcggggttagctggggcagcgggaactatcacacttaaagccagtaatttgggaattcaaggggatgtgcacgacgtttgtctgccggttggattccgggttttctccgaaggcgagggttacttccatggtgggctaagtcttcaagaggctgtggtaccggtcgtcgtattccaggcaggagcggaaaagcagagcacagcaggcaaacccgacatagatatcctttaccgatcagacaaattcacgagtcgggttatcggactgaaattccgtctgcagggagacatgtttggcacggccaaccgcgtgcgaatcgagtctttcgacggcccagggattaaggcaaaaattattggagaggccgcagactgcgaagctcgtgatgaaaaaactcatgaagtgtctttacaggcggggaaagaaacacccgttccaatattaatcgatccggatttcgatggtccagaggttgaaattcgagtcagcgatccagagacccgagtcgtatgggcgaaattgaagctgaaaaatgccatgctcgattaa

SEQ ID NO: 1208 - DNA, 2523 bp, Dehalogenimonas lykanthroporepellens
atgacgattaaacagtttatccaggaagaggtgctgaggccgaagctgaagaaggccagcgttctcgtcgtctatgaccctgagcggcgttaccgggacctctgttgtgaaatggtcgctgacaaatgtgccgtcgttgatgccacggagagcagcattgaaagccgcgaacaagcacttgcgttgctgcaggagcttggaaagccaggggcaatgttcgagaatctgttggtctatgtcccggcggcccaacctctgaccgacgaggatcggcagcaggacccctttgccatctatggtgctgttgggaccgagttccccgagggggacggcgatgagtatcagagcctttgcctgaaagccaaggcggactacgcaacggaaatccgccggatctttgccgacaaccccaacccgacttttgacgtgatcgatgccgtgggtggcggtgccggatggccgacgcttcaggcacatctgaaggtggaatcggcgcgagacatcctcttcgccatgctggctccgacggcaaagcagttggagtctttgaaatccagcgacgcctgggtgccggaaatcaggactctgctcaccaacaccttgggcctcaagctgaagaccaaaagtaagaattggtcccccattgctgatgagctgtggcgctttttgctgttcagtgaatttgtctacgatctgccgggaacgcttcccggtgcgttgtcggatgtgccctgcgccatgacagaagcccgacccttgatcgaggatctatgcgaccggctgagggactcgacggccaaccagcctctttatatcgaacgggcggagacgattgaaaccgaccttggcctgcgcgatgtgtgcaaggacctcgaggatttaggggttcgcgacacgtttccgtttgaagaacggtcatttttcgcccaggcagtggatgcactgaagcgcgataacatcgacaagctgcggcagatgctcgggcggcacaagtcttcggtctggattggacgcggggagaaccaggcccaatggcagctcctccaggcagcagtgagtttggtggaagcctgcgaggatgcggatcgtcagctgcctgaccatgccaaaactcaagaggccttgatcgatttctacacctccagcatgcgggaagttgatcgcttgcagcgggaatttgaacaggccgaacgtgatctgctgatcaaacaggacggggttgatgtggtgattcctcacgcccgcacggcctatcgcaaactggtcgacaaggtacaaggcgtgtttatccggcatctcgaacagtctggctggccgcctgccggtcgcctggccaattgtgatgtgttcgacaaaatggtcgcgcccaagctgcaggagagcggtcgccgggtcgccgtacttctcatcgatgccttgcgttatgaactcggggtggaactggagaagcagctggttgatgacgggcaggtggagatgcacgccgcgtttgctcagcttcccagcataaccccggtcggcatggcgagccttttgcccggcgctggcagtgaattgaagttgattcgcaaagaggatcaggtcgttgtggcgttaggggagcagtcgttaccacaggtgacgcagcgcatggatgtgctcaagaaacggtttggagatcgctttgccgagatgtcgttgaccgagtttgttcgtggcaaaggcaaggtcgatggaggcgtcgagcttttcgttctgcgcagcacaaccatcgatcagcatatggaatcgacgcccgagatggcgttgcggcttatccatgagtcgttgaaatcgatccgggtggccatccataagctgcgtggcttgggattcaaggatgccttcgtcgtgaccgaccatgggttttatctcaatacggccacggaagccggagacgtgtgcgcaaaaccgcaggggaaatggatcaacgtccacgaaagatgtcttctgggtgacggggtttccgatacaggaaatttcgtcatttcagcccagcatctgggtatccggggggacttcaaccagattggcggacctcgcgccatggttccctatcgtgctggcgagtggtacttccatgggggcgcttccttgcaagaggccgttgtgccggtcatcgcagtaaggatgcaagagcctgaaggcaagtttgtcccgcaagcgaaaatcaccctcaactataaacgaggtgcaaccaagatcacgacgcgtttgcccgtaatcgagatttcggcgagttctgcggatctcttctcgatgagtgcgacattcgagattcttgttgaggcccacgacaagcaaggcaatgttgtgggagagatcaagctgggcggcatggtcaatcccgcgacacgcaccttgtcaatcaagcccgggcaaaacattgctgttactttgcgaatggaccttgaatttgaaggcagcttcacggtaaaggcattggacccggtgactttaacgacttacagcaagctggatcttgagacggattatacggtgtga

SEQ ID NO: 1209 - DNA, 2613 bp, Desulfitobacterium hafniense
atgttgtcagaaacgataaaatcaaggcttgcggagcggttcgccgctcccttgactgaattccataaacgccggatcatcttttggtacgacgaagacggcgagtttgccgaggcggttgaccagttggctcttgatggcgtaacgctcgtgaaactcacgggcaaaaacaacttcgctgttaaaaagctgcttgcggaagatgacctcacaagggactacctcgtttacgatcctctcacctatgagaaagatcaacgggatgactggctccttgacattaagctgcatagcgaggagttccgcgccgacctcatttccatccagatggaggaactgcttgtcgagccgacctcggctatgcgcaagaccatgaagctgtacgccaagtttcttggcaacaaagaccgtaaggcgaaactccgcagaatcgggaagtcataccagactccccttggtctgcatatcgacattatggccgtgctgtgcggactgaacggcggtacggcgcaagatgtgatcatcgccgtgctgtcggcaggtttagataaagaaaataatgccccccttgccaatattgagaagtttggcagtatcgaggcgttctggcagttggtacaaaagtacacgggatacgtcaatggagacgcccgcccgctatctgaccttgccgcgcatattttaatctcagccctgtcccagacgatatcgaattccgcattgcgcggtttggagcggtttatcacggattcctgcaaggcttactgctatcagctggtccacgaatggcagcatgaaaaccactcactaacccctgctcccgattccctaaccctaatcgacatttgtcgccacatcgagggcgagcttcgtctagctgaccgcttcgacaagatagagataagcttactgctaaaaaccgacgcgttccctgcaatcaatgagagtatcttgaagcgtttctatggtgaaatcggtgagcgcgtcatcaaggttgattctattcttgaagcggtggaaaaccgccgtacttcggggtggtacaatctaattggcaattatctcgaaagcctgtactatatcgccaagatgcaggaattttaccttgcccatattgagggctttcacttcgtggagcctgcgaagatctggaaactctataccatcgacgcttaccagatggacagtcattatcggcattttcattactatttcggcaataccctgaaagctcccaacgcactcctggaggaccccttaaagaagtgttctgatgtggttgagggcttataccaccagtggttcctgaaagaactcaccttgaattggaccaatgccatagcggacgatttggattccctcggctatgtttctgaagtcaataaacagcgggatttttaccgcagatacgtcttcccgaacgtgagcaagggtaaccgcgtgtttgtggttatttccgacgccctccgcttcgaagtcgccgctgaactctccgaagttctcagccatacaaccaagggcaaagctacacttgaggcggtgcaagccgtgtttccaagcattacaaagttcggcatggcagctttgcttccgggtaaaaaactgtctgtcagcgacaaaatggaggtgtccattgacggcaatttgacgggaagtacggctaaccgcggttctattctgagcgcagcaaatcccgacagcgtggtcgttacttataaggacttactccaaatgaagaaaacggagcgccgtgccttggtgcatggcaaggaaatcatttatatttaccataatacaattgacgcctttggtgacaagttcgctaccgaaacaaaggtgttcgaggcttgcgatgcagctatctcagaactgaatgctatcgttaaaataatcgtcaatgaccttagcggcattaatatctttatcactgcagaccatggtttcctctacactcacaaaccccttgaggagagtcagaaaatcagtcgccagaactttaacggcgagatatacgaaatcggacgccgttacgcacttgtgccgcctgcaacatctgctgactatctcttgccggttaagatggagcgtgaaattggcggtatcccgctgaaaggctatgctccgcaggatactgtccgcatcaaagttcagggcggcggtgagaactacgtccacggcgggatcagcttgcaggagatggtcgtaccggttatcgtttacaaaggtatgcgctccggttataagcagtatgtggaggttcagaatccggggctatcgttgatttccgagagcagaaaagtctccaacttgattttttcacttgacttcctacaaaaacaacccgtgggcgaaaaggttcaggcctgcggctacacgctgcatttttcagatgacgtgggcgttcccgttagcgatactcagacggtcatcgctgacaggacaagcagcaacgcttccgagcgcgtattccgagtgaggtttacattaaagccaatgcagttcaataaaagtaaaatctatcgcctagtcatcgccaatgatacagacatgccggaagagatcgagttccgcatcgacatagcatttgccgatgactttggctttgatctttaa

SEQ ID NO: 1210 - DNA, 2496 bp, Desulfobacula toluolica
atgacgcagataatcaaatcccttgaaaaaatatttaaaaaacacagaattgtcttctggtacgatgcaaaaaaagagttacgcaaagattatgaagaacttgaattccaagacattgaaaaaattgaattgaacaataacgagttcagggtcaagcatcgaatccttcgggaagaaccggacaagaagtttcttttataccatgaagcagaggccccttcagatctggacaactggcttttagatgttcaactggcatttggagaattcagggcagaccagtcagccctccggcttaatgaacttggtctgggcattgaatttgtcgatattgtcaatgatcatgctgtgttttttaacgccgctaaaagaaaagaaaaattaaaaaagatccttgcgtccgatgacacacaaaatgctgtcaggataaagatgcttgccgtatgtgcagcatcagagccacggctagatgatattcttgaaaatcttctttccgaatctgccgttaaaaaggatgagaaactaaagcttattgaaaacagtggtcttgacgcatttttgtggaaccggctggaattgagttttggttatacatctgattcacccgggattaaggattttacgattaggctgtttaaatcatgctacgacatgagtctgggcaatgattcaaatcttgttcctgatgcattggtatttctcaaacgctggaaagacagtgttaaacatcagaaggcgtttgaaacattatcaaaagaatgtgccgatatcctggccattgaaaaagatcttcagacaagagacatcgcgtctcttgaggagattgattactttgaacttgtggatctgaaaatattaagcgatctggtcaagagtgttgtggatcagactgtttcatccggtgaccgggaacgcttaatcagaaaaagaaagttaagtcactggtacaaaacatacaaagctctctaccaggccattgattatggggcacggttcatcaaatttctggatgagactgaatttgccatcgaatccatggatgatgggctaaccaagtatgccaattattggtatcgccttgatcagctttatcgtaaatatattttccataccagacaatcgggccaggtctcaatgctcaaggcgctctcagataaggttgaaaatatgtattccaataattatctgctgacggtcaataataattggcagaatcaggttgataaatgtgactgctggggcaaaacccgtatagaatttcaaagacacttttttcagcaacaggtggtcccctttcttaacgacaaaaaaaaagtgtttgttattatctcagatgccctgcggtatgaaatcgggcatgaacttctcagccgtatcagacaggaagacaggtttgatgccaaaatctccccaatgctgaccacacttcccagcttcacccagttgggcatggcatctttgttgcccaacaaggacatacggttttcagacaatcattcaaccacagtttttgtggacgggaaaagcactcaaggcacggaaaacagatcaaagattctccagaatgctgtaagcggagcagccagggccatgagagcggatgaactcatgggaatgaataaaaccgaatgccgagaactgtttcgggaacatgatgtggtttatgtctatcacaatctgattgatgacaccggagacaaaaaagagtcggaaggccgggtttttaatgcggctgaagatacccttgaggcgttaataaaaattataaagaaactggtttcagccaatgccaccaatcttttagtgacttcggatcatgggtttatctatcaggatcgggtgcttgaagacagtgattttcttggcactgatatctccggcatagaggcgttgcatcgtgacaggcgtttccttcttggtaaagacttgccacagagtaccggcatgaaatgctttactgcaaaacaagccggtattgaaggtgatatggaaatccagatacccaaatccattaacagattacggttaaaagggtctggctccaggtttgttcatgggggggcaacattgcaggaagtggttgttcctgtcatcaatatccataaaaaacggacgagtgatatctccaaagtgggtattgatatctttagcggatctacatcgtttataaccaccggccagttcgcagtaattttttatcaggctcagccggttacggataaagttcaatcaagatcattgcgggccgggatctattcaaaaaataacgatcttgtttcagactgccacaatctgaactttgaattcacttctgaaaatccaagagaaagagaattaaaaatacggtttgtcctgacccaaaaggctgatgaccagaatgaacaggaggtctatttgcgccttgaagaaaaggagccgggaaccgcttactttaaagaatataaatcagcacgttatgtgataagaagatcatttaccagtgattttgacttttag

SEQ ID NO: 1211 - DNA, 2334 bp, Desulfomicrobium baculatum
gtgcctaacatcctcaaggaactagccaatacaatccgtagttcaggcaatcacaacccagaaatccagacacctcccgtctgcatcctttggccagacaaagaaagacagtgggaaggaatcattctgctcctgcttgatgagcttccggaactattcatccttggagactactcctcggacaagaggactggcccggccatctggctacgttgtgtcctggctaatacattatccaacatcccaaggccgttaaatcagacgccgatcctgtatcttcctggtgtaagtaggcaagacttgcgcgctgttgaaaattgtccggaacacctgaaaccacttgctgagttgcaataccggggaacgatctggaatcaaagcaatgcaaaggactggaccattctcgcctttctaagatcagcccaagggggcttgggcctagacgttgcccaagacaacgacaccaaacagtctatgctactggctctcagccgcctgctggatgaagaagtcgagccattaaaaaacaaacggcttgatgccgaatttttcaaaaaacttctgatcggtgatccgcgtcggcaaattttggagtggatcgaccactcagaaaaataccgaaccaactctagtgaaaacgaatggctggcgtttattgaggtttgccgttctcagtttggcatccatcctgaaaaagacggcccccttgttgcctctgagcgactcgctttgagagaaggtccgtggaaaaccgtgtgggataggttttgcgaagcgcccaacaggtatcctaatatccccgcacaaatcaaaaaatgcaaaatgcccggaaactcgatgctgtggagcatgggcaaagcatcggagtatgaaggctggccacaatggaacgagttgcaagaaacggcgttacgccaagggctattgtcccttgcaaagcatgatgcatccacatgccgcactgaacttatcaagtttgaacagcaccatgtcgcacgccgtagtctggtgtgggcggaactgcgagaagcgtctttagccctagccttagagcatttgatggtaatggcgtcagaaatacggaaatctttgaacgcaggctctctggatgacgtagtccaagcttacctgaacagtgcctggaaagccgacgatgcagttttgtccgcgcttgcatgcgtggaaagcagtgaagatttcaacgccgtgacagtggcgattcgaagcgtctaccttccctggttggaggactccgcccgccatctgcaaaatatttgggaaccaatagcgaagattgataacctttcgtctgatgccgaaagctgcattgtctttgtcgacggtttgcgtgctgattccgctcggcgtttaaagtccatccttgcatcaaaaggtgctgtcgttaaggagcaaattcgatgggctgcattgccaagtgtgacagggacgggaaagccagcagtggcacctttggcctcaaccagtgctgcggagaatccaagttccacagactttcaagcgatgtctccgtatcaattcgagaaagctctcaaagactcaggctggatggtaatccgagccaaagatccgattccagccccaatttgccaaggctaccccgtcgcgtccacggtcaacaaactttgggtggagatcggcaacatcgatcacgaagggcacgaacggggagcgaagcttgcgaagcagctcccggccctcttggcagaagttgccgaaagaatcgaagccctgctttctgcgggatggtctcgcattcgagtagtcactgatcatggctggctcctcctgcctggtggtctgccaaaatcaaacctgcccagcgccgtttctgaaagcaaatggggtcggtgcgccctgataaaatccggtgcaattaccgatcatcgcatatttccttggcattggaatcctgacgagtcagtcgttctggccgatggaatcagttgcttccgaagcaacgaagaatacacccatggtggtttaagccttcaagaatgcttaaccttggacctgattgtatcttcagattctcttcaagaagccgtcaccatcgctgaagtccgatggaaaggcttacgctgttccgtgctagcccaaggcgcattgagcgggcttcaactcgacgtccgcaaatttgcagaagatgcagatacttccctcatcaatcaagccaaacccattgaagatgacggacgcgcttctgtgctgatcgttgacatggacggggatctggacggaacagatgcttttatcgtgctaaccaatgatgcgggcacagtgacaacacaaatttcgacacgaatcggtggataa

SEQ ID NO: 1212 - DNA, 2517 bp, Desulfosporosinus meridiei
atggcagaacttaactttaaacaaattattgacaagcttaatgccgagttcgctggtgacatccgcaaactggtattctggtatgatgagaaagcagagtttgccgatgatattgacacactggaactaaccaatgccaaagtctatcacttggaatcagacaatcagttctatactaaatattttctggagcgcttggatcagacaacaaactacttgatttatgcgccgtttccaaagccctctgtacggaataatcatttagaggacacattactgtactccaagcagttttttgcagatcgagcgtctttgcttgctgtggaccttggcattgatgagaagtacaaaccggtcattcaaaaatatattaagttttttggggcgaaagatcgaacacaacgtttctatgatctggagatcgagaattttaatagagacaccatcgaagttgccctgatgagcgcactctgcaagacccgaattgcttcgtttgatgaggttgttcgtgtgattatgaccgatgacgggtttgaggacaacaagtatcttgcggagtttgggaaatatgatcttcttcctgctttctggcgattatgcgaggaccagtttggctataccgatgttaagcctacccttgaaaaactggtggttacgatgtttgtgacgtatacagaacgctatcttcattgcgagttgccgcagtcctggcgcagctttgtttcctttaaatccggttcgatcattaccttcttagacaatctgatgaacaacgtgttgtatcgtggacggtataatcagatttccgcaaatgtgggtgacgaattgaacgttactgcggtgtttgaatcatatcccccgcaagccctgatcgattgtgacacctttgctgtggttgatcgctttatcatcggttggatcaatgaacgactgctggctgaggatacgggggccaagttgaacgaaatgtctatccctgtggtgtgtcaggagcgacgtaaaaagcactttggagaaagctatgagggtcagtatcaactgctggaaaatgcctattatcttattctagcagccaactaccattgcccggatcaatttatgggtattgtcgatcagtaccgtgcttcggactgcctgatcgatacccattaccgaaacttctacttctattacgatcagctcacggataatgcaccttttgaaaagctccgtgatctggtggaggctatctataccaacgaatacctatccgctgtgattccaaagtggaacgctggatttacaggcgaagaggccctgaccgtgctgcctttgcagtcggacttctttaatcgctatgttcgcagctgtaaggagcgtgtggtcgttattatttccgatgctttgcgctacgaagttggccgctccctctgggtgaagctgcaggaagatgaaaaatgctctgcacagctggaggcaatgataagtgtactcccgtcttatacaaggcttggcatggcggcacttctgccccataaaaccttggaaatgacggaggattatcgtgttctggtcgatggttcgccttgcgatgatctaaaacagcgggaaactgtattacaaagctacgtcaaaaatagccgctgccttcagtacgataacctcaaatcaagagatgttatccggcaggcctttgccggaatggaagtgatctacatctatcataatcagattgatgcccgtggagataaacacaatactgaaaatgaagtctttactgcctgcgaggaagccatcggtgaaatctacaacctcattaagcgcttgacggaagatgtgagtgccactcattacatcgttacggcggatcatggatttatctataaacgggacaagctgcaagagagtgacaagattacaaatattgctgagaaaggctcttttgtcaaccgacgctttattgtttcagatcaggcccttcaggaagatggcatcttctctgtgccgatgagttggattctcaggaatgaagaccccaaaatggtctctttccctatcagcgccaatgtattcaaagtggcagggggaggacaaaactatgtgcatggcggatcatctcctcaggaaatgatcgttccagtgctggacattaagacggcaaagggtcacaaggaaacccgtaccgttcagatcacgctggtcagtatggttcagaaaatcacgaacatgattgcttcactggacttcattcagacggagccagtcagcgatgtggtcaagggaacccgctataagattttctttatttctgaggataacgaaaagatctctaatgaggccatttatgttgcagacaaaaaggagcttgagccccagaagcgaatcttccgtctgcggtttaactttaaaaataaaaagtatgacaagtccaagcaatattatctggtggcttatgatgaaaagaatgacctggaaatccttcgtcatgctgtcgtcatggatattgcctttggagatgactttgggtttaacctataa

SEQ ID NO: 1213 - DNA, 2619 bp, Desulfovibrio magneticus
atggactcagcaaaaattcaggaagccctttccaaaatttacgatatcgaagagtatcgcatcgttttctggtatgatccagaacaggagtttcttgagacgctttcgatgctctccattgaaggcgtcaccgtggtcaatctcctggacgagagtttgttagaactcaaaatccgactggagacgcaagaccgaacgggcaagtatctgctctattccccttcccccgagcctaatccggaaaacgactggctgctggacatcaggctttacagccgaccattccatgccgatagggcttccattctgctcaatgaattagggcttaccagccagtccctgcgtgcgcatctgaacgagcgcaaaaaatttttcaaaagccaggaccggctaaataggcttcgaaaactcgtggtggccgaggataaagagagcgatctcgaccagaagatgcttgccgtgctgactcgttctgaccaggccagcacgttcgacgttctcatgaacctgttctccgaaatgtgcacaggcgtcagttgcgacttcaagtctcccacgtcttcatggggagacattgaaaaattcggggtggctccctttttttgggaaaagatggccatgaccttcggctacgttgccgacagcccaagcctatctgacctcttgatccgccttttggtcagcgacttttccaacaccctgaaggggactattcccggctccttggcgcattttcagtttacggacaagtcgctggccatcaatagttccgtctttatagcgcaatggcgcagccatttaagccattttcgggagtatgccgcgatttcacaagaaattgccacggaactccgcctggaggaacaactcggggggtataatgaggaatccttactggacgtcatgaccttcgaggtggtcgagcggcaggtgcttcgcgctctacgcaagaagatcaaacaggaccagtgggacaaacccgaaagtcttaagcctgttatccaacgcaggcgggatgggtattgggccacaatacagctcgatcagtatactgaaagtggaaatatttataaaactacctacgacgcgcttgaagcagcccttgatctcttaaccctgcgcaaaatacatgatgcagggttcagctttgcaaaagcgggaacgatgtatcaagcatacacctcagagttattccgattcgaccagctataccgactatttcacgaatacgccgacagacttgagttagctggatgggatgtgcttaaggatgtccagaagatcgtagaagcatgttacagtggatggtttttggatcagctttctatctcctggggtagttttctcgatgggcgagacggacttttgaaagaatggtccattgaaaatattcccaaccagcaagattttttttcactcactgcccagccagttcttcaatctcacgccagaagcaaggttttcgtgattgtcagcgatgcacttcggtatgaagtagccgaggaactgaccagagaactcaattccaagttccgtttcaaggctactatctcaactcagcttggtatcttgccgagctatacggcacttgggatggcctcattgctgccacaccgaggatatggatataaagagcaatccgaccaaatacttattgcaggacagccttgtgctacgttagaacagcgcagttcaattctttctaatgtgaatggaatagcggtcaaggcagatgaattgcttgccatgaccaaggacgatggccgtgaattggtgcgtccttggcgtgtggtgtatatctaccacaaccaaattgatgcaaccggtgattccgctcagactgagggcaaggctttcacagctgttcgcaaggcgatagaagaactgtcctccctggtgcgtttcatcgtgaactcgcttaatggtgccaatgtttttgtcacagccgaccacggatttatttaccaagacactcctccatcacccttggagaaaagcgacttggctttcaagccagacggcgtgatcaaggccaagaagcgttatatcctcgggcgggaccttggcgaatccgaaaaggcatggcacggttcgacgcgggtgactgcggggacctccgacgacatggagttctggattccaaagggtgtcaaccgcttccatttttcgggtggagcgcgttttatccatggcggcgctatgcctcaagaaatcgtggtccccgtcgtccaggttagggaattagagggcaaaaccgcagcaaacgaagctgttaagcaggtcaacgtatctcttcttggttcaaaccgaaagattgtcaattctctccaaaaattcgaacttatccagaccgaaaaagtttccgacaggatgacgccaaggacgcttgttgtatcattgcgtgacggggaactacttatcagcactgaagaaatggttacttttaacagttcctctgattcaatggaggagcgcaagcggtctctgacgctcagacttaaaaagggtagctacgacaacaagagggaatactttttggtgttccgggatccaggaacacagatagaatacgagcgcatccccatgaccattgacttggccttcatgaatgatttttga

SEQ ID NO: 1214 - DNA, 2499 bp, Desulfovibrio vulgaris
atgaacgaccgcattgcccaggccctgaccaaactcttcgaccggcaccggatcgtcttctggtacgacgccaagctggagttgcgcgacgatttcgaggcacttcatctacccggtgtcgaaaagctggaactgaccaacaacgagtacggcatcaagtacaagctgctgcgcgagcaaccggaacagaaattcctgctctaccgagaaggccctcagcccgccgatctggataactggctgctggatgtgcaactggcccacggcgagttccgcaccgatcaggtggccatctggctgtccgaactggagctcggcctggagttcacggatgtggtgcaggcccatgcggagttctttcaagcgatcaaacgcaaggacgccctcaagaagctgctgaaagccgacgacaccgccgggcagattcgcctgaagatgctggcggtatgcaccggcagcgagccgcgcatggatgcggtggtggaaaacctgctgcaggagctggccgacggtcgcgacgagaagatcaagctggttggccggtgcagcctggacggtttcctctgggaacagatgacccgctgctatggctacaagtctgaggaaccgggcatccgcgacttcgccatcgagctgttcaagtcctgctacgccatgggcaccgacggccaggtgaaactgaccggcgacgccctggtgtttctcaagcgctggaaggatagccgtcagttcgagggcggcttcgagaccctctcgggggaatgcgccgaggtccttggcattgagcaggatctgaccaagcgggatttccgcgagttgatcgagctggattacttccgcctgatcgaccagaagatcatcagcgacctggtgcgggcggtggcagcccgcacggcctccagcggtgacgtggcgatctgggttcgccagcggcggcaagggcactggtatcgcgaataccggcatctgtacgaggcggtcgattacgccgcccagtttaccaatgccctgggcgaggccaagctcgccatggacagcctggccgagggcgtgcagcgctacagccgcttctggtatcagctggatcagctctaccgcaagttcacttaccacgtgcgcatgtcggggcaggcgtcgctgatgggcagcctgaccgaccaggtcgaaaacctctactccaacaactacctgctgaagctgggcgaccgtttccagaccttcgtggacgcggcaacgaagtgggaagccttcccggtgcgcaagcagaaggagtttttcgagcactgggtccggccgttcctgcgcaaggataacaaggtctgcgtgatcatctccgatgccatgcgctacgagatcggtgatgagctgctgagcctgatccgtcaggaggatcgttacagcgcagaactggaaccggccctttcaatgctgcccagctacacccagctcggtatggcggcgctgttgcccaacaaggcgttggcgattgccgacaatgaaaccggtaccgtgctggtggatgggcaaagttcgcagggtacggccaatcgcatcaagatccttggccaggcgatcagtcatcgagctacggcctgcaaggccgatgaactgatggccatgaagggtgacgactgccgggcgctggtgcgcgatcacgacgtgatctacgtctaccacaaccgcatcgatgccaccggcgacaagcgtgaatccgaggagcgggttttcgaggcggtggaagaaaccctgcaggagctgattcgcctgatcaagaagctgaccggggccaacgccaacaacttgctggtgacctcggaccatggcttcatctaccagaaccgcgccatcgacgagagcgacttttccggggtcgatgccgagggtgaacagattctgttccgggaccgccgcttcgtgctcggcaaggggcttgccgaggcatccagcctgcacaagttcacccccgagccgcttggccttgcaggtgaggtggaggtgcagattcccaagtcgatcaaccgcctgcgtctgaagggctccggcagccgctttgtgcatggcggcgcatcgttgcaggaggtggtgatcccggtgctcaagatcaacaagaagcgccagagcgatgtcaccgccgtcgaggtggacatcctgcgcggagccagctcggtgatcacctccgggcaattggtggtgaccatgtaccaggccggaccggtgacggacaagatccagccgcgtgtgctgcgggctggcatctacaccgaggcaggcgacctgatctccgacagccacgacctgacctttgatctgagctcggacaatccccgggagcgggagctgcaggtgcgcttcgtgctcacccgcaaggccgacgaggccaacggccaggaagtcattctacggctggaggaaaagcacgccgggacttcacattacaaggaatacaagtcgatccggtacttggtacggcgctcatttactagtgacttcgacttttaa

SEQ ID NO: 1215 - DNA, 2499 bp, Desulfovibrio vulgaris; identical to SEQ ID NO: 1214

SEQ ID NO: 1216 - DNA, 2340 bp, Desulfurivibrio alkaliphilus
atgcgagtaattgatcagcttctacaggcagtgcgcggagcagcggtttacaacccggaggtccaggtggcgccggcctgtatcctctggccggaccatgatcgccaatgggaggccgtcattccccgcttgcaggcggaattgccggagttgtttgttttgggcgattatgccccggagcaacgcaccggccccgctatctggctgcgctgtgtggttgccggcaagatcgaggaagtggcgccacccgcccatcgtccccccattctttacctgcccggagtcagccgccaggatctgcgggccatcgaaagctgcccggaaccattaaagcctttggccgagctgcagtatcgcggggtgatctggtcccagatcaatgccaaggactggaccattctggcctggctgaaaacggaccagggcgggctgggccttgatgtggcccaggaccaggaggccagaaaagccatgcaactggccctctaccgcttgctggatgaggaggtggagcggcttcgggataaacggctggacaaggattatttcaataccttgctgaccggtggtgatccggtgcgggatttgctccagtggctcgatcagggtgaaaactttctggctgaccgcaacgccaacgagcggcaggccatggtcgaggtctgcaaatctcaactgggctttgatccggccaagcaagggatcctggcgggagcggccaggctggccagccggcagggtccctggcagggggtctgggagcgtttttgtgaagctccgctccgctatcccggcattcccgcgcaaatccggaaatgccagccgcccagtggttccctggtgtggctgaccgccgctccggttaatcacggctggccgcaatggaatgaaagccaggaaaatatcctgcgccgcgaattgcaggggctggccgaggttgcggccccggcggcccggcagaagctggcggagctggaaaaacagcatggtttccgccgggagctggtctgggccgaacttggggaagcgcccctggccctggccctggagcatctggcggttctggccgggatcaccgcttccggcctggttgccggcaccgctgctgacctggcggaccgctatggtcagcagggctggcaggccgacgacgccctgttgcgggcgctggcaaaggtgaccgccccggcggacctggcagcactgactgccgccatccgggcggtttatctcccctgggcggaggagtccgctcgctatctgcagcagtcggttgccgcggccggctatccaggcggcagcatcgtgaccaggaaggtggcgccaccccagccgggggaatgcctgatgttcgtggatggtctgcgttttgatctggcccggcgcctgcaaagcatgctgacggccaagggttatgaaatcggccaacgcccctactgggtgcccctgcccagcgttaccgctaccggcaaaccggccatggcccccattctggcttcccccgagctgggggaaggaacggcgggttacaactttgaaccgatgacatcctatctgctgcgcaaacttatcatcgagcagggctggcagattctggagcgcaacgacaacggtgacggccagggcaacgcctggtgcgaatttggcgacatcgaccatgaagggcatggccggggctggaaacttgcccgccaggttgatcccctgctggaggaaatacgggaccggatcatggccttgctggctgccggctgggggcgggtgcgggtgcgggtcgtaaccgatcacggctggctgttgttgcccgggggcctgcccaaaatcgagctgccggcctgcctggtggacagcaaatgggggcgctgcgccaccatcaaacagggcgccgccaccgacgagcacctgtatccctggtactggaatccggaacagcaggtggctttggccgacggaatctgctgttaccggcggggtgaggaatatgcccatggcggcttgagcctgcaggaatgcctggccttggagctttctgtccgccggtcggctgagaccccggaagcggcagaggcgctggagtttaccgacatcgtctggaaaggcctgcgctgcacggtggcggtggccggcaattttgccggtttgaccctggacatccgccggcaggccggcgatccggcctccagtgtggtggtgggcaccaaggggctgaaaagcaacggtaccgcttccgtggtggtggaagatgaggaactggaggggcaggaggcggcactggtgctgctcaccgctgatggcgccctggccgcgcaggttgttaccgtaatcgggggagcaaaatga

SEQ ID NO: 1217 - DNA, 2604 bp, Enterobacter cloacae
atggatatcactcagcttcaaactgggcttaacaacaaattcaccgcagatcggattgttttctggcacgacccagaacagagctttactgcacagcttacagagctctccatactgtggaacgggttgccagtaacagtgctcaatatggcagagcagtcacagcttcaaactcgcaaacgcattgaaatcgatgaacccatgcaggggttccttctctactggcccagttcagaaccatcaccagctaaagactggttgctcgatatacgtcgttatagcaccactttttatgctgatgcagcctcaattctgcttaatgacctcggcctcgccaatatggcgctccgcgaccacatcgcatcacgtaaaagctttttcgccaacaaagagcgtactgcagcctttaaacgtcgcctggacggccgtggcggtatagaagatccgctatcacttgatatgaagatgataagtgtcgtgctggcctgtcatgctcagattgccgaaataatgaaaagcattggcgatcgattacttgagaatgctgaaaccgctcttgttccgctagaacagcatggattgctgcctggattttggcatttaatgaaccttgaatatggataccatatagctgaagggacagaaccgtcactacgcgaactgattcgtaagttactagtgagtgaatgctacgaacagcttgataccaaagagcgccctgtctggctacagtcacaactattagccactcccaccggacgtgcgaatgctatggctctgctatctggttggcgtgattctaaccagtacagcagcaattttgccgacatatctgcacaggtagcggatcagctcgaacttgcttcacgcctgacagcgcaagatatctggctctggggagaagtcgaaggctttgaagcggtcgaacaaggtttgatccgtgagctgatatctggattaaacaacggtgacttgaaactgaatcgagtagagtttgcccaactaatctctcgtcgtcgacatggattctgggccagaactgtacctaaatatgcatatatttaccaggcgctgcaacaagctgaattgttgctagaactacgccgttcgaaaccggatggttttcattacacttcagcgcaagaaatgtatcttgcctatgaagctgaattgttccagtttgatgcagcctatcgcctgtttaatgaagcgctattacatctgcaaggacagtcggtagaagtgctggcagtactggccagtaaaatcgaagatttgtatgtgaactggtatctgtaccaactgggactgacatgggatggcttgctagttaaagagcggttgcttgataactggcaacttggcctcccttctcagcatcgcttctatgatacagtcataaaacaacgctttgcccaaagcggcgtcaagcgccagtttgttattatcagtgatgccttgcgctatgaagttgctcatgagctccagggacagataaatgaagccaagcgcttcactgcacagctcaagagccagctcggggtactacctagctacacgcaacttggcatggccgccttactcccacatcagcaactagactatgccgctaccaactcaacagtattagtagatggacagagcagcgcgggtttagaaaatcgcagcactattctaagtaaggtaggtggtatagcgatttcggccaaaagtctgctgagctggacccgggcagaagctaacgaggcggttggtgacgcaaaggtaatctacgtctatcacgatgtcatcgatgctcagagtgaatctcagaaaagtgagctcaagacattcattcatgcccgccaggctatagacgaactgaatggactcatcaacaaaattatcaatgggtttggcgttactcgcgtagtaatcacagccgatcatggattcttattccaacaggcctcagttgaaaacggggtaaaatcgcccctgaaacacgaaccatcaggaactctggaagcttcaaaacgctatctccttggtcgcaatttaccaacaaacgaagatgtctggcatggacaattgcgtaatgttgttggtggtaactctgatgtggaattctggcttccgaaaggagtgagccgtttccattttgttggtggagcccgcttcgtccatggtggtgcaatgttgcaagaggtctgtgttccaatacttgaagtacaagagctgcgtggcaagaaacaaactctgcatgaaaaaaccaaagtcgacatagttccggcataccaacccattaagctggtaaatgtgatcgataaaatccgcttcctgcagaccgatgccgtcgatgaacgtcataaatcaagaatggttcgtttctcggtggtagatagttcagaacaaaccgtgtcagctattgagaagctactctttgaagcgacctcaagtaatctggatcagcgccagcaagacgtgcgtttaaaactgaccggtgctcaatttgaccgcaaggcgcagtatcaattgctactcgttgatgatgaagatggtattgaaatggcacgctatccagtcactattgatttggcaatccaggatgaattcggtttttaa

SEQ ID NO: 1218 - DNA, 2604 bp, Erwinia sp.
gtgaccttgcaaaatcaggaatttattgccggccttaaagctaaattcgccgaacatcgcatcgttttctggcacgatcccgataagcgtttccttgaggagctgggtaacctcaaactggagaacgtcacgctgctcgatatgaccgaccagtcacagctggcggtgaaaaagcgcattgaaatcgatgagcctgaacagcagtttttgctgtggtttccccacgatgtgcccgcaaaagagttcgactggctgttggacattcgtctttacagtgcggagttccacgctgatttcgccgccatcactctgaataccttaggcattccgcagcctggcctgcgcgatcatattcaacgccgaaaggcatttttcagccccaggcgtctgtctgccttaaaaggcctggtgacagagcaggaaaacgaagcctctcttgataagaagatggttgcggttatcgctggcgtaaaaacagcaaaaacggaagagatcctgttcagcctgatgacccaatacgttaatcagcagcaagatgacgacagcgatctggaaaacaccctggcgctgctgaaacgccacgatctgcaaggcgtactgtggggcattctgaatcaggaaatgggctaccaggccgagcatccttcgctggaaaacctgatcctcaagctgttctgtaccgatctctccgcacaggcagatccacataaaagcgcatggctggaaaaaaacgtgctggccacgccgtcaggcagagcatccgcgctggcgtttatggtcacctggcgtgccgaccgtcgctacaaagacgcttatgattattgcgcacagcagatgcaggatgcgctgcgaccagaagaccagtaccgtctcagctcgccctatgatttgcacgcgtgcgaaaccacgctgagcattgaacagaccatcattcatgcgctggtgacgcagcttcaggaagaaagcaccacgctcgaccgcgaagccttcaagaagctcatgtccgagcgtcagagtaagtactggtgccagacacgccaggaatactacgccatttatgatgcgctgcgtcaggccgaacggctgctgaatctgcgtaatcgtcacatcgacggcttccactatcaggacagcgcaacattctggaaagcctactgcgaagagctgttccgctttgatcaggcctaccgcctgtttaacgaatacgcgctgttggttcacagcaaaggcgcaatgatcctgaaaagcctggatgactatatcgaagcgctgtattccaactggtatctggcggaactgagccgtagctggaataaggttctggcagccgaaaaccgtatgcaggcgtggcgtattccgggcgttccctcacagcagaacttctacaatgaggcggtcaaaccacagtttaacaatccgcagatcaagcgcgtgttcgtgattatctccgatgcgctgcgttatgaagtggcagaagaactgggtaaccagatcaaaaccgagaaacgctttactgccgaactgcgttcccagttgggcgtgttacccagctatacccaactgggcatggcagcattactgcctcatgacgagatgggctatcaaccgggtaatggtgacatcgtttatgcggacgggttgtccacctcaggtacgcctaatcgcaataccattctcaagaaatataaagggatggcagtaaaatcggacgaccttctgaaatggaaaaatcaggaagggcgggatcttattcgcgattacgaggtcgtttatatctggcataacacgattgatgccatcggcgacagcgcatcgacagaagaaaaaacctttgaagcatgccgcaatgcagtcgtcgagctaaaagatttggtgacccgtgtgataaaccgactccacggtacacgcattatcgtaacggcagaccatggtttcctgttccagcagcaacccctttccggccaggataaaaccacgctgcagattaagccggacaatacgattaaaaaccacaaacgctttattattggccatcagcttcctgccgatgacttttgctggaaagggaaagtggcggataccgcaggcgtcagcgataacagcgagttcatgatccctaaagggatccagcgttttcatttctcaggtggtgcgcggtttgtgcacggtggagcgacgttgcaggaagtctgcgtgccggtattgcaggtgaaagcgctgcagaaaaccgcagccgacaaacaaccacagcgtcgtccggttgatattgttgcgtatcatccgatgatcaagctggtgaataacattgataaggtcagcctgctccagactcacccggtcagtgagctgtacgaaacacgcatcctgaatattttcatcgtcgacagtgcgaataacatggtttccagcaaagagcgaatcagttttgacagcgacaacggtacaatggaaaaacgcgtacgtgacgttacgctgaagctgattggcgcaaatttcaatcgtcgtaatgaatactggttagttctcgaggatgcacaaacggaaacgggttaccagaagtaccctgtgattatcgatctggcgtttcaggatgatttcttttaa

SEQ ID NO: 1219 - DNA, 2604 bp, Erwinia pyrifoliae
gtgaccttgcaaaatcaggaatttattgccggccttaaagctaaattcgccgaacatcgcatcgttttctggcacgatcccgataagcgtttccttgaggagctgggtaacctcaaactggagaacgtcacgctgctcaatatgtccgaccagtcacagctggcggtgaaaaagcgcattgaaatcgatgagcctgaacagcagtttttgctgtggtttccccacgatgtgcccgcaaaagagttcgactggctgttggacattcgtctttacagtgcggagttccacgctgatttcgccgccatcactctgaatacgttgggtattccgcagcctggcctgcgcgatcatattcaacgccgcaaggcatttttcagcctcaggcgtctgtctgccttaaaaggcctggtgacagagcaggaaaacgaagcctctcttgataagaagatggttgcggtcatcgctggcgtcaaaacagcaaaaacggaagagatcctgttcagcctgatgacccaatacgttaatcagcagcaagatgacgacagcgatctggaaaacaccctggcgatgctgaaacgccacgatctgcaaggcgtgctgtggggcattctgaatcaggaaatgggctaccaggccgagcatccttcgctggaaaacctgatcctcaagctgttctgtaccgatctctccgcacaggcagatccacataaaagcgcatggctggaaaaaaacgtgctggccacgccgtcaggcagagcatccgcgctggcctttatggtcacctggcgtgccgaccgtcgctacaaagacgcttatgattattgcgcacagcagatgcaggatgcgctgcgaccagaagaccagtaccgtctcagctcgccctatgatttgcacgcgtgcgaaaccacgctgagcattgaacagaccatcattcatgcgctggtgacgcagcttcaggaagaaagcaccacgctcgaccgcgaagccttcaagaagctcatgtccgagcgtcagagtaagtactggtgccagacacgccaggaatactacgccatttatgatgcgctgcgtcaggccgaacggctgctgaatctgcgtaatcgtcacatcgacggcttccactatcaggacagcgcaacattctggaaagcctactgcgaagagctgttccgctttgatcaggcctaccgcctgtttaacgaatacgcgctgttggttcacagcaaaggcgcaatgatcctgaaaagcctggatgactatatcgaagcgctgtattccaactggtatctggcggaactgagccgtagctggaataaggttctggcagccgaaaaccgtatgcaggcgtggcgtattccgggcgttccctcacagcagaacttctacaatgaggcggtcaaaccacagtttaacaatccgcagatcaagcgcgtgttcgtgattatctccgatgcgctgcgttatgaagtggcagaagaactgggtaaccagatcaaaaccgagaaacgctttactgccgaactgcgttcccagttgggcgtgttacccagctatacccaactgggcatggcagcattactgcctcatgacgagatgggctatcaaccgggtaatggcgacatcgtttatgcggacggattgtccacctcaggtacgcctaatcgcaataccattctcaagaaatataaagggatggcagtaaaatcggacgaccttttgaaatggaaaaatcaggaagggcgggatcttattcgcgattacgaggtcgtttatatctggcataacacgattgatgccatcggcgacagcgcatcgacagaagaaaaaacctttgaagcatgccgcaatgctgtggtcgagctaaaagatttggtgacccgagtgataaaccgactccacggtacacgcattatcgtaacggcagaccatggtttcctgttccagcagcaacccctttccggccaggataaaaccacgctgcagattaagccggacaatacgattaaaaaccacaaacgctttattattggccatcagcttcctgccgatgacttttgctggaaagggaaagtggcggataccgcaggcgtcagcgataacagcgagttcatgatccctaaagggatccagcgttttcatttctcaggtggtgcgcggtttgtgcacggtggagcgacgttgcaggaagtttgcgtgccggtattgcaggtgaaagcgctgcagaaaaccgcagccgacaaacaaccacagcgtcgtccggttgatattgttgcgtatcatccgatgatcaagctggtgaataacattgataaggtcagcctgctccagactcacccggtcagtgagctgtacgaaacacgcaccctgaatattttcatcgtcgacagtgcgaataacatggtttccagcaaagagcgaatcagttttgacagcgacaacggtacaatggaaaaacgcgtacgtgacgttacgctgaaactgattggcgcaaatttcaatcgtcgtaatgaatactggttagttctcgaggatgcacaaacggaaacgggttaccagaagtaccctgtgattatcgatctggcgtttcaggatgatttcttttaa

SEQ ID NO: 1220 - DNA, 2598 bp, Erwinia pyrifoliae
ttgcaaaatcaggaatttattgccggccttaaagctaaattcgccgaacatcgcatcgttttctggcacgatcccgataagcgtttccttgaggagctgggtaacctcaaactggagaacgtcacgctgctcaatatgtccgaccagtcacagctggcggtgaaaaagcgcattgaaatcgatgagcctgaacagcagtttttgctgtggtttccccacgatgtgcccgcaaaagagttcgactggctgttggacattcgtctttacagtgcggagttccacgctgatttcgccgccatcactctgaatacgttgggtattccgcagcctggcctgcgcgatcatattcaacgccgcaaggcatttttcagcctcaggcgtctgtctgccttaaaaggcctggtgacagagcaggaaaacgaagcctctcttgataagaagatggttgcggtcatcgctggcgtcaaaacagcaaaaacggaagagatcctgttcagcctgatgacccaatacgttaatcagcagcaagatgacgacagcgatctggaaaacaccctggcgatgctgaaacgccacgatctgcaaggcgtgctgtggggcattctgaatcaggaaatgggctaccaggccgagcatccttcgctggaaaacctgatcctcaagctgttctgtaccgatctctccgcacaggcagatccacataaaagcgcatggctggaaaaaaacgtgctggccacgccgtcaggcagagcatccgcgctggcctttatggtcacctggcgtgccgaccgtcgctacaaagacgcttatgattattgcgcacagcagatgcaggatgcgctgcgaccagaagaccagtaccgtctcagctcgccctatgatttgcacgcgtgcgaaaccacgctgagcattgaacagaccatcattcatgcgctggtgacgcagcttcaggaagaaagcaccacgctcgaccgcgaagccttcaagaagctcatgtccgagcgtcagagtaagtactggtgccagacacgccaggaatactacgccatttatgatgcgctgcgtcaggccgaacggctgctgaatctgcgtaatcgtcacatcgacggcttccactatcaggacagcgcaacattctggaaagcctactgcgaagagctgttccgctttgatcaggcctaccgcctgtttaacgaatacgcgctgttggttcacagcaaaggcgcaatgatcctgaaaagcctggatgactatatcgaagcgctgtattccaactggtatctggcggaactgagccgtagctggaataaggttctggcagccgaaaaccgtatgcaggcgtggcgtattccgggcgttccctcacagcagaacttctacaatgaggcggtcaaaccacagtttaacaatccgcagatcaagcgcgtgttcgtgattatctccgatgcgctgcgttatgaagtggcagaagaactgggtaaccagatcaaaaccgagaaacgctttactgccgaactgcgttcccagttgggcgtgttacccagctatacccaactgggcatggcagcattactgcctcatgacgagatgggctatcaaccgggtaatggcgacatcgtttatgcggacggattgtccacctcaggtacgcctaatcgcaataccattctcaagaaatataaagggatggcagtaaaatcggacgaccttttgaaatggaaaaatcaggaagggcgggatcttattcgcgattacgaggtcgtttatatctggcataacacgattgatgccatcggcgacagcgcatcgacagaagaaaaaacctttgaagcatgccgcaatgctgtggtcgagctaaaagatttggtgacccgagtgataaaccgactccacggtacacgcattatcgtaacggcagaccatggtttcctgttccagcagcaacccctttccggccaggataaaaccacgctgcagattaagccggacaatacgattaaaaaccacaaacgctttattattggccatcagcttcctgccgatgacttttgctggaaagggaaagtggcggataccgcaggcgtcagcgataacagcgagttcatgatccctaaagggatccagcgttttcatttctcaggtggtgcgcggtttgtgcacggtggagcgacgttgcaggaagtttgcgtgccggtattgcaggtgaaagcgctgcagaaaaccgcagccgacaaacaaccacagcgtcgtccggttgatattgttgcgtatcatccgatgatcaagctggtgaataacattgataaggtcagcctgctccagactcacccggtcagtgagctgtacgaaacacgcaccctgaatattttcatcgtcgacagtgcgaataacatggtttccagcaaagagcgaatcagttttgacagcgacaacggtacaatggaaaaacgcgtacgtgacgttacgctgaaactgattggcgcaaatttcaatcgtcgtaatgaatactggttagttctcgaggatgcacaaacggaaacgggttaccagaagtaccctgtgattatcgatctggcgtttcaggatgatttcttttaa

SEQ ID NO: 1221 - DNA, 2496 bp, Erythrobacter litoralis
atgtcagaccgtatcaaaacgggtcttaagctgctcttcgacgagcaccggatagtgttctggtacgatgcagcgcgcgacatgcggggtgagtttgacgcagttaaactgccaggcgtgcagaagatcgagatcgcgaataacgagttcgctctgaaataccggatgctgcggcaggagcctcgccagaagtttctggtgtttcacgacggccccgcgcctgaaatggacgacaattggctgctggatctgtatttcgccagtggtgtgttcaaagccgatcaggcggcaatctggcttgcagaactgggcctgccgctgcagtttgaagacgtggtgcgcaaccacatggagttttaccgctccaaagtccgcatcgaagcgctgaagcagtcggtcacaccttcagatacaaagagcgaggtgctgcgccgtatgatcgccgtatgcgcaggtgctcagggtgccttggatacggtcatcgaggagctgctggcagagctcgcagacgagcgagacgacgccatgcgtctgattgaacgctccggcctgacagatttcttctggaagcaggttgagaatgcctacggttacacgagcgaagagcccgatttcgaagacttcgcgataacactgttccagtcctgttatgcccgcgccttaggtgaggatggcaagctgaatggcgaggccttgctcgttttccgccgctggaagaacaatcgcctatggtcaaccgcatttgaaacgctgagcggtgagtatcaggacctcctgaaaattcctgaggacacccaagaccgcgacatcaagactttgggtgccattgatcacttcgaggagatcgatcgccatatcatccgctctctcgtacatgagatggcaagtcagacggtgtcatcagctgaggtgttgaaagccgttcgagagcggaggcagagccattggtacccgacctacgaggatatctacgaagccatccgccatgccacagaattccagcaagccttggctgaggcgaacttgaccatgacctcccccgatgagggggtgaagcgctatgtttcccactggtataggatcgaccagctctaccgcaaattcatctatcatatgcagaagagcggccaggcctcgctgctcagcgcgctcttcgagagcgtcgaaaaccggtatacgactaacttccttcaagctgtgaacgatgcttggcaagatcacattgctgagctcaaggactggaagatctcgggcttcgcgcaccagacggacttttacgtggatcaggccgcagaattccgccgccgagatcagaaggtggtggtgattatctcggacgccttgcgctatgaggttgcagaagaagccttgcgcgagatccggaaactgaaccggttcgacgccgagctcgaaccgatgatctctgctctgcctagctacacgcagctcggcatggcggcgcttttacccaacaaagatctaacgctggaagcggacgcaagtgtgtcttctttcagtctgcccactcagggaaccgtcaatcgcgaaaaggttctgggaatgggacgatcgggagatcgagccaaagccatgaaagctgatgacttcatgagcttgaaagcggatcagggcaaagagatcttccgcgatcatgacattctttatctctatcacaaccggatcgataacattggcgataagctcgccaccgaggagcacacggccgaagctgcccaggacgccatcgaggatctcaccaagcttgtccgcaaactcacaacagccaacttctcaaacattttggtgacggccgatcacggctttatctatcaacaccgcgccttggatgagaccgaattctcgattgcggatccagatggcgccgaaattctcgtcaaaaaccgccgcttcgtcatcggcagcgatcttcaagagacttcaggtatgaagaaattctcttcagccgatctagggctggcaggagatctggacgtgcttctgcctaactcgatcaatcgtatgcgcgtcaaaggatcgggcagtcgtttcgtgcatggcggagctacgcttcaggaaatcgtcattcctgtgatccgtgtcgggaaacaacgcgacgcggatgtcgagaaggttgaagttcagatcatcgttgccggaaagagcttgatttcgtccggacaaacttcggtcactctctatcaggctcagcccgtctcggaaaagcagcagcaacgggaccttcttgctggcatttacgcctcggacggcacactcatctctgatgagcatgctctcaccttcgactacacttcgcaaaatgcacgcgaacgcgagctgccactcaagttccttctttcccgggacgcggaccgcttcaacaatcaagacgttttgctcaagcttcgcgagcgcgtcggcaagacaagccattatgaagattacacaagtcaccgcttccaattgcgccgtggcatatcgacagatttcgacttttag

SEQ ID NO: 1222 - DNA, 2598 bp, Escherichia coli
ttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcggcgcaaggccttcttcagcactaaacgcacgcaggcgctgaaaaacctggtgacagaacaggaagatgaagcctcgctggataagaaaatgattacggtgatcgctggcgcaaagaccgcgaaaaccgaagacattttgttcaacctgattacccagtacgttaaccaacaaacagaagacgacagcgaactggaaaacacgcaggcgatgctgaaacgccacggtctggacccggtattgtgggaaatgctcaaccacgaaatgggctaccaggcagaggagccatcgctggaaaatctactcctgaaactgttttgtaccgatctctctgcccaggccgacccacagcaacgtgcctggctggaaaaaaatgtcctgctaacgccatccggcagagcatctgccctggcatttatggtgacctggcgtgccgatcgtcgctataaagaggcttatgactactgcgctcagcaaatgcaggccgccctgcgcccggaagatcattaccgactcagctcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaacctgagtattacgccatctatgacgcactgcgccaggcagagcggttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccctggtgtgccgcgtcagcagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgatcgcagctcggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaagaactataagggaatggcgataaaatcgaaggaccttctggagttaaaaaatcaggaagggcgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggaaaagtggcggataccgcaggcgtgagcgacaacagcgagttccttattccgaaagggatccagcgcttccatttctctggcggcgcgcgctttgttcatggcggtaccatgttgcaggaggtttgtgttccggtattgcagataaaagccctgcaaaaaaccgccgcagaaaaacagccgcagcgccgcccggtggatattgtcgcttaccatcccatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcttcagctttgatagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1223 - DNA, 2598 bp, Escherichia coli; identical to SEQ ID NO: 1222

SEQ ID NO: 1224 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgcgtcacagctggcggtgaaaaaacgcatcgagatggatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgtacgcaggcgctgaaaaacctggtgacggaacaggaagatgaaacctcgctggataagaaaatgattgcggtgatcgctggcgcaaagaccgcgaaaaccgaagacattttgtttaacctgattacccagtacgttaaccaacaaacagaagacgacagcgaactggaaaacacgcaggcgatgttgaaacgccacggtctggacccggtattgtgggaaatgctcaaccacgaaatgggctaccaggcagaggagccatcgctggaaaacctgctcctgaaactgttttgtaccgatctctctgcccaggccgacagacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggcggccctgcgcccggaagatcattaccgactcagttcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaaccagagtattacgccatctatgacgcgctgcgccaggctgagcgtttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagaagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaaccaagtaacggcgacatcgtttatgctgatgggctgtcgacctcgggtattcctaaccgcgataccattctgaagaactataagggaatggcgataaaatcgaaggaccttctggagttaaaaaatcaggaagggcgggaccttattcgcgattacgaagtggtgtatatctggcataacacgattgatgccaccggtgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaaggaaaggtggcggataccgcaggcgtgagcgacaacagcgagttccttattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccggtgggcgaactttatgaaccgcgtatcctgaacatttacattgtcgataacgccaacaatgtggtctcgggcaaagagcgcatcagctttgacagcgataacagcaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1225 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgagtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacttggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacaccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcagaccgccctgcacccggaagatcattaccggcttagctcgccatatgatttgcacgaatgcgaaaccaccctcagcatcgaacaaaccattattcatgcgctggtaacgcagctgctggaagagagcaccacgctcgatcgggaaacctttaaaaaattgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggagcgatgatcctcaagagcctggatgattatatcgaggcgctctacagcaactggtatctggcagagttaagccgtaactggaacgaagtgctggaggcggaaaatcgtatgcaggcgtggcaaatccctggcgtgccgcgtcagcagaactttttcaatgaggtggtgaagccgcagttccaaaatccgcaaatcaaacgcgtgttcgtgatagtttccgatgccctgcgttatgaagtggcggaggagctggggaatcaaatcaataccgagaaacgctttaccgcagaactgcgatcgcagctaggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaaaaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaagtaatcaaccgcctccacggcacacgcatttttgttacggcggatcacggtttcctgttccagcaacaggcgctttcggttcaggataaaacaactctgcaaattaagccggaaaacaccatcaagaaccacaaacgctttattatcggccatcagcttcccgccgatgatttttgctggaaaggtaaagtggcaaataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1226 - DNA, 2658 bp, Escherichia fergusonii
atgcagattagcgaactggcacaaggcgttgctgccaaacttgaacaaagccgcattgtgttttggtacgacccagagcaaagctttactgaagagcttgagcatttagctaacgccctatctattgcaaaagaagtaggcgatagcgcggcagatataactgctagggtactgccaaatgatttgaccatcctcaatatgggcaatgagtctgtattggcagtgaaaaaacgcattgaagtagatgagcgtgaagctaaattccttatctattttccaagcgctgagccagagcctgaccgcgattggttgctagacgtgcgtttgtatagcgagcagttttttgctgatcacagctcaatgctgcttaatgagctgggtatcccgaaaatggcgctacgcacgcacattcgtaagcgccagagcttttttgccaataaacagcgcatagccggtttaaaaaagtgggtgactgagaacgaagacgaactgtcgttagacaggaagatgatggcagtggttgtaaaagctgattctgcgtctttgtcggacattctgcttgggttactacgcgaatatgcggcttatatcgaagatgaaagccttggccaacctttatggagccagctaggaaagtttgatcttgagacctcactctgggcatatctgagtgagggttttggctatacagtcgaagagccaaccttcccagacttcgtgttgaaattattctgtactgaattctggagccaaattgaaggtgttgaacgcgattggttgcttaacaatgttctaaaaagcgcatcaggccgggcgacagccttggcgtttatggtgagctggcgcgacagccgctctttcgccgcttactacgaaagcatctctaaggtgcttagccaacagttggaaatttcgactcgtgctggccagtaccatccggttgaacttatcgaatgcgaaacgttcgaggctgtggaacaggccataatccgtggtttagttcgtgatttgctcgatagcagtaaagcgctagaccgggttcagtttgatacggtcttatcaagacgtcttgctagccactggacattgtcacgcaaagaatacttcgcaatttatgaagctatccgcaacgctgaagagttaatgcacttgcgaaatcgctatgtggacgggttccactttgataacgcgaaagcaatgtacgacgcctataccacagacatttatcgttttgaccaggcttaccgtttgttcaatgaacatgtgcactctgtattgagtaaaggtgcagacatactgcgtcagctcgacgacgaagtcgaaagcatttataccaactggtacttatatgagcttggccttgcctgggatcgtcacttggccaatgagaaattacttgaaaagtggcagatttctggcgtaccgcaccagtatgacttctatgaaaaagaagttcgcacacgactgagtctgaaacagacaaaacgcgtgtttgtgatcatctctgatgcactgcgttttgaaattgcgaatgagcttggcgctatcattaacaacgagaagcgatttaaggctgaggtgtctacgcagttgggcgttttgccgagttatacccaacttgggatggcggcattattgcctcataaggcgctcagttaccagccagagcaaggcacggctgtttatgtggatggtatttcttcacagggtctagacaaccgcaacgccatcctacaaaaagtaggtggtatggcagtgagttctaaggaactgatgagctggagtaaccaggaggggcgtgacaaggttcgagacgtagaagtagtttatatctatcacgataccattgatgcgattggtgataaggctgcaactgaagagaaaacgtttgaagcctgtcgtagtgccattgaagagctaaaagatctcgttgggcgggtcatcaaccgtctaaacggcagccgagttgtgatcaccgctgaccatggcttcctcttccaacaaaaagcacttgtagcggctgacaaaacctcgttgaaaaccaaacctgctggcgcgatagaagccaagaaacgttatatcgttggtaataacttgccttcagatgaagcctgttggaaaggctcaataaacgatacggctcatggctctagtgataccgagttcctgcttccaaaagcggctcaacgcttccactttgttggtggtgccaagtttgtgcatggcggagcgatgctacaggaagtatgcgtcccggtactgcatgcgcgagagctgcaaaaagaacaagcagcaaaacatgagaaacaaccggtaggtgttgttgcagccactcagcccatcaaattagtaaacaatatcgacaaggtcagatttattcagacagaccctgtaggcgagcgttttgtcgcacggttgttggatgtctatatcgtcgatacacaaggtaatgaagtatccagtcgtgaaacgattaactttgatagcgtgagtaaagttatggatgagcgtactcgcgaagctaggttaaagcttattggctctcagttcgacaggaacgctcaatacacattagttcttgagaatgcggaaatgagaacccgttatagccaatacgcggtaaccattgatttggcattccaagatgattttttctaa

SEQ ID NO: 1227 - DNA, 2559 bp, Exiguobacterium sibiricum
atgaacatggcacaaattgagtccacactacaagacatttttaatgaaccgttaaaagatggcgaacaacgaaagcttgtgttttgggtggataaggatgaagaatttacggaggaaattggtcaattagcattaccaaatgttaaagtccaagcattatctgatcgaaattcattttatataaagcatttgttggaagaagaagattcgacgtccttttatctgatctataccaccctagaactaagtgtagaagacaattggttagtagatacagtactttattctaagacatttttcgcagatcgaatttcacttatcttaaatgaacttcagatagattcttctcttagagcgattattaagaaacacgaacgattttttaacaataaagaacgcttccgtaaatttcagtcatttgctattgagtcttactcggaagaaacgattgaattggcgattatgagcgtactgtgtaatgtaaaaacaccagattttgaagcggtgttaaaagaagttttaatagatacgcttgacgagggtgaaaacaaactcttatctcagttagaacgattttttgatatggatatattttggcgatatgtcgcaaattactatggctatgtgcgcgaaaccaagaccttgaagactttgtttattcatttaaccgtcacagcgttcacacattctataagcgatgaatatttaacgagtgtaaaggattttatagctgtacgaaacaaagcaaatgcattggtgtttatcgatcactggatgcatcataaaacagatagtatagtatttgatcagtatgctgaaatggtagagcaggaaattaaactgccaagtattctacaagatattccggtagatgagtttaaacaagctgatacattcccttatatcgataaagtcattattatctacattgcgaataacttaatggagaggcttgaagattatgaggagtacacgaagctgattaaattgagacgtgtaaaacattattacgaaaagtatgcatcgatatatgaagctctttattacacagtaaaaatgcaggagttttataaagcacatcaacaaggaatttcacaagggtcagttattgatttgtacaaagcttatcgtgatgagtatttcgttatggatacatattaccggaaattctatgtggcctatgatgaagaaagtaatcacgagttagtgaaaaagttaaaagaacttgttgaacacttgtataccaactggtttatcggtgaattgagctctcattggtcacaatcagttaagtcagaaatggttgaggaatggtcgcttccaggaattacaagtcagcaaagtttttattcgtcagcggttgctccgcatgttcgaaaaggtgaacgtgttttcgttattgtttcagatgctatgcgttatgaagtgggattggaactaatagatcttttaaactttgaaacgacaggtatttgtgagatgcaatccatgcttggcgtagttccttctgtaacgaagttaggtatggcagcactattaccacatcgtaagttagattttgatgaaaatggtcgcgtcttagtagacggaaaggattcagcaggactcgaaaatcgcaaaaaaattatcgagtcttatgtagaagatagtctagccattcatttccaagatatgcttgccatgaataaagcggctcgtcgagaaacgtttaaagggaaacgcgttgtatatatttaccacgacacaattgatgcgatgggcgataaagcttctactgaaatttatacgttcaatgcggttgaaacatccctaaatcagttaaaggcattagttaaaatgattcgcgatgacttaggtggaacgaacatctacgtcactgctgaccatggttttttatatcaacgtgatgccttagaagacagcgataaaataagtaatgaagtattaaatgcggtcgaagtaaaacgtcgttatgtattgtcgaaagaaaaacgcaaaatttctggacagcttggtattaacttgtcttcaattgtggataatgaagagcaactgacagcctatgtaccaaatgggacgattcgaaatcgcatgcaaggaactggcgtcaactttgttcatggtggtgcaagtttacaagaagttgtggttccgttagttgtctacaaaaacaaaagagctggtcaaaagggatcttatgctctccaaaaagtagacattaaactcacaagttcgacacgcaaaattacgaatagtattttcaatttgaattttttccaaacagaaaaagttgaagataagatgattccgcgtacagtggttatttgtatcgaagatatcgatggaacggtgttgtccaatgaagaaacaattattggagatcgtacatttgataaccctggagatcgtatatttaagcttcaatttgtcttaaaaagtatttcgtatgatcgtaacaaaatgtattatttacttgtaaaagatttagaaacaggagttgtaacagagaagataccattctccattagtctaggaattgtcagtgattttgacttttaa

SEQ ID NO: 1228 - DNA, 2238 bp, Flavobacterium branchiophilum
atgatagatacttggtttaaaaaagaaatagaaaaaatattcaatacccatcctatagctgtatttatagatgagtcaaaagaagctacttttttacaagaaggggtaaaaaatgagtatgttacattttttacgaataacgaaattgatgaacttaaagtgaagtatgaaattgagaaaagcttggataaaaacaagaaatatttgatttataccaatacgccaaaagaacagctaaaattcattagagaatacgttgaaaccaatggggcggtagaaataaaacatttcgacagatacattaaagaaaagttaatcaaccatttaaatataaacctgcatttagaaaaagaagaattaattgcagctgcaaaagtaagtattggcaaagaccaaacctattggatgaacttaagccacaatggagctaaagaaatcttcaatttggaaaaagaaatcgtaccttttttagataaccctaaaacctatttaaacaagtacgataaaaacgttcaagaattattcttcacaaaagtaaatgaattaattgggcagccttacattgagaaaccagcagccgttttagctcaagaagtggttttttatttattggatggattagcaaacaacaatccaaacaaaatgctcttggaagcgtataataattggttagacagtaaaacataccaagaatcatttgataaatacctaaaaaaatataaactagaacccaaaacagaaattttcaattgtcatcctgcacatcctttcaaagagttagatgagctttggttagtagaactgggtaaaaacataaacaacaaagagtattgtgttaatttcttacctaaaattaaccaacgtattgtaaataaagccaccattcatttagggattacattttggaaaaacataaaaaccttattggaatttgacgaaaagaacatcaaccaaattgcttctcatcaagaatgtgtgtcattttataccaaccatttttacaaattagataaagcaattagggagttatatacggagtttttagaccgtaaaaatataatagaacctattcaatcatactataaaaattatgcagtaatatatcttgataagtggttcaaatatttcgaagactatcaatccaatcaaacagggaaaattcaagaaataataaacaataatgcattaagaacagcaattgtagtcggagacggcgtttcttttgagtttgctaaagacatcatcgaaagagtatcaaaagaatatacgttatgcaaccagcaacaatttatgtttgcaggtcttccatcagaaacagaacataacatgagtcaattgtatgtagatacaggtgtagttgtagcaaaaaaacaagaacgagaagcatacattttaaaccaaaatacagataaatcaataggctttatagatttagaaatggtaaacgaaaccaccgataaacaaaactatttaatttgtagttacaaagaccctgataaactaggtgaaacctatcaacaaaaagcattaaaatattttgaccaagtagcggcgctatttgcaacaaaaattgaacaactgcttagaaatgggtataaaaacgtattcttagtcacagatcatggtttcgttttaacaggtgtattagaaaattcagataaaatagaagttgatttcaaaggtaacgtaaacaaaagtgagcgctttattagaacagaagaaaaacaaaacatagatactaacctacttgttgaaaaagaaatccaatatgcaaactttaagtattgctatttcgctaaaagactagggccgttcaaaacacctggagtttacggatatagccatggtggtatagcaccacaagaaaccattataccttttttaaaatggtctaatgaaaataatacaagtgaacaattacaagtggtagttagcaacaaaaatgatctaaatgatgtgacaggtgatttgttctcaatagcattaaaagcaactactacggaagcaagtttattttcaacagaaagaaaagtaatattattattttttgtaaaaaacaacaaagtaaatgaaagtgatatcattacaattagtaaagaaatggaagtgaaaaaagagtttcgcttcggttcaaatgctgaattagaagtcaaaattgtagatgcaattaccaaagaacaattagataaagtggtagttaaacaaaacaaagcaagagatttaggaggtttactttaa

SEQ ID NO: 1229 - DNA, 2610 bp, Gallionella capsiferriformans
ttgagtaatcaacgaatcgtagattccttatcttcactatatgccaatcatgccatcgtgttttggcatgatgccgatgccgagttttcatctgtcgtagatgggcttccattgcctgatgtacaagtggtgcgcacagatagcatgcctgcgctcaaagttaagctggatatcgagcgcgcaccaaaacaaaaatggctgctctacagcaataaaccagaacctgaacttgcccaagactggctgctggatattcgcctgcgcagcaagtcattcagcgcggatgccgcctccattctgctggaagacttggggctgacatcgcagacattgcgtgcgcatctgaaacttcgcgccaagttcctgcgtgctaaagaccgtgttgaaaaactgaaacgactggtggtgccaaccgatacggcagaggatatcgaccgcaagatgctggcggtgttggcacgagcagatcagccagaattgacggcggtattatttcgcctgttttcaggtttggttgcggaggggatggctgacttgaatgccgagacccggcaatggcaggagattcagagcaatgaattggaatcggctttctgggaaaatgttgagcgagagttcggctacgcccagtcagcgccttcgttgtcagactttttgattcatttgctggttacggattttgcacgttcactgactggcacttgtcccggtcaactcgcccattttattttagccaataaaacgctggcggcgaatgcggcggtatttgttgcccgatggcgttcagatatggcgcactttgccagttacaacgccttgtctgagcagatagccaaggagctggatattgccggtatgttgggtggcttgtccggtgcgtcactatctgaggtgatgaccttcgcggtcgttgagcagcgcatcatcaaacagatcaaggatcaaatcattgcggcatccggtgctgaatcgaatgcagtacgctcgttgattgcgcgccgtcgcgatggtcattgggcaaaccgtttactagctcaggataatgatgtcactcgcgcattggctgcgagctatgatgcgttggaggcggcttacggcttctttgaattgaaggcggcacatgaggcaggatttagtttcgcgaatgcagccgacggtttagctgcgtatcaagccgagatattccggtttgaccagctgtatcgccagtttaactttgccgctgcggctgttgaaccgatgggctgggcggtgttgcatgagttgattgagcgtgttgaaagtgcctattccggctggttcatcccgcaattaacatcgtcatggagcaaagtgctggaaggcgacagcggtctactgggaaagtggaaagtcgatggcttaataaatcagcccgatttctatataaagcatgtgaagccggtgctggatggcggcgcaaaacgggtgtttgtggtgatttcggatgcattccgttacgaggcagccgaggagttgacgcgtattatcaatagccgtaaccgtctgaaggcatccttgtccgccatgctcggcgttttgcccagttacaccgcgctgggtatggcatcgctgctgcctcactccaaattggcgtacaagctaaatggcaattacgacttgagtgcggatggcgctgtggtttcgaccagcgagcagcgcagcactcatcttgagcagtatggcggcgtggcaatcaaagccgatgatttgatggcgctgggtaaagacaaggggcgtgaattcgttcgtgacaagcaagtggtgtacatctatcacgacctgattgacatgatcggtgataaacaagcatccgagaccaagacctttgcagcggtcaatgatgcgctggatgagttgggaaggctggccaatttcattatcaacagtctgaatggctcggttgtcttgctgactgcggatcacggctttatgtatcaggagtcggcccttgatgtagctgataaatcaacgctggatgaaaagcccacaggtctgttaaaagctaaaaaacgctatctgattggacagggaatcggtgttagtccaaaagcctggtgcggcaatacggcagtgacggcgggaactgaggcgggcgagggcagtatggacttctggttgcccaagggcgcggcgcgtttccatttcgccggtggtgcgcgatttgtgcatggcagtgcgatgccacaggaagtggttgtgccggtgattaccttgcgtgcaagtgaatcggataaggcaaagacccgcttcgtgaatttcagtattctgggtgcgtcgattaaagtggtaaccaacaggcagcgatttgaatttattcaggatgaggctgtttcagcacgcatactgccacgcatggtgcagatttcattgcgcgatggtgaggaatttatcagtgatgagcagtcgctgaccttcgatagcgattccgatctgatggatagccgtaaacgcacagtgatgctgaccgttcgatcgggaagctatgaccggaataaagattacttcctgatagcgcgtgacgcgcaaaccaaggtggaagtgatgcgcctgccgctgcgagtggatctggcgttttcaaatgatttttag

SEQ ID NO: 1230 - DNA, 2313 bp, Gallionella capsiferriformans
atgaaagcaataccgaccacagtgcttgcagcgctaataggcaaactgcatgagcaggccaagcgctataaccccgccttggaatccgcccctatcgccgttctctggacggatgaaaagcgagaatgggaagctgtgctgccgcaaatcaaacagcaattgcccgaattattctcgcttggcgcatacgcgccagatcaacggattggccccggggtgtggctacgcatggtggccgaccgacaagttggcaagttagaaggaataccgattctgtatttgccgggggtcagcaacggcagcctgcgcactgatttacgcggagtgaaggaagacccacaactcgcgcctttagctgaattacaatttcgcggtttgttctggcgacaggaaaacagtaaggactggacgctacgagcttttctggaaagcaaacgcaacgggatggggctcactgtggcggggaatcacgaaaccgcaagggcattggctgccgcattcggcaaattactcaatcgaaacttacctgcattgatcggacagaacatcgacgaaagattccttgatcagttgatgaatccaaaccctgatgaagatgtactccgctggttaactgcaccggacgagatacagcaagaaaaagctaatgcctgggatacctttgttgcaacaagtcatacacgctttggcgtcgatatgagcaaagggccagtagaagtagcacagaagattctagcctgccaaaccggcgatgccgcatatcccttgtgggaaaagtactgcgcacattggcatagttacccggatatctatgaggtgtttaagcacatatcaccaccggatctgttgcaaggcgcggaacgctatccaagtgaaaatgaagccgacgaaagaaaattggcagacgcactgttgcaggccgttaccttagaacccaatgcagccgcaaacaaagtattagagctggagcaaaaacatcagtcacggcgtgaaacattgtgggcgcaaatggaacatgcaccgctggcaactgcgatgcagtatttggctgaaatttcccgagcatttttgtcaccactgaatggcggaacggtagctgacttttctcagcattatgctgaaactggctggcgcattgacgcagcagcgcgcgaatctattgcgattgctcagactgccgaccttgaaaaaccgatctatgctgtgctggaaaccctctatcgccgctggctggaaaaggcagcagagtcattccagcagctggtgcaacgagatggctacccacattggagcctacctgacgtacccgatggcacggtggtggtgttcgtcgatggcctgcgttttgacctggccagagaattaaaagaaaaactggttgacgagggacttgccgcacaattggaacatgggtttaccagcataccgtcagtgaccagcagcggaaaagtatgggtttcacccgttggcgaactagccgaaggcggctcctctggcggattcgatcccaagctgccaaaaggcgattacaccgccgaaaaactgcgcaaggcgattgaagcgaatggcttttgtattgttgatactgaaaaccccagcattgctaacggccaaggctggggagagttcccaggtgatatcgacagcgatggtcataaaaaagggttacgtctggctcgtgctgcacccgcgcatctggacgatctaaaacgcaccattcggcgcttattcgctgcgggatggaaagaggtctgggttgttaccgaccatggatggatattgttgccaggcggattacccaaagcagaactaccagccaaaattgccgaaacaaaatggggacgctgtgcgatattgaaggactcagtggatgaccaggactggttggtactgccgtggagctacgacgccacagttcgcatcgctttggcgcgcggcatttcggcattttccagcggacgtgaatatgatcacggcggattgagtccgcaggaatccatcatcccgctattgcgagtgagccgaccaggccccgttgaaggtcagccaaagcttacttccatttcatggaattcccgcaaaacgatttgttcggtgatagcaagcgatgccgctgaattagacttaagtttggaacgactggccttccctattggcgaaggtaacgccatcgacaaagacggcaagggacgtgtgatattcgaggaagtggatgacctcttaggcgagcaagtttcgttggttttacgccgcgacggacaaaaggtttgtgaggaaaaatttaattttggggaggtttggcatgcagcttga

SEQ ID NO: 1231 - DNA, 2553 bp, Geobacillus sp.
atggatattgttcaagagttacttcaactattcgaaaaacaacttgaggaaaatattggtgcggatcgtgcgattgtcttttggtatgatgcgcaaagtgaggagcgcgatttagcagaaatagaacaagcgttgaatgaaaagggaatcaaagtttggaaattaaacgatcacaacgcgttccaaacaaaagtattgttggaactcgaggacacggaaaattcgtatttaatatacgctccatttgccaaaccgaaagatgaagataactttttattagatatccttctttacagcggcaaatacggagaatttcaagcggatgaaatcgcgattatgatgaaagagcttcgtatcgatcatttagcgattcgaccgtttatagaggagcattgggcgttttttaaaaacaagcaacgagtttccaaatttaaaaagctgcttccgaataacccaaatgccaatgatgtaaagcaaacgatgatggctgtattatgtgatgcgaaaagcatccatccacaggagttattgaaaagcgtcgtcgcaaaaaaaggcggaatgtcggatgataatgaagcgctcatgcaaatggggaagtatttagatgtcaatctgtttttcgagctaatcgaagattattttggcgtctcaccgaaagaagagcatcgtctatcccatattatcgaaacaatcgtttatcagcatgttgcttccaatatcgatgaaggtgtattacatgttcattatccttgtagcgttccaaatatttgtaaagtatttattgatgattggttgaaatcggacgaacgtgaaatattagaaacgattttgttggaactggaacaaaagtggaatgtgccgcaattagtagaaacgcatacgtatcaggcgttcattcgttgttttacgttcccgattatcgaacgaaaagtgctggatgctttgcatgaattattattaaatgaaacggttcttgtgaacgaatggaaaagtattttggcggaacgaaggaaaggttattggtatcaagcgcattttgcacaagagtatgaattgttggagaaaatacttgatttttatgaatggaaaatcatttttgaacgagatgatgcaccgaaaaacgaacaagaatggttttcgttgtatacagaaaagtattaccgtatcgaccaactttatcgccatatttatcttctgtatagaaaaggaacgaatttggaacgttacgaacaattaatagaaagagtaacattttggtatgagaataagtatttaatgacgttagcggcacatacagatcacatgttggaaacaagactcagcaaacaatggaacattccaagtgtaatgcagcaaaaaaatttttatcaacattttatacggccattgttagaggcgacacgggagcgtatttttgtcattatttccgatgcgcttcgttatgaaataggaatggaattgttagaagagtttcaacagcgtttaaacacagaagtgaaaatcattccgatgcaggcaacgcttcctacttatacgcaattaggaatggcggcattgcttccaggaaagattacgggaataaaagaagatggcacgatttatgtgaatgatttttctacgaaaggcttgcaaaaccggaataacattttgcaaatgtatgaagtggattctatcgctttaaaaatggaggacttcattcaattaactaaagacgaaggacaagagtatattcgtggcaagcgcgttgtctatttgtatcatgatgccattgacgcgattggcgattcgagcaaaacggaagcatatacgtatgaagcagtcgaaaatgcgttagaacggataaaagcagccgttcgcaaattaacaggtacgtatgaagctgttcgtatatttctaacaagtgatcacggctttttatatcaaacttcccaagtcgagcaatttcagaaagcagaaagtttaaagggagaaatttatgacgggaatcgtcgctttgcgattgggaaaaacttaacggtccctgttggcgcgatcaaagtttctctcgattatttaggtgtggattgtgaagcagtcattgcaaaggggctgaatcgctttactgccggtggcggattgcggtttgttcatggcggtgcaatgccgcaagaaagcattattccgttaatcgaataccggcaaataaaaggaaaagctcgtaaaactgaagcggaacgggtaaacgtacaggttgctttgattcaaaaagtcattacgagttaccgatttattgttccatttttccaagaagaaaaagtctcacctgagcgacaaccacgaacgttgcgggcagcgttttaccgcaataacgagcgaatttcgaatgaggtaacgattacttttgattccactggggaagtttcagaacggcaaatagaagtggtgtttcatcttttagaagaccggtatcgaatgggagaaatatgcgttttacgcttagaggacgtatcaggacgtaccacagagctgtatgccgaagaggaattcgagttgaagctgtatagtattgaatga

SEQ ID NO: 1232 - DNA, 2598 bp, Geobacter sulfurreducens
atgggtaaggtttccgacaaggtttgtgaattgctgaaccgccaagtcaaagagcgggggatcgtcgtctggtacgactcggagaaggtctatgacggcttggcaaaacgcctgcaaattccggagacgaccgtactgtgttatgaaaatggcttcttccccttacgggagcggatggagcagttcctggagttcgtcaccgaagacggccgcccccaggacgattgcggcgtgccacccaagctgattgtctatgtcccgaagtcacggagtgaaacaggttttgccctcatcgaggctgaatcggtcggagcggtggttgagcctggcgcgccgacagcggatcgtaattcgcggctttctagcctggttgaacaggtcttcaacggagtagccccggaaaaggcggcccatgtggcacgccagaccgaagaaggtttgctgacacttgcggaactcgaccagatggccgaggaggcgggtacagtaaccaccggggcactcaaactcatattcggcgcagcatcgccggtggatgtgatcctttccttcttggccgggaatgagttcgatgtgaagcttgagaaaaagcacagcctaagcgagctggctgtcgtggcccgcgaagagcttgggctggatgtcgagctgataccaacggcgacggaactgcgaacggccatccgccggcatctgctcctgtgcgagttgatccagggactaccggaagagggttttcctccctcgttatctaccattgctctcccccggaaaccagtccagttcgacacgatccgtcatgttctgaatgtctggcggcagcgcctggatctccaagaagcctaccgcgagactgccgaaaacgtccaggcaatgacgcagctggataaggcggtttttccaacagaagcgcttcgtggtctcgaaacatttcccttcatcgaataccgtctgttgctgtccgcaagaaacaacttggcccagagggacacagactcgccgctggctctggccaaggagcgcagagcctctttctggagccgtgtctatcccgaaatcagtctgcgttggtccctcgttgaggtggcggccaggctgctccaagtatcaggcttgatttgcgatgctctgaaacggcgcaaatttactgccgaagaactgataacggcttatacgcgtcatggtgagccgtggatgctcttggatcgttatgcgcgtcacctggaaagccgctatgtccgctgcgaaaccttcggttctactgatgatgctggcatggatgaattgatgcaccaatgccgggtcgagtatgcgaacaccctggcggtgctggcggaagcgtacagcggggcattggagagggaaggatttacccctgcgggattcgaccaacagtcacaaacattcaggaatgccgtggcgccgctcctcaaagatggtggcaaagtggcctattttctggttgacgccctacggtacgaaatggccgatgaactctgcgagggcctgagtgcggattttacggtacatctcgaaccggcactggggcagttgcccggcataacttccgtgggaatggcagcccttcttcccgcagctgagaacgggctcgcgctcgaagctgtcggggggcggatgcgcgtctgtgtacagggagagacggtgaatgatcgttcggcccgcgtgacctggtttcaggagaaaagtgattcaccgaccaaggtattcaagctcggcgatattgtgcgcttgacgccgaaacggaaaagggagctggcagaggcacaactggtcatcgtgacctctcaggagatcgaccggcatggtgaagaggggggggaagatgaggaaacccgtctctacatggacgaggtgctcgaaaagttgcgccggggactgcgtaaccttgtccaggcggggataatggaacttgtcattgccgcagaccatggcttcatctttgccgaagcgcttgaatctgggctgaagatggatccgccgggcggcaaaacgatagctcttcatgaccgggtctggatcggacagggtggcgttgctgcggatggcttcttccgggtcaatgcaagcgaccttgagctgggcggtccccttgagctggcatttcccaagggcctgggaatcttcaaggtcccgggtggcggttgctcgtatttccacggcggcgcgtccttgcaggagcagatcatcccggtgtgccggctgacggcgaaggctccaaaacgatctgctgttatcacggttaatctgaaacttcaactggccaaacccaagatcacgaatcgcttcttctcagtcacagtgagtctggaggcggaagggcttttcacggacgtggcgaaacgggtccgtctggaaattctttccggcaaggatgaggttggtcatacggctatggctgcctatggatttgaggaaggctcgcgggagatagttgtggactatgggaagcccaattccgtcacgattatgatctcagaaaccaaaaagcttgagcatatcgaaatccgtgccgttgattgtgagtcccagctgctgcttgcctcattgactggagtgccggtcgaactggcaatatag

SEQ ID NO: 1233 - DNA, 2316 bp, Haliscomenobacter hydrossis
atgagccttagcctctacgataaagtcctacaggccttaaaacaagccgaaaaccacaacagcaacgtgatggtcaggccggaggtcatcctatggcccgatccagaccatcaatggctggaggtgatcccggtattgcaagccagtttgccgcacttactccgctacggctcctatgttcccgctcagcagcaaggtcccgccatttggctaaaatgtatggtggccaggatgttgccagctgccaactgggactccagcatcatccccatcatttacctgcctggggtatccaaaaatgatttgcggaatgtagagcaggccgtttttgattttcaacccctcttggagtaccaatacaccggcaccctctttgtacaagaaaacggcaaagaatggaccatcctggcttttgtagaaaatcccttcagtggtttaggcctgaaagtggccaaagacagcgccaccaaagacgccctgaagaaaaccctccctaccatctttcaagacgcccaggccttgtcgggcaaagccctcattgacgccgatcacctcaacaagcaggtgtttcccgacatcattccggccatcctgacctggatgtgccagggcgatcgcttcctgcacagcctggaacccggcaaaagggaagtattcaaactcctctgccgatcggcctacgacttcgaacccgatcaccgcaacatcagcgccatcaccgaaaaattgggcgcgcaaaagagcgcctggaaatacgtctggcagctctatgcggctgctccgcacaaatacccggagctagaagccttgttgcgcctggccaaacccgctgacttgggcaagggccccgcggctttgcctgctgaaagttggccccaggtcaatgaggaggctgaagaggcactggcccaggctttgctcaaggctgccagcctggatgcccctgcagccatggctgccctgcacagcctggagaaaaaacacctgccccggctaaactgggtttggtttgaattgggcaaagcgccgctggctgctgccctaccctatttggtgcaactggccttcaaagtgaccgttcctttttcaacttcgtccatcgaggccatgaaaacctactatacggattcgggctatttgatcgaccaatccatgcgcaaagcgctggtgggcgtcaagtcggaacgggacaaaggcatcgtcaaatccctcatccagttgttttaccgcccctggctcgaaaacctcacccttaagtttcaaaaactggtggctgccgatgccagtatttttaccacccaaacggcccagccagagcaggagtcctttgttttgtttgtggatgccttccgctacgagttggcggtggaattcgcccagcgcctggccaaaacgcagtgccaggtgtctttgcaggccaactggtcggccatcccttctttaacgcctacggccaaacccagcgtttcgcccatcgctacggcggtgtccacccagagcgggattaccgagtttcgaccccacttgcaaaatggcaaggacttgctcactgccgcgtttcgggatgccttgaaaaaccaggatgtgaagtatattaccaacgccagcgagattcaaggccctggaaaatattggcaagagattggagacattgacaccaaaggccacgaagagcaatcgggcatggttaaacgcgttgaggagttatttgaagggatcgaagaggtgctggccctcgcttttgaaaaaggcatcacccgcatcaaaatagttaccgaccatggttggctcctgctacccggtggattgcccaaagtccaactcaatgccggactcaccgaaacccgctggggccgttgtgccttgatcaaagagggggtaaacaccgatttgttgcacctgccctggcgttggaaccccgctactttcattgcttatgcgccaggcatcgccttttttaaagccaatgaggaatacgcccatgggggcatctccttgcacgaatgtttgatccccaccctgatggtggagcagacccagtccgccactgccagcgccaaaatcagcgacatcaagtgggtcaacctaaaatgcaacgtgactaccgcacacgccagcgatcagtttaccattgacatccgcacgaaatacaacgacgaacatacctccatcgtggaatcaacccgccgcaacctcaaagacaacaaaggcgttttgatggtcagcgatgacgccgataccaaggccgccaccgtggtcctcctggatgaaactggacgaattttggataaaaaagtgaccattgttgggggttaa

SEQ ID NO: 1234 - DNA, 2496 bp, Halobacillus halophilus
gtgaatgtaattgaaaaactacaagaaaaaatacaacaagaaaaggaaaataaaggtagggcgattgtgttttggtatgacgctcaggctcaagtgagtattgatgaactaagccaacaattagtgggtgttgaagttaggtatttaacagatcaaaacttttttcaactgaaggtggagcttgaacttcaaagagcaacagattcctatttaatctattctgatgtaccaagacccgacgacaaaaataatatattgttggatatattgtcatacagcacagaattcaaagcagatgaaacagctatgctatcagaaacattacacgtatcagaccaggttttacgtccaatgatggagaagtatgcgtcattctttaatagcaaagagcgtaaaagaaaactgtataaagtattacctgaacaagcgaatgaaacgcagtttgaaattagtatgatggccgttataacaaaagccacggtagctgacgtcagagttatctcacgtcaagttctctcgtctgatttacagttggaagataatgagtttgtgaaggcgattaagcgtaacttctccttagatcgcacactggagatcgttggtcgttattttggtgtttctttgggtgatctaaaccaacctttcaaagagctgataaatgtacttatttatcaacactttaaacaaaaggcaaattttatcgtggaagagtgggaaaagcgttggatttcttcatcccctaacgtttgttcgcttttcattgaagagtggcttcagcagagtgatgcagatattcttgaaaaccacattaaggaatgggagaaggcatttcatgtaagggagaaattaggtacacaagacatctccaactattctctaacagacaccttccctgttgttgatgctctgatcatagaaaaatgtatcgatgagctacttcatcaaacaattcagggggaagaacgcttatctttaattgcgcaacgcttgcagacccattggggctcaaaaggtaaactgagagctttgtataaaaccctttacgaagctattcgaatggagactttaaaaacttttgtacatcgaattcatcaggaaagtgatttttatgaaaattatgcggaatctctctacgaaattgatcaggcctatcgtcatttcatggatcatttcacacgtcttgattcgaaacagatgttggaagaggttgctaatcgtctgacaaattggtatgaaaatgaatatttaggtcgtctatcaggggaaatgaatttcaaacttgaagatgattatgtaccaaaaataatgccacagcgaacattcttttctgaaaagattcaaccaatattggataaagaacaaacaagagtgttcgtaatcatttcagatgctttgcgttatgaagctggctatgaacttcatgaccatttaacgaaacgtgaaaatggtagctctagtcttcaaccgatggcatcaagttatccaacttacacacagttaggaatggcgtcattactaccccatcgtcaactagaagtcgatgacaaaaaaggtgtattagctgatggacaatcgactaaaggaatggataaccgccgtaaaatcctgcaaacggttgaatcacaaacagaagtttttaagttgaaacaactactagatatgaaaacaagtgaagccgagcaattattaagaggaaagcggttggtttacctataccacgatcacattgacgctttaggggattcagctaaatcagagcgtgaaacctacggagctgttcatcaagcaattcaagatttacaaattgcagttgatcgtttgtcccgccttcaagcaaagcggatttttatcactgcggatcatgggtttctgttccaatttaagcaaattgaggagtacggaaaaatcccagctgttgaagggaatgtattagatggtagccgacgttttgcaattggacatgatttgtcagttccagaaggagcaattaaattagctgagcaccaaactcctttaaaaaatgctgaagtcgtgcttgcgaagagcctcaaccgttttaaaactggtggtggccttcaatttatccatggcggagcattacctcaggaagctgttgttcctttgattgattaccgtcgcattgaaaaggctcaaccagtggatattgcggtagccatgattaataaagtaatctcgaactaccgagtgcccgtgtcgttctatcaggaacaaagtatcacagatgaatacacatcgcgaaaagtgcgagcagctttttaccagggcaatgagcgaatatccaatgaagttgaacttgtgtttgatctaaagggggaaaataaagagcgtaataggcaagtagagtttagcttaattgaaaagcattataagataggtgaaaaatgtaaactgagaattgatacagtaactaaaaagggtaaggaaacatatctcgaagaagagtttgttttacgcctatatgaagccttgtattaa

SEQ ID NO: 1235 - DNA, 2523 bp, Halobacteroides halobius
ttggagttagaacagatagaaaagatactaactgagaaatttaatcaaccattaactgaagaaaaggatcgtcagattatcttctggtatgatgcagaaggtgactttaaagaagatatagatcggctacaagtagctaacgctaagatttggaagttgactggagataataaatttgctactaagtatcaactagaagttaaagatcaagagtctaattacttagtctatgctagttatccccaacctgattaccgagaggactggttattggatatctcctcttatgcagatgactttactgctgataaagtgacagtcattatgaaggactttggagttgaagatccttctttgcggccagtatttaagaagtataagaagtttttcaataataaacgacgttataatcggctacttgattatgatattgaagactatacagaacgaaaattagatactgctattatctctgctgtctgtaagttgaaagcaactgacctagaagaggcagtcaagaaagtattaatgaattcgctaactaatgatcagaataaatggttaacaaagattaagaagtttgctaatgaagataaattctgggagctaatagaaaataaatatggttatttagcagaagataaagacttagcagatttaatggctttattaacagtaaccaacctagaacatgatttaaacgttactttaccagaagagtggtcagattatctatcctataaagataataattgtattgtatttattgaccactggatgaatcacagtagccaggctgaagtttatgataacttaagtacagaaattgaaactaaattaaatttgcaagagtatatcactaactgggaactagaagacttcttagaatgtgatacttttaaatcttttgatactgctattattgatcgaattgttgataacttgttaaatgatattgatgactttaagcgttatcaagatatcatctctttacggcggactaaacactggtatccagaatttgaggaagtctatgaagcaatctattgggcagtagaattattcaaacaagctaaagaacaatctattaggcagataaaagcaacagatttctttaacaagtatactgaaaaatattatttatttgaccaggcctatcgtaaattctattctacttatgatcaggccaagaataagagtctgttacgagagttaagagataaagtggaaaatctatatactaactcttacttacatgaattatctatcaactggtctaatagtgttgaccaagaactaaaagagtcttggccattaggcgggattactcaacagcaggagttttatcaagagtttatagctgataaaagtgaacgtacttttgtaattatctctgatgctctacgatatgaagttgcccaagagtttagtcaaaagcttaataatcgcttaaaaggaactactgaactatatgctatgcagggtagtttaccaagctatactaagctaggtatggccagcctactacctcatcaagagcttaatatcaatcagcaggggcagatatctgtagatggaatcagctcacaaggactgaagaatcgggaaaaaatattagcagaaaaagagcctgattcaactgttataacttacgaagagttagtcgaattgagtcggagtgagctaagagaaagaatgaaagggactcaagtagtttatatctatcataatgagatagatgctaaaggagaccatgctactacagaaaaagaagtcttttctgctgtagagaatacttttacccagttagatactattttaaggattttgaagcatagtttaagtgctactcatgtctatattacagctgatcatggctttatttatcgtcgccgtgctttagagtctagtgataagactgagcggttaaagtcagatttaattgagcgcaaaagaagatttattattagtgaccagcaggtagagcctgatggaactttaagtgttaatttagattatatctttggtgaggatagtaatctacaggcccttgtaccacgaggagttaatagatttactctacaagggccaggtcaaaattatgtccatggtggagctgcacttcaagagatagttattcctgtagtccaatttagaaatgatagaagtaaagaaagtgataatgaagtcaataaagttgaggtcaaattaactagtattacacgagaacttactaataatatttcctaccttgattttttccagacagaaaaggtagcagagaaattaattcctaggcgcttgaagttatattttactgatgaatctggtgaaaaaatatcaaatgaaaatattattatagctgatagtaattcttctgaacctaatcaaagatcatttaaagagaaatttactcttaagaatcgagagtatagtagagaagaagattattatctagtgatgattgaccaagaaaataatcaagtctataaagagattaaattttctattaacttattatag

SEQ ID NO: 1236 - DNA, 2604 bp, Klebsiella oxytoca
gtgaccttgcaaaatcaggaatttattgccggccttaaagcaaaattcgccgaacatcgcatcattttctggcacgatcccgataagcgtttcctcgaagagctgggtaatctcgaactggagaacatcacgctactcgacatgaccgaccagtcgcagctggcggtaaaaaagcgcattgaaattgatgagcctgaacagcagtttttgctgtggttcccccacgatgtgcctcccaaagagttcgactggctgctggatattcgtctttatagtacggagttccatgccgatttcgccgccatcacgctgaatacgttaggcattccgcagcttggcctacgcgaacacatacaacgccggaaggcatttttcagtactaaacgtctttctgccctaaagggactggtcactgagcaggaaaacgaagcttctcttgataagaagatggttgcggtcatcgctggcgtaaaaaccgcaaaaacggaagagattctgttcagcctgattacccaatacgttaatcagcggaaagatgacgacagcgacctggaaaacacgctggcgatgctgaaacgccacgatcttgaaggtgtgctgtgggacattctgaatcaggaaatgggctatcaggccgagtatccttcgctggaaaacctgatcctaaagctattctgtaccgatctttccgcgcaggcagacccgcagaaacgcgaatggcttgaaaaaaacgtgctgaccacaccgtcaggcagagcctccgcgctggcgttcatggtcacctggcgcgccgaccgtcgctacaaagaagcctatgattattgcgcacaacagatgcaggattcgctgcgaccagaagaccagtaccgtctcagctcgccatatgatctgcatgagtgcgaaaccacgctgagcattgaacagaccatcattcatgcgctggtgacgcaacttctggaagagagcaccacgcttgaccgtgaagccttcaaaaagcttctgtccgaacgccagagcaaatactggtgccagacgcgtcaggaatactacgccatctatgacgcgcttcgtcaggctgagcggctgctgaatctgcgtaatcgtcatattgacggtttccactatcaggacagcgcaacgttctggaaagcgtactgcgaagagctgttccgctttgaccaggcctaccgcttatttaacgaatacgcgctgttggttcacagcaaaggtgcaatgatcctgaaaagcctggatgactatatcgaggtgctgtattccaactggtacctggcagaattaagtcggagctggaataaggttctggaagccgaaaaccgtatgcaggagtggcgtattgcgggcgttccacggcagcagaacttctacaatgaggtagttaagccgcagtttaacaatccacaaatcaagcgcgtattcgtgattatctccgacgcgctacgttatgaagtggcagaagagctgggcaaccagatcaatacagagagacgctttactgccgaactgcgatcccagttgggcgtgttacccagctatacccagctgggtatggcggcattgctgccccatgacgagatatgctaccaagcgggtaatggcgatatcgtttattcggacgggttatccacctcaggtacgcctaatcgcgataccattcttaagaaatataaagggatggcagtaaaatccgacgatcttctgaaatggaaaaatcagcaaggacgtgatcttattcgcgattacgaagtcgtctatatctggcataacaccattgatgccatgggtgacagcgcatctacggaagagaagaccttcgaagcgtgccgcaacgcagtggttgaactgaaggatttagtgacccgtgtaataaaccgtcttcatggtacacgcattatcgtcacggccgaccacggtttcctgttccagcagcagcccctttccgggcaggataaaactacgctgcagatcaagccagacaatacgattaaaaaccacaaacgctttattatcggccatcagcttcctgccgatgatttttgttggaaaggaaaagtggcggataccgcaggcgtcagcgataacagcgagttcctgattccgaaagggatccagcgtttccatttctcgggcggcgcgcgatttgtgcatggtggtgccatgctacaggaagtctgcgttcccgtattgcaggtgaaagcgttgcagaaaaccgctgccgagaagcaacctcagcgtcgtccggtagacatcgtgaactaccatccgctgatcaaactcgtcaataacattgataaggtcagcctgctgcaaacccatccggtaggtgagttatacgaaccgcgtactctgaacatcttcatcgtcgacaacgccaataatgtggtatccggtaaagagcgaatctgctttgacagcgataacaacacaatggaaaaacgcgtgcgtgacgttacgctgaagctgattggcgcaaatttcaatcgccgtaatgagtactggctgatactggaagatgcacaaacggaaacgggttaccagaagtaccctgtaattatcgatctggcatttcaggatgatttcttttaa

SEQ ID NO: 1237 - DNA, 2487 bp, Lactobacillus amylovorus
atgcctacattaactactgataagattattgctaaacttaatagttattttacagataaccaatatgttttttggtacgatgataagcaagaattcaaggatattattgattcaattgcacagcgtttaagctcagttaagctctacaaagctcaagcaaatcaacaattcaagagtaagattgatttgctaaacgattcagagcataaatatttaatctatgcaccatacaagagacctgcaattcaagagaattacctaactgatatggaacattattctaagctcttcactgcagatgctacacaaattatcttggaagaactccaacttccagagaatcaactgctttttgttaagaagtataatagttactttggtgccaaaactagaagagcagattttgttaagtattggtctgatacttttgataagacaccagaaaagggtattattgctgcaattactaaaacagaaaagctcgatatgaatgagttgttaatgaaagtaattgctgcaggttatactaataatcattatatttttgcgttcagtaaatatgatgtacttgatactttttggaagatggtcatgaattactttggcggggaaactgatagcgaggttgatctgaagtatttagtcgagcgcatttttatcacatacctagccaatgaattaaacaataagcttcctgatagatttaaaaattattatcttaagcaatctgataatgtgcagatctttattgatcgttttgctgattcaaataagtatcaacaatactatgacaattgttcatctacagtttggcgtgatttaaatttgaatactgtactgaagcatgaacctgccatgatcttaactaagatcagtatatttgaagaaattaatcatttgattttagctaagttagtcgctaaatttgacggtaaaagaattaccgactatgaacagctacttgagattatcgatcagatgcttgatcatacacgtaataatttcaatggcggaactgaacccgaatataaattcttacgttatgctgcagaattattgaatttaagagtgccaatggttgatgattggcaagatgagttaaatgattacttagataatagttacaaaatcgatacgatttatcgtaagagtttgttggcttatactaatatcattgatactgacaattatattgacattaagaaaactattgaccgttattatggcaatattttgcttgatagttctgtgaagcaatggaatgaaacttttgacttaaaagaagttccagccaagctgaagcaagaacgcttttatcataattatgttagggatgtacgagagagagtagtcgtaattttctctgatgccttgcgttatgaagtggctaaagaattagaagaagaactgaatagtgatgatcgtctaactatgaagatgaatcatgcaattacggttttaccatcggttacttatatggggatgaatgtaatgctgcctcatgaaaccttagaatgggataataaaacttctaaggttaaagtgaatggtgaaaatgcagaaaatactgacagccgggacaaactgcttaagtcatatgataaaaacaatcttgcttttcaattaaagaatgtcctagaaatgtcttctaaagagattaagcaaatgattacaggtaaaaatgtaatttacctctatcataaccaaatcgatgccaagggacatgaattaaagacaactaaagaattagtcgaagctactgagaaggcaattgatgaaattaagcaggctgttcaagtcttaagaactaatggtataactcacatcatcattactgctgatcatggatttatttatcaagaaaagccaattgaagataaagataaaatcgatcttcaaggtcaaaattatgaaggaaatgctcatttaagatatttaattactccaagtcaaattagtgtaatgggtgttaaaaatacaacaatgggtgtcagtttaaataatgatgaccctactaatgtttattatccagtaagtcccaatgaattcgtagctagaagtggaagcaagaattatgttcatggtggttcttctattcaagaaatgttaattcctgttttagatattaaagcaacttctagaagatctattgctcaaccagcagaaattaagttggcggcaacaacatttagaattaataatttgaagatgaatctattgttcaaccagactgcgccaattagtgataccgtcttaccagcagaatatcatgcttacttcactgatgaagatggtaatttgatttctaataatgtaactattgaagcaaatcgaactggctctgcggccgatcgtacaattgctattacgattacaatgcaagacatgcagtatgatcttgataagaaatactatttagtaatagatcgtgaaggtagtacagaagagccaaaacgatttgaatatagtatggatttgattaattaa

SEQ ID NO: 1238 - DNA, 2499 bp, Lactobacillus casei
atggcagaggtagaattgaaggatgtcgtcactggcattgagaagctgttcaaaggtcacacgcactttgtcttttggtatgacaaggagggcgagtttgctgacaatattgacgaactaggtcatcagttgactgaaccaattgtaatcatgcagccacgaacccagctgaagacaaaaatcgaacttttggacattgaaaaggccggggggaaggcgcttgtttatgctgcgttcagtgagccagacattcatcagaatcttttgaccgacatgattctttattccaagaagtttacagccgatatgaatgtcatgctgcttcacgaactcggattgcctgagactgagctgacctttgttcaagctcagcgcaaattctttgccgctaagacgcgtattgctaagtttaagcagcgttatcaacgcggaaagaatccagaacaagttgagcttgcggcaattgctaagacgaatgacttgcaactatcaaacatattgattgaagttatcaaggcaccaacacttttagacgaatttgccaaatatcaggttttagagacattttggagttttgttgatcgagcatatgggtatcatggtaaacatgatctacaagagctgctggcaaccatgatggtgaattttgcgtattatcagatggagttggatttgccggtaacgcttcgccattatgaagtcagttacattaataatgttgtatctttcatgttgaactggcggaatcgaaacgatactcgcgaagtatataaaaacacagctgctcaagtttggtgtcaacttgatggtcagcagatcttcaaaaatctgaagatagctgatttattgaaggcagacacgtttattgagtttgatcggcacgctgtgaagtggctgatatctgaattgttggcaggtcatctgggagaggttattaaccacatgaccttgccagcgattgctgaaaaacgtgggaaaatgtacttttctccggagtatcagctcgcttatagtatgactgttgatgcccataacgttttgttgcctcgggaaaaccgagatgttgatcagtttgacgacctaatcaaggcttatatcaccaaggattatttagttgacacggcttatcgtcgatatatcaatgctttggatcagcttccacccacacaagtggacttgtttgacgatttgtctcgaaatgttgaatcggcatacaacaacgagcatcttgttccgatgatttccgattggtgccaagattatgtgccaaatatgatcaaaccgcaaaggcgtgagcggaatttttattcctccacggttgggccaaataaggatcgtacagtagtgattatttcggatgcctttcggtttgaggcggctaaggaattacagcagagactggatgaacgggatgtttttggcacagaaatgcaatatgcagtcacgggattaccgtctgtcacttattttggtatgccatcgcttctgccgaatcatgaactctcgtatcaaggcaacaaggaattattggtggatggtcaaaaggcgatcaatcttgagcaacgcatgcatatcctacaaacgattgagccgaaaagccaagccacgcggttgacggatttcttatcgctttcgtcaacagaacaaaaaaaatacgtcgcagatcaaaaagtgatttatttttatcacaataccgttgatgcgactggcgataaaccagcctcggaagtcaaggtatttcgtgccgtagaggatgcgatagctgagttagagcggggcattgatcgtttgcggactatttcaattcgaaatatttatgtgacagctgaccatggctttatctatcgccgtcatctactggattcgacagacaaaattaatttaccaagtgatgtcgaatttgagcacaagaatctccgttacgcaattggatcaactgattttgacgaaattggggtagataacatcaagctgggcgatgtgttgggcaacaatgatcaacgattcgtcttttatccaagtaatgcgaacgtgttctcagtacctggagccggtcaaaattatgttcatggcgggtgttctcctcaagaaatgattattccggttttgcatgtcaccacagagagtcgcaagtcgcaggcatcgtatgccacattggcagtgacagattccagccggcgaattacgagccacgaagttattgtcaatatggttcaaaatgatccggtcgatgaaacgcatcgtgcggcaacttacgcactttattttgttgatgggaatggccgacaaatttctggcgaacagcttgttcacgcggatattacctcaatcaatgtcaacgaccgattgattcgccgacacataccattgatcgatcaggactttgaacgtggtggccactatcagttaatcatcaaaaatgttgatgctaacacaagtacaccgatagattatcaaatggatctcactgtgggaggaggttttgactttgacatctga

SEQ ID NO: 1239 - DNA, 2487 bp, Lactobacillus helveticus
atgcctacattaactactgataagattattgcgaaacttaatagctactttacagataaccaatatgttttttggtacgatgataagcaagaattcaaggatattattgattcaattgcacagcatttaagctcagttaagctctataaagctcaagcaaatcaacaattcaagagtaagattgatttgctaaacgattcagagcataaatatttaatctatgcaccatacaagagacctgcaattcaagagaattacctaactgatatggaacattattctaagctcttcactgcagatgctacacaaattatcttggaagaactccaacttccagagaatcaactgctttttgttaagaagtataatagttactttggtgccaaaactagaagagcagattttgttaagtattggtctgatacttttgataagacaccagaaaagggtattattgctgcaattactaaaacagagaagctcgatatgaatgagttgttaatgaaagtaattgctgcaggttatactaataatcattatatttttgcgttcagtaaatatgatgtacttgatactttttggaagatggtcatgaattactttggtggtgaagttgatagtgaagttgatctgaagtatttagttgagcgcatttttatcacatatttagctaatgaattaaacgataagcttcccgatagatttaagaattattattttaaacaacaagataatgttcaaatctttattgatcgttttgctgactcaaataagtatcagcaatactatgacaactgctcatctacagtttggcgcgatttgaatttgaataccgtgttgaagcatgaaccagccatgattttgactaagattagcatattcgaagaaattaaccatttaattttggctaagttagtcgctaaatttgacggcaagagaattaccgattatgagcaactgcttgagatcatcgatcagatgcttgatcatacacgtaataatttcaatggcggaactgaacccgaatataaattcttacgatatgctgcagaattattgaatttaaaagtgccaatggttgatgattggcaagatgaattgaatgattacttagataatagctacaaaattgacacgatttatcgtaagagtttgctagcttacactaatatcattgatactgataattatattgatattaaaaaaaccattgatcgttattatggcaatattttgcttaatagctctgttaagcagtggaatgaaacttttgatctaaaggaggttcctgtcaagctgaagcaagaacgcttttatcataattatgtcagggatgtacgagagagagtagttgtaattttctctgatgccttgcgttatgaagtagctaaagaattagaagaagagctaaatagcgatgatcgtctgacaatgaagatgaatcatgcaattacggttttaccatccgtcacttatatggggatgaatgtgatgctacctcatgaaactttagaatgggataataaaacttctaaggttaaagtaaatggtgaaaatgcagagaatactgacagtcgggacaagttacttaagtcatatgatgaaaacaatcttgcttttcaattaaagaatgtcctagaaatgtcttctaaagagattaagcaaatgattacaggtaaaaatgtaatttacctctatcataaccaaatcgatgccaagggacatgaattaaagacaactaaagaattagttgaagctactgagaaggcaattgatgaaattaagcaggctgtccaggtcttaagaactaatggtataactcacatcatcattactgctgatcatggatttatttatcaagaaaagccaattgaagataaagataaaatcgatcttcaagggcaaaattatgaaggaaatgctcatttaagatatttaattactccaagtcaaattagtgtaatgggtgttaaaaatacaacaatgggtgtcagtttaaataatgatgaccctactaatgtttattatccagtaagtcccaatgaattcgtagctagaagtggaagcaagaattatgttcatggtggttcttctattcaggaaatgttaattcctgttttagatattaaagcaacttctagaagatctatcgctcaaccggcagaaattaaattggcggcaacaacatttagaattaataatttgaagatgaatctattgttcaatcagactgcgccgattagtgataccgtcttaccagcagaatatcatgcttacttcactgatgaagatggtaatttgatttctaataatgtaactattgaagcaaatcgaactggttctgcagctgatcgtacaattgctattacgattacaatgcaagacatgcagtatgatcttgataagaaatactatttagtaatagatcgtgaaggtagtacagaagagccaaaacgatttgaatatagtatggatttgattaattaa

SEQ ID NO: 1240 - DNA, 2487 bp, Lactobacillus helveticus
atgcctacattaactactgataagattattgcgaaacttaatagctactttacagataaccaatatgttttttggtacgatgataagcaagaattcaaggatattattgattcaattgcacagcatttaagctcggttaagctttataaagctcaagcaaatcaacaattcaagagtaagattgacctgctaaacgattcagagcataaatatttaatctatgcaccatacaagagacctgcaattcaagagaattacctaactgatatggaacattattctaagctcttcactgcagatgctacacaaattatcttggaagaactccaacttccagagaatcaactgctttttgttaagaagtataatagttactttggtgctaaaactagaagagcagattttgttaagtattggtctgatacttttgataagacaccagaaaagggtattattgctgcaattactaaaacagaaaagctcgatatgaatgagttgttgatgaaagtaattgctgcaggttatactaataatcattatatttttacgttcagtaaatatgatgtacttgatactttttggaagctggtcatgaattacttcggtggtgaggctgatagtgaagttgatctgaagtatctagttgagcgcatttttatcacatatttagccaatgaattaaacaataagctccctgatagatttaaaaattattattttaaacaacaagataatgttcaaatctttattgatcgtattgctgattcaaataagtatcagcaatactatgacaactgctcatctacagtttggcgcgatttgaatttgaataccgtgttgaagcatgaaccagccatgattttgactaagattagcatattcgaagaaattaaccatttaattttggctaagttagtcgctaaatttgacggcaagagaattactgattatgagcaactgcttgagatcatcgatcagatgcttgatcatacacgtaataatttcaatggcggaactgaacccgaatataaattcttacgatatgctgcagaattattgaatttaaaagtgccaatggttgatgattggcaagatgaattgaatgattacttagataatagctacaaaattgacacgatttatcgtaagagtttgctagcttacactaatatcattgatactgataattatattgatattaaaaaaactattgatcgttattatggcaatatgttgcttgatagctctgttaagcagtggaatgaaacttttgatctaaaggaggttcctgtcaagctgaagcaagaacgcttttatcataattatgtcagggatgtacgagagagagtagttgtaattttctctgatgccttgcgttatgaagtagctaaagaattagaagaagagctaaatagcgatgatcgtctgacaatgaagatgaatcatgcaattacggttttaccatccgtcacttatatggggatgaatgtgatgctacctcatgaaactttagaatgggataataaaacttctaaggttaaagtaaatggtgaaaatgcagagaatactgacagtcgggacaagttacttaagtcatatgatgaaaacaatcttgcttttcaattaaagaatgtcctggaaatgtcttctaaagagattaagcaaatgattacggggaaaaatgtaatttacctctatcataatcaaatcgatgccaaaggacatgaattaaagacaactaaagaattagttgaagctactgaaaaggcaattgatgaaattaagcaagctgttcaagtcctaagaactaatggtatagctcatatcatcattactgctgatcatggatttatttatcaagaaaagccaattgaagataaagataaaatcgatcttcaagggcaaaattatgaaggaaatgctcatttaagatatttaatcactccaagtcaaattaatgtaatgggtgttaaaaatacaacaatgggtgtcagtttaaataatgatgatcctaccaatgtctattatccagtaagtccgaatgaattcgtggctagaagtggaagcaagaattatgttcacggtggttcttctattcaggaaatgttaattcctgttttagatattaaagcaacttctagaagatctatcgctcaaccggcagaaattaaattggcggcaacaacatttagaattaataatttgaagatgaatctgttgtttaaccaaactgcgccgattagtgatactgtcttaccagcagaatatcatgcttacttcaccgatgaagatggcaatttgatttctaacaatgtaattatcgaagcaaatcgaactggttctgcagctgatcgtacaattgctattacgattacaatgcaagacatgcagtatgatcttgataagaaatactatttagtaatagatcgtgaaggtagtacagaagagccaaaacgatttgaatatagtatggatttgattaattaa

SEQ ID NO: 1241 - DNA, 2487 bp, Lactobacillus johnsonii
atgcctacattaactactgataagattattgctaaacttaatagttattttacagataaccaatatgttttttggtacgatgataagcaagaattcaaggatattattgattcaattgcacagcgtttaagctcagttaagctctacaaagctcaagcaaaccaacaattcaagagcaagattgatctgctaaatgattcagagcataaatatttaatctatgcaccatacaagagacctgcaattcaagagaattacctaactgatatggaacattattctaagctcttcactgcagatgctacacaaattatcttggaagaactccaacttccagagaatcaactgctttttgttaagaagtataatagttactttggtgccaaaactagaagagcagattttgttaagtattggtctgatacttttgataagacaccagaaaagggtattattgctgcaattactaaaacagaaaagctcgatatgaatgagttgttaatgaaagtaattgctgcaggttatactaataatcattatatttttgcgttcagtaaatatgatgtacttgatactttttggaagatggtcatgaattactttggcggggaaactgatagcgaggttgatctgaagtatttagtcgagcgcatttttatcacatacctagtcaatgaattaaacaataagcttcctgatagatttaaaaattattatcttaagcaatctgataatgtacagatctttattgatcgctttgctgattcaaataagtatcaacaatactatgacaattgttcatctacagtttggcatgatttaaatttgaatactgtactgaagcatgaacctgccatgatcttaactaagatcagtatatttgaagaaattaatcatttgattttagctaagttagtcgctaaatttgacggtaaaagaattaccgactatgaacagctgcttgagattatcgatcagatgcttgatcatacacgtaataatttcaatggcggaactgaacccgaatataaattcttacgctatgctgcagaattattgaatttaagagtgccaatggttgatgattggcaagatgagttaaatgattacttagataatagttacaaaatcgatacgatttatcgtaagagtttgttggcttatactaatatcattgatactgacaaatatattgacattaagaaaactattgaccgttattatggcaatattttgcttgatagttctgtgaagcaatggaatgaaacttttgacttaaaagaagttccagccaagctgaagcaagaacgcttttatcataattatgttagggatgtacgagagagagtagtcgtaattttctctgatgccttgcgttatgaagtggctaaagaattagaagaagaactgaatagtgatgatcgtctaactatgaagatgaatcatgcaattacggttttaccatcggttacttatatggggatgaatgtaatgctgcctcatgaaaccttagaatgggataataaaacttctaaggttaaagtgaatggtgaaaatgcagaaaatactgacagccgggacaaactacttaagtcatatgataaaaacaatcttgcttttcaattaaagaatgtcctagaaatgtcttctaaagagattaagcaaatgattacaggtaaaaatgtaatttacctctatcataaccaaatcgatgccaagggacatgaattaaagacaactaaagaattagtcgaagctactgagaaggcaattgatgaaattaagcaggctgttcaagtcttaagaactaatggtataactcacatcatcattactgctgatcatggatttatttatcaagaaaagccaattgaagataaagataaaatcgatcttcaaggtcaaaattatgaaggaaatgctcatttaagatatttaattactccaagtcaaattagtgtaatgggtgttaaaaatacaacaatgggtgtcagtttaaataatgatgaccctactaatgtttattatccagtaagtcccaatgaattcgtagctagaagtggaagcaagaattatgttcatggtggttcttctattcaagaaatattaattcctgttttagatattaaagcaacttctagaagatctattgctcaaccagcagaaattaagttggcggcaacaacatttagaattaataatttgaagatgaatctattgttcaaccagactgcgccaattagtgataccgtcttaccagcagaatatcatgcttacttcactgatgaagatggtaatttgatttctaataatataattatccaagcaaatcgaactggttctgcagcagatcgaacaattgcaattactattacaatgcaagatacgcagtatagtcttgacaaaaaatactatttagtaatagaacgtgaaggtagtgcggaagaaccaaaacgatttgaatatagtatggatttgataaattaa

SEQ ID NO: 1242 - DNA, 2508 bp, Lactobacillus reuteri
atggtgcaattaaagttagacaaaatagttaaagaaattaatcattattttgaccaaggatatcagtatgtattttggtatgatcctgatggtgaatttgcagatgatgtaactgaagacaatcagtatttaaaagataatttagctgctgaattacagcccgttggtgcgaaggaacagtttaaaattaagcgaaaactactggataaaaagaatcaggaccgtagttttttagtttatgtaaaagcaaaaaggcctcagctacaatttgattattttgctgacatggagcgttatggccatatatttagtgctaaggctagcgatatagtgtttgaacaattggctgagcaattaaactttgataattcaaaaagaaattttgtcaaaaaatatttaaaatattttcgggctaagtccaggcgtcaaacatatattcataattttgagtcaagattaataaatcatcctgaattaatgatcttatctaatttagctggcttagatcagtttgatgaaaattcactattgatggcagtcttcaaaggaggaatggacgaatctaataacaagattattcgatcattcagtaaatatgatgtcttgccattattttggcagatatacgataaatactttggctgcagtaatgttaggagcttaaagggactgttcgatggtgctctcgttacaagtgtctatagtcaattagaagaaaaaattccatcagagttattagcccaaccttttgaaaattattcgaacgtgcaagttttcatgaagcgctttagtgattctcgtaaataccaagaactataccagaatttaacgggaacggcatggaacgaatttaagctaggtacttacctaaaagatgaaaacgttcaagatttattaagagttgacggtataagacagattgaagaattgctcttagaaagagtcagggccaattttagtgcggatggtactgtcactgatggtgatgagactatcggtgtaatcgatcaagtaaccagaggagtaaatgcgtttaatccggaattcaactttttaaaagagacttatcatgtgttgaagtatcgaccacgattctatgatgactggcatgaaatgcttaatgattatgtaaataaagtatttaaagttgatactcattaccgctacttggtgactaattaccgacgtatttccgaagataagcgtcacaaatatgaagacattaagcgtatggtcgatgattattacaacgatcagatattagatcagtctgttcgtgaatggaatactaccttccagcttcaagatgttgaatctaagcagcgggaacaaaatttctataggaactttgttcatggtgctaatgagcggattgtggtgcttatttcagatgcttttcgatatgaagcagcacatgagcttcatgctcagatagctaatgatgataggattacaagtaaaatgaactatctactgaccggattaccatccgttacgtatatggggatgccttcactcctgccccaccataagttggagtggcaaaaggataatgtactagtagacggccatatggctaataatgctgataatcgccgtaaaattttacaattatgggataaaaataatgacctattaaaactggatgatattctaaaagctaccagtaaggaaattaaagccatgattgctaacaaaaatgttatctatgtgtatcacaatcaggttgatgcaattggcgataatttaaaaacggaagacgagacttttagggcgactgatcaagcaattaatgagataagaagagctattcaagtattaagaacaaatagcgtatcacatattatcgtgaccgctgatcatggctttatctaccgtgaagcgtcagtggaggaacaaagtaaaattgatattccagcaagtgattataatggtaaaatatcgccgcgctatttgatgacaccagatgacctttcgaatattcctggggttatgtcagtgaaactgggcattagtctgacaaataatgatcaaacgaatgtttattaccctgctactgtgaatgtttttaaatcccaaggtggtaaaaattatgtacacggcggatcatcattacaggaaatggtaattcctgtattagatatgagaatgaactcgtcaagatcaaaggccgagtttgccgaaataagattagcagctactcaacatagtattaatgccctaagaatgacgttgaaattcaatcaagtcgaaccaattagtgacttgataaggcctcgtaaatttaacatctacttcatgaatcaatttggacgggtaatttcaaatgttgctactattaacgctaatcgaacagatgcagagattaatcaaccattatcagcagatatcgtaatacaaaatcgacaatatgatcggagtgaagattactatctagttattgatccggataagggatcgattactaatcctagataccactatcaaatgaacctgataaatgattaa

SEQ ID NO: 1243 - DNA, 2499 bp, Lactobacillus rhamnosus
atggcagaggtagagatgaaggatgtcgtcactggcatcgagaaattgtttaaaagcgggacacattttgtcttttggtatgacaaaaatggtgagtttgctgaaaacattgatgatttggctcaagaactgaatgagccaatcgtagtgatggcggtgcgtacgcaattaaagacgaaactcaaacttataaagattgaagaagctggtgaaaaggcgcttgtttatgccaattttgccgaacccgatattcaccaaaatctcttgactgatatgattttatattcgaagaagtttacagcagacatgaatgttatgttgctgcatgagcttggcttgccggagactgagcttagttttgttgaagatcagcgtaagttttttggcgcaaagccccggattgcgcgatttaagcaacgttaccagcatggcaaaaatcccgagcaagtggaattagccgcaattgctaagacgtctgatctgcagctttcaaacattttgattgaagttatcaagaatccggcattgttggacggattcgacaaatatcaattgttgccaactttctggagttttgtcgatcgggcgtatggttaccacggcaaacatgaattacaagatctattggcgacaatgatgattaactttgcctattatcagatggagctcgacttgccaacaagtcttcaaagctatgaggtcagttatatcaataatgtcgtatcctttatgcttaattggcgtaatcgaagggatactcgagcggtttacaaaaaaatagccacagacgtttggcagcaacttgatggctatcaattgttcaagaacttgaagatctctgaacgcttaaagacggatacttttattcagtttgatcagcaagttgtacagtggctggttgaacagcttctgcaaggccatcttggtgaagtgattgaccaaatgagcttgcctgagattgctggaaaacggtgcaggatgtattttgccgaagagaatcaacttgcttatagtatggtcgttcaggcccacagcattttgacgaaacgcgaaattcacgatactggcaagttagatgatcttattcatgcttatatcactgacggttatttgattgacaccgcgtatcgcaaatatacgaatgcttcggaccaattgcctacgtcgcaagttgaagtgtttgagaaattgtcacagaaggtcgaagctgcgtataacaatgaccatcttgctccaacgattcatgattggtgccaagagtatgtgccaaatgtagttgagccaagaacccttgagcggaacttctattcttctgtcgtagcacctaataaagatcgggttgtagtaatcatctcagacgcttttcgatttgaggcggctaaagaacttcaagaacgccttgattcgcgcgatgttttcggaaccgacatgcattatgcgatcacgggggtgccttctgtcacttactttggcatgccatcactgttgcctaaccagaaactgacatatcaaggcgacaaggaattattggtggacggtaagaaagctgtcaacctagaacaacgcttagagattctccaatctttagagcctcaaagtcgggccatgcatttgaaggattttatctcaatgagcttggcagatcagaaaaaatatattgttaaccaaaaagtgatttatttttatcacgatactgttgatgcaactggtgataagcccgcatctgaaacgaacgtttttcgtgcagttgatgatgcgattgaagaacttacgcgcgcaattgaccggttacgtaatatttccattcgaaatatttatgtaacggctgatcacgggtttatttatcggcggcatttgcttgattcaacggataagatcagtttgccggctgaggtggatttcgagcagaagaacctgcgttatgctattggttcacaggattttgacgaaatcggtgttggtcgtgtcaagttaggggacatcttgaacaatgacgatgagcgaatggttttctatccaagcaacgcgaatgtcttttcggtccctggagccggtcaaaattatgtccacggtggctgttctccgcaagaaatgatcgttccagtgctacatgttttgacggaaagcagaaagtcgcaggcaacctatgttacgttatcggttacagattccacccgccgtatcacgagtcatgaggtgatcgttaacatgctgcaaaatgaccctgttgatgagacacatcgaccagctacttatgctctgtactttgtagatgggagtgggcggcacatttccggtgaacaagttgtccaagcagatagtacgtccgtcaatgttaatgatcggctgattcgtaaacatatcccgctcattgatcaagactttgatcgcgctggtcactatcagctaatcattcaaaacgttgaggcgaatacaacaacttcaatcgactatcaaatggatctcactgtagggggagggtttgactttgacatctga

SEQ ID NO: 1244 - DNA, 2499 bp, Lactobacillus rhamnosus; identical to SEQ ID NO: 1243

SEQ ID NO: 1245 - DNA, 2529 bp, Leuconostoc kimchii
atggttgaattaaatacaggggagattgttgaacgaattcgtacgttattcgcgcaaggaaaacagtttgttttttggtatgacgcaaatgcggatttcgcagataatatcggagaaatcactgcacaattgactcaaacgacaattgaaatgcttccgggtgaacaatttaagactaagttagaggttttgagtcttgagaagaatggggaagctgcattaatatattcgcctgcaaaaaagcctggcttatcacaaaatttaatggccgatgtagaacgctactcggttgaatttacagcggacgcaactgtaatgcttcgtgaagaattaggactggaagagaaacaccaagagtttgttgtggacaacatgaagttcttcggaaataaggagcgcattaataaatttaaggcgttaactaaagaccgaaaaattaacaatccagttattgttattttagccgctcttgcaaaggctaacggcatttcatctctggacattcttaagtcggttattcaaacggacttagaagataatcaagcgttgaatgagtttaaaaaattcaatgtttatgatcagttttggcaaggaatgagtagccaatttggttatttttcttcagagccgaagttgaaagaattgttaagtggtatgcttgttattacggcattcgatcaaatggaactggatcttccttcccaagtaaatgtttatcaatcgtttgcgaagactaatgttatagctgcagtttcgcaattgatgaatatggctaatttcacgtctcgtatgaaacaaattgccgatgaagtctggcaatttattaacggagaatcggtttttaaaaacgttgagatgaatgatttgattaaatctgatgtatttagaaattttgatttaaaaatcatggattgggctgctactagtttagtgaactcagaacttcagcctaatggggttgatttacgtttcttgactcatgaacgacaggatacgatgtatgcgaatgagtacgaatcggcgtacaagatgattcgaaaggcgataccagtattagctggtaaagcgtttggtgattacgaaaacgtagaaaaatttgcagaagcgtatgtggatacaaaaaacgggcttgctaatatcgatacatcatatcgtaagtttgttgactatcgttggacgttagattctgaattgtttgactcgtttgatacgcttgcacaacgtgtagaacaaagctatttaaatggctttttgaacccgatgattaagcgctggtctgatgtgtatgatattaagtccattgaatcacaaaaattgcagagaaatttctatcgaaacaaggttgcttcaagcaaaaatccagttgtcgtaattgtttctgatgcattgaggtttgagtcaggacaagatttagcgaagtttattaatagagaaaatcaactatctgctgaagttgattatatgattaccggcgtgccgtcggtgacatacttcggtatgccgtcattacttcctcatgaagagctgacgtatgatgcgtcggtgcctacggttttggtggatggtgttaaagcaacagatttggcttcaagagagttggttttgcaaaaacgcaatgctaaatcaatgacgattgctgcagataaggtgatgagtaccaaaacggaagacctaaagtctgaattcgtgggcaaagatgttatttacgtatatcacaacggcattgatgcaattagcgacaatgcaaaaaccgaacgtaaaacgttcgaagcgactgctcagactgtcagcgaaattcaatcaattatcaagcggttaagaagcgcaaatcgcacaaactttattgtgactgcggatcatggatttatttatcgtgattccgaactggacaccacagataagattgatcttaagccagctaactttatgaaaaaagcaccaagatacgccgtttcgaaagaaaaatttgaacagacgggcgttgattcagtggcgattagtgatgttttggacaatgaccaagaggaaatagtgtactatccaacttccgcaaacgtctttatgtcgcaaggggctggtaaaaattacgttcacggcggtgtttcgccacaagaaatgattgtgccggtgattgctgttcactcaaagcgtggggcagatacatctgaaactgtggaagttcaactgagtccagtcccacaccgcattacttctcgaactattattgtcagctttaaccaattgcaaccaattagttccgacgtgaatggcgctacgtttgaagcgaagtttgtggaccaagcgggtgacgtcatttcttctacggaagttattaatgcgtttagtgatgaccaaaatccaagtaagcgaattattaagaaacgctttgtaatcgcggaccaagtgtatgatcaaacgcaaagttacttcttgattgtcgaaaatgttgaaaataagcaagaaataattcgcgaagaatttacgatggatcttgcaatcactggaggtttcgattttgactttagttaa

SEQ ID NO: 1246 - DNA, 2505 bp, Methanobrevibacter smithii
atgaatcttgaggaaattgaaaaccggataaattcaattattgatgaggcatatcatcgccaaattgtcttttggtatgatgaaaatcaggaatttatagaagatattaataatattcaattaaataatgctaagttacatatcttgaaagacaataatttgattaaaactaaatatcaaatagaatttgaagataaaaattctaattatcttgtttatgctccattctcccaacctgatgataatgaaaattatttagcggatttaatccattatgcagttccattttctgctgataagattgaaatgattggacaagaattagggatttctcctgagttttatcatttgcttaagaagtattctttattttggaatgctaaatcaagagttaatgcatttaaagatttgaatgtttcttttactgaattaaatattaaacaagctattttagcagttttatctaatcagaaaactttaaattttgattatattgttcgtgaagtgattatcaataattttaatgaagaaaatgaaattataaaaaactttgaaaaatataatatcttagaagatttctgggagttaatttcaaggaaatttaaatactcagaagacaatccatctgtgaaaagacttgttagattcttaattttaaattatactgcaaattcatatcgaggatcaactccaaaatcatgggatgaatatttagtttctgataaaaacaatgcttccatatttattagtgaatttatgaataatgcaaattattctgaatattatgataggatagctagagaattagaatcaaaacttaatattacaagcttaagtaaaacaaacattgattcttatataaattgcgattcatttgaaagattcgatgaaaatataattaatcattacactgaattattatttgaaactaaagtggacttaggtgctgaatttaaagagattttagaaaacagaaagaaaactcatttttatttaaaatatgaggataattatgaagttttaaaatatgcaaatttatttatttctttaattaatgagtttatgcgaagtgaacttccagaaaaacctgaagaaattattaaagaatattctgaaaaatgggtttacttagattcatattataggaaattctattatttctatgataaattagatgatactgagtatcttgaagatttaaggcaattagttgaaaatttatatgtaaaccgttttttaagtgtaattaatcctaaatttactaaaaaattagctgaaaaaccaatttctgagttagacattccaaaacaatggaagttcttcaaacaacatattccaacttcaattaggaaacataaaactgcagttattatttcagatgcatttagatatggctgtgcagttgaattattcgcagagcttgaaaaagatccaacaagaactcctgagattaaaccaatgttatctactattccatcatatactgcattaggtatggcatcacttttacctaataaagaaattgtttatgaaggtgatacaatattagttgatggaatgaattgcaggtcaactgatgagaggaataatattttaagttcaaatgttaatgaagtaattgccatatcttacgaagatgtggataaattaaaatctaaggaatttaaagaattaacaaaaggattaaacttaatttatatttaccacaataaaattgatgctagaggagaccatgctccttctgaaaatgaagtgtttaatgcggctcaagaaacaattgaagatttagaagtattaattaaaagattaagaaatcaaggtaattttgctaaaatctttattacagcagatcatggatttatttataaacgtgacaaattaaaagagcatgataaagttaatttagataaattcccagaaaaaaaacataaacgttttattttatctgaaaaacctttaaaaatagatggtgcagtttccttatctatggaatatctaaacatggataagtatgttaatgttccgataggtgcagatgtatttaaagcacagggtgctggacttaattttgttcatggtggagctagtttagaagaatgtattgttccattgctggaagttaaagcaggaaaaggtgctaaaaaccaaaggactgtagaacttcaattaatttcaactaaaaatactattacaaattatgatgtaatgttaacatttttccaaaaagaaaatgtttcacaagatgttttaccattggaagcttcagtttacttcattgatgaggaaaataataaaatatctggtgaacaaataatctttgctgataaaaactctgattcagcagaagatagggaatttaaagaaaaattcagattgttacaaaaacaatatgataaatctaaaaattattatttaattattagagatttaaaagaggatgttgaagttgatagaattccatttacaatagatatggcttttcaagatggatttgattttttttag

SEQ ID NO: 1247 - DNA, 2292 bp, Methanoculleus bourgensis
atgaagaccttgcttgacgcgatcgacgacgctatcagggcggcaatcaagaactacgaccgcggagacgccgtacccccggccgcgctcctctggcccgacccgaccggagagtggcagccggtggcaaccctgctgcgggaggagcggggactgccgatcataacactcggcgactacgcccctgaccgccggcaggggccggccatctacatccgctgtctcgtcgaagacaccctccccggaacagggctacccgacaatgaaacgccggtcatctacctccccggccactccaggatcgaactccgcaacatcggggactgccccgaacccctccggcctctcgccgaactccagtaccgcggcgcaatctggtcccaccggaacgggcgggattggacggtggcaggatttctccaggcacacctcggtatcgataccgcttctgaccaggagacgaaagaatccctcagaaacacggtcggcaaactctgcagcgaacctgtcaggtcgatccagacgcaccagcccctcaacgccgcctacttcgccaccctcatccacccggattaccggaaacagatcctcctctggatgaacgctccaaaggaagagaaagaacggataggtgcagaagaatggccgctgttccggtacatgtgcaagacagactacgggttcgatccccataccgacggtgtcgcaaccgccgcagaacggctcgcctcacaggaccagcgatgggcgcaggtctgggagcggtacagggagtatccccaggcgtacccaaacatccccacactgctccggaacgcccgcatgccgccgctacccatgttcaaggattcgtggccccagatcaacgatgccatggaagaagccctccgccaggccctcctcggcctgcagagcgcttcccacggcgaagcccgccaggagatcgtgcggcttgaagaggaacatggggaacgccgctcgtgggtctgggccgacctcggtgaaagcccacttgccttcgccctccagcacctcgcccggctcgccgagctgacaggcgacttcaggttcggcggaaccatcaccgagcaggcggagcgctacgctcaggagtattggaaggctgacgacgccatcgtcagggcactggctcagatcgagagaaaggaggatcgagcggccgtcaccgctgcagtccgtactctcgcgcgtgcgtggcttgaggcgctcgccacggcattccaggaggaatggctcgcatctccccccgagcaggagaaagaaacatggaaaccacctcagggtgaggtcctgctcttcgtcgacgggctccgtatggacctcggccgccggttgcaggagcagcttgcgagagcaggctgcacatgctccctgacccaccggctcgctgctctcccctccatcaccgagaccgcaaaacctgccgtaatgcccatcgccggggaacttgctgcagggaagaacctcaccccggcaaccaggaccggagcaggcgcacagatctccgcactcaggacgctcctgaaagagcagaatatccaggtattgggagataacgatgatggagacccggagggcagggcatggacagaatgcgggaacatcgaccgtgaagggcatgataaaggcagtgaactgccagtgatcctggacggcgaactcacaacgatcgagcggcggatcatcgacctcctcgatgccgggtggcagcaggtccgcgtcgtcaccgaccatggatggctcctcctgccgggcggtctggtcaagaccgaactccctccttcgctcgtcgcgatgaagaaaggccggtgtgcggagctcctgcccgacagcagcgtctctctccctacagtaccgtggttctggaatagaaccatccgggttgccctcgcacccggcatcacctgctttgaagcaggcaaagagtatgaccatgggggcttaagcccccaggaggttgtcgtgcccgatatcgtcgttacccgcggatcgcctggagcccggaacctggttatccagacaccggcctggagaggactccgctgctatgtcacagtcaagggcgccgggggatatactgctgatatccggctaaagcccggcgacccgaagacaagtgtcactatggacgcaaaacccatcccccccgaaggggatgtcgcgcttgttgtcccggacgatggccttgaaggaacggatgcgatgatcgtcatcctggatgagcatggaaacaccacggctcagcggcagacgaccataggaggcgagtag

SEQ ID NO: 1248 - DNA, 2622 bp, Methanolobus psychrophilus
atgttaaacccagaaaaaaccactcagagcatacttaagaaattcgaaatcctcagtgacttcgagaagaggaagatcgtcttctggtatgataaggacgggaccgcggatgaggaggggcttgcacagataggggaagctctggtggagaggggaattaagttgcatgtattgaagaataacttctttgcaacgaagaaaatgctggagaatgatgatacgaagtccagctatctgatctattccgatcaggcagaaagggacccggaatcgaactggctgctggacattcagctgtattcggcgaggtttgagaacagcaggatatcggacatcaagagcgagttcgggatagaagggtatgaccttgacaggttcctggaaaagcaccagcagttctttgcgagcaagaggagggtcgtgccgcttaagaagatataccagagcgactggagggacgaggagttcacactcgggttcttgggagtgctgtccggctcggctaccacggatctcaaggagatcatccggaagatactcatcagctcgctggatgagaactccaataccctatgggaggacattgtcaggttcgagctggccgaagagttatgggggcttgtgaacaggtactttggctaccggtcggaggagcctactttaaagaagctcttcctgagctttgtgatcacgcacatctcgaggaacacggacatcaacctcaagaagtacaaggcttacagcaattccctcagcaatgaatgtgagatattcatcaaaggctggatggacaactccagggattcgggagtctttgacgagtattgcaggcaactgcttgaagataacagcagtcagcttgaaaaatatctcaatgcagagatcccgaagtacgatgtcccgaagtatctcgaagcggaatccctcgctttgttcgatgagcatgtcatccgcaggatagtcgatgagctcgacaatggcaaagaggactttgaaggctatcttgaatggatagccagcaggaagacaaaacactggtatcccggctttgagaatatctacagtgccctggaatatgccgtaaagttacaccagttcgcaaaagagttcagcgcagaggacctcagcagccagaacctgaaccacttcttcaggaattatgcggaacgctactacctgatggactattactaccgcaagttctactatcattacgacaaagataaccagaaagaggacctcaaaaccacaagagaggccatagaaaagctctacaataacaggctcctcgacaaactgctcacaagatggagcgagctcatatccaaagagatggacgggcactggaatatcgagctcatcgaccgccaggacgagttctacaagctctatataaggaacatcatcaaccgtaatgacaaggacaagatagcagtcgtcatttccgatgccatgcgctacgaagtagccgcagagctacaggagatcctaaataaggacaccaggggcacggtcgagctaaagtgcatgaccggctctctaccatcatataccaagctgggcatggccagcctgctcccgcatgagaggctggagtacaggaaccagagtgtatttgcagatggcatcagtaccgaaggaatcgagaaccggggcaagatactggagaggatgacacccgattccattgctctgggctatgaagacctcatgaacctgaaaagagatgaagctcgtgaaaggttcaagggcataaggcttttctatatctatcatgacatgatcgatgccacgggcgatcactcagcatcagaacacggagtctttaatgcagctgaagagacaatttccgatgtcaagaaaatcatcgagaaactcaccaacgcccagataatcaataacctaattgtcacggcagaccatggtttcatttatcagagagataatctcgagagcgttgataaagttgaaactaatggctttgacaaggaaaaagtaatagcttcaagcaagcgcttcatcctcagtgaagagaacatcgatctgatgaacgtccataagttcaacatggattatgttgtcaaatctgatagcaaaaaggaaatgttcgcatatgtccctcaggcagacctcaggttcaggatgcagggtgccaataagaatttcgtgcatggcggagctgctcctcaggaaatagtagtccctgtgcttaaatactcatacaacaccacagcagaccttgacagaaaaggcattaagcacggtaaagtaggggtaataatcaccaaccccagccgcaagataacaagcagcccgttctatataaacatcctgcagacagagaaagtgactgataagctgctcccgagaaggttcagggtcgccttatgggacagggatggtgatgagtacaaagtgagcgatgaaaagcttgtcattgccgaaggctcatcagatgaagcctctgataggcaatacaaagttactctcacactgaccggtaatatcgagaacaagatatactatgcaagacttatagatgaagacccgacagaaatcaacagggacataatcgatcccatgccctttgaagttgacctattgatagtcgatgatttctaa

SEQ ID NO: 1249 - DNA, 2613 bp, Methanomethylovorans hollandica
atgttaaatcccgaaaagaccacccagagcatacttaagaagttcgaaactctcagcgacttcgagaagaggaagatcgtcttctggtatgataaggacaggaccgcagatgaggaaggtcttgcacacatacgcggcgctctggcagaaaaggggataaagctgcatatcctgcacaacaatttctttgccaccaagaagctgctggagacggatgatacgacttctagttatctcatctattcaggtgaggcggaacgggaccccgaagccaactggctgctggacatacagctctattcatcacgatttgagaacagcaggatatcagatatcaagagtgagttcgagatagagggctatgacttggacagattcctggacaagcaccagcagttcttcgcaagcaagaaaagggtcactccgtttaaccgcttatatcaaaagcactggaaagaagaagagttcatacatggtttcctggcagtgctttccggctctgcgaccacggacctgaaggaaatagtacgcaaagtactgatcgattccctggatgagagcaccaacacggcatgggaagagatcactaagttcgagtttgccgatgatttctgggacatgatgcacaggcacttcggataccagccagaagagcctacgctgaagaagctctttctgagcttcatcataacccacataacaaggaacacgaaccttgatctcaagaagtacaaagcgtacagcaactccctgagtaatgaatgtgagatcttcatcagaagctggatggacaactccagagactccacagtatttgacgagtactgcgaacaactgcttgcaggcgatagcacgcttcaaaagtacctcgtgaacgagatacaaaagcatgaagtctccaaatacatcgaagcagaatcccttgacctctttgacaaaagcatcatccgaaagatagccgaagcactccagaacggcaaagaagatttcgatacatatcttggctggataaccaaccgcaagacaaaacactggtactccaggttccagaacatctacaattccctggaatatgcattgaaactgcaccagttcgcaaaggagttcgatgcaactaacataagcgagcagaatctcactaagttcttcagaaactacaccgaacgctattacctgatggactattattatcgcaaattctactatcactacgacaaggacaaggaaaaagagatcctcaaacccaccaaagaccttgtggaaaaactgtacaacaacaggctccttgacaaactgctcacacgctggagccagcttatcacaagtgaaatggaaggacgatggaacatagagctcatcgaccggcaggacgagttctataagctctacgtgaagaacatcatcacccgtaatgataaggacaagatagccgtcataatttcggatgccatgcgctatgaagtagctgcagagcttcaggaagtcctgaacaaggacacaaggggcacagtcgaattaaagtgcatggcaggatccctcccctcttacacaaaactcggcatggcaagcctgcttccccatgacagactggaatacaacaaccaatcagtctttgcagatggcatcagcaccgaaggcacagctaacagaggaaagatactggaaaaaataacaaaggactccgttgctatagattatgatgaactgatgaacatcaaaagagacgaagcccgtgaacgattcaaaggcacaaggctcttctatatctaccacgacaagatcgacgccagaggagaccatttcgcttcggagcatgaagtcttcgatgcagccgaggataccatctcagatatcaaaaagatcatcgaaaaactcaccaatttccagatactgaacaacatcctgataacagcagaccatggtttcatctaccaaagagatgaattggaaaacgtcgataaagttgagaccggtggttttgacaagcagcagatcatcgcatccagcaagcgattcatcctgagcgagcagaatgttgacctcatgaacgtccacaagttcaacatggattatatcatcaaatccgggcaaacgatgttcgcatacgtaccccaggcagacctcaggttcaagatgcagggcagcaacaagaacttcgtacatggtggagctgcaccccaggagatagtcatcccggtactcaagtactcctacaacaagactgcagatcttgaaagaaaaggcattaagtacggcaaagtcggtctgaccgtaaccaacgcaagccggaagataacaagcagcccgttctctataaacatcctgcagaccgaaaaagtgacggataaactgcaacccagaaggttcaaagtagctctctggaacagggacgggaacgaattcaaggtaagcgatgaaaagcttgttattgctgaaagctcatctgatgagccagcagaaagacagtacaaagtcaccctcactttaaccggcgaagtagagaacaagttctactacatacgcctgctagacgcagaccctacagagatcaccaaggacatcatcgatcccataccctttgaagtggacctcttgatagcagatgacttctga

SEQ ID NO: 1250 - DNA, 2700 bp, Methanosarcina acetivorans
atggtcaacgtagaaaaaaccagcagtagtatactcaaaaaattttctccttcagaactgaaagactatgagaaaagaaaaatagtcttctggtacgacagagacaaaaccgcctgggaccaggagaagcaggctcccggagaggagcttgaagaaataatccatgtcctgaaagaaaacaacatcaaattccatatccttgacaataactattttgaaaccaaaaaactccttgaaatcaaagacccggagtcaaactaccttatctactgcccggacaaagaaagagcgcatgaaaccaactggctttttgatattcagctttactcatccagattcgaaaacagccggatttcagacatcaagagcgagtttgagattgacgggcatgaactggacgacttcttcactaaatatgagaaattctttggaaaccagaaagaaagagtccagcctttaaagaagctctatcagaaagactggcgtgaaaaagagtttattctgggcatgctggctgttttttcaaaaacgcaggctcctgaattcaaacagattgtaagggacatcatgctcaaatctctggatgacgctgaaaatcctatctgggagaacatttcaaagtttggactggaggagaacttctgggaacttacagaagaggactttggattttcggcaaaaaatcctaccctgaagaaacttttccttagcttcctgattacgcacatgaagaggtattccggaatttccctttcaggttacgaccagtatgtgaaccgaaaagaaaatgagtgtcagatcttcctcaagcactggatggacagctcacgggattccaaaacatttgaaaaatatacaaaggatatacttgaagaaaacaaccaggatctggaaaaaaacctgcagggagcacttgataaacgagatgtacagaaatatcttgaagcagaagctgttgatacttttgacaaagctctaattgttcatatactcaaattcctgaacagtcctgtagactcaacaggagaggactttaaaaactatctttcctggatcgatacccgtcgaacaaagcactggttttcagagtatgagaatatctacaacgcacttgagtatgcggttaaactcttccagttttccctagaatattacgataatccaaaagcagctgatgcacttgaaaatacacgcagtttgtacgatttattcaaagcatatgctgagacctactaccagattgactatctctacaggaaattctactattactatgataaagagcaggaaaaagatatccttaagaagaatctcaggccacaggtcgaagacctttacaccaacaagctgctcggaaaattgttattgaaatggagcagccttattgaatccgatcttaaaaggcagtggaaaattgagcttgcagaaagccagaaggatttctacaaacagcatgtaaataagatcttgcaaaaagatgacagaagcaaagttgcagtcatcgtctctgatgcactgcgctacgaagcagctgcagaactttttgaaaccctcaacaaagatacctggggaattcccgaactcagctacatggcaggagttttaccttcatacacgaagctcggaatggcaagtttacttccccacaatgctctggaatatagaggaagagaaatttttgtggacggtataagttctgaagggcttgaaaaaaggaacaaaatcctgcagagtaaatatgaagattcgcttgcatttaattatgaagacttcatgcggtacagccgggaagaggcaagagagttcatcaagggaaaaagagtcctttacatatatcacaataagatagattcaactggggataaacagtcttcggaaaataacgttttcagtgctgtagaagaaacaattgttgaaattaagaaacttgtcaagtatttgagtgatcgcctgaacacaacaaatatcattgttacagcagatcacggttttctgtaccgaagagatgatatggaaaatgcggataaagtggatacctcattatttgacaaatctcgtataattgacacaacaaagagatttatcctgagtgaccaagagctttcacctgagaattcgctggataacatacacagctttggtatgcattatattctcgggcaggaccacacccccctctttgcctatgtccctaaagcagacctcaggttcaaacttcagggaggtgggctcaatttcgtgcacggaggagcctctcctcaggagattgttattccagttctgacatataaccacaggcggaatgaaaaggctattgataagaagggtatcaagcacggtaaggtcaatgtctcggtaataaacgaccggaaaaagattacaagcagcaaatttaaagtaaagattttccagaccgaaaaagtaaccgataaaatgaaaccccgcaccatcaaagtttctctatgggatattgatggtgggcaggaaaaaatggtcagcgatgaaaaaatcattattgccaataacgaatccgatgagcccgaagaaagacagtataatatcatgctcaccctcggaaacaatcttgaaaacaaaacatattacctcaggctgattgacgaagacccggctgaaataaaagacattgcacggattccattcgaacttgaccttctgattggcgattttgatgatttctaa

SEQ ID NO: 1251 - DNA, 2703 bp, Methanosarcina mazei
atggtcaacgtagaaaaaaccagtagtagtatacttaaaaaattttctccttcagaattgaaagactatgagaaaagaagaatagttttctggcacgacagggataaaactgcctgggatcaggagaagaatgctcccggtgaagaacttgaagaaataaaacatgtcctgaaagagaacaatatcaaattccatatccttgacaacaattactttgaaaccaaaaaacttcttgaaattgaagataaggaatcaaattatttaatctactgtccagacaaagaaagatcacacgaatctaactggctttttgatatccagctctattcttcaagattcgaaaacagccggatttcagatatcaagagcgagtttgagattgccgggcatgaactggatgacttcttcacaaaatatgagaaattctttggcaaccagaaagaaagagttcagcctttaaagaagctctaccagaaagactggcgtgaaaaagagtttattctgggcatgctggctgttttttcaaaaacgcaggctcctgagttcaaacagattgtaagggatatcatgctcaaatccctgaatgaagctgaaaaccctatctgggagaacatatcaaagttcgggctagaggagaacttctgggaacttgcaaaagaagattttgggttttcggcaaaaaaccctaccctgaagaagcttttcctcagcttcctgatcacacacatgaagaggtattccggaatttccctttcaggctacgaccagtatgtgaaccgaaaagaaaacgagtgccagatcttcctcaagcactggatggacagctcacgggattccaaaacatttgagaaatacgcaaaggatatacttgaagaaaacggccaggacctggaaaagaacctgcagacagcacttgataaacaagatgtaaagacttatcttgaagccgaagttgttgagacatttgacaaggctttaatccttcatatactcaaatccctgaacagtcctgtagattcaacagaagaggacttcaaaaactatctttcctggatcgatacacgccggacaaagcactggttttccgaatatgagaatatctacaacgcgcttgagtatgcggttaaactcttccagttttccctggaatattatgataatccaaaagcagctgacgcacttgaaaacacacgcagtttgtatgagttattcaaagcgtatgctgaaacttactaccaaatcgattacctctacaggaagttctattattactatgataaagagcaggaaaaggacatccttaaaaagaatctcaggccccaggtcgaagatctttacaccaacaagctgctcggaaaactgttgttaaaatggagcagccttatcgataccgaacttgatggaaagtggaagattgagctggccgacagtcagaaggacttcttcaaacgacatgtaaaccggatactacaaaaagatgataggaatactagagttgcagttatcatttctgatgccatgcgatatgaagttgcggtggaaatttccgaaattctgaataaagatacatggggacttatagatcttgattacatggcaggtgttttgccttcatatactaaattgggtatggcaagtttgctgcctcataagacactggaatacaaagaaaaagaagttttcgttgatggaatcaattctgaagggcttgaaaacagaaaaaagatccttcagaataattgccttgaatcgtttgctattcgctatgaagatttcatgaaatgtagccgggaagaggctagagaactcgtaaaaggaaaaaagatcttttacatttatcacaataagatagattcaaccggggataagcagtcctctgaaaacagtgttttcaatgctgttgaagaaaccattttcgaaatacagagattggtccggtatttaagtgataccataagtgtagcaaacatagttgtaacagcagatcacggtttcctgtacagaagagacaatatggaaagtgtggataaagtggatacatcattatttgacaaatctcgcataattgacacaacaaagagatttatccttagtgaccaggagcttgcaaaggataattcactggataacatacacatctttgacatgcgccatattctcgggcagaaccacactcccctctttgcctatgtccctaaagcagacctcaggttcaaacttcagggaggtggactcaatttcgtgcacggaggagcctctcctcaggaaatcgtaattccagttttaacatataatcaccggcggaatgaaaaagccattgagaaaaagggtatcaagcacggtaaggtcaatgtctcggtaataaacgaccggaagaagatcacaagcagcaaatttaaagtaaagattttccagaccgaaaaagtaaccgataaaatgaaaccccgcaccattaaagtttctctatgggatattgatgatgggcaggaaaaaatggtcagtgacgaaaaaatcattattgccaataacgaatccgatgaacccgaagaaaggcagtataatatcatgctcaccctcggaaacaatcttgaaaacaaaacatattacctcaagctgattgacgaagacccagctgaaataaaagatactgcacggattccattcgaacttgaccttctgattggcgactttgatgacttctaa

SEQ ID NO: 1252 - DNA, 2310 bp, Methanospirillum hungatei
atgacaaaaaaacttgatgaggttatttgtgcttctcttcaaaaagtctcacgagaatatgcgcaaaaagacgtagttgctcctctctctgtattctggtttgataaaaccggagaatggcaaccagtcattgatcgcctgaagaagagatttaccatctacacgtatgggtcttataataaagagacactgaccggcccggcaatttacatcagaacttctgttatgcaccatgaagataacagtcggaacatacccattctctatctccccggttatagtcgggaagaactacgtgaccccacaactgtcccaggagaactaaaacccttgatggggctatatcaccgaagcgtatcatggacatcgaaaacaaaaaaagactggacccttgttacatttctacaatcatcagatccaggacctggaattgccatcaaacaggatggagaaacaaaagaagcactacggacgagtattggacttcttcttgacgagccaatcgaaaggttatcacatcacgctccattacatgcgacatatctgcatcaaatccaattaccagacccacgaaaacagatacttacctggattcatgatcccgttgaaacagaaaagcagatgaaagaatcagggcaatggaagccattctgtggaatatctataaaagaatataacctcaatccggaaagagacggatcactcgccggggcaaccaagcttgcgacccaggaagggaaatggaatgagatatgggatagatttactgaaaatccagagagatatccaaacattcccgctattctttctacaataaaagttcctgctttcaccccgtatcaggaatcctggccacagataaatgagaaggaagagactgagctcttgaaagaattggaatcgctcctctctttgccactcgcacaggcacaagatctcatccttgaaatggaagaaaaacacaaaaagcgaagagattgggtatgggcacggatcgggaaggcagatctcgcccattctctcaagtacctgtcgattctggtagaaaattcaagacagataaagactggcggagatttgaaagcacaaatcgaacgatatgctgatgaaacatggaagattgatgacgcagtcctctccgcgatagcatcggttcacacctcatcgcatctcgccctcttacaaaaagtcattgctcatgtatacaaaccctggctgaacacaactattgacgcatttcaaaaaacctggatacaagcccctccagagcagaagaaaaaagaaatccctgcacaagctggagttctctactttttcattgatggtctacggatggacctcggtcatcggttacaatccctcctgtctgctgctggatatcagactacccttacccctcaattatcagtcatcccaagcattacagagacggctaaaccggcggtaatgcccgtcgcttccaaactatatgcaggagatgaactcactccaaagacaggttcaggagcttttgcacgtatcgaatcactccgttcactcctcaaagaacaaggataccaggtcattaaaaatgatgaattgggcgacccaacaggaggaggatggacagaatttggcaatatcgatcatgaaggacatgataagggattgactcttgctcatactgttgatcgggaattgtccagaatagaagcacgaattattgaattaatccaaactggatgggaaaagatcaatattgtcactgaccatggctttatctatctcccgggtggcatggaaaaagcagaacttcccgtgggaaatacagagataaaaaagggacgttgtgctctgttacgtgataacgcccaggtatcatatccggttctcccatggttctgggacagatcgaagaatattgcatgtgcccccaagggtgcctgctttgaggagaatacggtcttcgatcatggtggcttgtctcctcaggagatggtaattccagaaattactattataaaagggaggagtcttaagactggtgtggtcatcgatgagataaaatggaagggaatgcgttgtaaaattaccgccacaactggtcctggatatatcatagatattcgggaacagcccggagatgctacctcaacgttcctaaaagataaggatggaaattcactagaccaaataaaaattccgattgatggcgtaatctccatcgcaatctgggatgacacacacgaaggaaaaaaggcctggttggtgattactgatcaaactggaaagatcatcactcaggaagagaccactattggagggatgtaa

SEQ ID NO: 1253 - DNA, 2622 bp, Methanospirillum hungatei
atggctattctgagtattgagaagacaaccgctgcaatcctggagaaatttaaaaccctctctgaatttgagaccagaaagatcgtcttctggtacgacggggaacagaccgccggggaagaggacctgacccatatcagagaggcactcggagagcagggcattcggatgcatatcctgaacgggaattattttgccaccaaaaaactccttgaacatgaagatatcacatcatcctacctcatctactcagcccagcctgaaccagactatgagaagaactggctattagacatccagctctactccgaacggttcgaaaacagccggatatcagatatcaaggcagagataggaatcgaaggatatgaccttgatcccttccttggagccaaccagaaattcttctcgaataagagacgtgcccttggatttaagaagttctatgaaccagcctggagagaagaggactgcatcaggggaatactcgccgttctctcgaatgcatccgccccggacgtccgtgagataataaagtcggtcctgatgggttcccttcatgaagatgagaataccctctgggaacagatagcaaagtttgacctcaccgaacggttctgggagatagtgcggaaacaattcgggtattaccaggagagcccgaccctgaaaaaattattcctaagtcttctcatcacccacatcgaccggaatgccaccctcccgctcggccacctggaacagttcgtcaatgcaaaacgacaaggaaatgaatgtgagttattcatctccggatggatgcatcacgcccgggattcagcccgatttgacagctactgcaccgacctcctgacggaacaggataaaaaactcgagaaagaactgacctccatcgtggataatgaacgaatagaaggctatctgaatcccgaagcacctgacatctttgacaagagcatcatcagaaagatagtatcaaccctctccgatggcgggcaggactatgacaagtacctctcctggatcgaagcacgaaagacaaaacactacttccatgagtttgaggacatttacgctgccctggtatctgcaataaacctcatccggctagcagagcagtgcgaagaagagaagatcctcgcagctacccctcatgaactcttccggacctatactgaccggtattatctccttgactatcagtaccggaaattctacacctcttatgacaaaaccagcgataaagacatcttaaaaacccatatccgggagattgtcgagcggcagtacctccatatcacccagaagatccagatgaaatggagtgaccttatcacggcacaagaccggaccagctggggagttgaactcatagagccccaggaacagttctataccgcccatgtagataagatcatctccagaaatgaccgtgataaagtggcggtcatcatctccgatgccatgcggtacgaggtagccgttgaactaaaagaaaacctcaataagaacacaaacggcaccattgaactcacttctatggccggatgtctcccttcatataccaaacttgggatggcggcactccttcctcataccatacttgaatttcaaaaagaacacatcctcgttgacggaatgaacgctgatggcattgaaaaccgggagaaaattctcaccaggaccaaagaggagtcgattgcactccggttcaaagagctccgtgagctcagaagagatcaagccagggaaaaaatcaggggaaagcgggtgatatatatctaccacaataagatagatgataccggagataaccagcaatccgaagatgaagtgttcaaagccgctgatgaaacaatccaggagattgaagacatggtaaaccgcctggtcaattccctgaacatcagtaacatcatcatcacggcagatcacggatttctctatacccgtaatgcccttgaagatatcgatgtcattgatgtagccggatttgacaaagatcaattcatctcctcaaacaagcggttcatcatcagcagtgaaaagaccaacctcatgaacacccatcgctttctcatggattatatctcagatgaacaaaaaacgctctatatctacacaccctatgcagatctcaggtttaaaatggccggaggcggacgaaatttcgtccatggcggattgtccttacaagagatagcaatcccggtgctcctctataaccacaacaaatccctgtcagaccttgataaaaagggtattgaatatggaaaggttggcatcaccctcatcggacagagcaggaagataacgaacaacccattcaaaattaccctgttccagaccgaaaacgtaaccgagaaacgaggacacctcaaatgcaggattgccctctatgataactccggtgccagagtcagcgatgaaaaggtcattctggccgacagaaccacagatgatccaaaccagagaaaaataaatatcaccctgaccatggacagcaaaattaaaaatggtatatacatcctgaaagccatagatgaagatgtgaaagcaacattccgcgatgtcctcgagatacccgttgaagttgatattttgatacccgatgatttttaa

SEQ ID NO: 1254 - DNA, 2496 bp, Microlunatus phosphovorus
atgacttcgctcagcgccgtactgcctcacctggagcagacgttagcgacacagcgcctggtcttctggcacgacgctgacggtgaatacgccgccgaccttgacgcgcttgatctcagcggcgtgaccacagtgcgcgtggagaacaacgagtacgcggtgaagaaccgcgtgctccatgacgagccgaccggcaagttcctcctctatcgcggcggcactgtgccccctggcaccggaaactggctgctcgaccttgagctggcgtatggggtcttcaccgctgatcggaccgcactggtacgccaggagctcggcctcaccggcacgggcatcgacgatgtggtccgcgagcatgaaaagttcttccgtgccgcgaagcgagttcagagcctcaaagcgttgctcgcggttgatgatgacgcggatcggctgcgagcaaagatgtcggcagtagtgcttggccagcgcgaacacagcatgctggaactcacgcgcacattgctgatcgagaacgccgacggcaaccgcaccaagtacgaggcgctggccgagcaggggctcgatgggtttcactgggccggcaccgccaagatttacggctatggggcgggcgcgcccagcatcgacgatttcgtgctgtggatgttccgccaagcaatcaacggcttcgcatcggacaccccaggagccctccgcaacatccagctcgactttgcgagcctgcgcaacgaccggcgcagtgcaaacgccctcgcgagcttggcacgacgggcatcagagagtctgagctacgcgagcagcatcgaggacgccgaactcgccgaacttgtgggcaacgatctcttcgaagacgtggaacgcaaggtcatcagcgcccttgctcacgctgtggtcaagcgaacgatgagcgcccgcgaagtgtccgaaaccatccgtactcgccagagcagcatctgggttgacggctatcgggagctgtatgcggcgctcggcgccgcctcagacctgctgagcgagctcgcgaccgcaagattcgagatcgcctcgttcgatgacgggctcgaccagtaccgcgagagctggttccgcgttgatcagctctaccggcggttccacttcgccgcccgtacgaccgagtacgccggcccgctcgaagcgctccgggtggaagtagagaagcactacgccaaccgatacctctacgaactcggcaatgcctggcagcagcagatcgacgccgtggatgagtggcgttcggtgacgctgcggccgcagacgaggtttttcgctgatcggatcgagccgctcgcccggaagggtaaccgaagggctgtcgtcatcatctccgatgccctccgctacgaggtcgccgacgagttgcggtcacgcatccgccaggaagacaagttcgacgccgacctcgacgcgatgctcggtgtgttgccgagctacacccagctcggcatggccgccctcttgccgcacaagacgctgggccactcccccaacggagacccggtgcttgtcgatggccaacgttccgacggaacggggaataggaacaaggtgctggctctggcgaatgggttcgctgttcaggccgaggacgttcttgcgatgccccgcagcgagctgcgcgagctgtatggcgcacaccaggtgctgtatgtgtaccacgaccggatcgacgccgtgggtgacaaggcccgtaccgaacggcaggtgttcgaggccgccgatgatgcgctgcgcgagctggtcgacctcattaagcggctgacgaacgcgaatgccacaaacatcctggtgactgccgaccatggcttcctctaccaagacaccgcgctccccgacgccttctacctctcgaccaagccgcagggcaacgaccttgtggcgacaaaccgccgctatgtgctgggccggggactcaaggacgatccagcgttccggaagttcgagcccgagcagctcgggctcagcagcgatctcgaggtgcagattcccaaatcgatccaccgcctcaagctgcccggcgcaggatcgaggttcgtccacggcggagcctcgctccaggaggtcgtggtgccggtgctgacggtcaacaagaagcgcaagagcgacacccggcccgtcaatgtcgaggtgctgcccgagaccgacaagatcaccaccggtcagctggtcgtgaagctcttccagtccgagcccgtcaacgacaaggtccagccgcgcacacttcgggcaggcatctatatcggcgagacgctgatctcgaaccagcccgagctgatcttcgaccaatcctccgatgagaaacgcgaccgctaccagaacgtacggatgctgctcagccaggacgccaacgagttcaacaaccgctccgtggagttccgcctcgaagagcagatacccaacaccacccagtggcgcacctaccagcgggcgcagtatctgctcaagcgttcgttcatgtcggacttcgatttctaa

SEQ ID NO: 1255 - DNA, 2355 bp, Moorella thermoacetica
atgtctagcaggacgagtgaaatgttggccaatactctgctggaggctgtgcgcgattcattgcttcgagccggccggtatgactctgcgaccattgtcccgccggcagcgattctctggaccgatgccgacggccagtggcagcccctggtatcccagttgcgcccgcttatgccggagcttttaaccctgggagattacaacccggaagaaaaaaccgggccggcaatctggctgcggtgtgttattgaacgaatgctacctgatgttgaactaccggataaagccattcctatcatttacctgcccaacgttagccggcaggtgctccgggccggtgaggagtgcccggaaagcctcaaaccgctggtggaactgcagtaccgcgggacggtttggacccagcgcaacggtaaagactggacagttgaggcgtttcttgtctctgaagatggcctgggcctggatgtggctaaagataaacagacccgccaggcgatgcttcgggcactaccccaactggccaccgctcctgtcgcacgcctgcggggcaaacgcctggaggccgaggattttgacaggttgatggtggcagatacccagcgggacttgctgtcatggctcagcgacccggctcgtacccgcgaaaaatggggtgaagagaagtggatggccttttgctcccgctgtaaggttgaatatgaaatcgacccggatagggatggcgaaattgctgtcgccgagaaaatgggattgcaggataatgaagcctggcagggattgtggcgcaggtatgcagaagccccggccctttaccccggcatccccgcaattttgcggcgcgccaaaccatcaagattgttcgttaaccgggagccctggccggatgaaaacgaagctgaagaggaggccttaaggcaaagccttttggagctggaaaaattatcttcccctgatgctaggcaaaaaatcgaagaactcgagaaggaacacggcgagcggagggagtggatctgggcccagctgggacagagccccctggccggggctttaaagcacctggtgaccctggcgcgaaagactgcccgaggcctgggaggtgacatgccccaggcaatggccgaactatacatcgagggcgggtatctggccgatgatgccgtcttacaggcaactggcagcgtaaaatcattagaggatgcgcaggcaatacaggccgctgtccgcagtatctaccttccctggctggaggatgtagcccggcatttccaggatttgattaaaaccttccctttgccgaacgctgatgataaagaccgtactttaattgccgccaatcccgggcagtgtttgctctttatagacgggctccgctttgacattgcccggcgactggttgccatggctgaagcaagacagctccgggtaaatataaattggcgctgggccggactgcccacggtaacggcaacggcaaaaccggcagcctcccccatagcaggaaagctttccggccatttacccggcgaatactttattccagagattgccggggctaatctccccctgactcccgaccggtttcgcaagctcttagcggaagcaggctatcaggtgttcaattctccggagacggggcacccgggtgaacctggagcccgggggtggacggaatttggtgaatttgaccgattgggacatacgctgcaaagcaggcttgctgcccgcatcgatgaacagcttgagcttgtcctggatcgaatccagggtttgctggaggccggctggcagcaggtgcgcgtagtaacagaccatgggtggcttttagtcccgggcgggctgccggccatgaagctgcccaaatacctcaccgaaagccgctggacacggtgtgccgccatccggccgggtgcccatgttgatgtgccgactgccggatggtactggaatgcataccagcacatcgcttttgctccgggggtatattgtttcataaacggcaacgaatatgcccatggcggcgtcagccttcaggaatgcctgcttcctgacttgacttttaattccagcgggctaaccccagttacggttagcataagggaaattcaatggtatgggatgcgctgtcgcgttgcagttgatacgagcagcagcgaagtcatggccgacctgcggaccaaacccaatgatccccattccagtattaccacgcccaaaccgattgattccggtggacgtgttggccttcttgtcgcggacgatgcccttgaaggcactacggtcagcctcgtcctgctcgacccgtcgggacgggtactggcaaagcaggcgactaccgttggaggtgatgagtag

SEQ ID NO: 1256 - DNA, 2499 bp, Parvularcula bermudensis
atgcatgatcgcctccacgccagccttgcgcgcctgttcgagaccgagcgtatcgtcttctggtatgaccgggaccgggacatgcgcgaggcctttgacgcattcgcgctggacggcgttgagaaggtcgagatcgcgaaaaatgagttcggcctgaagtatcgcatgctgcggcaggagccgaagacccggttccttctctataaggacggccctgagccaccgcattcagagaactggctgctcgatgtgcagctcgcaacggccgtgttcaaagccgatcaggccgcgatctggctcgccgagcttggcctgccgccaaagtttgaaagcgtggtgcgcgagcatctcgaattcttccgcgccaagtcccgcgtcgagtcgctgaagaaaatcgccgatacacatgacacccccatccgcctccgcctccgcctgctcgcggtctgtgcaggcgctgagggcggcctcgacacggtcatcgagggcctgctcggggacctcgccaatgagcgggatgagggcgtgcgcctgattgagcggtcgggcctgaccaagtttttctgggatcaggtccggcaggtctatggctacgaaagcgatgaaccggatttcgaggacttcgcgatcacgctgtttcagtccgcctatgcgcgcgcgctgcaggagggtggcaaactcaacaccgaagccgcgctcctgttttctcgctggaagaataaccgcacctcgctcgacgcgttcgcggcgctctctgcgcgttatcaggatgtcttgcgcatcgaggaggatgttcgggcgcgtgatttccgcgacctcgtcaccgctgaccatttcgaggagattgaccggcatatcatccgctcgctcgtccatgcgatgtcaacccagaccgtcagtgcggcagacgtgctcggctgggtacgcgcccgccgccagagccactggtatgagacgtatcaggacatttatcaggcgatttccttcgcgacggaattccagcaggcgctggccgaagccgatctgcgcatgacctctcctgtagagggcgttcgtcgctacgtagcgagctggtaccgcctcgaccagctttaccgtaagttcctctatcaccttcagagaagcgggcagtcatccctgctctcagaactgtttgacgcagtcgagaaccgctacgcgaattcgttcgtgctcgccatcaacgatgcctggcaggatcaggtcgctcgcctcgaatggtgggatattcctggctatgagcgtcagctggatttctatcgcaagcacgcagcgtcctaccggcgcaaggaccagaaagttgtcgtcattatctcggacgctctgcgctacgagattgctgaggaaacgctgcgcgaaattcgaaagctcaaccggttcgatgctgaattgagcgcgattatcggtgcactgcccagttatacccagctcggcatggcggcactgctcccgcatcagtccctgtcgttcaaaggcgatggtgcgctggtgcttgccgatggcgaggaaaccagtggtcttgctgcgcgcgggaagttgcttgcgaaggggcgtgaaggcgaccggagtaaagtcatctctttcgaagagatgatgaacatgcggtccgacgaaggcaaagacctcttccgggaacacgatatcgtctacgtctaccacaatcatattgacgcgattggggataaggctgcgacggaggatcgcctgccggaagcggcgcagaaagcgatcgaagatctcgtaacactggtccgtaaactgacgtcggcgaatttctcaaatatcctgatcaccgccgaccatggatttttgtatcaacaccgcgcccttgatgagacgagctattcaatcgctgatccacagggcgatgagatcattgtccgtaaccgccgctttgtgattggccgaggcctcaaagaaacgcctggtatgacaaaattcacggcagagcagttgggcctgaccggtgatatggacgtgctcatctccaattccgtgaaccgcttgcgtcggcaaggcgctggcgctcgcttcgtgcacggcggtgcaagcctgcaagagatcgttgtgcccgtccttcgggttggcaaacggcgcgaggctgatttggcgcaggtggaagtgcagatcatcctttcgggcaagagccagatcacgtcgggtcagattgctgtcaccctgtatcaagcccaagccgtatcagagaaggttcagccgcgttctctcctcgccggcatttacgctctcgatgatacgctcatctccgatgagcatcagctttcctttgatttcacctcgaacaatgcccgcgagcgtgagcttccattgaagcttttgctgtcacgggaggcggacaagtacaacaatcaggaagtcgtgctgaagctgcgtgagcgcgttggcaagacgtcccattatcaagactacgcaacccacaggctccagctgcggcgcggtattacaacagatttcgatttttga

SEQ ID NO: 1257 - DNA, 2604 bp, Pectobacterium carotovorum
gtgaccttgcaaaatcaggaatttattgccggccttaaagcaaaattcgccgaacatcgcatcgttttctggcacgatcccgataagcgtttcctcgaagagctgggtaatctcgaactggagaacgtcacgctgctcgacatgtccgaccagtcgcagctggcggttaaaaagcgcattgaaattgatgagcctgaacagcagtttttgctatggttcccccacgatgtgcctcccaaagagttcgactggctgctggatattcgtctttatagtacggagttccatgccgatttcgccgccatcacgctgaatacgttaggcattccgcagcttggcctacgcgagcatattcaacgccggaaggcatttttcagcactaaacgtcttgctgccttaaaaggcctggtgactgagcgggaaaacgaagcttctcttgataagaagatggttgcggtcatcgctggcgtaaaaaccgcaaaaacggaagagattctgttcagcctgattacccaatacgttaatcagcaaaaagatgacgacagcgacctggaaaacacgctgacaatgctgaaacgccacgacctggaaggcgttctgtgggacactctgaatcaggaaatgggctaccaggccgaacagccttctctggagaacctgatcctcaagctgttctgtaccgatctctccgcgcaggctgatccgcagaaacgcgaatggctgggaaaaaacgtgctgaccacgccgtcaggcaaagcatccgcgctggcctttatggtcacctggcgtgccgaccgtcgctacaaagaagcctatgattactgcgcacaacagatgcaagatgcgctgcgaccagaagaccagtaccgtctcagctcgccatatgatctgcacgagtgcgaaaccacactgagcattgaacagaccattattcatgcgctggtgacgcagcttctggaagagagcaccacgcttaaccgtgaagccttcaagaagcttctgtctgaacgccagagcaaatactggtgccagacgcgtcaggaatactacgctatttatgatgcacttcgtcaggctgagcggctgctgaatctgcgcaatcgtcatattgatggtttccactatcaggacagcgcaacgttctggaaagcgtactgcgaagagctgttccgctttgaccaggcctaccgcctgtttaacgaatacgcgctgttggttcacagcaaaggcgcaatgatcctgaaaagcctggatgattatatcgaagcgctgtattccaactggtacctggcagaattaagccggagctggaataaggttctggaagccgaaaaccgtatgcaggagtggcgtatcgcgggcgttccacggcagcagaacttctacaatgaggtggttaagccacagtttaacaatccacaaatcaagcgtgtgttcgtgattatctccgacgcgctgcgttatgaagtagcagaagaactcggtaaccagatcaataccgagaagcgctttactgccgaactgcgttcccagttgggcgtgttacccagctatacccagttgggtatggcggcattactgcctcatgacgaaatgtgctaccaaccgggtaatggcgatatcgtttatgcggacgggttatccacctcaggcacgcctaaccgcgataccattctcaagaaatataaagggatggctgtaaaatccgacgatcttctgaaatggaaaaatcagcaaggacgagatcttattcgcgattatgaagtcgtctatatctggcataacaccattgatgctatgggtgacagcgcatctacggaagagaagaccttcgaagcgtgccgcaacgcggtggttgaactgaaagacctggtgacacgggtgataaaccgtctccacggtacacgtattatcgtcacagcggaccacggcttcctgttccagcagcagcctctttccggacaggataaaaccacgctgcagattaagccggacaatacgattaaaaaccacaaacgctttattatcggccatcagcttcctaccgatgatttttgctggaaaggaaaagtggcggataccgcaggtgtcagcgataacagcgagtttctgattccgaaagggatccagcgtttccatttctcgggcggcgcgcgatttgtgcacggtggtgccatgctgcaggaagtctgcgttcccgtattgcaggtgaaagcgctgcagaaaaccgctgccgagaagcaacctcagcgtcgtccggtagacatcgtgaattaccatccgctgatcaaactcgtcaataacattgataaagttagtctgctgcaaacccatccggtaggtgagttatacgaaccacgtaccctgaacatcttcatcgtcgacaacaccaataatgtggtatccggtaaagagcgaatctgctttgacagcgataacagcaccatggaaaaacgtgtgcgtgacgttacgttgaagctaattggcgccaatttcaatcgccgtaatgaatactggctgatactggaagatgcacaaacggaaacgggttaccagaagtaccctgtgattatcgatctggcatttcaggataatttcttttaa

SEQ ID NO: 1258 - DNA, 2601 bp, Pelobacter propionicus
atgcccaaacatcaactgactgatacgctgcaaaagatattcaaggaagagaaacaacgcatcgtcttctggtacgataccgaccgggaatttgaggaaggtttgccagacctgaagcttgacggggtgaaagtcatccgccttgacgaaatcggctcactggaaatcaagatactccttgagcttcaggacaccaccggtaaataccttctgtatgccccatttgtggaaccggatgccaagaacgactggcttctggacatccgcctctatagccgcattttccatgcggaccaggcttccatccttctgaatgaactgggtttgaccagccaggctcttcgaccattcctgaccagcagaagaacatttttccgcaatcaggaccgcctgaatcgcctgaagaaatgggtgaagcctgaggatgtcgagaacgaacttgatttgaagatgctggcggtcttatccagggccgagctacccgatatcttctcaatcctgatgaaactgtttggggaactatgcaattcaggcgagcaacaactcctgcttgcttcgcaaatgtcttgggaagaaattggcaaatatgaccttttaaaacctttctggaatctcattgccaccacgtttggttataccgaaccagaaccgagcgtcaatgacctgctcattcgcatcctggttacggattttgcgaaaaccctgaaaggcgctgttcccttatcgttgcagcatttcgtcatacccagcaaaagccttgccctgaccgcttccgtgtttgccaatcactggcgcagtaatatcaatcattacaagtgctataacgagttggcagggaatgttgcccagcaactcaaggtggacaaccagctgggtgacctcgatgagcaggccctgttggaggtaatgacattcgaggctgttgaacgaaggataatcctttgcatgctggcaaaaatgaagaacggttattccttcggtgacgagattaaatcggttgtcgcccaccggctcgatggctattggtccaatgcccaaatctcttccggcgttatcaattaccgcactctctatggggcgctgttggcagcggctgacctgtttgagttgagaagcaggcatcagaccggcttgagctatcccgatgcatccggcatgtatgcagcctacaccggtgagctttaccgttttgaccagctttaccggcagtttcacgagaaggccgaccagattgaactgtcgggaacggatatcctcaagggactgagggctgacgttgagaactgttacagcaactggtttatcgaccaggttgccgtgacatggggaacgatgatagagccgccgcatggcaccggcttattgcaggattggcgattgaacaatatcccgaaccagcaggatttctttaaatcttgcgtcgagccggccttgaaagcctttccgcaagggcgggtctatgtggtcatcagtgatgccctccgctatgaagcggcggcagagcttacggatgaactgaatgcaaagacccgcttcgatgccgacatctcatcccaactgggagtgcttccaagctataccgccctgggaatggcggcacttctgccacataactcgctcgattacaaggcaagtggcgatgtcgaggtagatggccagccgaccgcttcattggagcagcgcaacaagattcttgcggaatactccggaacgctcatcaaggcagaagagctgttggccatgagcaaggacaaggggagggaatttgtcaagccgcaccggctcatctacatctatcacaaccaaatcgatgcaaccggcgatacggcttcaaccgagtccaatacattccgttctgttcgtgaaacaatcaacgaactgacagccctgaccggctacataatcaacaaccttaacggcagtcttgtactcattaccgccgaccacgggttcctgttccaggagacctatcccggacaaaatgacaagagcggcctggacaccaagccggaaggtacgctcaaggccaagaaacgctatctgctgggtaacgacctggggggaaacgccaaagcctggcatggctacacctcaataacggccggaacgacgaacagcgttgaattctggatacccaagggggcaaaccggttccactttgcaggtggagcgcgttatgtccacggcggggcgatgttgcaggagattgttgtgccgatagtatcagtgaagggggtccgtggggtcgagaagccgggcaaggtcaatgtttctctccttggtacggtgaagaagattgtcaataacatgcagcggttcgagttcatccagaccgaggcgatctcggaaagagtcaggcccgtaaccctcacggtttccctgcgtgacgttgaccagctcatcagcaacgaaatgacgctgacctttgacagcgcatccgaccagatgaacgaccgcaagaagtcggccagcctcatggtcaaggcaggcaattacgacaagaaaaaagagtattacctggtgctccgtgatgcagcggacaagaccgaaatcgagcggattccgctgacgattgatttatcatttggaaatgaattctga

SEQ ID NO: 1259 - DNA, 2223 bp, Pelodictyon phaeoclathratiforme
atgttcgataaatggctcaatcaggatatcaggaaagtccttgaccggcgaaacagagtagttgtgggggctgaagcctctcttctggatcttttgcgcaaggtattgacgaaggagctgacaatttttgtggttcatggctcccttgaggagctggagtgcaagtacactgtagaaaaattccacaagggtgataaagttgtaataatagcgacatcacaaaaaaacaagctgacctttattcgcgactacgctgaaacctgtgggtatgtggatatccgcatggtggaaaattatgtggcggcgagggtttttcaggagcttggcttgaacatttcgcttacaccggaagaactcaaagttgctgcgtacaacagcattggtaaaggacgtgagtattgggaggagctttgccgcaagggtggagagcggctttttgatatcggcagtgatatcctcccctttctccatgacccagtgggtttctgcgctacccgtgatgcagtggtggttgcggccttttttgaaaaaatcaatacctggcttgggcgcggcaacatcagccaaccccccgaaatccttgcgaaagaggtggctgagcagattctggggtcgctgctgacaggtaaaccgaagaagaagtacctcgatgtgtacaagaagtggggcgattccaaagcgatggagggttcgttgctgggctattgccaagagcatccggtccggttggagctgccggaactttggaaagtttatgccgcccatccgttcgatttggtggatctccagtggctgaaagacctggtagcgcacttatcggacagagtctccattaaggataaactcccgctcatacacgcccgtttcaggagcagccacggcaggcaatggcgcaaggggttgtggggccatctgctgcaactgctggagtttgatacttccagaatcaaggggattgcgtcgcttgaggaggcgacaaccttttacacgaccgaactctaccgggttgacacggctatacgcagcatctacgaggagttctggggtgacgaaaaggttattcgcccattccaggagtattacaaccagttggtttcaccctttctccataagtggtttcagtacttcgacgactaccgggagaaccagaaggggcttttgatagagagaatccgttccgctcaaggacggatagcaattattgtgggtgatggtatctcttatgaaatttcacagagagtcactgcgaaaataagtgatacgatcaaggttgataaccaatatcgctgctgcggcattccgtcgattaccgaaaacaatatgagcctgctttatcgtgacgatggagttgttgagccattgcagtcccggcgagaggcatatcttgccgcacaagtcgcaatgcggattgagtttgttcagttggaggaggtcaactttcaacatgctgaagtggatgtgcttctctgctcctgcaaggatattgacgacatagccgagaagatgcagcacaaagcgctgaaattcatcggtgaaattgagaatatgcttgccgaaaaggtagggtttctgctcaataacggttttcaggaggttgtgctgacctccgaccacggatttgtgcttaccggtattcttgatgagtccgacaaggccgaagtgcagtttcaaggaattgtgtcaaaggcagagcgatacattcgtaccaccggcaggcagagtccatcacctgaattgatcgaatacaggcaacagtataaggagttcaactacgtgtactttgccaaacatatgaaaccattcaaaacccctgggaagtacggatatgctcatggcgggttgtcgcctcaggagttgattattccttttataaccttcagccacacaatctcttcccttcaggaactgaacatcagtgtggcgaacgaaaggcagttgagcggtgttgtgggcgactatttttcactccaccttaaagctgatgatggagcgggtgatatctttacccaggaacggaaggtgcagctcctctttatcgacaacgggaaggagttcaacaagagtgacatcgtggccattaaagcgggtgaactcatcaagaaggagttctcatttgacaaccatctcaatattgaggtgattgtggtggatgccctgtcgcggctgaccctgacgaaggtggctgtatcgcaaaccgttgctcgtgaccttggcggtctttaa

SEQ ID NO: 1260 - DNA, 2607 bp, Polaromonas sp.
atgagccaacagcgtctacttgagagcttaggcaccctctttaatacccactcagttgtgttttggcacgacgtggaggccgaattcgcctctgctgtggatggcttgcagctcgacggcgtgcgattggttcgcttggacgaaacccccgcgctgcgggtgaagctcgacattgagcgcgcccccgagcagcggtggctgatttatagcgccaagcccgagccggaaccaacgaatgactggctgctggacgtgcgcatgcgcagcaagtcgttccgcgctgattccacctccatcctgttggaagacttgggcttgaccacgcaagggttgcggcagcacctgaaagagcgcgccaagttcctgcgcgccaaagaccgggtcgaccgccttaagcgcctggtgctgccgggtgacaacgcagcagacctggaccgcaagatgctggcggtgctgactcgggccgaccaaccagagttgttcgccatcttgcagcgcctctatgccgccgtagtggtggacggcgtggccgatttatcggctcagcccaaggcctggcaagacattgtggccaacgatttgactccggcgttctgggaattggtgcagatgcaactcggttattccgatgtaacccccagcctgcgggatttgctattgcgcattctggtgacggacttttgcaggggtcttgacggggatgctccgcgtcagctggcgcattttgttctatccgaccgaacgctggcggcgaacgcgtccgtctttgtggcacgctggcggtctgacctcgcgcacttcggtagttacaacgcgctggcgcatgcggtcgccaatgatgtggatttgatcagtctgctgtcgggccagtctgcagagcaactggtcgagtgcatgacctttgaagacattgaactgcgggtggtgcaagacttgaagcagcgcatcgttgctggtgccggcgcgaacatggaagtggtgcgtgccctgattgcccgccgccgtgacggacattgggccaacccgttgctcgccagtgcaaacgagcgtacccgggccctcgccgcttgttacgatgcgctgaccgctgccgccgattttttcagcctgaaggcggagcatgcggctggcttcagctttaccgatgcaggcgccgcgtttgcccactaccgcgatgcgctgttccgttttgaccagctttaccggcactttcacacggcggaagatgcagttgagcccaccggctgggcagtgctccacgaattgcgcgagacgattgagggggtgtattcgggctggtttatcccgcagctgagcacggcttgggccaaggtggtggaggggccgcagggtttgctaaagcgctggaccgtggccggggtgaccccgcagcaagaattctttgcgcgcgaggtgctgccgctctacgaggcgggtgtcaagcgggtgttcgtggtgatctcagacgcttttaggtttgaggtcgctcacgagctggtgcagcacaccaacagcaagagccgattcaaggcatcgttgggtagcatgctgggcgtgctccccagctacaccgcgctcggcatggcctcgctgctaccgcatcagacgctggcgtacaaggacaacgcgaatctggatgtatttgccgacggccacgcggtggccacgttggaccagcgcagcgagcacctcgagcccttcggcggccttgcgatcaaggtggaagacctgatggcccttggcaaggacaagggcagggagctggtgcgcgaccaacgcttgatctacatctaccatgaccgcatcgacatgatcggtgacaagcaggcgtcagagaccaaaacctttgaggccgcggcgcaaaccgtgcaggatttgtcgcagttgctgggcttcatcatcaatgggctcaatggttcgaccgtgctggtgacggcggaccacggcttcatgtaccaggaatcggcgcttgatgagtctgataaatccaccctggatgacaagcccgccggaacattgaaggcgaagaagcgctacctgatcggccggggcctgggggcaaccccgaaagcctggtcgggcaacacggccacaacggcgggcaccacgccggagggcagcgtcgacttctgggtgcccaagggggcgagccgcttccactttgcgggcggcgcccgctttgtgcacggcagcgcgatgccacaggagattgtggtgcccctcatcaccgtgcgcgagagcgaggccgaccatgccaagacccggtttgtcagcatcagcctgctgggggcttcgaacaaagtggtgacgagcacgcagcgttttgagttcatccagaccgatgcggtgtcggagcgggtgttgccgcgctcggtggtggtgtcgctgcgcgacggtgacaagccgatcagcaacgagcagtccttgaccttcgacagcacctcacagttgctggacgaacgcaagcgttcggtgttcctgaccgtgctggccggcgcgcatgacccacacaagcgttatgacctgatcatgcgcgatgccatcaccaaggtggaagtgctgcgcctgccgatcaaggtgaacctggcttttggcaacgatttttga

SEQ ID NO: 1261 - DNA, 2523 bp, Pseudomonas brassicacearum
atgagcattggcgaattcattcagaacaaaattcttcgtcctcgattgcagaagacaggcagtctcgtggtgtatgaccctgccgggcattaccaagatgtctgcaaagggttggccgacgaaaagctgctggttgtggatgcttcaaagagcagcattgagagtcgggtagctgcgatgcaaggcttgcgtgatgtgattgatcggcagctcgctggaatgctggtctatgtgcctgcaaaagcgcccgagagcgatgaagaaaggcaggctgatcccttcgctccaattgccgcagcagggtcgattttccccgaaggggatggtgatagctttgagagcctatgcctgaaggcgaaaccagatcacaccacggccattcgggccatctttgagcaggatgcttcgcctagttttgcggtggtggatgctattggcggcggcttgggctggcccaacttgcgtgcgctactggcagtcgagtccgcccgagatattcttttcacgctgcttgtgccaaacgatgcgcagcaagcggcattgaaaggcagcgatagctgggtgatagaggcgcgtgatttgctccgcaacagcatgggcctgtcattgaagactagggggaagacatgggactcggttgccaacgaactgtggcgttttgttttgttcagcgagtttgtttttgatctgcctggtgcattgcccgccagtttgaacgatgtaccgcgagccgaaacgcaggcgaagccgttgattgaatacctgtgcgatttgctgcgcaatgatcgccgcacgcagagtgtctatatcgaccgcgcagaagaaattgagagggatctcaacctggtcagccaatttggtagctggtctgatttgggcgaccgggacaccttcccgtttgaggaacgcacgtttttgagtcgggcgatcgaaggcatcctacgtgatgacatcgaccgggtgaggagcatctcggagcgccatcagcaatcggtgtggacgggcaaaggcgagagccgtgcccagtgggatttgattcgatcggctactgagttgcttcaaacctgcgacgacatggagcggcagctttcggacaatgcacgcaatcttgatgtgctgttgaccttttatgtgagcagtctgcgtgaagctgatcgcttgcatcgcgagttcgaacaggcagttagcgattacgactggcaagacgcgcaaggtgtcatgacgccagtcaagcagcaggttcgcaagcagtacggcaaactggtcgagaaggtgcagttgatcttcactcgtcatgtgcagcaaagtggctggccgttggctgggcagctatcgaataccgatgtgtttgaccgcattgttgcgcccaagctgcaaaagaacggccacaaggtggcgtacttcatgattgatgcgcttcgctacgaattgggcgtggcgctggaacgacagttgacggaagacggacaagttgaggtgcaggctgccatggcgcagctaccaagcatcacgccagtaggtatggccagcttgttgcccggggctggtcagcagcttcgcatcaagaatgacgaacagagtctggtgccaatgctgggtgaccaggtggtggaaaccgttgcgcagcgcatggatgtgtttcggaagaagtacggccagcgctttgaagaagggcgtctggaagaatttgttcgcgggcgtttcgatttctcgcctgaaactgatttgttggtgttgcgcgctgtagagatagatagccactttgagaaccatcctgacaccgcccctgcagagattaccaatgcactcaaacgcattcgggtcgcaattcataagctgaaagagcgtggctttcatgaggtggtgatcgcgaccgatcacggctttttcatgaacacccacgctggtgcgggcgatgtctgcagcaagcccgctggcaactggattggcattcatgaccggtgcgcgctgggtgatggtgctggcgacagcaatcacctagtggtctcagccgagaaaatgggcattcgcggtgactttgccaagttcactgcgccacattcgttggcggcctatcgcagtggtttgctctattatcacggtggcatttctttgcaggaatgcgtggtgccggtgataacgatgcagttgaaaacatccaatcaaccgacactgcataaagcatctgtggcgataagctacaagaacggcgccaaggcgatcactacacgtatgcccgtgattgaccttgcagttgaaacggcagacatattctcgactgaaaacgagttcgagattttgctggaggcacacgacagcaagggcgaagtggtgggtgaagcgaaggccggaggtgcagtgaatccggcaacaggaacattgtcgttgaagccaggtgataaggttcaggtcacgatcaagatgcaaatggatttcgaggggaaattcaagatcaaggctttgcatccaacgacttatacggtgtactgccaacttgacctggcaaccgactatgcggtgtaa

SEQ ID NO: 1262 - DNA, 2499 bp, Pseudomonas stutzeri
atggaaaaccgcattgcccaggccctgaccaaactcttcgaccggcaccggatcgtcttctggtacgacgccaagcaggagttgcgcgacgacttcgatgcgcttcagcttcccggcgtcgagaagctggagctgatcaacaacgagtacggcatcaagtacaggctgctgcgcgagcaaccggaacagaaattcctgctctaccgcgaaggccctcagcccgccgatctggataactggctgctggacgtccagctggcccatggcgagttccgcaccgatcaggtggccatctggctgtccgagctggagcttggcctggagttcacggatgtggtgcaggcccatgcggagttcttccaggcgatcaagcgcaaggacgccctcaagaagctgctgaaagccgacgacacagccggacagattcgcctgaagatgctggcggtatgcaccggcagcgagccgcgcatggatgcggtggtggaaaacctgctgcaagagctggccgatggccgggacgagaagatcaaattgatcggccggtgcagcctggacggtttcctctgggaacagatgacccgctgctatggctacaagtccgacgcgccgggcatccgcgacttcgccatcgagctgttcaagtcatgctacgccatgggcaccgctggccaggtgaaactgaccggcgacgccctggtgtttctcaagcgctggaaggacagccgtcagttcgaaggcggtttcgagaccctctcgggagaatgcgccgaggtgctcgggattgagcaggatctggccaagcgggatttccgcgagttgatcgagttggattatttccgcctgattgaccagaagatcatcagcgacctcgtgcgggcggtggcagcccgcacggcctcaagcggtgacgtggcgatctgggttcgacagcggcgacaaggccactggtaccgcgaataccggcatctgtacgaggcagtcgattacgccgcccagtttacccacgccctgggcgaggccaaactcgccatggacagcctagccgaaggcgtgcagcgctacagccgcttctggtatcagctcgatcagctctaccgcaagttcacctaccacgtgcgcatgtcaggacaggcgtcgctgatgggcagcctgaccgagcagattgaaaacctctataccaacaactacctgctgaagctgggcgaccgcttccagaccttcgtggatgcggcatcgaagtgggaagccttcccggtgcgtaagcagaaggagtttttcgagtactgggtacggccgttcctgcgcaaggacaacaaggtctgcgtgatcatctccgatgccatgcgctacgaaatcggcgatgagctgctgagcctgatccggcaggaggaccgttacagcgccgaactggaaccggcgctatcgatgttgcccagctacacccagctcggcatggcggcgcttctgcccaacaagacactggcgattgtcgacaacgaaaccggcaccgtgctggtggatgggcaaagctcccagggtacggttaatcgcaccaagatcctgcaggctgcactgaatggccgtggtgaagccattaccgccgaagactttatgcagctggatcgggatggcagccgcgaactgctgaaaagcaacgatgtgctctacatctaccacaatcgcatagaccatactggcgacaagatgcattcggaggggcaagcgtttgaagcggctgagcaaacgctaggcgatatcgtcaggctggtgaagaaactgaccgcggcgaatgccaacaatattctggtcaccgccgatcatggtttcatctaccaacatcgaccgctggacgagagcgactttgccagtgtcgaggctaagggtgaggtgattctgtaccgtgacaggcgtttcgtgctcggcaaggggcttgctgagtcagccagcctgcacagcttctcgtctgaacagctgggtctttccggggaggtcgaagtccagattcccaagtcgatcaaccgcctgcgtctgaagggctccgggagccgttttgtacatggcggcgcatcgctgcaggaagtggtgatcccggtgctcaagatcaacaagaagcgccagagcgatgtcaccgccgttgaagtggacatcctgcgtggagccagctcggtgattacctccgggcaactggcggtgaccatgtaccaggccgggccggtgacggacaagatccagccgcgtgtgctgcgggctggcatctacaccgaggcaggcgacctgatctccgacagccatgatctgaccttcgacctgagctcggacaacccccgggagcgggagctacaggtgcgcttcgtgctgacccgcaaggccgatgaggccaacggccaggaggtcattctacggctggaggaaaaacacgccgggacttcacattacaaggaatacaagtcgctccggtacttgatgcggcgctcatttaccagcgacttcgacttttaa

SEQ ID NO: 1263 - DNA, 2499 bp, Psychrobacter cryohalolentis
atgaatgatcgcatcatcaacgcattacagcagctctttaaaaaacatcgtattgttttttggtacgatgccaagcatgagctgcgtgatgattttgacagtctagtactagaagatattgaaaaaatcgtcctagataacaatgagttcagtgttaaatataaaataatacgcgagcagcctaatcaaaagtttctgctttatcgtgcaggtgctcagcctgcgctatttgataattggctattggatgtacagctggctcacggggaatttcgtactgaccaagttgctatctggctctcggagctatcattaggtattgagtttgcagaggtcttaaaagatcatgcagagttctttcgcgctaaaagccgtaaagatgctctaggtaagcttatagagcccagtgatagctcaggtatggttcagctaaagatgctggctgtttgtgctaagagcgagcctaaaatggacacagtcgttgagagtctgttgcaggacttggccaatgataaaggtgaaaaaatgagcctgattagtcgatctgctcttgatggctttttctgggagcaaatgaatcgctactatggctataactctactgagcctagtattcatgattttgccattgaactctttaaatctagctatgcaatggcaactgatggtcaggtaaagctgtccaatgatgctttggtatttctgaaacgttggaaagacagtagacaatataaagacagctttgagatgttatccgataaattttctgatgatcttgatattagagatgatcttagtagtagagattttaaacagctcatcgatatagactacttccgcttaattgataacaagataattagcgcgctagctaatgcagtcttacaaagtgactttaccgctgaacaaatggctatttggattcgccagcgtcgtcagagtcactggtacgctgagtttgagcatacctatcaagcccttgataatgcagcgcagtttatagctacttttaatcaagtcaaaatcgatatggatagccttgtacaaggggtagagcgttatacccagtcttggtacaagcttgatcaactttatcgtaagtttatctaccacaaacttgagtctggagaagtatcacttctcaaccacctcaacgataaaatagagaatatatactctaataactatttgcttaagttaggtaatcgctttcaggaattcgtagaatctgaaagccaatggaatgctgcgccaattctcagacaggataacttttttggtcattgggtgaaaccgtttctagataacaacaacaagatatacgtcattatctcagatgccatgcgctatgagatagcggatgaactagtcagcttaatacgtcaagaagatcgctacagtgctgatatagcgcctatgttgtctatgctacctagctatactcagcttggtatggcagcgctcctaccgaacgatacattatccatagcagacaacacttcaggcacagtgcttgtgaatggacaaagctctcaggggacatctaacagaagtaagatacttaaagctgcgttgcaagatcgaggagatgcgatcactgccgataattttatgcagctcaatagagagggtagtcgagagctgttaaaagctaatgacgtcatttatatttatcataatcggattgatcatactggcgataaaatgcactctgaagggcaagcgtttgaagcggcagaaaagacgcttagcgatttgatgaaaatcattaagaaattagcagcagctaatgctaataacattttaataacggctgatcatggctttatataccaaaaccgtgccatagaagagagcgacttttcgagcgcagagcccaaaggtaaagaaatactatatcgagatcgtcgatttatactgggtaaggggctagttgattcaccaagcttgcataagtttagctctgaagcgctcggtttaattggtgatgttgaagtgcagatacctaagtcgattaatcgcttaagacttagtggctcgggaagtcgatttgtacatggcggagcatcattacaggaagttgtcgtgcccgtcgttagcattaataaaaaaaggcaaagtgatactacagcagttgaagtggatattttacgcggatcgaactctttaattactacagaggagcttaccgttagcttataccaaagtacccctgtcactgaaaaaaatcagcctcgcgtactgagagtaggtgtctacactgaatcaggtgagttgatctcagatagctatgagatgacattcgatttacgctcagaaaacccacgcgcgcgtgagcagcaggtaaacttgattttcacacgtaggatcgatgagcttaacggtcaagaggttattttaaagctagaagaaaaagtaggcggaacttctcactacaaagaatacaaatcgcttaaatatacagtaagacgttcatttagtagtgattttgatttttaa

SEQ ID NO: 1264 - DNA, 2496 bp, Rhodococcus erythropolis
atgactgagacctcctccatccagaagcaccttgagcgccggttccagagacaccgggtggtgttctggcacgatcccgaagacgagtacgccgccgatctagacgcactcgggctagacggggtcgaaatcattcgtgtcacgaacaacgaattcgcggtgaagaaccagctgctgcatgtggaacctgatacgaagttcctcgtctaccgttcaggcgtcgtaccgactgggatcggcaactggttgctcgacctcgagctcgcctacgggatcttcaccgcagaccgaacgtcactggtgcaacaggaactcggcctcaccagcgaaggcatcaccgaagtggtgcaggcgcacgagaaattcttccagacagccaagcgagtgcagagcctcaaggcactcctcgctacagacgacgacgttctgttgctgcaggccaagatgtcagctgtcgtgctcgggcaacgggaccacagcctgcaggagatcacccgcaccctgctgatcgagaacgccgatcgcacggacaccaagttccgtgccctcaccgactacaacctctccaacttctactggcaaggcgcttcatccttctacggctacacgtcgccgaacccgagtatcgacgacttcgtactgtggatcttccggcaagcaatctccgggttcatatcagaacgccccagcggactacgggaaatccaaatcatcttcagcagcctgcgttacgacgtccgcagcgaaaaagcgatgaccacactcgctaaacgagcagctcgtgacctggattacgcgagcacgatcgttgacctcgacttccgagatctgttgagcaacgacctcttcgaagacgtcgaccagaagatcatcagcgaccttgcacgtgccgtcgccgaccgcaccatcacagcccgcgaggtcgccgaaactatccgtagccgccagagcagtgtctggatcaacgagtaccgcaagctatacacggcgatcggtagcgcttccgatctgctagccgcactcgacgcgctcaatgtgtcgatgcagtcgttcgacgaggggttggatcggtatcggaaggactggttccgcattgaccagctctaccggcagttcacctatgcagcccgtactgcagagcacaccggtccgctagaaacgctgcgggcgcaggtcgagaacttttatgcgaacaaattcctgcataccctcggttctgcatggcagcagcaggtcgatagtgtcgaccgatggcgctcctccatcctctgttcgcagacgtcgttttttaccgaccacgtcaagcccatcacgcgggacggccggcgtaaagctgtcgtcatcatctccgacgccatgcgttacgaggttgccgacgagcttggctcgcgtattcgtcaggagaatcgattcgacgcgaccctagacgccgttctgggtgtactgccgagctacacccagcttgggatggctgcgctcttgccgcacagcacgatcgggcattcaggtaaaggcgacctcgccgatgtggacggtcagcctacttccggaactgccaaccgcagcaagatcctcgcgggcgtgcaaggaacgtcgattctcgcggaagacctgctcagtatgacccgcgacgagattcgtgagctctaccaacagcaccaggtgctgtacatctaccacaatcgaatcgacgctaccggcgacaagcaaggcaccgagcggcaggtattcgaggccgtagagaagaccttggacgagcttgtcgatctggtcaagcgcctgaccaacgccaacgccaccaatatcctcgtgacagccgaccacggcttcctcttccaggactccgcgctcgacgacaccggctacctgtcagtggcaccccaaggcgacgacatcgcgatccaagcgcgccggtacgtactgggcacaggtctcaagcccgatcccgcgttcacgacgttcacctccgcccaactcgggctcaccagcgactacgaagtgcagatcccgaagtcgatccatcgactgcgactcaagggttccggcgcccgtttcgtccacggtggggcgagccttcaggagatcgtcgtgccagtgctcgccatcaagaaaaaacggaagagcgatacgcggctggtcaacgtcgaaatcttgccggagtcggacaagatcaccaccggacagctagtcgtcaaactcttccagtccgatccggtcaccgaaaaaatccagacgcgaaccgtgcgcgctggcctctacgtcggcgaaaccctcatctcggaacacgtgcctctggtgttcgatcaggagtcgaccgacaaacgcgaccggtatcagagcgctgtcatgtttctgagcctggacgcgaacgactacaacaatcggacggcggagttccggttggaagagcagatcaccaatacgaaccagtggcgcgtctatgcaaaggcgatgtataagctcaaacgttcattcgcctcggacttcgacttctaa

SEQ ID NO: 1265 - DNA, 2571 bp, Rhodopseudomonas palustris
atgcacccgcttcacgattatatcgccggccagatcggcgaccgcatcaaggatcggcgtgttgtcgtcatgtacgacaagcgcgaggaactgcgcccgttctttgcagaggtcgccggcgggcacgtggtgggcgacggtaccgctacggttagcttcggccggcgcaaggctcgtctttgcgttttcgacggctccttcctgaaggcgcgatttgccgtcgaagaccttacgaaaggtgatcagccggacgacgttgtcatctacattcccggactcgaccgcgattccagaggttctctgctgatggagttggagaaggcgggcattttctatcagcagccagccctgaagcagttcgccaggctggtgctgcgcaagcgattcacggacgtcgcgatcgacgaaatgctgaagtcggacgcgctgtcttactccgatctcgccggtatggcgcaggacgacggtggtgcagcgcagggcacctcgttgttgaagagcgtattcggcgtctcggacacggtcgcgatcatgaccgactggttgggcaacgctgcgttcgacgcggacatgcaagccaaaggcgccatcggagagcttcgggacgccgctcttgccaggctcggactcgcgttgcctcaagatgcgacgttgtcccgtgcgcgtcagatcgggtttcgatatgttctggtcaacgagtttcgcgctgatcttgacgcgaaggctgagcttcggccgcaagtcggcaccgccatcaagaatgtggcggaggccaagaccagcgatcatcagaaggctgtgcaggaagtcgccaagcgactgcgcgaacgatactcacccgcctacatcgaggcggccgacaagatcgaggctgaactcgggttttcgaccgacacggtgcacggtgcgtcgcttggttcgatcgacaccttcagattcgaggaagctgctgttgtcgcggcatgtttcgagctcgtcgcttctgaaaaattcgaggccgcccgcgctctcatggcctctcgcgagagcagcttctgggtcaaccgtgaggtgacgcgaaagtcggtctgggccgtctgcaaactgatggtcgaccttgggctggtcgcggcagcggtcgactcgacgatttcgaaggccaacggaaatccttccgtatgggtcgaacggtacgtgtccgaaaaggatgggtggtatgccctcgaccaggcacagcggcgcctggaggcgttcctttcgtccgtggacgaaggggtcgacgagcgagccgtcgcgaggatccggatcatctacgagaatgcggtccgtcgcatgagcgaaggatttctgaaggcgctccagaaggcggattgggccgtgccgaacgtcttgccgcagacacgcgtctggtcagacgttgttgcagcccgcccgcttccggtcgcctatctcatggtcgacgccatgcgcttcgagatggggcacgagctcatcggccgtcttaaccgggcctcggaagttcaaattcgacctgctctcgcggcacttccgtccatcactcccatcggaatggcggcgctgcttccgggggcgtcggcaaccttctcggtcgtcgcggccaaggaccggctcggagcgtccgtggacggcacgttcctccccgacctgtcggcccgccagaagttcatgaagtcacatgtgcccgatttggtcgacttgacgctcgacgaagtgatctcgatgagcccgaaggcgctccagaagaagatcggcagttcgaaccatatcgtcatccgctccacggagatcgatgccgcgggcgaaaatgcgaccacgaccacgtacgcccggcgcatcatggacaacgtggtggaggacttggcgcgatgcctcggacgtctggcggctgtcgggatcggagaggctgttatcacggctgatcacggtcatctgttcttcgctgccgaccgagatccctcgatgcgccttgaaacgccgggtggcgacccgatcgacctgcaccggcggtgctggatcggtcgcggcggctccacaccggcgggatcggtgagagtgggcggcgccaagctcggttacgccaccgatctggatttcgccttcccggcaagcacgtccgtcttcaagagcgggggcgacctggcctaccaccacggcggcacctctctgcaggagatggttatcccggtcatctccgtgaagctgaaggcggacggcagcacgaaggccgagaaagatgctgtcacggtgtcccatgagttcgatgcggtcacgaaccgcatcttcacggtgcaggtcgaactcggtgcagcatcgaaggatctgttcgccggcgctcgcaagatccgtccgctcgtggtgtccgacgaccgaccagtcgccagcgcagccatcgccaccggcgcggtcatcgcagacggcgtcctgaccttaccgccgtccgtcaaggcccaggtcggcttcatgctgactgacgacacggtcaaacatgtccgcatccaggtgctggacgcggaaaccgacgcgcttctttacgtctcgcaaaaagacatccccgtccgcttgggagtttaa

SEQ ID NO: 1266 - DNA, 2328 bp, Saccharophagus degradans
atgaccaccgttttagcagccttagagcacgccttactgaattcaggttcgttcaaccccgatattgaagtggctcccgcggccgtgctttggccggataaagaccgtttgtggcagcccgttattggccagttgcaagcgagactcccacaattgtggaccttaggcgactatgcgccggagcaaaaaaccggaccggccatttggttgcgctgtgccatggctaaccgtgtggagggtgttgatgcggccggtgccatccccattctgtatttacccggtgttagccgccaggaaatccgcgccattgagagttgcccagaagcgctaaagcccctggcggagctgcaataccgaggtgtgatctggtcgcaagtgaatgccaaagactggaccattctggcctttttacgctctgaccagggtggcttggggctggatgtggcgcaagatcgcgctgctttgcatgccatgcaattggctttgtatcgcctactggatgtagacatcagcctgctaaagggcaaacgcttagacaaagactatttcaataccctgttaattgatggcgacccgattcgcgatctgttgcagtggctggatcagggtgatgcctttaaagccgccaagggtgacacggcctggcctgcgtttgttgaaattattaagtcgcagctgggttttgaccccgacaaacaaggcacattgagcgcggcggctttgttggcggcccacgaaggcccctggcaaccggtatgggatagatactgcgaggcgccaaagcgttacccaaacattccagcgctgctggaaaaaacagcgctgcctatggatatgtttgccgataagagcggctggccgcagtggaatcggcagcaagaacatgagttgcgcctggcactcacgcgccttgagcagtcatcaccagcgcaagcccgcaaagcaattgcggatttggataacactcatggcgagcgcagaaccctggtgtgggcagagctcggcttgtcgccactggctcagtcattgaagtggctcaaaaagctcgccgaagtaaccaaaagctcgattgctggcggcacgatcgcagatatggccaatacctatcaaaccgtcgcctggcaggcggatgatgcggcggtgcaggcattaaagcccattgatcaacaagaagattttgatgcggtttctacggccattagagccatgtataccgattgggcacaagatgctgcccgctatttgcaggattccgtacagaaacacggctacccagggctaggtgccgccgagcgtaaaccggttaagtacgccaaaagcgagaccgtattttttgtggatggcttgcgctttgatgtgggcaagcgcttcgctgaaacactcgaagccaaaggctacagtgtggagttatcgacgcggtggtcagccttgccaagtgtaacggcgacggctaaacccgctgtatcacctgtggcccaactcattagtggggttgttggcagtgacgccttcgaaccctgcgttaaggaaaccgagcaaaagctaagcggccatcattttcaaaaactgctggaaaccagcggctggcagaagttggcgaaagccgaaaccggtgaaagcactggacaagcttggtgcgagtatggggacatagactcagaaggccatgaccgtggctggaaactcgccaagcatattgatgccattttagctgaggtcgaggatcgtattgatgggctgtttagcgcgggctggaagcaagttcgattagtcaccgaccacggttggctattgctgccaggtggactccctaagacggagctacccgctgcgctggtggatagcaagtggggtcgctgcgcctcgattaagccgggttctcacaccgatgaactactgtacccatggcattggaatgctgagcagcactttgctttagccaacggtattagctgctacaaattgggtgaagaatatacccatggtggcctcagtctgcaggaatgcttaacaccggagctgatcatccgtaaggcgggcaatgcttatgttgatgttaaagcagaaatcaccgatgtttcctggcgtggcctgcgctgcaatgtggccgtagagggtgcgtttgaaggtttattgttggacgtgcgcttagacgcgggtgatgcatcgaccagcaaagtaatgagcaccaaaacgattaaagattccggtgtaggctcagtagttgtagatgatgaagatttagacggcgttactgcagtcatcgttttgcttaccgaaagtggtgagcttatcgctcagcagcaaacgcgtatcggcggagaataa

SEQ ID NO: 1267 - DNA, 2598 bp, Salmonella enterica
ttgcaaaatcaggaatttattgccggccttaaagcaaaattcgccgaacatcgcatcgttttctggcacgatcccgataagcgtttcctcgaagagctggataacctcgaactcgaaaacgtcacgctgcttgatatgaccgaccagtcgcagctggcggttaaaaagcgcattgaaatcgacgagccggaacagcagtttttgctgtggttcccccacgatgcccccccaaaagagttcgactggctattggatattcgtctttatagtacggagttccacgccgatttcgccgccattacgctgaatacattaggtattccacagcttggcctacgcgagcacattcaacgccggaaggcatttttcagcactaaacgtctttctgccttgaaaggcctggtcactgagcaagaaaacgaagcttctcttgataagaagatggttgcggtcatcgctggcgtaaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccgtcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccatcattcatgcgctggtgacgcagcttctggaagagagcaccacgctagaccgtgaagcctttaagaagcttctgtctgaacgtcagagcaaatactggtgccagacgcgtcaggaatactgcgctatttacgatgcactgcgtcaggccgaacggttgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaagcctggatgactatatcgaagcgctgtattccaactggtacctggcagaattaagccggagctggaataaggttctggaaaccgaaaaccgtatgcaggagtggcgtattgcgggcgtaccacggcagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgccgaactgcgttcccagttgggcgtgttacccagctatacccagctgggaatggcggcattgctgccccatgacgagatatgctaccaaccgggtagtggtgacatcgtttatgcggacgggttatccacctcaggtacgcctaaccgcgataccattctgaagaaatataaagggatggcagtaaaatcggacgatctgctgaaatggaaaaatcagcaaggacgagatcttattcgcgattacgaagtcgtttatatctggcataacaccattgatgccatgggtgacagcgcatcgacggaggagaagaccttcgaagcgtgccgtaacgcggtggttgaactgaaggatttagtgactcgtgtaataaaccgtctccacggtacacggattatcgtcacggcggaccacggtttcctgttccagcagcagcccctttccggccaggataaaaccacgctgcagatcaagccagacaatacgattaaaaaccacaaacgctttattatcggtcatcagcttcctgccgatgatttttgctggaaaggaaaagtggcggataccgcaggcgtcagcgataacagcgagttcctgatcccgaaagggatccagcgtttccatttctcgggcggcgcgcggtttgtccatggtggcgccatgctacaggaagtctgcgttcccgtattgcaggtgaaagcactgcagaaaacggctgccgagaagcaacctcagcgtcgtccggtagacatcgtcaagcatcatccgctgatcaaactcgtcaataacattgataaagtcagcctgctgcaaacccatccggtaggtgagttatacgaaccacgtactctgaacatcttcatcgtcgataacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1268 - DNA, 2604 bp, Salmonella enterica
gtgaccttgcaaaatcaggaatttattgccggccttaaagcaaaattcgccgaacatcgcatcgttttctggcacgatcccgataagcgtttcctcgaagagctggataacctcgaactcgaaaacgtcacgctgcttgatatgaccgaccagtcgcagctggcggttaaaaagcgcattgaaatcgacgagccggaacagcagtttttgctgtggttcccccacgatgcccccccaaaagagttcgactggctattggatattcgtctttatagtacggagttccacgccgatttcgccgccattacgctgaatacattaggtattccacagcttggcctacgcgagcacattcaacgccggaaggcatttttcagcactaaacgtctttctgccttgaaaggcctggtcactgagcaagaaaacgaagcttctcttgataagaagatggttgcggtcatcgctggcgtaaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccgtcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccatcattcatgcgctggtgacgcagcttctggaagagagcaccacgctagaccgtgaagcctttaagaagcttctgtctgaacgtcagagcaaatactggtgccagacgcgtcaggaatactgcgctatttacgatgcactgcgtcaggccgaacggttgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaagcctggatgactatatcgaagcgctgtattccaactggtacctggcagaattaagccggagctggaataaggttctggaaaccgaaaaccgtatgcaggagtggcgtattgcgggcgtaccacggcagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgccgaactgcgttcccagttgggcgtgttacccagctatacccagctgggaatggcggcattgctgccccatgacgagatatgctaccaaccgggtagtggtgacatcgtttatgcggacgggttatccacctcaggtacgcctaaccgcgataccattctgaagaaatataaagggatggcagtaaaatcggacgatctgctgaaatggaaaaatcagcaaggacgagatcttattcgcgattacgaagtcgtttatatctggcataacaccattgatgccatgggtgacagcgcatcgacggaggagaagaccttcgaagcgtgccgtaacgcggtggttgaactgaaagatttagtgactcgtgtaataaaccgtctccacggtacacggattatcgtcacggcggaccacggtttcctgttccagcagcagcccctttccggccaggataaaaccacgctgcagatcaagccagacaatacgattaaaaaccacaaacgctttattatcggtcatcagcttcctgccgatgatttttgctggaaaggaaaagtggcggataccgcaggcgtcagcgataacagcgagttcctgatcccgaaagggatccagcgtttccatttctcgggcggcgcgcggtttgtccatggtggcgccatgctacaggaagtctgcgttcccgtattgcaggtgaaagcactgcagaaaacggctgccgagaagcaacctcagcgtcgtccggtagacatcgtcaagcatcatccgctgatcaaactcgtcaataacattgataaagtcagcctgctgcaaacccatccggtaggtgagttatacgaaccacgtactctgaacatcttcatcgtcgataacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1269 - DNA, 2598 bp, Salmonella enterica; identical to SEQ ID NO: 1267

SEQ ID NO: 1270 - DNA, 2463 bp, Salmonella enterica
atgaccgaccagtcgcagctggcggttaaaaagcgcattgaaatcgacgagccggaacagcagtttttgctgtggttcccccacgatgcccccccaaaagagttcgactggctattggatattcgtctttatagtacggagttccacgccgatttcgccgccattacgctgaatacattaggtattccacagcttggcctacgcgagcacattcaacgccggaaggcatttttcagcactaaacgtctttctgccttgaaaggcctggtcactgagcaagaaaacgaagcttctcttgataagaagatggttgcggtcatcgctggcgtaaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccgtcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccatcattcatgcgctggtgacgcagcttctggaagagagcaccacgctagaccgtgaagcctttaagaagcttctgtctgaacgtcagagcaaatactggtgccagacgcgtcaggaatactgcgctatttacgatgcactgcgtcaggccgaacggttgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaagcctggatgactatatcgaagcgctgtattccaactggtacctggcagaattaagccggagctggaataaggttctggaaaccgaaaaccgtatgcaggagtggcgtattgcgggcgtaccacggcagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgccgaactgcgttcccagttgggcgtgttacccagctatacccagctgggaatggcggcattgctgccccatgacgagatatgctaccaaccgggtagtggtgacatcgtttatgcggacgggttatccacctcaggtacgcctaaccgcgataccattctgaagaaatataaagggatggcagtaaaatcggacgatctgctgaaatggaaaaatcagcaaggacgagatcttattcgcgattacgaagtcgtttatatctggcataacaccattgatgccatgggtgacagcgcatcgacggaggagaagaccttcgaagcgtgccgtaacgcggtggttgaactgaaagatttagtgactcgtgtaataaaccgtctccacggtacacggattatcgtcacggcggaccacggtttcctgttccagcagcagcccctttccggccaggataaaaccacgctgcagatcaagccagacaatacgattaaaaaccacaaacgctttattatcggtcatcagcttcctgccgatgatttttgctggaaaggaaaagtggcggataccgcaggcgtcagcgataacagcgagttcctgatcccgaaagggatccagcgtttccatttctcgggcggcgcgcggtttgtccatggtggcgccatgctacaggaagtctgcgttcccgtattgcaggtgaaagcactgcagaaaacggctgccgagaagcaacctcagcgtcgtccggtagacatcgtcaagcatcatccgctgatcaaactcgtcaataacattgataaagtcagcctgctgcaaacccatccggtaggtgagttatacgaaccacgtactctgaacatcttcatcgtcgataacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1271 - DNA, 2604 bp, Salmonella enterica; identical to SEQ ID NO: 1268

SEQ ID NO: 1272 - DNA, 2598 bp, Salmonella enterica; identical to SEQ ID NO: 1267

SEQ ID NO: 1273 - DNA, 2598 bp, Salmonella enterica; identical to SEQ ID NO: 1267

SEQ ID NO: 1274 - DNA, 2592 bp, Selenomonas sputigena
atggacatagaacagattatcgccgatctaaaccgccgctttgccgagcctttgccggagttttatcggcggcgcatgatcgtctggcatgacgaggagaaggagtttgtcgataaaatcgacgagatacgactgaataatgccaaaattgccattctcacaggaacaaactatttttctgtgaaaaaacttctcgccgtggacgatacggacagcaactatcttctctattctcccttcgcctacgaaacgctggaggataattggcttctggatatcgaactgtacagcgaagagttccgcgctgatctcatttccatgtggctgagcgagatgggactgccgcagacgccgagccttagaagcgccatcaagccctaccgcaagtttatgaacgccaaggaacgccgcaagaaaataatggcgcagacgaatcttcccactactgccggaggattgcacctctcgatcatggcggctttggcagggataaaagacgcaaagcccgccggaattatcaaggcggttctgaaggcaggactaaatcattcagccaataatctgtggcaggattttgaaggctaccatattgctgatgtgttttggcgtatggttgcccagggtacggggtacgcgcaggaaaatcccacccttggggcattggctgtccatatccttctgacagctgtcagccgcaccctgcggcaggaatttttgaaggggctggatacatatatatccacggctcatgcggctttttgctatgaccttgtttccgattggctctatgccgaagaccatcatgctttgcacgaaattgccgaatttgcagagtctgaagcgaatcttcatgagcgatttatgaaacttgaaatcgctgatttgttgcatactgccatattcccttgcgtgaacgagattatcctcgtaaagctcatgcgggatatggagaaaaacgtcatcgatccgaaattcgtcaaggaaatcgtggaaaagcgacgtaccttcgcttggtatgaggcaagccgcaatttttacgaagggctataccaagcagcgaatatgcaagagtttttcaagagccatgcagacggcttccatgcgatagcgccgaaaaaaatctggcagggatacaccgaggaatattatcgcttcgataccttttatcgccgattccaccgaagctacgacgccagtttgaaaaattgccatgcggatttatcggatatgtttgccgatatcaaagatatggcagaagggctgtatgtcaactggtttttggaggaacttggaacaagttggttgaacgctgtagaggagagtctttctgcacacggaaaagcctctgatattcccatgcagacagatttttaccgtcacaaggtttatcctgcggattcgagagtttatgtcataatttccgatgcgctccgctatgaagtggctgctgaacttgccgacgacctccgacgggaaacacagagcaaggtggaacttggttccatgcagggaatattccccacgattaccaagttcggtatggcggcgctcttgcctcataaaagactttccgtggaggaaaaggccggcagattgtccgttttggcggacggcgaatcgacagaagcgccccggcgggataaaattctgaaagccgccaatcccaaaagcgtcgcactgaaatataaggatatgctcggcatgaagcgaccggagcggagcgccttggtacgcggcatggatgtggtgtatatttaccacgataccatcgacgaggcaggacatagtgaaagttctattttcggggcgtgcggcgaggccatcgaagaaatcaagaatatggtgcggatcattaccggcgagttcagcgggacacgcatcttcattaccgctgaccacggctttctctatacctttaatccgctccgggaagatgacaaggtggataaaattacaaagagcagccaggatgtggaaatcgcccgccgctatgccatcgtgcggaaaggcgctgcgccggagtatcttctgcctgtaaaattcttggatggggatacggaatatgatgcattcgcccctcgtggcaaccttcgcataaaaatgaagggcggcggcctgaatttcgtacatggcgggataagccttcaagagatggtcgtgccgctgatcgactaccgttatctcagaaacgactccaaagaatacaaaaaaaataaagcacggtacgacactaagcctgtaacgctaagcctcttatcctccagcagaaaaatcagcaatatgatattttctctgaatttttaccagaaagaggctgcggcgggaaatagagaggcggctgtttataccgtgtactttacggacagcaacgggaaagttgtcagcgatacggtgcacattatcgccgataagacttcggatcatgccgaagaacgtacgtttagggtaggttttaatttgaagtcgctcaaatacgacagcaaagaaaactactatctggtcatcgccgacgagagcggtctgcccgtcaggcaggagaaattctccattgatatcgcctttgcggtggatgaatttgatttttttagctag

SEQ ID NO: 1275 - DNA, 2040 bp, Shewanella sp.
atgttagttgttaactatttaatcgagcagttgagaaatgctgctgcctataacaagtcagttcaagtcaagcctgctgcggtgttgtggaccgatgagctgtgtcaatggcaaagtgcgatgccattaatcaaagagtatttacctgagttgttggagttgggtgactatgaaccatcacagcgcacaggtcctgcgatttggctcaagtgtgccattgctggggtattagacgaagcgccgttggttgaaggacgcacgcccatcatctatctccctggtgtgagtcgtaaggcgctgcgcgccattgaggattgtccggattatttacggccgcttgcagagttacaatatcgcggaagctggtgggcctataatactgctggacgagactggagtgttggctcgtttttgacgaacccaagggttggactagagctggatgtggctaaagataacagcactcaagaggtcattcccaaagtgctacgtgatttacttgaaacccaagtggatgcacttaaaggtcgtcgtttagaggcgaaagactttcaagagttggtatttaacgatcccattaaagatttgctggggtggcttaatcatcccagccagaaacgtgcccagtgggatgaaaacaagtggcagctattttgccaaacctgtgagagtgaattcggtctgaaaccaggtgatgatacccatcagcagatgttggcagccatgcttaatgccgaggggccttgggctgcggtgtggcagcggtttgaggattcggcccataatctgcattctctcctcactgcgattgctacacttgtgccagtcgatttggcggcggattttagtcattaccccatcgaaaacgcccgcgaagagcagcgattgatgaatgccatagtggcgttggggcagggcgaactgagcttggttaggagcaacattgcggatttgtataaagcccaccaggtgcgtgaaggctggctttggtatcgcttaggacaatctaagtatctgcaaattttggccgagcttgccaaagtggcgaagctgacggcgcagccgtttactcatcaatcacctcaagagatggcagccctttactgtgaaacttattggcaagccgatgccgccgcgctgcaggcgatggcactggcaatagagcctcagcagcaagagctggtggcagaagtacttgcacttatttattccccttggctctctgaagtgacccataacttccagggattggtgaggcgtcagggttaccctggcgatggggagattaacgaggccacagcgggttatcttgccaaaggtttagtggtgttttttgttgatggtttgcgttatgactgcgccaaatggttggagcaaaaactgcttgcgcgccagatacaggccacgctgactagccagtggtgtgcattgccgtcattgactgacaccgctaaagctgcagtgacacccattgcaggcttgttaacgggagcgcaggatacccaggactttacgccgtctgttgcggcgacttcgagtgatttcagtgcttatcaccttaaaaagctgctggcagaacacggatggcagtatttagaggggctcgatagtggcgagcaagaaggacttgcctggttacaaactggcgacctggataacctgggccaccagcagcagcgcaaattgcctttggggattgatgctgtgctcaatgaagtggccgatagggtttgccatctgttggatgccggctggcgtgaggttcacattgtgacagaccatggttggttgtggttgccggacaaactgccgaaggttgagctggataagccactggtgcgtaagtatttgtcccgctgcgccattttgcatgataacgcctcgaccgatcttccgcaggtgggctggcattggaataatgcagtatcgcttgccatggcaccgggggtcggcgcttttaccgctggtgactattacaaccatggtggattaagcctgcaggagtgtttaacgcctgtgctgaaaattaccaatagttag

SEQ ID NO: 1276 - DNA, 2040 bp, Shewanella sp.
atgttagttattaactatttaatcgagcagttgcgcaatgctgctgcctataacaagtcagttcaagtcaagcctgctgcggtgttgtggaccgatgagctgtgccaatggcaaagtgcgatgccattaatcaaagaatatttacctgaactgctagagttgggcgagtatcaacctgaacagcgtactggccctgcaatttggctcaaatgtgccattgccggcgtattagacgaagcaccgttggttgaagaacgcacgcccatcatctatctccctggtgtggggcgtaaggctctgcgtgccattgaggaatgtccggatgagttaagacccttagccgagctgcaataccgtggcagctggtgggcctataatactgctggacgagactggagtgttggctcgtttttgacgaacccaagggttggactagagctggatgtggctaaagataacagtactcaagaggtcattcccaaagtgctgcgtgatttacttgaaacccaagtggatgcactgaaaggtcgtcgtttagaggcgaaagactttcaagagttggtatttaacgatcccattaaagatttgctggggtggcttaatcatcccagtcagaaacgtgcccagtgggatgaaaacaagtggcaactattttgccaaacctgcgagagtgaattcggtctgaaaccaggtgatgatacccatcagcagatgttggcagccatgcttaatgccgaggggccttgggctgaggtgtggcagcggtttgaggattcggcccataatctgcattctctcctcactgcgattgctacgcttgtgccagtcgatttggcggcggattttagtcattaccccatcgaaaacgcccgcgaagagcagagattgatgaatgccctagtggcgttggggcagggcgaactgagcttggttaggagcaacattgcggatttgtataaaacccatcaggtgcgtgaaagctggctttggtatcgcttaggacaatctaagtatctgcaaattttggccgagcttgccaaagtggcgaagctgacggcgcagccgtttacccatcaatcacctcaagagatggcagccctttactgtgacatttattggcaagccgatgccgccgcacttcaggcgatggcactggcaatagagcctcagcagcaagagctggtagcagaagtacttgcacttatctattctccttggctctctgaagtgacccataacttccaggcattggtgaggcgtcagggttacccaggagatggtgagattaacgaggctactgcaggctatttagccaaggggttagtggtgttttttgttgatggtttgcgttatgactgcgccaaatggttggaacaaaagctatttgcgcgccaaatacaggccaagctgactagccagtggagtgcattgccgtcattgactgacaccgctaaagccgcagtgacaccgattgcaggcttgttaacgggagcgcaggatactcaggactttacgccgtctgttgcggcgacttcgagtgatttcagcgcttatcaccttaaaaagctgctggcagaacacgggtggcagtatttagaggggctcgatagtggcgagccagaaggacttgcctggttacaaactggcgacctggataacctgggccaccagcagcagcgcaaattgcctttggggattgatgctgtgctcaatgaagtggccgatagggtttgccatctgttggatgcaggctggcgtgaggttcgcattgtgacagaccatggttggttgtggttgccggacaaactgccgaaggttgtgctggataagccactggtgcgtaagtatttgtcccgctgcgccattttgcatgataacgcctcgaccgatcttccgcagatgggctggcattggaataattcggtatcgcttgccatggccccgggggtcggtgcttttaccgctggtgactattacaaccatggtggattgagcttacaggagtgcttaacgcctgtgctgaaaattaccaatagttag

SEQ ID NO: 1277 - DNA, 2571 bp, Slackia heliotrinireducens
atggacatcgaatacagcgaaatcgaaaacaggttgaaggcggcgttcgggcacagcacgaggctcgtcttctgggaggacgagtcctcggaatacgccgactcgatcgaaggcctcaagattgaaggggccgatatcgtcgacgcgacaggacacgaactcgcaacgaagaggacaatcctgagggagcagcccggcaagaggttcgtggtctaccgccacggcggcgcgccaaatcccgccgatgacctgctgctcgacgtcaagatcgcggcaaggcccttttcttgttcgatggagggcgtctgggcggacgaatgcggaatacccgtcactctcgccggcatgttggccgaccatgcggccttcttcaacagcaaggagcggagggccgcgctcgcggctacgtcccttccgaaatcgggcactcaaagctttctcttcgcgatggccgccgcaaccatgaaggcagccgacgcggaggaaagggatgcggcacgctcgatggccaagaaggccgtcctcgagtgggcgcgcggcgacgagcagtccatgcgcatgctggtcgacgccggtctgtctggaactttctgggcggccatgagggaacatatcggctaccgggtcggagagggggacgcaccgaacgcgggcgacctggcgttcagactcttggagggcatgtgcggcccgatcgtccaagacgatatgcgagccgatgacgcggaagcctccaggatccttggcgacctcgcccgcgacgggcgaacgagagacgagttcgaccgcgtcgtgcaggaatactccaaggccgtcgccgcgctggtgccgcaagatatgaggacggctgagacgctgtcggaggtcgacgcgatacccgaaatcgacgaatggatcctctcgggcttcgcggcggaggtgtccgcctcgagcacgagctcggcagcgatggagcgcgtgcgcgacgcaaggaagcacagcctgtaccattacagatacggcgcctattacagcctcctcatcgcaataaccggcttcaggtcggaatgcgcccgatacaagaaggaatgcggctccggaacggggaccgcgcagatactcgagaagtactgctccgcctggcatctcgtcgataggcgctaccgcgaggcgcacctcgcgttcgacagggtgcccgccggcaggttcaagtcgtccatgaccaaggccatggacgagctccgcggcgcgtacgacctgttcctcgtggacctgaccgatcgttggcagatgcacctgatggacgacggagcctggcccccgtccgagctgccatcccaatcaaggttcttcagggagcacgtcgagcttgcccttcccagggctgaacggggcaaacgagtcggcgtcatcgtttccgacgccctgaggtacgaggccggaagcgacctcgcgtcgaggctctccgcctcaaagctgaagggaatcgccggcagagccgcagtcaagtgcgcatacgcgctcagcgccatacccagctacacccagctcggcatggctgccctcctccccgacggggcaatggagatcgacccggctacaacgtatgtgcgcaaggccggtgctccgacttgggggaccgcgaaccggggcaagataatttctgcccggatacccggcgccgtggcgctgcaggccaaagacgtcatgggcacaaagctcgacctttccgatgcccctgtggctgtcgtctaccacaacgtcatcgacaagaccggggacacgcgcgacacagagggcgacgtcttcgaagctgttgagcgtgcttgcgcagaaatcgagaagctggtccaggcgctcattcaatcgggttgcggaaaggtcgtgattacgagcgaccatgggttcatctaccaatcccaaaacccggagacatacgcctacgtggacgttcccggcctctcgcagctcaagtcggccgacgacgtgagctgcgaccataccagacgtttcgtggtgggcaagagcatccccaagagcgaatcgctcgtagagtacgctgcggtggacctgtcgctcgaaggcgattacaacgtggcgttcccgaagggcgtgaccaggctcaggctctccggcagcgggtcgcgattcgttcacggcggggcgtcactgcaggagaacgtcgttccagtcatcaccgtcgaggcagcaaaaggcgccaaggcttcacgcccaacgggagtcgaaggctttgtcatagggaggccagttgtcaccggcccttcggtctcggtcactgtctaccagtccgacccttgcagcgaatcggtttcgccgcagaccgtaaaggtgggcgtgtactcgaaggacggcgctctcgtgagcgccacggagaagaccatcgaactcgccagcgagtccgacgacgtcgaaacgcgcaagactcgcgtgacgatgccgctcatcgacgaggtcgacgattgcgcaagcgtcgtagtaaggatttcggcgcgcataggcaatacgaacgcatatgagagcgcatgggagcaagaatactccgtcaaccgcgctttcggcatggatttttag

SEQ ID NO: 1278 - DNA, 2607 bp, Spirosoma linguale
gtgaacgacctacaacgaaaaataaacgctttctttcaacaacatccggcccgccgggtgttgttcttcttcgacactgaaaaccgccatatcgatgatgtagctggactaaacggcgaaacattcgagctggtacggcttaatccaccgtatgcctttttcagcacaaaggtgcagcttaatagtcggtctgccgatgctcttccggtgctactgtatttgcccggtctacagtcgccacgaaccgaagccgaccgtcaagagttccccttattcgatttactagtcgccaacgatgaactacgtcttgaccccgtagccgagttgatggcccgctatggtttacaacctcaccagcgaccactggtcgaacgatatcaatcggagttagtccgaaaagacccatcgggtatacttcagcccctacttcgtgctgacgcattcgaagaagcctccttacaacacgcactgacagccaggctattgggttttaaaatcttgccagatgttaatagcttactagccaaactcctgaccgaccgtgccgaccggccaaccgaacaggcaaactaccttacccggctggagcaattgaatctggatgctcctttgcgtcgacgtattggtgatgtctttttcgatgggccggtaaccgagccgctaaccagtggctttgtgcagcagttggtcttgcggctcaaatacaatttgatggtttcctcgctacccaccgatggcgagccataccccatgctacgcctgaaccgaacggatactttaagccgcctggcggttatacgggaaacgattggggccgctccgcttgaacgactactgacaaaggtcggcgaggctgttcaagaggaaaagctactggcgcgctatggaacgaccgcaaattatgggtattactccatccggttacgcgagttattgctcaagaaaattatgttggcatccggcccttcggtctcaccggatagccagctaaccgccctcgacgaactcttagccgacgtacctgagactcatccgcaacggctgttgttgttaacagttcggcatggacttagcctgctggaagccacgggcaatgtgctaacctaccgactcgatacgcctgaagcttacataaaaacttacgaagaaacgttttaccgcatcgacttactgtatcgttggtttgtgctggctcgacgcgactggcagatcgtgggctcagatgattcggccatcggaacaacggccgacgatatagctgaatggttaataccttttgaacagcgtatccatgatcgctatgaccgatttctgctcgaacttaaccgcgaatggttagcctgtctacaggagcggaactacgatttacgaagcattgctattccgaaacaatatgatttttatcgacaggcagtcgttcgacctcatctgcgggataccatccagaaagtagcggtactgatttcggatgggttgcgctacgaaatagcccgtgatcttcaagctgagttgaatcaggaccctaaaaaccagactacggttggctcgatgttaaccgccttaccgtcggctacctggttgggtatggctaatttgttgccgcataatggcctgctctttgacgggcaaacggtcaccatcaatggccagcataccaaggatatagaagctcgcaatgcgattctaaaggctacgaatgtacgaagccaagccattgactacaataagctggagtccatgagccggtctgagctccgcgatctattcaaacaggaggtcgtttatgtctatcataaccgaattgatgatgtgggcgataagcgccagtcggaaggggataccgttaaagccgttcgcgaaacgatggacgagctaaaacggctcattaaactcttacacagtcagtacaacgttgcacgggttttgcttaccgccgatcacggctttatttaccaacacatagcacccaatgatcaggcactaatgaaagcgccagaggtaccggtaaaactcgaaaaaaatcggtatgtacttacgaatcagagcaatttttctggggctacagtgacaggcagtcatgttttttcgctagccagcgtatcggctttggctacagatgttgactggaaggtgctggtgccggaaggcatcaaccggtatcgtcgtcaaggtagtggaacccgctatgttcatgggggagctagcttacaggaagtactcgtacccctgctcgaaagtagccgaaagcgggaagacgtaggtcagaaggtgaccatccgactgatccgcgaagacctaagtttactggctaaccaagtgaaggtacttttcttacaggagcagcgcgtaaccgatattgatcgccctcgtacggtagctgtaggtctttatgtaggcaatgaactagcatcgaatcgggtagagctgctattcgattcagtctctgaaagtgcgtcgggtcggacacgcgactgtacgcttcatctgacaggcaatttgcccgttcagcggcagtacacacttcgaataagcgacgtaaccgatgaactgaacccacttcttgagcggccagtaactaacaagacgataattgaacgagacttttaa

SEQ ID NO: 1279 - DNA, 2493 bp, Sulfuricurvum kujiense
atgagcaaaattaccgagagcctcaccaaactcttcgacaaacaccgcattatcttctggtacgacgatgggggcgcactgcgtgaagagttcgaatttctgactctggacaatgtcgaaaaacggctcattgccaacaacgagttttcgctcaaagtacagatccaccgcgccccgtccgatcagcggtttctcatctatgctccaaatcctcaaccggatgacgcgcacaactggctgctcgatctgaatctctccggctacctctacagtgccgaccgcgcctcgatgctcatcgacgaactggggatcgatccgatccataaagagctgatccaaacctatgagaagtttttcaacgccgaatcacgtcggagtaagctcatccccctcatcggcaaagagagcgacgcctctgccctaaaaaccgcgatgctcgccgtggtgtgcggctgtgaaccgcgacttgagtcgatcatcctgaaagtgttgagctgggtgtcagaggagaacgacaaaaagatcgcggaaatctccgggtatggtctggattcgttcttctttgacgaaatgcgccggatttaccgatatgagagcgcggagccttctttcaaagatttcgcctatgccctgattctggcccacttctacaacaccctctcccctgccaaagcggggctgaacgtcgatgcggtctatttcgtcaaacaccagtggatcgattcgcagcgccaccgggagagtttcatcctcctctcccgccaggtcgaagagatgctggggataaaagagacgcttgagagctattcgctctctcagctgggggaatgtgatacgttcgaatcgatcgacaaacggatcatcatcgaactacgcaacggcatcctctcatccctgctcgacgccgacaccctcatcgagacgatccgaaagcgggaaaaaagtgtctggtttgaggagtaccgccatctctacaaagcgctcgaatactccgcgctgctgctgcagcggatcaaaagctccagccttaaaatcggtggcctaaaagagggatttgaacggtatgcctcgctctggtacgagacggataccctctatcgaaaagcgctctatcacagcgcgatggccgaacacatcgatgtcctcaaatcgctgatgagccaggtggaaaacgcctatctgggcagctacctgatcccactgggagacgcgtggcaagagcacgtcaatacgatggaggagtggaaaatccccggactcatcagtcagcggcaattttatgagcactacgtcgccccgcagacgacaaacgatcgtaaagtttacgtcatcatctcagatgcgctgcgttatgagtgcgccaaagagctcgaaaaacggctactggagaaaaaccgctaccaatgctcgaccgaggcgatggtgggggtccttccgagctacacgcagttggggatcgcgtcactgctgccgcacaacgaattgggattattggggagtgatgacaccatcagcgtcgatggcaaatcctccgcaggtgtcgccaaccgcaacaaaatcctcgaagcttcacctgcaagtgccacctatctcaaatgggatgagttcatcggtatgggccgagacgaggggcgggaattcgtcaaagggttccaggtattctacatctaccacgaccggatcgatgcgatcggcgacgatgccaaaaccgaatcacacgttttcgaagcggtcgaaaaagcgtacgacgagatcgaaaagatcatcacccaggtgaccaatctcaacggcaccaacatcatcatcaccgccgatcacggctttttgtatcagaacaacgtcgtcgaagagaccgatctgtgtcagatcgaccgaaacggcagtacgattaccaaatacaaccgccgctttgttttggggcaaaacctcaatacccacgcgtgcgtcaaaaagttctccttcgaacagctcggcctgagcggcacaggtgaagccctgatcccaaaatcggtcaacaaactccgccttcagggggcgggaaaccgattcgtccacggaggggcgagcctgcaggagatcgtcgtgccggtggtgctgttcagcaaaaaacgcaaagacgatgtcgaaaacgtcgacgtcgatatcgtcaaatcgttcagccgcatctcctccaaccagataaccctgaccctgtggcagaaaacccctgcaggggataagatgctcccccgcaccctgtatgcgggattctacgccggggatgagctcgtatccaacgaagagcagctcgttttcggcagtacggacgaggattcccgcaaccgcgaagtgaaagtcaaattccacttcgtccagacgatcagccagtacaataatcagacgatttccctgcggctcagcgaactcgaaccgggtacttcgcgtcggcgggtctacaaacaagagcagttttcgatcaacatctccttcgtcagcgaatttgacgatttctaa

SEQ ID NO: 1280 - DNA, 2592 bp, Synechococcus sp.
atggtgggagttgtcagtgactatctggtgcaattgatcaccaagcaggttgatgaaaagggtctagttgtctggtatgacccggagcaagcttatgaatcggttgcggtagaactctcactccccaataccactgtggctctcttcgagggtagcttcttcaaattacgcgaggacattgatcacttgctcaacgataaccatcccccacgtctggtcgtgtatgtgccaatggatcgaatggagacacatcatgcattgattgaacttgattgtgctggtgtcattatgcaacccaaacaacaacctccatcatgcaatacccgtttgtcagtcgtggcccgaaacgctctgaagcctattctgggagatgaacaggtttctgaaatcgaacaccaagtggaggcaggaaagctatccttagatgatctcaactccttagcagataaaggtaaggatatttcaacgggtatcctaaccctgattttcggtacagcaaacccccaagaagtagctttagactttttgcatagtgatcggcatgataacaatgtggtcaagaaagctgctgaacaggaattacaacatctctttcaagttagttttgacgttgaattatctgctagtcagtccttagcaagttggcgaaaaaagttgggacaatatatattgttgactgatttgtttgccagcctcaagcaattaccctcatctcttgcttcagttcccattgccaatacgaaaagcagcatcgatgcttgtgtacggttgacacaaacatggcggaacagccgaaacatgcgagacagctatgtcactgtatctaagcagattgagaaggagctagccctcaatcaactacaacttccagtcgagtctctccaggaaaatgaaaccttcttgtgtgttgaacttgcattgctggagtatgtcgaaagtgaattgatcaaggctgcaaatttagctttagtcgaacttgccaagtatcgactatccagtttctggtctaacgtgatacccgagattcaagctcggtgggcacttatcttatctgcggctgaagtcttaattgaagctgatcgggtgggtcgggctattaagaaagcgccaagttcggttttggatctagttaaatcctactctgatgacgatgaaccttggtgtgcattagatacccaccatcgacacatggagagtcggaagtataactttgagtttgccggtagcaacgatcacgagtgtttagaaaagctgctcattagggcagaacaacgttacaccgaagttggctcagaattagctaaacactttatcacccactaccaacaagcagaacatcccatcaaaggattattgcagcagagagaagtttttaagaaaagagtcaaacctcatcttagtgatggcaaggtagcctacctatgggttgatgcattgcgtttcgagatggccagtgagctatgtcgagtacttaaagaagacttcactttcgagatccagccagccattgctatgatgccaaccatcaccgagattggaatggcagctttattaccaaatgctgatgaatcagccaaagtcgtatcagtgggagggggcaagcttgggctggagatcgcaggcaaagtaattaaagatcgcaaggatcgaatcaaatttctaagagagcaagctggtgtatccgtcttcgatgccaagctagatgatcttcttcctaaaccgactaagaaagtgagagacagtattcaaaatgccgaattgatcctgataacctctcaggaaattgatgaactgggcgagcaggacaacatctcacaagctcgtcttcaaattgatggtgtgttaagccaactgcgtcggggaatacggttgctagccgacctcggcataaaaaccattgtgctcacagcagatcacggacacatatttgcggatgaacttggggaagatatgaaaatcgaggctccagggggcgaagtaaaagacctccaccgccgagtgtgggttgggctgggagggacatcagagctctcctatcttcggacttctttagcctctctgggagtagacagcgaattcgacatcgcaactccgtggacatttgcttgtttcaagtcaaaaggaggcgggcgggcctatttccacggcgggttatctccccaagaactgattgttcctgttgtggttctgaattcgatagtaaaaccccaactccaatcaacaggcgtgcagtggatactaacccccggtacaccaaagttaacgacacgatttttctccgttcagatatctgggatacagagtgagctaagtttgtttggatttaccccacccaacgtaaagcttgaattacgtgccaataagaaatgtgtctcatgccctgttagtgcctcctatggatttgaagatgccacaggcgaagtgaagctaaagattgcagatcatgacaacaaacaaattgagccgaatacaatcacactaatgttattggaagagatttctcagaagacagtaggggtctacttgctagatgctacatcaggagtagaattggcagaacccctgacgatagacgttgctatttcaatgtga

SEQ ID NO: 1281 - DNA, 2241 bp, Syntrophomonas wolfei
atgactaatcaatggtttttagaagatattgaaaatcttataaaaaaacgggggcgggtagtaatattagaccccaggtctcagtatggctttttattgccattactggagttccagggatacaccctgctcaggactgatagcaatttaaccgagccatggcaaacagtcaaggaagaactgttattgcgttatgaagctgaaacccggcataaatcagataaggtagtattctatgtcagccgggaacaggataagctcagctttttgctggactactgttttacccacggctgtctggattttagcgagccggcgaagtggcttagaaagaaacttttttcccataccgggctgcaggtgcagctggatgacgccactcttttaaccgcaggtaaaataggagcagaaaaagacctggcctggtggaagaagattctgcaaaacctggaggatttgattgacctggaggatgagttgatacctttcatggatgatcccgaagcttatattgccgatctggagcaggacatccgccgcatgtttgaaaccaaagtatttcaattattaaatcagccttatatgaccaagcctactaaaacattagctgaagaagtagcccgtaaactgctggatggcctggcctataacgatattaagactgacctcttatcaatctaccatcgctgggctgatagcgaaacctacagtccctctttaatgaattacgttgctaattacaatctggatagttcggttgacccctgggcagctcatcccgaccattgtttttctgcgttggatcaaaaagccctgcagcagcttaccggacatttaagagataaagagtatgtatccgggaagctggatgcgataaaagcccgggctaaaaacaccagagtaaagcgttttgtccctggctggtggcaggattttatcatcctgatggaatttgataaccagcccttgactgcctgctccagttttgaacaggtagtagatttttataccagccattttgcccaggtggatcgggctatccgcaatctttataccgcctttttatcagacaaaagcattattcgcccgctgcaggaatactatgagagcctgaattatgaattgctgcagaagtggtttgaatatgcccagcaatataagtcagaccagcagggttatttacctgatttatttaagaatgctaaagctggaacagccgttattgtaggtgatggtatccgctatgaaattgccgattatgtagcaactactttggcaaataagttcaaggtagacaaacagattatgttagccggactaccatcggaaactgaacataatatgagtgcgttatatgtgggtaataatgaagtgctggcctcgcataaagaccgggaaaaaaagcttggcgaaatcagtggtaaagctattacttatatgaacctggaagcagttagctatggtgaaaaagctaattatctggtacttaactacaaagatattgattatgccggggagacattgcagcagggtgctcttaaactttttaccgaatttgaacaggtactgcaagataaaattgcccaactcctgaatatgggttataaagaggttcacttggtaactgatcacggatttgttttgaccggcttattggatgaagctgataaaatagcccctgatgccggtaaagataaagaagtccatgaacggtttattcgcacccaggataaacccgataatcccgactggcttgttttcgagaaaccttatggcgaatacaaatatctatgtgcggcgaaaagtcaccggccattcaaatccaaaggggcctatggctttgcccatggtggatttactccccaggaaatcatcttaccccgctttgttttccgtaaagatggctttgccacttccagtttaggagttgccataagcaataaaaccgagttagcggaggtagccggtgaaatattcgttgttaagctgcaggctgatgccggcgctacggatttgtttgcctttaaacgcaaggtaaagatactgctctatgatgataatataaattgtggcagtagtaatctaattaatatggagcccggcaaaactgaaacgatagagtttacttttgacgaccggcagaccttaaaagcagttttactggatgctgaaagccaggagcaattagatattgtaagcgtaaaaaaagccaatattcgggatctgggcgggttgctataa

SEQ ID NO: 1282 - DNA, 2622 bp, Syntrophomonas wolfei
atggaacgggaacagattgagcagagtttgaataaaaagtttgaggaagccctgagaccgggggaaaaacgaaagattatcttctggtacgatagcgagggacagtttgctgatttaattaatgaactgcatctgcaaccggccagggtgcaccagcttaccgggcacaactatttttacaccaaatatctactggaagtggacgatactgaatctaattatttaatctatgccaaccaccggccggctcgcgatgaggataactggctgattgatacatacctttattcctatgaattttatgctgaccgcctcctgctacagatggaagaactgggcatcccgctgtctttaagaccacaggttaaacattatgagaaattcttcaagaatgctgagcgccgtaaaaggttggccggttatcgggaatggggacatgccccggggataccccggaccgggaatgtcacccatggggaagatgatgtctccaaagatgccagttacgatgaggccactctggagattgctatgatgtcggccttatgtggattaaaatatccggatcagcaggaagtctataaaaaggtgctgggcagtggtttagaggaacagaacaaccggtttctctccgatatcaaacgttttatggacgaagaggttttttggaagcatgccggcaggtattttggctacacccgtgaagaacactccctgcccaaactagctgcccatatcttaattaatagcctgcggcgcatccttgatgataaacacctccaacccttgcaagaatacctggctgacccaggtaagggaaactgcatttattttgttgaccactggatgaataaccagaccgataacgacaggtatgaaacgctgtccggcgctgtagacagaaccatgggtattgccgggcggatagaggatatcccggtggaggaactgggcgaatgcgatggttttgagtgcttcgaccagagaattcttggttacatccaggaatctatcggtaatcaggtggaaaactatgatttctgccttaaccttattaaagcccggcgtaccaaacactggtaccaaaaatacgaaaacatttatgaagccctgtatcacctgttaaaaataatggatttaaagaaaactctggcgccgattcccatggtaggagtaaaagaactatgggaaggctatgcccaaaactattttttagttgattatcattaccgtaatttctactggcattatgaccagaatccggtggaattcttaaagcccctgcgggcactggtggaaaatatctatagcaactggtttttgcaggaactgggtacggcctggtcgcacgccctggaaagcaatcctccgggctggcaggtggacggggttactcggcagcagaatttttataagcgggaaatagaacccatgattaatgggggtgaacgttgttttgttatcatttccgatgccctgcgctatgaagtggccgtggatatcgccattcgcctgaaccaggaaacgctagctaccgtaagcctggataccatgctgggggttctgccctcaaccacaccttatggtatggcggccctcctgccccaccggggactgagattgaaccagaatcaacaggtattggccgataaccggaaaactgatagcctgcaagaacgggaacaagttttgcagaattgggtatcagatgccgtggccacgcattgccagacgcttatcgatatgaacaaagaagcccggcgagaattggtgaaagggaaaaagttaatctatatctaccatgatagtattgatgccaccggacataccgccgccaccgaagtgaaggtatttgatgcggtggggcagagccgggaggaaatctatcgtttaatccgcctgattcgggacgatttgggtggggtcaatatttttgtgacggccgaccatggttttctgtaccggcgggatccgctgccggaaagcgataaaatgaaaaaggaaacggtagcggcatttgcagagaaaaggcgctatctgctcagttataaggaagtggaaagcgaggccttgatgcgctttaaaccggattatattagctccgaggaaggtgccttatgggtttacgtaccccgctcggctattcgctttaaggtacagggagcaggagccaacttcgtccacggcggcgccgctctgcaggaggttatggttcctttaatcaagtacaaggctttgcggggttccaaccgacggaagaaggaagaaaacaaggtcaaagttaaactgacaaacgaatcccgtaagataagcaataccctgtttagcctggaattcttccagagcgaaaaagtggatgaagaacacctgccccgaacggttgaagtttatatggaagatgagaacggcaagataatctccaaccgggaaatacttattgtcgacaagcgctccgacaaaccggctgaacgcagccataaagcgaaattaactttaaaaaccgggccctatgataaacagaaggactatttcctgatagtcagggatgcagatacggaattaattgaagagaaaattccttttaaaatcaacatagcatttagctccgattttgatttgtaa

SEQ ID NO: 1283 - DNA, 2352 bp, Syntrophus aciditrophicus
atgaaagatgaaacgaccctgatagagtctgtcttggcctctctggcacacgctgcacggtacaatcccggtgacatggttgctccggcagccgttctatggacagacacggatgggcagtggcgactggtggttgaacaacttcgaaggttcatgccaggactgctgacacttggtgagtacgatccacagacacgcaccggaccagcgatctggttgcggtgtgtgatcgagccagtggttcggaaagagaaattcacagacctgcaatggccggacgatgcaacgcctgtgatttacatgccgggtgtgagccgccagacacttcgggccgtcgaggaatgccctgacgggcttaagccactggtggagcttcagtatcgcggtacggtctggacgcagaaaaacggcaaggactggacagttcttgctttcctcattagtgaagatggggggatgggtttggatgtggctggggacaggcttacactccaggcgattcggggcgctttgtcgaaattgtcagtaacgccggtaaagcagttgagaaacaaaagactggaggctgaggacttcgaccggttgatgattggcgacccaacccgcgatctgctgcgctggctgaatgacccggatggggtgcgtaaggagttggaccaaggaacctgggcggcatttcgcaatcgctgccgacaggactatagttttaatccagaaacagatggagacattgtagccggcgaaaagctcgggatacgcgagggcacatggtatggcgtttgggaacgtttcgtggaggcgccggcgttctatccgagagttccggagctcctgcgacgctctaagccatcgggaaaattgatctttgataaagattcatggccggatgagaatgaatccatggaaaatgaacttcggagtgctctattaaagacaagcgcgatgagtcccgacgaagctcgacaacaactggaacagttggaagtcaagcatggagtacgtcgtaactgggtatgggctagattgggcatgagtccgctggccaatgccatggagcatctggcagccgtggccaaacggaccgaagtaacgcttggtggcgaatcggtcgatgccatggccagactttatgccgagggtggatatctcgctgacgatgcaatgcttcgatccttggcttgtgtgaagacggcggaagataccacagccgtccagacagcagtaagatgcgtttatctgccttggctggaggacacgaccaggcatttccaacaatgccattcggttaagtcgttgccttcagtggaacaacaggaagttgccaaagttaacacacatgaatgcatcttgtttgccgatgggctgcggtttgacataggacagcgactcgcagcgatggccagcgagcggaacattgaagtgtctgtcacttggcgctgggcttcacttcccacagtaacggcaacagccaagccggcaacgtctcctattgccgggaagttaagcggcggtcacatgagggaagacttctctccagaattgaaggaaaccggcgagacgttgactacggatcgttttcgtcggctgctttcagatgctggcttccagatactagggcaggttgatacaggagaccctctaacgcaggacgccagagggtggaccgagtacggagagtttgacaaactcggacacgatctccaggtaaagctggcaaccatgatcgaagaccaattagaacttctgttcgagcgagtgcaagggctactggaagccggatggaaacgggtggtcgtagtaaccgatcacggctggctgctcgtgcctggcggaatgcccaaagcaccactacaaaagtaccttgccgagagccgatggtcgcggtgtgcagccattaaggatacatcgcatgtagaagcaccggtttccggctggtcatggaactcgcatgaacaattcgcccatgcgccaggggcttactgctttgtgtccgggcaggagtatgcacatggcggcgtgagcttgcaagagtgcatggttccgattcttacctttactgccatgatggaatcgcctcagttgatcgtcaaggtatgtgaaattcagtggattcaccaacgctgccgagtaaaggttgaaccagtggcggaaggaataatggcggatctgcggacgaaaccaagcgttgccagttcaagcatttctggccttaaacgtctggatgcccatggaaaggcggcgctgctggtcgctgacgacacgcttgaaggaacaacggtcagcctggttattgtcgatgcttctggacgcgtcatttgcaaagaagctactaccgtcggaggtgacagatag

SEQ ID NO: 1284 - DNA, 2559 bp, Tepidanaerobacter acetatoxydans
gtgattaatttggaacttgatgaagtaaaaaaaatactggaacaaaactttaacaaagggctttctgaaggaaaaaagcgaaatatcatcttttggtatgatgataatggcgaatttaaaggtcaaattgacactttagagctttccaatgcaaaaattttaaaattggacggccaaaactatttttatgcaaaatatcttctagaaaaacaggatattaagagcaactatctggtatatgcacctttttgcaagcctggacctcgagaaaactggctattagatattttaaaatatagtgatgaattttctactgacaggactactattattatgagaaacttaggagtcaaaaatgaagctttaaaaaatatatttgaacattataaaaagttttttgataataaagaaagatatagactcctcaaatcctacaatatagaatactgcactgaagaatccgttcatatagcaatattgtcagctttgtgcaaacttcccttttccgaccttgatgaggtggtaaaatctcttttaatagagtatgccaaagatgataacacgtattttacggaaatagataagtttggagatattaatactttttgggcgcttatggagaaatactacggatatattttagaggaaaaaactatcgaacaccttagcgcttttttcttgataacagctttgtattatacccttgaagataaaataccagctcactgggaaaagtttatttctcctaaaaaggcggactgttttgtgtttcttagtaactttatgaacaatgctaaggctatggattattttgatatgctttcaataaaagtagaaaaacaattaaatctacgagattatgcagacaaatggcatattgataattatgtggtaagtgatgtatttaaaatttttgatgagactattataaataagttaattgaaaatttaatttctgatgccggtgagtttgaaagatatacagatattattttgcagcggagaacaaaacattggtatagaaagtatgaaaatgactataactgtgtttactgggccctagttatgcttgattcatggagaaagattaaggatgatataaaagaagataaaccatatgatttatttcaaaaatatgcgggtcaatattacattatagatatggcttatagaaaattcatatatttctttgataaactacctaataaagaaccgttttttgaattaaaggaaaagatagaaaatacctatgtaaacgggtatttgaaccaactgtcgataaaatggagcgatagcttggagactttagagcaaaactggaaaatttctcctttggagttgcagcaggatttctatataaatcacgtaaaaccttatgaagataaggacgagagggtatttgtaattatttctgatggtttaagatatgaggcggctaaggagttagaagaggatttgaatactgaaaggaagggctcaacaaagattactcctatgcttggcatacttccttcctataccgcccttggcatggctgccttgcttccacataatgaaatcaaaataaatgataaatttcaggtaattgtggacgggcttagttctgatggaacagagaaccgaagtaagattcttcagaaggcgcaaaaagacagtattgctgttgggtatgaacagctcagtggcatgaaaagggatgatttcagaaaactttttggcggcaaaaaggtagtatatatatatcataacagcattgatgctagaggagataacgcccttactgaaaacgaggttttcaatgctgtcgaagatacttttggcgagcttaaagctctaatcaatgatttgataaataatgtttcagcaaccaatatatatattactgccgatcatggttttatatataaacgaggaaatatacaagaaagtgataaggtatccaaggaatctttagaggattcattacaaaatcggcgttttattcttactgaagaagatgtagattttaatggcactcttacttttaatatgagtcatattgaagatacaaagttaaagtgtatagtgccacggggtgtaagcaggttcaaagtccaggggaaaggagctaattatgttcatggtggtgcggcactccaggaagtggttatacctgttattaaattcaaacatgagagaggcaaaaccgcaaaagaagtcaaaaaagttgatgttaagcttactagtatatctaggaagataacaaataatattacctatcttgagtttttccaagtggaaaaaattcaggacaagactgtgccaaggagactttcagtttatcttgcagatgaagaggggaacagggtatcaaacgagaatataataatagccgacagcacatcagataaccccgaagataggacctttagggaaaagttcgtactcaagagtatgaaatatgataaaagtagtaaatattatctggttctagaggatgaagaggaaaccgttgaaaggatatatgagaagattccgttcattattgatattgcatttatgaatgattttggtttttaa

SEQ ID NO: 1285 - DNA, 2550 bp, Tepidanaerobacter sp.
ttggaacttgatgaagtaaaaaaaatactggaacaaaactttaacaaagggctttctgaaggaaaaaagcgaaatatcatcttttggtatgatgataatggcgaatttaaaggtcaaattgacactttagagctttccaatgcaaaaattttaaaattggacggccaaaactatttttatgcaaaatatcttctagaaaaacaggatattaagagcaactatctggtatatgcacctttttgcaagcctggacctcgagaaaactggctattagatattttaaaatatagtgatgaattttctactgacaggactactattattatgagaaacttaggagtcaaaaatgaagctttaaaaaatatatttgaacattataaaaagttttttgataataaagaaagatatagactcctcaaatcctacaatatagaatactgcactgaagaatccgttcatatagcaatattgtcagctttgtgcaaacttcccttttccgaccttgatgaggtggtaaaatctcttttaatagagtatgccaaagatgataacacgtattttacggaaatagataagtttggagatattaatactttttgggcgcttatggagaaatactacggatatattttagaggaaaaaactatcgaacaccttagcgcttttttcttgataacagctttgtattatacccttgaagataaaataccagctcactgggaaaagtttatttctcctaaaaaggcggactgttttgtgtttcttagtaactttatgaacaatgctaaggctatggattattttgatatgctttcaataaaagtagaaaaacaattaaatctacgagattatgcagacaaatggcatattgataattatgtggtaagtgatgtatttaaaatttttgatgagactattataaataagttaattgaaaatttaatttctgatgccggtgagtttgaaagatatacagatattattttgcagcggagaacaaaacattggtatagaaagtatgaaaatgactataactgtgtttactgggccctagttatgcttgattcatggagaaagattaaggatgatataaaagaagataaaccatatgatttatttcaaaaatatgcgggtcaatattacattatagatatggcttatagaaaattcatatatttctttgataaactacctaataaagaaccgttttttgaattaaaggaaaagatagaaaatacctatgtaaacgggtatttgaaccaactgtcgataaaatggagcgatagcttggagactttagagcaaaactggaaaatttctcctttggagttgcagcaggatttctatataaatcacgtaaaaccttatgaagataaggacgagagggtatttgtaattatttctgatggtttaagatatgaggcggctaaggagttagaagaggatttgaatactgaaaggaagggctcaacaaagattactcctatgcttggcatacttccttcctataccgcccttggcatggctgccttgcttccacataatgaaatcaaaataaatgataaatttcaggtaattgtggacgggcttagttctgatggaacagagaaccgaagtaagattcttcagaaggcgcaaaaagacagtattgctgttgggtatgaacagctcagtggcatgaaaagggatgatttcagaaaactttttggcggcaaaaaggtagtatatatatatcataacagcattgatgctagaggagataacgcccttactgaaaacgaggttttcaatgctgtcgaagatacttttggcgagcttaaagctctaatcaatgatttgataaataatgtttcagcaaccaatatatatattactgccgatcatggttttatatataaacgaggaaatatacaagaaagtgataaggtatccaaggaatctttagaggattcattacaaaatcggcgttttattcttactgaagaagatgtagattttaatggcactcttacttttaatatgagtcatattgaagatacaaagttaaagtgtatagtgccacggggtgtaagcaggttcaaagtccaggggaaaggagctaattatgttcatggtggtgcggcactccaggaagtggttatacctgttattaaattcaaacatgagagaggcaaaaccgcaaaagaagtcaaaaaagttgatgttaagcttactagtatatctaggaagataacaaataatattacctatcttgagtttttccaagtggaaaaaattcaggacaagactgtgccaaggagactttcagtttatcttgcagatgaagaggggaacagggtatcaaacgagaatataataatagccgacagcacatcagataaccccgaagataggacctttagggaaaagttcgtactcaagagtatgaaatatgataaaagtagtaaatattatctggttctagaggatgaagaggaaaccgttgaaaggatatatgagaagattccgttcattattgatattgcatttatgaatgattttggtttttaa

SEQ ID NO: 1286 - DNA, 2619 bp, Thauera sp.
gtgagtcaccaacgcatcatcgacgccctcgaggcgcagttcgtagcccatcagctgctgttctgggacgacccggaaggcgagttcgctgcctgggtcgatggcctgagcctggaaggggtgcaggtgctacggctcgaccgcacgccgtcactgcaggtaaagctcgacgtcgagcgctcgccgggcacgcgctggctgttctaccggcctgcagccgaacccgatccggcgaaggactggctcctcgatctacgcctgcgcggaagggcgttccgtgcggactcgaactccatgctgctggacgatctgggcctgacgagccaggccctgcgtccgcatctgaaggcgcgcagcaagttcctgcgggccaaggatcgcgtggaaaagctgcgccggctggtgacgccgagtgatgacgccgaggcgctggaccgcaagatgctggcggtgctggtgcgctcggagcaggcggatttccagaccattcttcttcgcctgttgagttcgatggtgcatgagggcgaggcagatttggcggccgagccgcgtgcgtggcaggacatcgtcgccaatgagctggactcggccttctgggcgcttgcactgcagacgctggggtatggcgcggatggcgtggcaccggcctttaccctgcgggatctgctgtaccgaatcctggtgacggatttctgccgctcgctctctggcgcggcgccggagtcgctgcggcattttgtgttgccggatcgcacgctggcggccaacgcgtcggtgtttgcagcgcggtggcggactgatatggccgcctatgagagctacaacctgctgtcggacgcggtggccggcgagatcggcctggatggggtgctgagcgtgttgcccggcgaggccttggcagagaccatgacctttgcggtcgtcgagcgacggatcctgaaggacttgaaggatcgtgtgctggccggcgcaggggcgagcgatgaggccatgcaggcgctgatcgcccgtcggcgagatggtcactgggcgagccggctgatggcgcagagctcgagtgagagccgggcgctggcggcgtgctacgacgcgatggaggctggggcggctttcttcgagctgaaggcgcgcttcgatgcgggtttcagctttgccaacgccgaggcggcgctgatggcctatcaggcagagctgttccgcttcgaccagctgtatcggcatttccatgaggcggcggagaaggtcgagccgatgggctgggcggtgctgcatgaactgcgcgttcgaatcgaggaaacctacacggggtggttcctgccgcagtttggtaccgcctgggcgagagtgatcgagggcgagggcggcttgctgagtcaatggacggccgccgggatgccgaaccagcatcgcttcttcgacatccaggtagcgcccctgctggcggccggtgcgaagcgggtgttcgtggtgatctcggatgccttccgttacgaggccgccgaggaactggtgcagcagctcaacagcaagagccggttcaaggcggggctgtcttcgcagctgggtgtgctgccgagctacaccacgctggggatggcggcgctgctgccgcatcacagtctggcctacaaggccaacagcaatctcgatgtgctggccgatgggcagccagtgtcgacgctggagcagcgcaacgcgcacttggcgaagtatgagggcttggcgatcaaggccgacgagctgctggccttggggaaggacaagggtagggcgctggtgcgcgatcggcgggtgatctacgtgtatcacgaccacatcgatgccctgggcgacaagcaggccacagaggggatgacgttccgcgctgtggacgaggcactggctcagctttcgcagctggtgagcttcatcatcaacagcttgaatggctcgacggtgctggtcactgcagaccacggctttatctaccaggaggcgccgctgctggcggcggacaagtcggcgcttgaaacacagcccgagggcaccttgaaggcgaagaagcgctacctgctcgggcgcggcatcggcacgtcacccaaggcatggtgtggcaacactgcgctgacggcgggcacggatccggaggccagcctggacttctgggtgccgaagggtgcgagccgcttccactttgccggtggggcgcgcttcgtgcacggcagtgcgatgccgcaggagatcttggtgccggtgatcacggtgcgcgagagcgagtccgacaaggagaaggcgcgctacgtggagttcagcctgctcggcgcgtcgaacaaagtcgtcaccaacacccagcgcttcgagttcatccagaccgaggctgtctccgacaaagtgctgccgcgtacggtggtgatcgcgctaagcgatggcgaacggccgatcagtaacgagcagacgctcaccttcgatagcgcctcgcagctgctcgacgagcgcaagaaatcggtgttcctgaccgtgctcgccggcacctacgacaagacgcgcgattactggctgaccgcgcgagatgtcacgaccaaggtcgaggtgttgcgcgtgccgctgcgtgttgatctcgccttcacgaatgacttctga

SEQ ID NO: 1287 - DNA, 2355 bp, Thermacetogenium phaeum
atgtcgaatagaacaagtgaaatgtcggcgaatacccttctagaagccgtgcgccggtctttgcttcgagccgctcggtatgatccgggtacccttgtcccgccggcagcgattctctggaccgatgccgacggccaatggcagcctctggtatcccaattgcgccatcttatgccggagcttttgaccctgggagattataatccgggagaaaaaaccggcccggcagtttggttgcggtgtgtcattgaacggatgctaccggaattagagctgccggagaatgtcatccccatcatatacctgccgaacgttggccggcagatactccgggccggtgaggagtgtccgaacggcctcaagccgctggtggagctgcagtatcgcgggacggtttggacgcagcgcaacggcaaagactggacagttgaggcgtttcttgtttctgaagaggggctgggtctggatgttgctaaagacaagcagacccgccaggcgatgcttcgggcactgccgcaattggccatcacccctgtttcgcgcttgcgaggcaaacgcctggagtccgaggactttgataagttgattgttgctgatacatcccgggatttgctgttatggctgaacgacccggttcaggtgcgtgagaaatgggggaatgagaagtgggaagcattttgttcccgttgcaaggccgagtatggtttcgacccggaaggggagggcgagcttgtcgcagctgaaaaactggggttgcgggaaaaagaagagtggaaggctttatgggaaagatatgccgaatcggcggcaatttacccgggcattcctgaaatcttgcggcgcgccaaaccggcaaggttgatatttgacagggagccctggccggacgaaaacgagaaggatgaaaatttgctgagacgaagccttttggaattggaaggattgtctccggctgctgccaggcaaaagatcgaggagctcgaggaaaaacacggcatgcgtagggagtgggtttgggcgcggttgggacagagcccgttagccgaggctttaaaacacctcgtaaccctggcccgaagaacatctcaaggccttggaggcggctcgcccaaggcaatggccgatctgtatacagagagtgggtatctggccgatgatgccgtgttgagggcaataggcagcgtgaaatcagcagatgatgccagggcgatccaggctgctgttcgcagcatttacctcccctggctggatgatgcagcccggcattaccaagatttgattacgacctttccttttccggacgccatcggcaaagaccaggccttagtggccgccgaccccgggcagtgtttgctctttgtggacggacttcggttcgacatcgcccggcgaatggttgcgatggccgaggaaagacagctccaggtaaatgtagactggcgctgggcgggactgcccacggtaactgcaacgtgcaaaccggcagtctctcctctcgcaggaaagctttccggcgacctgcccggcgatgaatttgtaccggaggtcggtgagaccaaccttcccctaactaccgaccggtttcgcaagctcttagcggaagcaggctatcaggtgtttaattcctttgaaacgggccacccgggtgagcgtggagcacgtgggtggacggaatttggcgaatttgacagattgggtcataccttgcaaagcaggctcgctgcccgcattgatgaacagctggagctggttctggagcgagtccaggatttgttggaggccggctggaagcaggtacgcattgtcacagaccatgggtggcttttggttccgggtgggctgccggccatgaagctacccaaatacctcaccgaaagccgctggacgagatgcgccgccatcagacagggaacctgcgttgatgtgccgactgccggatggtattggaatgcctgtcagtactttgcctttgcacctggggtctattgtttcgtcaaaggtaatgagtatgcccacggaggtgtcagccttcaggagtgccttatccctgacctgacctttaattcgttcgagctgccttcggtagctgttagtataagggaaattcaatggttggggatgcgttgccgcgttgcagtcgacgccgttagcagcgaagtcatggccgacctgcgaacaaaacccaatgatccgaattccagcattactacgcccaagcagattgattccaccggacgggtaggacttcttgtggcggatgattccctggaaggaactacggtcagtcttgtcctgctcgacccatcaggacgcgtgcttgcaaagcaggcaaccaccgttggaggtgaggattaa

SEQ ID NO: 1288 - DNA, 2562 bp, Thermoanaerobacterium thermosaccharolyticum
atggatttagctcagataaaaacgcttcttgaagatacgtttagtaaggaattaagcgaaggcaagaaacgccatatcgttttctggtatgacgatgatggggaattcaaggaagatatagatgaactaaatcttgaaaatgcaaagataattaaattaagtaaaaacaattatttttatgttaagtatcaattggagaaggtggatacaaattccaactaccttatctatgctccctttgagaaaccgtccccaaaagagaactacttattggatgtattaaaatatagtatggaattttctaccgacaaggctgctgtcatcatgagagacttgaatatttcagatgatagtttaaaaatcgtgtttagaaaatatataaaattctttaacaacaaagacagatataagatttttaaaggatatgaaatagaaaggtatacagaggaaacagtggatgtggctgttctgtcggcattgtgcagactgccttatccagattttgatgaatgtttaagagtacttttgatggaagaagatttaaaaaacaacaagtacatcgaggctatcgaaaagtttggaagattagacgtactgtggaaacttgctgataagtactatggatataatgataaggaacctaccctcgaaaaactggccgtattcatgctggttacaaatgttgcatattcccttaatggtgaaatacctgaaacatggagaaaatatgtttcttcaagaaaggctgactgtgtggtattcttgagcaacttcatgaaccactctctttactccgctttctatgacaggttggcaaacagtatggaagagaaactgaaagtacgtgaatatattgataactgggagatggaggactatatcaactgtgatactttcaaagcctttgacgaagcaatcataaagaaaattaaagagcaactgcttatcagtataggagaatttgaaaggtacagagatattattcaggccaggaggacaaagcactggtataatttgtttaaatctgagtatgagtgtatttactgggctatcgagttatttgactgctggaagaatataagccagaacatgcgacagtatactcctttagaatttattgaaagatatacagagcagtattatagactggatactgcctacagaaaattctatgcttctttcgataggatacaaaacaaggaattgttgatggaattaaaggagaaggttgagaatacctatgtcaacggatacctgaacatactttccatcaagtggtctgatagcctagaaactttaaatgggaactggaaaattcctggcatggttatgcagaaagatttttatagtacctacataaaaccatttgaaagccgtggtgaaagagtatttgttgttatttcagatgcgctccgttatgaggctgccagggagttttgcgatatgctcaataaagaaaggaaagggtcttgtgatattgtattcatgcagggcagtataccatccagtactaacattggcatggcagcccttttaccccataaggccattacaatagatgaggattataaggtatatgtggacggtatatcttcagagggaacggataacagaaacaaaattctaaataattacagtcaggaatccatagcaatacagtatgaggatgtaattgagatgaagcgggatgacttccgcaaaaccttcggaggaaaagatttaatctatatttaccacaacaccatcgatgccagaggtgaccatgctcagaccgaaagggaagtttttgatgcggtagaagaagcctttgaagaattaaaggtgctgataaataatcttgtaaataatgttacggcaaccaatatcattattacagccgaccacggatttatatataaacgtggagatcttatagaaagtgataaggtggcaaaaggttctatcgaagatgcctatgaaaatagacggtttgtattgagtacaaagcctttggagctggaaggaaccttaacctttagcatggagtacttacttggacccgataccaaccttaactttataactccaagaggagtaaacaggtttaaagtgcagggtgctggggccaactatgtacatggtggtacatccctgcaggagattattattcctgtagtcatatttaagaatgacaggagcaagagcagtaaaaatgaagtgaagaaagttgatgtaaaactcacaagcattacgaggaaaataaccaacactatatcgtatttggaattcttccagaccgagaaaatagaggataagcgtataccattgaggcttaaagtgtactttgtagatgaggatggtaaccgcatatccaatgaaaatataattattgccgatagcaagtctgaaacttatgaggacagaagtttcagggagaaatttgtattaaagaacagaaagtatgataaaaccaagaaatattatcttattatggaagatgaagaggaaacggtagaaaagatatatgataagataccgtttattatagatatagcaatatccaatgatgactttgggttttaa

SEQ ID NO: 1289 - DNA, 2883 bp, Thiocystis violascens
atgacgatcgatctcggccctgtttccaaaacgctcgaagccgaggtacgcacctgggtgcgtcgaaacggcaccgtcgtctggctcgatctggacaaccactactcgggtttcgtcgaccggctcgcggcccggcgtgacgcaggtgagctgccctacgaggtacgcgccttccgcggcagtcatctggcgttgatcttggcgcccgaggaagtatccgtaggcgtcgatcgacttcctctgttgttacacctgccaggcttcaacgaggagaccgtacgtgagacgccgctctacgaactctatgtcgccgggtcgcgctatcgcaaggcactcgacaccctgatcacggaggcggcggccggccaggtgacgcctgagcagattgcggccttcaggacgcagccggagacgacgcttgagggagcggacgtctggctggcagcgctgctcgacgagagttcgaacgagctcgtcaccctgttgcgctcgctgcagccgacagcggtgctcgacgatctccttgggggtggcttcatcgccggtcagctgggccagccggaagcggaatccgcgctctgggagcagatccgggtctggactggctggccgtccacctggcgcgaaacggcgctgccgtcggttgcgtcgcgggcgcgtctgagcgccgaggaggttgcctttgccgctgcggcctgggcgctctgcgtcgagtacgtccatgatctcaagcggccgcctgtcagcgcggtactcgccggtgcgatcgatctgccaccgagtttgaccgagacctgtcggacgctggcaacccatctgcgcgcgcgtcatccgggcttttatcagcgctgtgccgatgagaccgaggctttgctggcggaagaggtggagaccgcgaaggcggaggacctcgggcgaatcgacaccttccgattcgaggaagacagggtactgaaagccgcattcgctgccctgcaatcctcggactggatgcgcgcgttggagtgggcggatctgcggatcggagcgaagtcgaagcagccctccttctgggtgcgcgatgacctggcgcgaacctcggcttggcaactggtgctggccgccgcccagctgggacaagcgatcgcgcaagcaggaacgctcggcgctgtcggggatctcgtcaccgccatcagtgcctacaccgagcgcggagcggcggtggatcaaacgcaccggcatttggagcagcgacgcgtggccctgctctatccacaacttcctgagttcgagagtctgcgttcctgtctcgatcgtttgcgggggcattggcgttcctgggcggacgcttgggcgcgagatttcaacgcccgctgccgcgctcatggatttctgccggaagcagggttgcagcagcgacatctgttcgacgagcaggtcaggccgctgaccggggaatctggcaccacggcctattttctcattgatgctttccgttatgagatggccgatgagctttatcgccagctagtggatacaccggcgacgacggtcaccctgaagccctgtctggcggagttgccaacctgtaccgaagtcggcatgaaccttttggcaccagtcgcgacgcgcggacgcgtgagtccggtactctcaactgaggggggcggggggcgcgtgctgggattcactcgcggagagtttcgcgtgacggatcccgccacccgtcaaagggccatccatgatcgggttggcggtggaacctgtccctggctgacgttggacgaggtggtgacccgcgatcctgtttcgctcaagcgggcgattgcccaggcgagactggtggtcgtgcatagccaggagatcgatgatgccggggaaaagggcgtcggtccggccgtgttcgagcatgtcatgcagaagctgcgcgccggatggcgcctcctgcgcgatgcgggggtgcgccgcttcgttctgacggcggatcacggcttcctgctcctcgatccacaggccgctgccgtgcagacacacgggcgtcggatcgatccagggcgtcggcatgtcttttccccggccgcggcggatcacccgggcgaggtcagggtggcgctggccgagctggggtatgagggtgtggcagggcatctgatgttccccgagagcaccgccttgttcgataccggacgacctcgcaggggctttgcgcacggcggcaacagtctccaggagcgtgtcatcccggtgctcacgctggtgcatcgggcggccgcgggtggcagcgcacagcgctatgtcgtctggggtgagcggcgcgaaggtgtggcaggcatgcactgtgtcgcggtgcggatcgaggccgccgtccagtgcgagctcgacttcggcagtccgcgcgagctcgagttggccttgcgcgtgcctgaggcggcggatgttcaggttgagctgtgccagacgcgtggtccggcacgcctggtcggtggcggcgtgcgggcgcaggtcggtgcacccttcgagctgttcttccgcctgtccggatcctctgacgcccgggtgttgatcgagctgtatcatccgggtgccgcagcggatgtcgaatccggcatgccagaggcgcgcttcgctgtggccgcagcgggaatgagcggcacgccatcattgagagatccagcgggcacgcccgatgtctggctcgagcggctgcctgagggcggtgtccgccaactctttgcgcacctggcacagcatggtgtcgtgaccgagagcgaggcggccagcatgctgggcgggcagcggggtttgcggcgcttttcgctagaattcgagtccttcgcggtcaaggtcccctttgcggtgcgcatcgatttgatcggaggggtgaagcgctatgttcgcgattga

SEQ ID NO: 1290 - DNA, 2556 bp, Thioflavicoccus mobilis
atgaaaatcagggactacatccaagaccagctccgcgagcgcctcgccgcggccgagtgcctggtcctctacgatgcgcaggggcgctatcgcgagctggccctcggcctggccgggccggactgcaccgtggtcgatacctcggagagcagcatccagggcagggccgaggcgatggcggcctggctcgccttgggggacgcggccccagggtcgcggcaactgctggtctacgtcccgcgcaagaagccgctggcagatcgcgagtgtcaggcagacccctttcagaccttcgcccttggcggtgacacctttcctcggggcgagggggacagctacctgtcgctctgtcttcaggcgatgccggaccacgaggccagcgtctacgccctgttcgagggcggggcgccgccgaccttcgagacggtggacgccctggactccggcgcgacctggccgaagctgaggaccctgttggaggtcgagtcgccgcgggagatcctggtggggctgctctcgccgacggatcgtcagggccccgcgctacaggccgatcagggatggctcggcgagtatcgggagttcgcgcaggcggccctggggctcagttcccacatcaaggtcggcggctgggcggacgtccgcgaggagttggcccgtttcgttctgttcagcgagtttgtgctcgatctccccggggacccgcccggcaatcttccgtctgcgctcgcagcggtgccgcgggcggacccgcatcgccggcccctgatctacgcggtctgcgactacttgcgcgatgcccgaacacaccaggatgtctacatcgagctggccaacgctgtgagtcgtgagctgaatctcccggtgcagatggcacagacccaagaatttgggtcccgggacaccttcctgttcgaggagcgggcctatctgaagcgctgcggtgtcgccgcgggcggtggcgatctggacacggcgcggaccatcgtcgagcagcggcgccgctcgatctgggctcagtccgaggagcgcggcgcggcctgggtcatcgccgatcgtggcctggagatgctccaagcggtgatcgacctggaggcggagttgggcggactgaagaaggggctcgccgcactcgtcgatttctacgccgaccgcgctcggcttgccgacagcctgcatcgcagcttcgagcgcaccgtccacgatgcctatggccagacggaggggctggaagacctgatcgagtcggcgcggcaccgtcatcgcgccttcagcgatgccttgcagaagcgcttcatgcaggcggtgcgagaggaggggtggccggtctcgggcttcacccgacacactcaggtgttcgaccagttcgtggccccggtattggcggagcagcggcgcatcgctctgctcatggtcgacgcgctgcgctatgagctggcggcagagctggcgaccaggctcccgcaggggatgaaggcccgattggacaaggcgctggggcagatcccgaccatcacctcggtcggcatggccgccttgctgccgggcgccgacggcaagctggcgctggtcagagaaaatggcgagctggtgcccaccatcggttccaagcgcgtgaacggccccaccgagcgggtcgactacgtgcgtgggatctatggtgatcgtgtcgccgccgtctcgctcgacgacctgctgaaggcgccgcgctatcggcccaagctcaaggagaccgtccatctgctcctggtgaagacgaccgagatcgatacggccggggagaacatgtccggcgcggccttgggcgtcatgcagggggtcctggagaagtttctccgggcggtgaagatcctcggagagatgggcttcgagcgggcggtcttcgccgccgaccatggcttcgtgctcctcggcgagcagctccctggggacaaggtcgagaagccccagggggagtggaccctgtcgaaggttcgctgcctgatgggatcaggctcgggatcgggctcgggggcccccgccaagggggttgcgtgccttcgcaaagaggatctcggagtgcgcggggatctcacccacctggcggtgcccgaaagcctgggcgccttcgtcaccggacagaccttcatgcacagcggggtctcgctgcccgagtgtctggtgccggtggtgaccgtggatcttgccgctgagaccccggccggccgttccgccgcgcggcttcagctccagtaccggggcggcaagacggatcgaatcaccacgcgccggccgatgatcgaggtcgtgctgttcctccagcaggatctcttcggcgccgagaccttgcgcttcagcctggaggcgaaggccggcaagcgactggtcggccaggtggccgcaagtgccaatgtcgacccggccaccggcctggtggtcatcgagcccggggctgcggtgaagatccccctgcggatggacgaaaaattcgagggcgatttcaccgtggtcgcgatcgatccggtgacccaggtgacctacgacaccttgaagttgaagaccgattacctggactag

SEQ ID NO: 1291 - DNA, 2658 bp, Vibrio cholerae
atgcagattagtgaactggcacaaggcgttgctgccaaacttgaacaaagccgcattgtgttttggtacgacccagagcaaagctttactgaagagcttgagcatttagctaacgccctatctattgcaaaagaagtaggcgatagcgcggcagatataactgccagagttctgccaaatgatttgaccatcctcaatatgggtaatgagtctgtattagcagtgaaaaaacgcattgaagtagatgagcgtgaagctaaattccttatctattttccaagcgctgagccagagcctgaccgcgattggttgctagacgtgcgtttgtatagtgagcagttttttgctgatcacagctcaatgctgcttaatgagctgggtatccctaaaatggcgctacgcacgcacattcgtaagcgccagagcttttttgccaataaacagcgcatagccggtttaaaaaagtgggtgactgagaacgaagacgaactgtcgttagacaggaagatgatggcagtggttgtaaaagctgattctgcgtctttgtcggacattctgcttgggttactacgcgaatatgcggcttatatcgaagatgaaagccttggccaacctttatggagccagctaggaaagtttgatcttgagacctcactctgggcatatctgagtgagggttttggctatacagtcgaagagccaaccttctcagacttcgtgttgaaattattctgtactgaattctggagccaaattgaaggtgttgaacgcgattggttgcttaacaatgttctaaaaagcgcatcaggccgggcgacagccttggcgtttatggtgagctggcgcgacagccgctctttcgccgcttactacgaaagcatctctaaggtgcttagccaacagttggaaatttcgactcgtgctggccagtaccatccggttgagcttatcgaatgcgaaacgttcgaagctgtggaacaggccataatccgtggtttagttcgtgatttgctcgatagcagtaaagcgctagaccgggttcagtttgatacggtcttatcaagacgtcttgctagccactggacattgtcacgcaaagaatacttcgcaatttatgaagctatccgcaacgctgaggagttaatgcacttgcgaaatcgctatgtggacgggttccactttgataacgctaaagcaatgtacgacgcctataccacagacatttatcgttttgaccaggcttaccgtttgttcaatgagcatgtgcactctgtattgagtaaaggtgcagacatactgcgtcagctcgacgacgaagtcgaaagcatttataccaactggtacttatatgagcttggccttgcctgggatcgtcacttggccaatgagaaattacttgaaaagtggcagatttctggcgtaccgcaccagtatgacttctatgaaaaagaagttcgcacacgactgagtctgaaacagacaaaacgagtgtttgtgatcatctctgatgccctgcgttttgaaattgcgaatgagcttggcgctatcattaacaacgagaagcgatttaaggctgaggtgtctacgcagttgggcgttttgccgagttatacccaacttgggatggcggcattattgcctcataaggcgctcagttaccagccagagcaaggcacggctgtttatgtggatggtatttcttcacagggtttagacaatcgtaactccatcctacagaaggttggtggtatggcggtgagttctaaagaactgatgagctggagtaaccaggaggggcgtgacaaggttcgagacgtagaagtagtttatatctatcacgataccattgatgcgattggtgataaggctgcaactgaagagaaaacgtttgaagcctgtcgtagtgccattgaagagctaaaagatctcgttgggcgggtcatcaaccgtctaaacggcagccgagttgtgatcaccgctgaccatggcttcctcttccaacaaaaagcacttgtagcggctgacaaaacctcgttgaaaaccaaacctgctggcgcgatagaagccaagaaacgttatatcgttggtaataacttgccttcagatgaagcctgttggaaaggctcaataaacgatacggctcatggctctagtgataccgagttcctgcttccaaaagcggctcaacgcttccactttgttggtggtgctaagtttgtgcatggcggagcgatgctacaggaagtatgcgtcccggtactgcatgtgcgagagctgcaaaaagaacaagcagcaaaacatgagaaacaaccggtaggtgttgttgcagccactcagcccatcaaattagtaaacaatatcgacaaggtcagatttattcagacagaccctgtaggcgagcgttttgtcgcacggttgttggatgtctatatcgtcgatgcacaaggtaatgaagtatccagtcgtgaaacgattaactttgatagcgtgagtaaagttatggatgagcgtactcgcgaagctaggttaaagcttattggctctcagttcgacaggaacgctcaatacacattagttcttgagaatgcggaaatgagaacgcgctatagccaatatgcggtaaccattgatttggcattccaagatgattttttctaa

SEQ ID NO: 1292 - DNA, 2304 bp, Vibrio cholerae
atgattgatacctggtttaaagaggatttagcgcgcatcttggaacagcaccctgtggccatatttattgatgaaagcggtgaggcggagtttctattgaagagcttaaaacgagattgtgatgtgtatcgcaccaatggagaactcgaagagttggaagcgaaatatcgcgttgaaaaggccttacaagagcatcctaaatctgagcacaagtacgttatctatacgcaactcagcaaagaagacttaaccttcgtacgcgagtactgtgagaccaatggttgcatcgaaattcgttatttgcagaactacatcaaagataaagttcaccggaccttaaacttaaatattaacttgccgaaagacgagttgatcgctgctgcaaaagtgagtgtgggtaaggatcgtacctactggatggacttaagccacaaaggggcctctgaaatctttgatttagacaaggaactgctgccctttgttcatgatcccgaaaactatgtcactgaaaaatacgacgcacagttgcgtgaaaccttttaccgcaaggttaatgagctgctaggccaagaatatatcgataaacctgcatctaccctggcgtctgaagttgtatctgcgatgttaaagggcttggcggataatgactgtgataaaacgttgttatcagtttacaacagttggcttgattcggtgagttatcgcaattcatttggctcatacctcaccaaacataagttggattcagcgtttattaacagcagtgctatctggcaggtcaatcccgaccacccatttaggcaggtggatgaagcttggttaaaggaattaggcaataaactggctaataaatctttgtctaaagtagagtcagcacaactagttgctaggctgaaacaacgccatcaaagcaaacaggcacaagcgctgggcattgtgttttggaacgacattattgctttgctcgaatttgatccgaaggatatgtcctatttaagcagctttgctgaatgtgttgaattttacaaaaagcatttctgcccgcttgatactgccatacgtaatttgtacaccgaatttatgcaacaacgtgacagccttgagcctttccaagagctttacaaagagtacgttacgctgtttttagataagtggttccagtatttcagtcagtaccgggaagatcaaactggcattttacaagccattattgaccgcgatatccaaattgatcgcccaggaaagaacagcaaaatagccgtgattgtaggcgatggcgtagcctatgagattgcagagcaggttgctatcaaggttaagcagcttagtaaccatagtacacttactcgccgtcatattttggctgattgtccatccgaaactgaaaacaacatgagtcatatctacatggcaaatggtgtggttgagcccgttcaaaacaagcgagaaaagtatctttcagcccaaaattcacacattgatatcgattacattcgtcttgatgaggtaagtgatcagcctctttcgggtcaggtgctaatttgtacctataaagatattgatgacatgggtgataagctcaatcacaaggcgctgaaatatttcccagaatctatcgatttttttgctgaaaagattaatcagttgctcaatatcggctatggaaaagtgtatttaatcaccgaccatggtttcgtgttgactggcttgctaagcgaagctgataaaatagtggttaagccttcagggcaaaactacattgacgaacgctttatctggaccagtgacaagcaagaaagtttaatccctcagtttattgaggtggcaaagtcctacaaagattacaactatctttacttcgcccgcagcatgaacccgttcaaaacccctggcacttatggctttgcgcatggcggtttagcacctcaggagttggtgacgccttatttttgttgggagcaagaaagtgatgttatgggagagctgcctgtaactattgcgaacaagcatgacttggtcagtgtaactggagagctgtaccagctaaaactgcgggctgaatcgggtgaaggaaatatgttcacgctagaccgtaaagtgatgttgttgttctttgctaacaaagcccaagtgaacaagagcgatgttattaccgtgcagagtaatggtcaggttactaaagagtacacctttgatggtcataatgagatagaggtgcaactggtagacgcgatgacaaagcagcagcttgaccgtgttcttattaaaaagaataacgaccgcgaccttggcggattattttaa

SEQ ID NO: 1293 - DNA, 2508 bp, Zymomonas mobilis
atgactgaccgcatcaccgccggcctgatgcgcctttatgaggatcaggggcaccgcatcgtcttctggtatgacgccgcccgtgatctccgcggggcgttcgatgcggtggacctgcccggcgtcaccaaactggagatcgccaacaacgaattcggcctgaaataccgcatgctccggcaggagccgaagggacggttcctgctctataaagacggccctgagccaccgatgcctgagaactggctgctggatgtacaactggccagcgccatctttcgcgccgatcaggcagctatctgggtcgcggatctcggcattccggcgaaatacgaagccgccgtgcgcgatcacgccgaattctaccgttccggcaaacggttggaagcgctgcgcgcgatcgagcgcgagcggccttcccaaagcgccaatgatgtccgccgcaagatgctggcagtctgcgctggtgcggatggcgatctcgatacggtgatcgaggcgttgctggccgaactggccgaaggctgtgatgacgcgctgaagctgatggatcgggtcgggctgacagagttcttctggaaaaacgtggccgcgcgttatggctatgcggcggatgcgccggattttcaggatttcgccatcacgctgttttccagcgcctgggcgcgggccatgggagaagctgcccccctgaacaccgatgccgcgctgatgttccgccgctggagcgcctcgcgccggtggggtgaagcgtttgagaagctgtcgggcgattatcaggacgtgctgaagatcagggacaatctggcctcccgcgattttcgcaccctcatgccgcatgatcacttcgaggaagtggaccggaggatcgttgtcgccatcgttgaggggctggcccgccagagcctgtcggcgacagatgtgctgaaatgggtgcgtgatcgccgccagagccactggtatggccgttacgccgatgtctatcaggccatcggctatgctacggagttccagcaggccctggccgaagctgatctgacgatgaccagcctgtccgatggcgtgaagcgctattccgcaagctggttccggctggaccagctctaccgcaagttcatctatcacatgcagaaaagcgggcagtcggggctgctctccgccctctatgaagcggtcgagaaccgctacaccacgaatttcgtgctgaagctgaacgacgcctggcaggatcaggttgcccgcctgacggactgggcgattccgggctttccgcgtcagatggatttctaccgcgaacaggccgcagagttcaggcgcaaggaccagaaggtcgtggtcatcatctcggacgcgctgcgctacgaggtggccgaagaggcgctgcgcgagatccgcaagctcaaccggtttgatgccgatttgaagccgatgattggggccttgcccagctatacccagctcggaatggcggcgctcttgccgcaccggcaactgacgatccgggatgacaatgatctggtgcttctggacggcgaaagcaccatgggtgccgccgctcgtgaaaaggcgctggctgctggccgggctggagaccgggtaaaggttctggcggcgaaggatttcatgaaccttggatcgtcagagggcaaagacctcttccgggatcatgacatcctctatctctaccacaaccagattgacgcgattggcgacaagctcgccaccgaagagaatgttcccgcagcggcagagaccgccatcgaggatctggtgaagctggtgcgcaagctgacctcggccaatttctcgaacatcctgatcaccgccgaccacggattcctgtggcagcaccgggcgttggaagagagcggttttgcgctgagtgagccggaaggcgacatcgttacacgcaaccggcgctatgtgatcggacagggcctcagcagcagcggtggcatgaagaagttcacggcctcgcagcttgggctggggggtgatcaggacatcctgatcccgaactcgatcaaccgcctgcgcgtgaagggatcaggaagccgctttgtccatggcggggcaagcctacaggaggtcgtcctgccagtcctgcgtgtgggcaagcagcgcaaggaggatgtcgggcaggtatcggtgcagatcattccgccaccccgtgcccagatcaccacgggccagatccagatcactttctatcaggcggagccagttaccgagaagcagcagccccggcaggtgcatgcagccatctttgcggacgatggaacactcatctctgacgaagccgagctggagttcgatttcgcgtccgagaacccgcgcgagcgtgagctatcgcggggcttcctgctgaccaaggcggcagacgcctataacaatcagacagtcttcctgaagctgcgaacgcgcatcggcaagaccagccatttcgaagatcacgcttcgcagccgctgctgctgaaacgcgggatcagcacagatttcgatttctga

SEQ ID NO: 1294 - DNA, 2583 bp, Magnetospirillum magneticum
atggataagattatcgacgcactttcatcgctttacggtgaaggcaatcgcatcgtgttttggaacgaccccgaccgggagttcgaggaatccctttcctcgctcggtctagacggggtgaccctcctgcgtgccgatcagatgcctgggcttgaagccaaaattcggatggagcgggaacagcccgagagccggttcctggtctattcggcgacccatgtaccgctgccgtccgaggactggctcttggatatccgcctatacagccggaccttccgggctgatcgggcttcgatcattcttggtgaattgggcctgcaagaacaatccctgcattcacatctccaggcccgtgccaaattccttggcagcaaggaccgtctgacaagattgaagaagctggttcagccgacagattcgatccgtgatctggaccgcaagatgctggcggtggtgaccaaggtcgatcaaccggaatttctcggcattctcaccgctctctaccatgccattcccgactccgacctggatgccctgccacccgcctgggacgagattgaaaagtacgacctatcggaatccttctggtccatggtgcaggggcaatttggatattccgagaattctccgacgctgaagaatctgctgatccgcctgatggtcagcgattttgcccattcgatcacggcggaacttcctgcggccttggctcacctgatgctgcccaggctgttcctatccagtgcatcggtctgcctttcccagtggcgagacagcaattcacgcagcgacagttatgaccggctgtccaagatggtcggcgatgccctgaagatcgacagccttcttccgggaatgaagatcgagccgctgctcgacaacaagaccttccttgtcatcgagaagttcatcgctgtttctctgcgggacagggtgactgcgaccacggccacgatcaatgccgaagctgtaaaggccatcgcgaaacaccgccagaacggctactgggcggatagaaaccgtggagctatcggtgccacccgtgaagcccttcatgccgtctatgacgccctaatcgccgccgctgacctgtttgggctgcggggggagttctcgaacgggttcgactacaattcggctcaggcgatgtttgatggctatgccaccaccctccaccagtttgaccgactgtatcgccatttcatcgaagcagccgacgcggccacggcacaggggtgggaaattctcaagaccctgcgtgacggggttgaagattgctacaccaactggttcctgaccaatgtcagcctgaaatggggcaagttcgtcgaggatgagcttctgaaggaatggcgggttgaaggcgtcatcccccaaccatggttcttccacaaggtcgaagccgctttgatggaatcggatcgtcgagttttcgtcatcatcagcgatgctctgcgatatgaagcggcgaaggaactggtcgatgtcctgaacggcacctatcgcatccaggccgaaattcagccaatgctgggggtgttgccgtcctataccgcactggggatggccgccctgctgccccattccaaaatcagctattccgacaagggcgatgtgctggtggatggtcaatcatcggcagcggggaatcgttcgaacatcctcgccacgaagaagggtgttgcggtcaaagccgatgacctgaaggacatgaagaaggatgccggtcgagaattcgtgaagccctatgaggtcgtctacgtctaccacaacaccattgatgccatcggcgacagcggttcaaccgagggcaagaccttcgaggcggttcggcaggctctgaatgaactttctgatctgatccgcatgatcatgaataatctcaacggcacctacatctacgtgaccgctgaccacgggttcctgttccaggaaacggcactcgatgcaacggacaagaatgccctgaccgacaaaccggcggggacattgatcgcgaagaaacgctaccttcttggccggaacttgcctgattcagccaaggcgtatcatgggtcaaccgcgatcactgctggttccgatggtgacatggaattctgggtgccgaagggaaacaaccggttccattttgtcggtggctctcggttcgttcatggcggtgccatgctgcaagagatcacggttcccctcatccgagttcggcagatcaagggcgatgccaagtccaagacctcggtgaagaacgtcggtgtgatggtcatgacccagagtccaaagatcaccacaaaccgctatcggttcgaactgatgcagaccgagaaggcaaccgacagggttaagcccgcgaccctggacatcgccgtctatgaggatgggcaggccatcaccaacatcgaacgggtcaccttcgacagcacccaggacaacctggatagctggaagaagtctgtctggctgtcgctccagaaacgcagctatgacaagaagggctgctaccatctcattctgcgaaatgccgaagatggcattgaagtgcagcgggttgaagtgagcatcagcatcgctttcatggatgatttctaa

SEQ ID NO: 1295 - DNA, 2517 bp, Marinobacter aquaeolei
atgagccagcaaatcaattatgcgctgagcaggcttttcgataagcaccgcatcgtgttttggtacgacaccaaacaggagctgcgcggtgacttcgaggcggtttctattccggacgtggagaagctggagatcgccaacaacgagtacggcctgaaacatcgcatcctgcgggaggcaccggaacagaaattcttgctgtacaaggagggtccgcaaccggaggatctggataactggttgctggatgtacagctggcccacggcgagttccggaccgaccaggtggccatttggctgtccgaactggagctgggcctggagtttgccgaagtggcccaggcccacgcggagtttttccaggcaatcaaacgcaaggaggcgttgaagaagttgctcaagccggacgacactgccggtcagctgcgtctgaagatgctggccgtctgtgccggtagtgagccccgtatggactccatcgtcgagtatttgcttgacgagagctgtcagttgtcagccgtcagtgatcagttgggtgaaaaattcaggctgattcagcgctgtaatctcgatgcgtttttctgggagcagatgacaaggctttatggctatatcagcgatacgccaagcattcgagactttgtgatccagctgttcaaagacagttactatcagaattttactgaccactgcacactgacagctgacagcttggtcttcctcaaacgctggaaagacagccggcagttcgagcaggggtttgaaaccctgtctgccgagtgtgccgaggtgctgggcattgagcaggatctcgataagcgggacttccgggacctggttgagctggactactttcggctaatcgaccagaagattatcagtgacctggtgcgggcggtggtaggccgcacggtcactagtggcgatgtggcgttgtgggtacggcagcgacgccagggccactggtacggggagttccgccacctttatgaggccattgagtttgcggcccgttttgtccagatgctcggtgaggctcgtctcaccatggaaagcctctcagacggcgtccagcgatacagccgctcctggtaccagctggatcagctctaccgcaagtttacctaccatgtgcgcatgtccggccaggcctcgttgatgggcgagctcagtgagcaggtggagaacctgtattccaacaactacctgctcaagctgggcgatggcttccaggttcacgtggacgccgcgccgcgctgggaggcctatccggtcgttcagcaaaaggcctttttcgagcactgggttcgcccgtacctgcgcaaggacaagcggatctgcgtgatcatttccgacgccatgcgctatgagattggtgacgagctgctgggccttatccggcaggaagatcgctatagcgcggagcttgaaccggctctctcaaccctgcccagctatacacagctaggtatggcggcgctgctgcccaacaagtccctggcaatcgccgacaacgataccggcacggtactggtggatggccaaagctcacagggcacggtcaaccgtaccaaaatcctgcaggccgccttggatggtcggggccaggccgtcaaagcggaggattttatgcagctcaaccgggaagacagccgggagctgctcaaaggtaatgatgtgctgtacatctaccacaaccgcatcgatcacaccggcgacaagatgcattcagaggggcaggcctttgaagcagcggaacaaaccctggatgacctgattcgtctgatcaagaagctcacggcggccaacgccaataacctgctgatcaccgctgatcatggctttatttaccagaaccgtgagctagatgagagtgacttcctgggtgatgtcgtttctggcgatgatattcgctaccgggaccgtcggttcgtgctgggtaaggggctgtccgcctctccggctttccatcacttctcgtcccagcagcttgggctggatggcgatatggaagtgcagattcccaagtccatcaaccggctgcgccttaaaggctctggcagccgctttgtgcatggcggcgcatcccttcaggaagttgtgattccggtcctgaaggtcaacaagaagcgccagagtgatgtcagtgccgttgaagtggacatcctgcgtggggccagctcggtgatcacttccggccaactggccgtcaccttgtatcagtccgggccggttaccgagaaagtacagcctcgtaacctgcgggccgggatttatacccagtcaggggagttgatttcggacagtcacgaactgtcgtttgacctgacctcggagaacccccgcgagcgggagcttcaggtgcgctttgtgctcagccgcaaggcggacgaggccaacggccaggaggtcttcctaaggctggaagaacagcacgccggcacctcccactacaaggaatacaagtcgctcaggtatttgatgcggcggtcctttaccagcgattttgatttctga

SEQ ID NO: 1296 - DNA, 2568 bp, Nostoc punctiforme
atgaacaccattcgtatccaaaacaccctagaaacactcttccaagattcagcccgttggttgcacccaggacgaagggtggtgttttggtacgaccccgaacaacaatttatcagcagcttcaatgaactccaactcgaaggcgtagaaaaactccaactcgctgatactgcctttaccgtcaaatatcacctgctggtcgagcaacccaatcaaacttttctactgtacgccccctttgccgaacctgcgccccaagaaaactggcttctagacatccaaaaaagcggtttaactttctctgcgaaccccgcggccctcatctatgcagatttaggattgcgatcgcgcggtctggaaattgtcatccgggaacatgataaattctttaaaagccgcaaacggacagaagccctacaagcaatgggtatttcccccgatagcgacgaacggggattactcctggctatgctttccgtcctcgcaggcttaaaagtacccgatgcagggacactgattcggcgggtgctgctgggggggttattagagtctgataacgccctctggtctgatattgagcgttttatctccccagaagctttctgggaagtagtccaggaacacacggactttcctaagcaaaaccccagtttaaacaagttattcgtgcagttgctaatcacccattttgctaaatctctgcacgataccatcccgccccagctagcaaaccaagtcatcactcctggacaacgggcttatgcttttatcgaccagtggatgcgcgaccagcaggattctctaggctggaagatcctcagcagtgaggtagcagaacaattacatatatttgatgctatagagaatttagagccggaagttttatttgaagcagccagtttcgaggtggtggataaggtattaatccgcacctgcgttaaaacactgcaaatgcaaatgaggcaacaaataacggaattgacaccctggcgaacttggttacaggcacgtcataccctgatttggttcccccagtatgagaagatttatcaagcattagaagctgcgatcgctctattggaatttaagcaacagtatccagaaggattccgccagccagccccaattctcttcaaagcctacgccagcgatttacactcttttgacaaagcttaccgccactttatcgtcaagagcgatgatgcccaaggggatatcctcaagggtttgattgacgatgtggaaaatttatacacacaatggttcctggatagtctaggagaagcttggtctgatgcccttggcaacaacaactgggaattggagggcatagcatcccaaactagattttttggtaggcacgtattcccaattttagaacggagcgatcgcgaaaaagtatttgtgattatctccgatgctttgcgctatgaagtcgccagcgaactcgaagaggtaataaaaaaagaagttcggggtgaaaccagcctagaggcacaattgggagttttacccagcgtgacacggttgggtatggcagcacttcttccagggtcaaaactagaactgataccaggtgatgatgatgttcgactggatgggcttagtactaaaggagcgtcagcaaggcaaaaggtactaaaccaaaatagtcgggtagaagctacggtacttagtgccaaagacctgctagagatgaatactgacgaaggacgggctgctgtgcaaccttatcgcctaatctacatttatcacaacgtcattgatgcgatcggcgatcaggcatctagcgaacgtcaagtactatcagcttgcggaacagcaattagcgaactgctacggctggtaaagaaaatttgtaattctatcaatggtacaaacgttatcatcaccgcagaccacggttttttataccaacgtcgccttattcaagaagcagacaagcgacccctaccaagtggtgaagtagtactggaaagcaaacgccgctacctgctagcacgagaacagttgaatgactcaaccttactgcactttagcctgccctatacagaaaatggcacagttgcgatcgttccccgtggtagtttacgctttgccgtccaaggtgcaggagcgcagtttgtccacggcggggcatctctccaagaaatctgcgtaccagttatcacctatcatcaccaacgggcggttaaaggagacgaaggcccagcccggaaagtaggggtacaggtaagtgccagagttcggcgggtaacgaataatcgttttacattgacattagtacaaagtgatgcagttgaggggagatggcgatcgcgtcaaattacagttgctttctacgatccccaaactaatataccgataacagatgtgcgaggagcaaacttaagcagcactagccctcatcctagcgatcgggaaattagcttaaggttgaccgtaactactgcaaatccccctactaacgtctatttaatagttaaggatgcagacgatgagagtgaattgctccgagaaacctgggcagttagtttaggaattgctaacgactttggagatttctga

SEQ ID NO: 1297 - DNA, 2508 bp, Rhodobacter sphaeroides
atgagtgaccgcatcgccgccagcctgcggcagctgttcgaggatcagcggatcgttttctggtacgacgccgaccgtgacatgcgggcggagttcgaggctgtcgacctgcccggcgtgaccaagctagagatagcgaacaacgagttcggtctgaagtaccggatcctgcggcaggagcccaagggacagttcctgctgttcaaggacgggcccgagcccgagatggtggacaactggctgctggacctgcagctggcctcggccgttttcaaggcggaccaggcggcgatctggctggccgagctcggcctgccgttgcatttcgaggacgtggtgcgagcgcacatcgagttcttccgtgccaaagcccgcgtcgagtcgctgaagcggctgatgccgacgtcttcctgggacacccagacccagatgcgcctgcgcatgctggcggtctgcgcgggcgccgagggcgggcttgacacggtgatcgaggcgttgctgggcgaattggcccacggccgggacgacgccctgcggctgatggagcgatcggggctgacggacttcttctggaagcaggtcggccaagcctatggctacaaacccgatgagccggacttcgaggacttcgccatcgttctgttccaatcggcctatgcgcgtgttctgggggaggacggggcactgaacgccgaggcgcttctggtcttccgccgctggaagaacaaccgccattgggcggaggcgttccaggccctgtcggcccgatatcaggacctgctgaaaatccccgccgatctggcaaagcgcgatttccgcactttggtgggagtcgatcatttcgaggagatcgatcgccaggtcatccgcgagatcgtccgcgcgatgtcggcccagtctgtcagcgctccagaattgctgaactgggtgcgcgagcgtcggcagagccattggtatccgacctatgcggacatttatcaggccatcggctacgccaccgagttccagcaggcgctggcagaggcgaacctcgggatgaccagccccgccgagggcgtgcaacgctatgtgaccagctggtatcggctggatcagctctaccgcaagttcatctatcacatgcagaagagcggtcaggcatccctgctggccgacctctatgcgtccgtcgagaaccgctacacgaacagctttgtcctggcgctgaacgacgcttggcaggatcagatcgcaggcctcggcgagtggaagatccccggcttcgggtcgcaagccaatttctaccaggagcaggccgccgagtaccggcgcaaggaccagaaggtcgccgtgatcatttcggacgccctccgcttcgaggtgggcgaggaatgcctgcgccggatccgcgctctggatcgcttcgatgccgagcttaagccgatgatcagttcgctgcccagctacacccagctcggcatggcggcgcttttgccgcacagcacgctcgccctggcagaggacggaagcggcgatgtcatctcggacggggagaataccaagggtattgcggctcgagaaaagctgctcgccgcggggcgtaagggcgacagcgcgcgggcgctaaaatccgaagacgtgatgaacatgcgcaccgatgacggaaaggcgctcttccgcgacaatcacatcgtctacgtctaccacaaccgcatcgacgccataggggacaagctgcaaacggaagacaagctgcccgaggcggctgaggatgctatcgaagatctgaccaagctcgtccgcaagctgacttcggccaatttctccaacatcctcatcactgcggatcacgggttcctctatcaacatcgtgctcttgacgagagcgatttcgcgatcgccgatccgcagggcgccgagatcctcttccgcaaccggcgttttgtgattgggcgcggcctcacaccaacatcaggcatgaagcacttcgccgccgcagaactgggcctttcaggtggactggatgtcctgatcccgaattcgatcaaccggatgcgcgtgaagggcgctggcagccgtttcgtacatggcggcgccagcttgcaggaagtggtcatcccggtcatccgggtcggcaaacagcgcgagacggatgtgggccaggtcgacgtgcagatcttcgtcacgggccgcagcctgatctcctcgggccagacagcggtgacgctctatcagactcagcctgtctcggagaagatgcggcctcgggagcttctggcgggaatctatgcgacggacggcacactgatctccgacgagtacaccctgattttcgatttccgctccgacaacgcccgcgagcgggaaatgccgcgcaagttcctcctctcgcgcgaggcagataggttcaacaatcaggacgtcattctgaaactgcgtgaacgggtcggaaagaccagccattaccaagactatgccacccaccgttttcagttgcggcgtggcatgaccaccgactttgatatctga

SEQ ID NO: 1298 - DNA, 2514 bp, Runella slithyformis
atgcccgatataatcactatcaacgacaaagtacaggccgccttggaaaaactattccaacagcatcggctggtattttggtacgatgaccatgccgaaatgaccgacctctttgaaaacctccaactcccggaggtagagaaagtcatcattgccaacaacgagtttaccctaaaatacagactattgatagagcagccccatcaacgttttttgctgtatcaacccaaagaaaagcctgtcgattacgaaaactggctgcttgatttgttgctgtcgcactacgagtttcgtaccgagcccgcttcgctgtaccttcaggaactggaattgccgcaggaatttaaaacgttgattcaggaacacgaaggattttttacccaccaaaaacgcatcggcgatttaaaatccctgctcgaacccgacgaccgggaaagtttgattcgcctcaaaatgctgtcggtggtttgtgccaccgagcccgaatgggacaagatactctacgccctgtttgctgaagccgccaaagccaaagacactcagtacaaagccattgaaaactttggattgagccgttttttatgggaaaccgtcgaaaaaaaatacggctataaatcccccaaacccagcattaaagatgtgctgctgcggctcatacaggataattttgagcgcaatacgcccatcggcaaacccattctgaacaaggaagcctatctttttgtcaatcgttggaaagaaaacagcaaagcccggcaggtattttatgattggagcctaacgctggaaaaagacctcagcatagaagcctttgtacaaaaccggcccattgagcatttgctggaagccgatacctattcggtcatcgacaaaaaaatcattgttgaccttcgtgaccgcattcttcaccataccttacccacccataccctacaggaatggattgacaaaagaagggtcaaattctttttcggtgattatgcccatctctacgatgctctcagttttgccgccgcgtttctggatgagatcaggaaaatggacctgaccatgcaaagccccgaagaagggtttgtgaagtacgaaaaacagtggtacaagctcgattacctttatcgtaagtacatttttgaaagtgaacaggccgaacaccaaggcatcctcaaagaactcagcgcccggattgaaaaggcgtacggcaactcatttttgctccaactgggcgataactggcaggccgctcttgaaggaatgtcgcgctggagtttggaacgggtcaccggccaaaagcaattctacccacaatgggtgatgccgtacatcaggaaagagaatcgggtatttgtgattatttccgacgccctgcgttacgaatctgccgccgagctgagagaccttgtggtgcaggaagaccgctatacggccacgctcaatgccgttttgggctcgttgccttcttatacccaattaggcatggcttctttattgcctcacacccaactgacctttgaagaagaatcggatactgtttttgccgatggtgtcagtacaaaaggcacgcccaaccggaccaaagtcctgcaaaagagctacgcgggcagtatcgccatcaccgccgaagagtttttgagaatgaaagcaagcaccgaaggccgggagtttatcaagccttaccatgtgctgtacatttacagtaatcaaattgataaaacaggcgatgatacaacgtcggaaaacaaagtatttgaagctacaaaattggaatttgattacctgctgagaatcatcaagcacatcagcaacatgaacggctccaacgtaattgttaccgccgatcatgggtatctgtatcaacacaatcggttggatgcgaccgattttagtgattttacgcccattggcaacgtgtacaaaagcagtcgaaggtttgtattgggcaaaaatctggtacccaatgcttccgttcaaaaatggaaaggtgaggcgttgggtttgggcgaccaaacggaagtgttgattcccaaatctatcaaccgcctacgcatccagggggccggaagccgatttgtacacggtgggtcaagtttgcaggaaattgtggtgccggtactggaaatcaacaaagcccgtaaaagcgacattgaacaggtagaaattgacatcatcagcggctcttccaacattacaagcaatacctttgccgtaagtttttaccaaaagcaacccgttacgggcaaggtacagccaagacagctaaaggcaggtttttatacggaagcaggccaagtcatttcggatatgatcacgttgctgttcaacagccccgaaacggacgctgccgcccgggaaaaaagacaaagtttcttatttacgtcggctgcttccaagcacaacggacaggatgtgtacctcaaattggaagagcaaatagacggtaccaatcaattcagaatgtacaaaagcatcacctatcgaatgctcattgccttcagcagcgagtttgacgaattttaa

SEQ ID NO: 1299 - DNA, 2193 bp, Halorhabdus utahensis
atgcaagctacccaaactctccctgacgctgcaaaagacacaatccgccgcaaattcgaccgcgcagagtcgaacgacccgatcgttctctggtgggacgacggtaactacctcgaagacatcctccagcaggcctgtgccgaactcggcgtcccgctgaagactgccgaaaaaacaccgctggaactccgtgctgacccagtcgacggtgagcaggtctggtacgttccacacgtcaaagagccagccgacagagaaggtgactacgactggtttcgggacgtccagcacacggggagcgaggtggagatgagcatcgaggatctcaccgtccacgtcttcgggagcgaacagctccaagcgtgggaactgaagaacgccacccaatccgacaaccctcagcagcgccgggagatcgcgcgaatcctccacgaccaactcaccggcggccagctcccgacgctcgaacaactccgtacccagatcgtcaccgggggctataccgatccggtggcgttcgtgctggagaacggctgggcagatatcgacgacgatccccagaccgtcgaccagatgaaggacttgctgaccagcgagggcgtcgacgcggtcgccgacgagagcgagcctacgaccatcgaaacccagacgcgtcggtgggcggtcgcggagtggttgattcacgctggcgccgacgccgaccgcttccccagcaagttccgggccgaaaccgccggcgctcacgacctgccggaactcaagtcactgctgaacaacacgacctcgcccgatctgatcgccgaccgctacctcggggaggcggtgtggcccgacgtagtcgataccatcgacgatccgtgggaactgtcgagttgtatcgtagacgctgcactcgaacgccgtctctgggatgagtggcacgcgtccttcgacgtcggtgactacgaggagtgtctcgatcgtgccgaggaacggtacgaagccctcctcgggagcgaggacatccacgggaactaccgaggcgcatacggcccggatagcccgtggacgcaaacgtgggagcaggccgccgaggtggcccgtctcgcacatcagctcgacacgtgggacgagaacgtgaacgacgacgtcgtctccctgtacgcggacgaggatgacggtacgtggcagatcgacaacgccatccttaatctcgtcgtctccggcgaaccggagactgaccttcccggcaaccacccggcgaccaaaacgctggacgacctccgcacccagctccagtcggagtacgtcgactacctcgaagacctcggcgacctcgtcactgagaccatcgaggctggcgctccattcgtcgacgaggatcacgcctaccagttcttcaccaaggaatccgacggcctcgagagcgggcagacggtcgcgctgttcgtcatcgacgcccttcgactcgaccttgcccgtcgcctcgcggacgaactccgcgagtacgtggcgaccatcccggccgacgcgcccgagttcgccgtcgaagagagtgtctggctcgggacactaccctcggagaccgagttcgggaaggccgccctcacgcccggtgaagtccagatgttcgacatctcgctcgtcgatggcgacctattgccgctccgcaacaaccgtgaagtcaacacaaaccgacgcaactcgctgctggatggtgacggctggacggtcacgcgcgaggaagacgagggctggcagtcgacgcgtgtggcctacttcaagaatgacctcgacaatatgggtgagaaggaactcagcgatctcgaagagatgcttgcccagcgtgtcgactctctcgcggaattcattggcacgaaggtcgaacagggcgagtgggatcaggcctacgtcctgaccgaccacgggttcgtcctcctgcctcacgacgtaaccccggggaaaatctcacgaccgacggagtcgacagactccggtcgtcggtgggttgccggcgagaacgtcgacgaggactcgcccggtgtgctgctcgacgccagcactcggttgggatatctcgacgccaacgtcagcgccttcgcgagcccgctcaggcggttcagcaagcagggtgtcggcgacgcccgcttctaccacggcggtctccttccacaggagttcgtactcgacttcatcagcatcacgcaagggtga

SEQ ID NO: 1300 - DNA, 2193 bp, Halobacterium salinarum
atgcaagcgaagcaaaccctccccgacgccgcgaaagacaccatccgaagcgagttcgaccgggccgagtcatcagacccgattgtcctctggtgggacgacgggaactacctcgaggacattatcgagcaggcctgcgacgaactcggcgtgcatctgaaaatcgccgaggagacgccgctggaactccgtgcagatccagtcgacggcgagcaggtctggtacgttccacatgtcaaggagcccgaagacaccgagggcgactacgactggttccgcgatgtcgagcacacgggcggcgaggtagagatgagcatcgaagacctcaccgtccacgcgttcgagcgcggacaactcgatgcgtgggagctgaaaaccgcgacgcaggcggacaaccctgcgaaacggcgcgagatcgcgcggattctccacgatcaactcaccggcggccagcttccgacgctcgaacagctccgcacgcggatcgtcaccggcggctatactgacccggtcgcgttcgtgctggagaacggctggggcgacatcgacgacagccccgacacgatcgagcagatgcaggacttgctgaccagcgagggcgtcgacgcggtcgccagcgagaacgaaccggtggggatcgtcgcggcgacgcgtcggtgggcagtcgccgagtggctgatccacgccggcgccgacctcgaatccttcccgagagagttccgcgccgagacggccggcgaccacgacctccccgaactcaagtcgcttctaaacaacaccacctcggtcagcctcctcgccgaccgctatctcggcgaggcgatctggcccgacgtcgtcgcggacgtcgacgacccgtgggaactggcggactgtatcgtggacgctgcgctcgaacatcgcctctgggaggagtggcacgcgtccttcgactccggcgactacgaggagtgtctcgagcgcgccgaggagcggtacgacgccctcctcgggagcgaggacttccgcggcacctaccgaggggccttcggcccggacagcccgtggacgcagacgtgggagcaggccgcggagatcgctcggctcgcccaccagctcgagacgtgggacgagaacgcgaccgacgacgtcgtctcgctgtacgccgacctggacgatggtacgtggcagatcgacaacgcggtgctcaacctcgtcgtcgccggcgagcccgagactgacctccccgacgatcaccccgccaccgccgcgctcgacgacctccgcacccaactccagtcggaatacgtcgagtacctcgaagacctcggcgacctcgtcaccgataccgtcgaagccggcgcgccgttcgtcgacgaggatcactcctaccagttcttcaccaaggagtccgacggcctcgaaagcggccagacggtcgccttattcgtcatcgacgcactccggctcgatctcgcccgccggctcgcggacgaactgcgcaactacgtagcgacgctcccatcccatgcccctgagttcgccgtcgacgaagacgtctggctcgggacgcttccctcggagaccgagttcgggaaggccgcactcacgcccggaaagatccagatgttcgacgtctcgctggtcgacggcgagttacagcccctccgaaacaaccgtcgcgtgacgaccaatcgccgcgagtcactgttgggcggcgacgggtggacggtcactcgcgacgaggaagacgggtggaaccagacgcgtgtcgcctactttaaaaacgatattgataacatcggtgagaaggaactcagcgacctcgaggcgatgctggctcgacgcgtcgactcgcttgcggagttcatcggaacgagacttgaacagggcgagtgggatcaggcctacgtgctgaccgaccacgggttcgtcctgctcccggacaacgcgtcgccggagaagatttcgcggccgacggaagtgtccgactccgggcgccgatggatcgccggggaggatgtggatgaggattcgcccggcgtactactcgactccagctccagattgggatacctcgacgccaacgttagcgtccttgcgagcccactcaagcgattcaggaagcaggggcttggtgacgcgcggttctaccacggcggactactcccacaagaattcgtgctcgacttcatcagcatcacgcagggctaa

SEQ ID NO: 1301 - DNA, 2193 bp, Haloarcula hispanica
atgcaagcgaaacagacccttcccgaagccgcgaaagacaccatccgaaaaaagttcgaccgagccgaatcagcggacccgattgtcctctggtgggacgacgggaactacctcgaggacatcatcgagcaggcctgcgacgaactcggcgttcacctgaaagtcgccgaggagacgccgctggaactccgtgccaacccggtcgacggcgaacaggtctggtacgtcccacacgtcaaagagcccgaagacgccgagggcgacttcgactggttccgcgacgtcgagcacaccggcggcgacgtggagatgagcatcgaagacctcaccgtccacgcgttcgagcgcgggcaactcgacgcgtgggagctgaaaaccgcgacgcaggcggacgaccccacaaagcgccgcgagatcgcgcggattctccacgaccagctcaccggcggccagctcccgacgctcgaacagctccgcacgcggatcgtcaccggcggctacaccgacccggtcgcgttcgtgctggagaacggctggggcgatatcgacgacagccccggaaccatcgagcagatgcaggacttgctgaccagcgagggcgtcgacgcggtcgccagcgaggacgaacccgcggggatcgtcgcggcgacgcgtcggtgggccgtcgccgagtggctgatccacgccggtgtcgacgccgaacggttcccgacggagtgccgcgccgagacggccggcgatcacgacctccccgaactcaagtcgctgttgaacaacaccacctcggccggtctcctcgccgaccgctacctcggcgaagcgacctggcccgacgtcgtcgcggccgtcgacgacccgtgggacctcgcggactgtctcgttgacgccgcgctcgaacgtcgtctctgggaggagtggcacgcgtccttcgacgccggcgactacgagacgtgtctcgagcgcgcggcggagcggtacgacgccctccttggcagcgaggacttccgtggcacctaccgcggtgcctacggcccggacagtccgtggacgcagacgtgggagcaggccgcggaggtcgcccgcctcgcacaccaactcgagacgtgggacgagagggccaccgacgacgtcgtctcgctgtacgctgatccggacgacggaacgtggcagatcgacaacgcgatgctcagcctcgtcgtcgccggcgcgcccgagtccgacctccctgccgaccatcctgccgtcgatacccttgacgacctccgcacccagctccagtcggaatacgtcgagtacctcgaagccctcggcgaccgcgtcaccgaaactgtcgaggccggcgctccgttcgtcgacgaggaccactcctatcagttcttcacgaaggagtccgccggcctcgaaagcggccagacggtcgcactgtttgtcatcgacgccctccgactcgacctcgcgcgccggctcgcggacgagttgcgcgactacgtggcgacgctcccggccgacgcccccgagttcgccgtcgacgaagacgtctggctcgggacgctgccctcggagaccgagttcgggaaggccgcactcacgccgggcgagatccagatgttcgacgtctcgctggtcgacggcgagttacagccccttcgaaacaaccgaaaggtgaacacgaaccggcggaactcgctgttgggcggcgacggctggacggtcactcgcgacaccgaggacggctggcagtcgacgcgcgtcgcctacttcaaaaacgacctcgacgacattggcgagaaggaactcagcgacctcgaggcgatgctggcccgacgcgtcgactcgctcgcggagttcatcgggacgaagctcgaacagggagagtgggaccaggcctacgtgctgaccgaccacgggttcgtcctgctcccggacagcgcgtcgccggagaagatttctcggccagcggaagcgtccgactccggacgccgatggatcgctggggaggacgtggacgaggattcgcccggcgtgttactcgactccagctcccggctggggtatctcgatgccaacgtcagcgtcctggcgagcccgctcaagcggttcaaaaagcagggcctcggggacgcacggttctaccacggtggcctgctcccacaggagttcgtgctcgatttcatcagcatcacgcaggggtag

SEQ ID NO: 1302 - DNA, 2265 bp, Halophilic archaeon
atgcctgcgaccaagaccctcccacagtgcgctgaagacgccatcacgaccgctatcgacgaggcggccgacgaagatccggtcgtgctctggtgggacgacggtggctaccttcaggatatcgtcgaaagcgtgagtaagtcgataggttgtgagttccagactgccgagcagacacccttggagctacgcgccaaggcagcccgtaaccgaaccgtttggtacgtaccacaggcacacagcgacgacgtggactggttcaaggacgtcgagaataccggcggcgtcgttgaagcgcacatcggaaagctcgccgcacgttgcttcgagaacgatcgcatacaggccgcctcaatccgcacggcctatgaggacgccgcggagcgaagtcgttcgagagcggccaatagccgctctcgtgatcacgaaagatcgcccagcgatctttcggacgactccgcgagtccccactcgcacgctcgcggggacgccgacgcccgcgagaaggtcgcccagacgctctacgaggaactcgatggcgagggcggcctgccgtcgctccagggcctccagacgaagatcgtgctgaacggccacgacgaccccgtgcagttcgtcctcgaacatggaacacgaaacctccccgatggcgagggcctgctgaagatccgtgacctgctcgtcgacgatggcgtcacggccgtcgagggtgagtccgacgctcggaccatcgtcgaacgaacacgccgctgggcggtcgctgagtggttcgtcgacgaaggactggacaaggccctgctcccgcaggagtaccagccagaaccgagcacagggttcggtgtctccaggcccgaactccggtcgatgctgagcaagaccgaacgaaaaggcgagctggcgaacgtctatctcgaccccgaccagcggttctggcacgacgtcctccgcagctacgacgacccatgggaattcgtcgactgtcccgtcgacgcctcgcttgaacaccgtctctgggacgaatggacgcagtcgttcaatgcaggcgagtacgagacgtgcgcgtcgcaggcgacacagcgacacgaccgcctcgcttcgacgtatggcgacgttccctggactgtagtctgggagcaggccgtcgacgtcgcaacgctcgcagccgaactggagacctgggaggagagcggcgacaccagcgacgtcgtcgacctctacggagacgtcgaggacggtacctggcagatcgacaatgcggtcttcaacctcatcgtctccggcgagccagagaccggacttcctgaggagcacccagcaacggcgacgctcgacgaccttcgctcttcgctcacagaatcgcggtatctcgagtacctcaccgacctcggcgacctcgtcgtcgaccagatcgacgccggctcaccgttcgtcggcgagaagcacgcacaccagttctttgccgaggagcaggaacatctccaaagcgggcagagcgtcgcgctgttcatcgtcgatgcactgcgcttcgacctcgcacacgaactcgccgactcgatccgtcgcgagcttccgcggctcgaagtcgatgagagcaggtgggtcggaacgcttccctccgataccgagttcgggaaggctgcgctcacccccggcagcaagttcagcttcaacatcgaactccaagatggggagctcgtccccgaacgcagcgaccgcaagatcaccaatcaccgtcgccagacactgctcgagaacgacggctggagctacatcatgcaggacgccgaggacgaggtgggctggagcaacacccgcgtcgcctactactggaacgatatcgacgagaccggcgagaaggagctgacggacttcgatgaactgttcagcgaccgaatcgaggcgatttcacgcatcatctgcgagaagctacggaaaggcgagtgggaccgtgcgtacattctctcggaccacggtttcgtctcgcttcccaagcacgtcgacatcgacgacctccatccgccggataacgccgaacaggtgacccgacggtgggttgccggaacaggtctcgatgacgacgcaccaggcgtgttgctcgacgaggatacccacctgggctacctcgacgatgatgcgagggtcagtatcctcgccgatccaatccagcggttccggaaccagggactcccggatgcccggttctaccacggtggcattctcccgcaggagttcgtgctgaacttcgtcaccatcacgcaggaataa

SEQ ID NO: 1303 - DNA, 2166 bp, Natrinema pellirubrum
atgcccgcgacgaaaaccctcccacagtgtgctgaagacgccatcgagactgccatcgacgaggcggccgacgaggatccgatcgtgctctggtgggacgacggtggctaccttcgcgacgtcgtcgagagcgtgagctactcgctgggctgtgagttccatgcagccgagcagacgccactcgagctgcgcaccgatgcgccccgagaccgaaccgtctggtacgtaccacaggcccacagcgacgacgtggactggttcaaagatgtcgagaacaccggcggcgtcgtcgaagcgcacatcggcaagctcgccgcacgctgtttcgagaacgaccgcatccaggcggcttcgatccgcacggcctacgaggacgtcagggaaggcgaccgtgaacaggtcgccaagacgctcttccaggagctcaacggcgagggtggcctcccgacgctccagggtctccagacgaagatcgtcctcgatggccacgaggacccggttcagttcgttctcgaacacggcgccgagaaccttcccgacgagaccgccgatctgctacagattcgcgatctgttggtcgacaacggcgtcgcggccgtcgacggcgtcaccgacgaagacgtgctcgtgacacgtacgcggcgctgggccgtcgccgagtggctcgtcgaagaagggctggagaagtcgcttctcgacgccgagtaccggcccgagtccagttccggactgggaatctctcgacctgaactccagtcgctactgagcaaagtcgacccagaacgtgccgaagagctggcgcacgtgtacctcgatccggacgcgcagttctggcacgacattcttcggtcctacgacgacccgtgggaactggccgattgtcccgtcgacgcctcgctcgaacacgaactctggaacgagtggctgcaagcgttccacgacggggagtacgagacgtgtacgacccgagcggccacacgctaccagcgtctcgaaacgacctacggtgacgtcccgtggacgagcgtctggaaccaggctgtcgaggttgccaaactcgctcacgaactcgaaacgtgggaagagcgcggcgatacgactgacgtcgtcgacctctacggtgacgtcgacgatgggacctggcagatcgacaacgccgtgttcaacctcatcatctcgggcgagcccgagcacggtctccccgaggaacatcctgcgagggcgagtctcgacgacctgcgcacgtcgttgactgagtcacgctacctcgactacctcagcgacctcggcgacctggtcgtcgaccagatcgaggcaggctcaccgttcgtcggcgaaaactacgcccaccagttcttcgaccaggagcaagaacacctccagagtggccagagcgttgcgctgttcatcgtcgacgcgctgcgtttcgacctcgcccacgaactggcggagtccgtccgtcgtgaactccccggcctcgaagtcgacgagactgcttgggtcggaacactcccctcggatactgagtttgggaaggccgcactcacgcccgggagcaagttcagcttcaacatcgaactcgacgacggggaactcgttccggaacgcaacggccgcgagatcactaactaccagcgcgagaagatgctgaaggacgatggctggagttacatcatgcagagcgaagacgacgagtcggggtggagcaacacccgcgtcgcgtactactggaacgacctcgacaaagctggtgaaaaagagctcaccgacttcgaggcgctatttagcgaccgcatcgagaaaatctcggacatcatttgcgagaagctcgaccagggagaatgggaccgcgcatacatcctcgccgaccacggttttgtctcgcttccccagagcatcgatcttgatggcatctatccaccggacgaggcggagcaggtgacgcgccgttggatagccggaaaagacatcgatgaggatgcacctggcgtcctcctcgacgagaacactcatctcggctaccttgacgatgacacgaaaattagtgtcctcgctgatccaattcagcgcttccgcaatcagggaattcccgatgctcgcttctaccacggtggggtccttccacaggagttcgtgctcaacttcgtcacgatcacgcaggaatga

SEQ ID NO: 1304 - DNA, 2916 bp, Planctomyces limnophilus
atgagcgatctctttgggccagtttctcgtttgctggaagccgaagtccgtgactgggtgacgaaacacaacctcgtcttctggctggacacgggcagccactacgtcgatctcgtgaaccagctccgcgcgctgcggaaacagggagaattgaagtacgatatctacaccttcaacggcagctttcttgaaatgctctttgagctggaagaggtgatggggggcgtcgatgcgacgcgggccgtgatccatttgccgggcttcaacgaagaactggtcaaagcgaccccgctgctggagctgtacaaggcgggtgcgcggtatcgcaaggccctggagacgctggtccgcgatgcggccgcgggcaaggtgcgtcccgatcagattgatgagttcctgcagcgcggcaatttgtcgctggcaggggcggacatgtggctacacgatctgcagtcaacaggcgcggaaggtctggccagccagttacgcaacgtctcgctaaacgaactggtcgacgacctgcttctgaaccggtcgctagcccagcggatcgcgacgatcgatcttcgcgccgggacaatctctgatggggacccaagggcgatccgggaccggatcgtgtcgctgaccgggatgccagagtcgtggttcgacgtgagcctgcaaaactctttctccagcggcgcggaaccgacctccgtggaagccgtcgcgtatgccatctgcagttgggccgcctgcgtcagttatgttcacgacctactggtgccccctctttccccactgctggaaccggtcccccgtctgccgcaactcgtgcgggacacctgccacgaactggtggtccatctgcagaacgggaacgaacgccagcgatcgttctaccgtcagatggccctggaaacagaactccggttgaccgacgacgtgggtcaaattgcagctaccgacctgggacgattcgacacattctattttgaagaggagaccatccttaaggcgtccttgcaggctctgcaggaccggcgctgggacgcagcccaggattgggccagccgacgcagtgatcccaattcattctggttggttgacgacgcgctgcggagaaacgtctggcaactggtcgcgggtgcggcacggctgggagtcgccattcagacggctggtcccgcgctcaaggcgaccgacagtgtcgcgaacgccgctcaggaatacgtgcagcttggagcgaaagtcgaccaggcccagcgtcacctggaacaggatcgtcagaaactgctgcgatcccaaatgccggaattcgagcaggtccgctccgtgctggaccagatgcagatcgtctggcgtgactgggccaacagctggggccaggggttcaatgccgtctgcaagacgcatggatttctgcctgactcgtccctgcaacaacgcactctgttcgacgagaccgtgaagccgctgacagccggcgatggaatcaccgcgtactttgtcgtcgatgccttgcggtacgaaatgggtcaggagttgctggagtcgatcggagacaccgccaagacggacgtaaagctggactggcggcttgcagaattgccgacagttacggaagtcggcatgaatgtccttgccccggtcgccaaaggaagcaaacttcaaccagagatctccaatggccgcattgctggattctcgacgggtgagttccgtgtccatgatccggacacacggcgcagagccgtgcatgaccgggctggcggacggacgtgtccgcgcatcgaacttgaggaagttcttcgcctggaagctatcacgttgcggagaaaaattgctggcgccaggttggtcatggttcacagccgagagatcgacaattcgggcgaggcgggtttcggaccatcggtgtttgaaacggtgctcaaggatcttcgctcggcctggcatctgctgcgcgaggccggcgttcggcactttgtcttcactgccgatcatggtttcctgttggtggacgaaaactcgcacacggcgcaatcatatggtcgtaaaatcgacccccatcgtcggtacgtgattgcggaccgggctgccaatcattctggcgaagtgcgggttgccctgcgcgacctcggctatgactgcgatgatctacacctgatgttccctgaaagcgtggcggtatttgatactggtaagcagcgcaagggttttgcccacggtggaaacagttttcaggaaagggtgataccagtgctgaagatctcgcaccgagtggcagtgggtggtaacagtactgtgtacaatttgagtgcagcacgcaaaccagccgtcgccggaatgcattgcctcgccgtccgtgtggcccacgcttcaggtagtcttgattttgccagcatctttgaactcgacctggcactccgtgtccttgattcgcctgatgtacgcgtcgaactgtgtgagatccgtggaggagcccgactttcctccgggaccgtcatcgcgaccgtgggagaagagtttgaactgttcttccggttggcgggaggtacggattctcgcgtctcagtcgaactataccaccccagccgggaagccagtgtcgaaccctgcgcactgaaggagcgatttgatgtggttagacgaatcgccatcgcgacgtccactcgcaccgatgaaacaccttcacagtctgaggtctggctcgccgatttgcctggtgcagaaattcaacgagtcttccggcacctggcccaacatggcacagtgacggaaaccgaagtcgccgagatgctcggcagcacccgggagttccgaaaattctcccgccagtttgaacaacacgcggcaagagcgccattcacaatccggattgacagtgtttcaggagtgaaacgatatgtccgggaaggagcgaccttatga

SEQ ID NO: 1305 - DNA, 2862 bp, Anaeromyxobacter dehalogenans
gtgaccggcggactgaccgctttggcgctcgagcaggagctccttggcgagctgcgtcgccgcggtgtcgtcgtctggctcgacgcgcacggcacatacacccccttcgtggacgggctctccgcccgcgcgaagcagggtgagttcccgttcccggtcgtcgcgttccgaggcagcttcctcgagatcgtactcgcgctcgagccgtacggcagcggcctcgacaacgcgccgctcctcatccacatgccggctttcacggaggacagcatccgggcgacaccggtgctcgagctgtacgagccgggcttccggttccgcaaggacccgaagacgctcgtccgcgaggtcgcgcgcggccgcgtggcgcccgatgcgctcgagcagtacctcgcgggcgcgggcaccgtggacctcgcggccgccgacgcctggcttgcgagccagctcacgcacacgcgagaagggctcgcggcgctcctggagcagctcggaccgacgctcgtcctcgacgcactcgtcgatgtgctcgagcggcgggagagcttcctcctccagcgtgtcggcagcgacgccgagagggaggtgctggaggcctggctcgcgcgccagaccgggatggacgccgcatggctccggttctacgggagcgacccgaaggcgaccccgctcgcgagcgtcgcgggcgcgctcgtcggctggctcctctcggtggagtacgtccacgatcttaaccggccaccgttcgtcgccgaactcgtgcgcctgcgggacctctcggcgccgctcgtgaaggcgtccctcgcgctcgtcgaccacatcagagggaagcacacggactcgtacgcgtcgctcgccgacgaggtggagcttcacctgcacgaggagcttccggcgatcaggcccgaggacctcggcaagatcgacacgttccggaaggaggagcagcgcgtcctccagggcgcggtggacgcgctccgggccggcgagtgggagaaggtccgcggctgggccgaggctcggaacgaggagcggtcatactggctccgccgcgatccggcgcggcggcgcgcgtgggagctcgctcgggaagccgcggcgctcgggagcatgctcacggcgcggccgcggccgctcgagggcgtgcggtcgctcgacgcggccgttgagcgctacgccgccaccgcgtacgaggtagatcgcgcgcaccggcggttcgagcagcgccaggccacgctcctcgactcgcagctgccgcacttcggtgacctgaaggagatcgtccgcgtgctcaggagcgcgtaccggggctgggccgaccggctcgcgcgcgatttcgccgcggcgtgccgagcggcggggttcctccccgacgccactctccagcagcgggccgtgttcgagcaggtggtccagccgctcgcgacggacgaacgtgtcgcgctgttcctccttgacgccttccgctacgagatggcgacggagctcctcgccgagctgaaggcgcccgggaccgtcgtggacctgaaggcgcggctcgccgagctcccgaccatcaccgcggtgggaatgaacgcactcgcgccggtcagccagggcgggcgtctccaggtttcagggaccttcggcgggttccgcaccggcgagttcacggtccgtacccccgacgaccgcgcgcgcgcgatcggcctccgcacgggcgcgaagcagagcgtcctactgcagctcggcgaggtttgcgagctcgagccggagaagctgaagcggaagatcgcgagcgcgcgcgtcgtcgtcgtccacgggacggagatcgatgacgccggtgaggcgaacctcggcccggcaacgttcgagatcttcctgcggcagctccggacggccttcgcgcagctccagaaggcgggggtgaagtcgttcgtgttcacggccgaccacgggttcctcctgctcgacgagacgacgcagaaggtgccctacggctcgaagcgcgaccccgctcagcgctacgtgctcgacgagcatccgcgcgccgagcagggcatggtgaacgtctcgctctcggcactcggctacgacgggctcgcggggtacctgctcttccgcgaggacaccgcggtgttcgccaccggcaacgccggggcgacgttcgtgcacggcggcaacagcccgcaggagcggatcatccctgtcttgaccgtccggcgcgaacggccgttggggcggacgctgatggcgtaccgggtggacgccgagcggctgccagatgcgatgggcctccgccgcgtccgcgtccgactccgtgcggcccacgacgacgccggccagctcgggttcgtagcggcgcccgcggtgagcgtcgggatgcgcgcgcccggtcatcccgaggtacgcgcgaccttgaagggcgtctcaggtccgggagccgtggaagacggcacgctccgcctcgcaatggacgccgactggacggaagtcttcttcgcgctcgagggtccgtcgtctgaagccgtgcggctcgaggtctaccacccggacgcggtggagaaggtcgcgccgaagccgctcgacggctggttcgacgtggactggcggcgcggctccgtggagccggtcgccccgcagccggagcgggtgctggactggtcggacgcgctgcccgctggcggcgttcgcgcggtgttcgagcacctcgcggtgcacggggcgatcaccgagaccgaggtgacgcgcatgctcgggtcgccgcgcgcgttccgccggttctcgctcgacttcgacgagcacgttcgcaaggtgccgttccgaatccgcaccgagccgggctctgacggcaagcggtacgtgaaggaaggggagaggtag

SEQ ID NO: 1306 - DNA, 3051 bp, Haliangium ochraceum
gtgagcgccgacgcccgcgcccccggcgcccgcgcccccggcgtccgggacagcgacgacgccagccgcgcccagcgcctcggcctgggcccggtctcggccgcgctcgagcgcgacctgcgccagttcgtgcgccgccacggcctgagcgtgtggctcgacccggccggtcactacaccgagctggtcgatcatctcgcgcagctcccgagcgcgcccgaacccggacacctggactacgaagtccgcgcattccgcggcagctacctggcgctgatgcacgagctggccaacctcaccagcggcgtgcacccgccgcgcctgctcgtacacctgcccggcctcaacgatcggagcatcaggaccacgccgctgtacgagctgtacaaagccggcaagtgctacagcaagagtttggacacggccgtgagcgaggccgcggccgggcgcgtgccgcccgacgacttggccgccttgtgcgcgcgcgccgacctcagcctggcagccgccgacgcgtggctgagcgagcgcgtcagcggcggcgtgggcggcggcctgcgcgcgaccctggagaacatcagcgcgagcgcgctcatcggcgacctgctgcgcggcgagggcgtggccacgcgcctgcgcgaccccggcgacgcggccgcgctgtgggcgcacctcgaggccgccctgggcctgcgcgccgactgggccaggtcgaccggcgcaggcgaggccgccgatgccgacgccgaccccggcgcccaggtcggcgcccaggccgacaccgtgcgcgccgaggacgtggcctttgccatggcgagctgggcgcaggcggtcgagtacgtcggcgacctgcggcgcccgccggtgtcgccgctcttggccggcgtgagcgcgctgccggcggccgtgcgcacggcctgcggcgagctggccgagcacctgcgccaggcccacgccgacttctaccggcgcacggccgacgagaccgaggaccggctcgccgacgaggtcgcggccgcgcgcgccgaggacctgggccgcatcgacaccttccgcttcgaggaggacaagatcctcgaggccgccatcgccgccttgcgcgcgcgcgaattcgaccgcgcgtccgagtacgtgcaggtgcgcgccggcctgcgctcgccctgggtcgccctcgacgccggccgccgggccgcgtggcagctcgtggccgccgccaccgccctgggccaggccatcgccgacgccggcgccaagctcgcggccaacgatcacgacgccgccctggccgcgtactgcgagcgcggcgcgcgcgtcgaccgcctgcaccgcgagctcgagcaggcgcgcttcaagctgctgggcccgcaggtgccgcgcttcgacgccgtgcgcgcgtgtctcgacgacctgcgcgcggcctggcgcgcctgggccgacgcctgggccgagggcttcaccgtcctgtgcgagcgcgacggcttcttgccgcgcgccgaattgcagcagcgccatctgttcgacgacgtcgtccgcgcgcacgcccaggccggcaccaccgcgctgtttctggtcgacgccctgcgctacgagatggccaccgcgctgctcgccgccatcgtcaacatcgatggcaccgccgccaccagcgtccgcctcgacgcccgcttcgccgagctgcccacggtcaccgaggtcggcatgaacgcgctcgcgcccgtgagcgcgcgcggccggctcacgcccaagatcgcgaacggcacgttccagggcttctcggccggcgagtttcaggtcaaggaccccgagacccggcgccgggccatgggcgcgcgcgtcggcggcagcacctgcccgctgctgagcctgagcgaggtgctcgcgcgcgacgcccgctcgctcaagcacagcgtggcccaggcgcgcctggtcgtggtccacagcctggagatcgaccaggcgggcgaacacggcaccggcctggccgcgttcgaggacgccttgcacacgctgcgcaacgcctggcagctcttgcgcgacgccggcatcaagcgcttcgtgttcacggccgaccacggcttcttgctgctcgacagcggcgccggctcgggcggcgcggcggcggcccaggcccacggccgcaagatcgaccccaagcgccggcacgtcatctcgtccgtggccgccgaccacagcggcgaggtgcgcgccccgctgagcgcgctcggctacgacggcagcgagctacacgccatgttcccgcgcacctgcgcgccctttgacaccggcgcccgcgcgcgcgatttcgtccacggcggcaacagcctgcaggagcgcgtcatcccggtgctcagcgtcgtgcaccgcagcgacgccggcggcaccaccctgcgctaccgcgtcgaggtcacggacagggacaagccgctgggcgacctcggcggcgtgcaccggctgcgcgcgggcgtgcgcgtggccgggcagagcgcgctcgattttggcgccgcgggcgagatcgagctggcgctgcgcgcgcgcgagccggccgatgtcagcgccgagctggtgagcgtgagcggcggcgcgcgcatcgagggcgggcggctgctcgccaaggtcggcgaggacttcgagctgcactttcgcctctccggcaacaccgaagcgcgcgcgctggtcgagctgcaccaccccggacgcagcgccgagctcgagcccggcggcccggcccggcgcttctcggtgacgccggcggtgaagcaacgcccagcggacgcggagccgacgtccgccgcggcagccagtgaagccgcgcgcgcgcccgcggcgtcgtggctggcccagctcccggccggcgtgcgcgaggtgttcgcgcacatcgaggcgcacggcgtgtgcgtggagaacgaggccagcgccctgctcggcggcgcccgcaagctgcgccggttctcggccgagtttgaaaaacacgccgcgctcgcgccctttggcgtgcgcatcgacaccgtcggcggcatcaagcgctacgtgaaagagggaacccggacatga

SEQ ID NO: 1307 - DNA, 3051 bp, Haliangium ochraceum
gtgagcgccgacgcccgcgcccccggcgcccgcgcccccggcgtccgggacagcgacgacgccagccgcgcccagcgcctcggcctgggcccggtctcggccgcgctcgagcgcgacctgcgccagttcgtgcgccgccacggcctgagcgtgtggctcgacccggccggtcactacaccgagctggtcgatcatctcgcgcagctcccgagcgcgcccgaacccggacacctggactacgaagtccgcgcattccgcggcagctacctggcgctgatgcacgagctggccaacctcaccagcggcgtgcacccgccgcgcctgctcgtgcacctgcccggcctcaacgatcggagcatcaggaccacgccgctgtacgagctgtacaaagccggcaagtgctacagcaagagtttggacacggccgtgagcgaggccgccgcccagcgcgtggcgcccggcgacttggccgccttgtgcgcgcgcgccgacctcagcctggcagccgccgacgcctggctgagcgagcgcgtcagcggcggcgtgggcggcggcctgcgcgcgaccctggagaacatcagcgcgagcgcgctcatcggcgacctgctgcgcggcgagggcgtggccacgcgcctgcgcgaccccggcgacgcggccgcgctgtgggcgcacctcgaggccgccctgggcctgcgcgccgactgggccaggtcgaccggcgcaggcgaggccgccgatgccgacgccgaccccggcgcccaggtcggcgcccaggccgacaccgtgcgcgccgaggacgtggcctttgccatggcgagctgggcgcaggcggtcgagtacgtcggcgacctgcggcgcccgccggtgtcgccgctcttggccggcgtgagcgcgctgccggcggccgtgcgcaccgcctgcggcgagctggccgagcacctgcgccaggcccacgccgacttctaccggcgcacggccgacgagaccgaggaccggctcgccgacgaggtcgcggccgcgcgcgccgaggacctgggccgcatcgacaccttccgcttcgaggaggacaagatcctcgaggccgccatcgccgccttgcgcgcgcgcgaattcgaccgcgcgtccgagtacgtgcaggtgcgcgccggcctgcgctcgccctgggtcgccctcgacgccggccgccgggccgcgtggcagctcgtggccgcggccaccgccctgggccaggccatcgccgacgccggcgccaagctcgcggccaacgatcacgacgccgccctggccgcgtactgcgagcgcggcgcgaaggtcgacagccggcaccgcgagctcgagcaggcccgcttcaagctgctgggcccgcaggtgccgcgcttcgacgccgtgcgcgcgtgcctcgacgacctgcgcgcggcctggcgcgcctgggccgacgcctgggccgaggacttcaccgcgctgtgcgagcgcgacggcttcttgccgcgcgccgaattgcagcagcgccatctgttcgacgacgtcgtccgcgcgcacgcccaggccggcaccaccgcgctgtttctggtcgacgccctgcgctacgagatggccaccgcgctgcgcgccgccgtcgtcaacatcgatggcaccgccgccaccagcgtccgcctcgacgcccgcttcgccgagctgcccacggtcaccgaggtcggcatgaacgcgctcgcgcccgtgagcgagcgcggccggctcacgcccaagatcgcgaacggcacgttccagggcttctcggccggcgagtttcaggtcaaggaccccgagacccggcgccgggccatgggcgcgcgcgtcggcggcagcacctgcccgctgctgagcctgagcgaggtgctggcgcgcgacgcccgctcgctcaagcacagcgtggcccaggcgcgcctggtcgtggtccacagcctggagatcgaccaggcgggcgaacacggcaccggcctggccgcgttcgaggacgccttgcacgcgctgcgcaacgcctggcagctcctgcgcgacgccggcatcaagcgcttcgtgttcacggccgaccacggcttcttgctgctcgacagcggcgccggctcgggcggcgcgccggcggcccaggcccacggccgcaagatcgaccccaagcgccggcacgtcatctcgtccgtggccgccgaccacagcggcgagacgcgcgccccgctgagcgcgctgggctacgacggcagcgagctgcacgccatgttcccgcgcacctgcgcgccctttgacaccggcgcccgcgcgcgcgatttcgtccacggcggcaacagcctgcaggagcgcgtcatcccggtgctcagcgtcgtgcaccgcagcgacgccggcggcaccaccctgcgctaccgcgtcgaggtcacggacagggacaagccgctgggcgacctcggcggcgtgcaccggctgcgcgcgggcgtgcgcgtggccgggcagagcgcgctcgattttggcgccgcgggcgagatcgagctggcgctgcgcgcgcgcgagccggccgatgtcagcgccgagctggtgagcgtgagcggcggcgcgcgcatcgagggcgggcggctgctcgccaaggtcggcgaggacttcgagctgcactttcgcctctccggcaacaccgaagcgcgcgcgctggtcgagctgcaccaccccggacgcagcgccgagctcgagcccggcggcccggcccggcgcttctcggtgacgccggcggtgaagcaacgccaagcggacgcggagccgacgtccgccgcggcagccagtgaagcggcgcgcgcgcccgcggcgtcgtggctggcccagctcccggccggcgtgcgcgaggtgttcgcgcacatcgaggcgcacggcgtgtgcgtggagaacgaggccatcgccctgctcggcggcgcccgcaagctgcgccggttctcggccgagtttgaaaaacacgccgcgctcgcgccctttggcgtgcgcatcgacaccgtcggcggcatcaagcgctacgtgaaagagggaacccggacatga

SEQ ID NO: 1308 - DNA, 1842 bp, Acetohalobium arabaticum
atggaatatagttggtataatgctatcttagataagattaagagtatagaagcagatattatattggttattgatagcgaagaattattgaaatctcaaggcttgcaagaaaaattaaaggatctttattccactgttgaactttaccagtcagaattactattaaggcgcaatttgaagcaagagcaagaagcaattattatatttgaaagtggtaatgatattccgtattttttgctcgataaatatcccgaagtagaggttagttatagagatatttttcctcaattagcagaggaagtgctagattggttagaagagaaggagattgaagaactttatctttattatcaaactaatgatttctttactcaattggatagtcgagagacattggaatttgttattaaaacattgtatgaagttgctcttaatgggaatcaaatagagaacattgttgcttttctaattaagtacttttttgtaaaatcagagattacaggagcaattaatgaattagtaggggaaaaattagtttctagcaattatacagtcaatatcaatcagattcgagaacgagatgatttctttatctggttagagggaaaatggaaagaatttttaatcaatgaaagagcagagattgatttctctgatccaaagctgagatatttaatagatgattgcttcgagcagggattaatgcagcctgttgatttaagtaatgaagatattgatttagagacagtaattaatgaaggaagagcaaattactgggtcaggagtggaattcaaaatctcaatcggctatcggtaaagcaggagcttaagatagaaagagaaaaattagaagaattgttaactggtaatttatcgattagggagtgggggatagcagctaaaatttggggtaagatctcttatttagcctatacagaggaaatgtatgaatccttcatttccttacaaaagagattagatgaaaaattcataaattttgttgaagaggagtatgatagattagtttttgatcaccgatttcaatatgctccattaaataatagaattttacctcatattgttgaagaagagccggataagtttgctttaatctgttttgatggtatgagttttaaggattggcgggtagttaagcaatatttaactacaaacttagattcagttagtctaaaagagaaattcagtctagctatgattccaacagtaacttcttattctaggcaagctatcttttctggggagttacctcgaaataatgatgataaatatcaggaggaaaagggacttacacagtatttaatgaatgagttagatattaataaagaagaaatttattttgataattgtgaggttcctacagaaattaatcttttaggctataaagcagtaggacttatttatagatttatcgataagtcagcacataattctttaaacccaaagttgcattacaaaagcttaactgatattctagagagtagtgaattagctaaagttataatgaaattaataacaaataattttaaaatctattttacttcagaccatggtaatctcttttgtaaaggaaatggtgttcatccctcgagacatcttgtagatgatagagccaatagagcagcagtttatcagcatgaaaatttagctaaagaaattgaagtttctaataaattaatattaaactttcctaatattattggagatgactatatcgttactatgcgggatagaaaaaaattcggtaataaaagaccggccttaacccatggaggaccaaatattgaagaagtaattattccacttatagaggtgagtaaataa

SEQ ID NO: 1309 - DNA, 2034 bp, Acidothermus cellulolyticus
atgggtagttggcgtgaccaaatcctgagtgagttcacaccccaggtcgcccggcttaccctggtcgcggatccggacggcctgctccttgaagaaggtgtgctcgaagggatccgggaacggggctttgagctgatcccgttcgaggatcatgtcgcctttcgctatgcctacgaatccaagttccgctcccgctgggaccgtcgtgaggaaaccgatctggtggtggtgctgagatcgccgtcgagcgatctcgatgccttgccctacgacctgctgcaggctggccgcaagctctctttcaacctgggcgatctcttcccgaatctcagctaccccgtggtcgcggtactcgaccgggctgatctcgacgtcttgttcgatgcgcaattgaggcacgcgccggggccgctcggcgacaacgcgacgaaggagttcgtccttcgtcatgtgttcgagatcgcgccggaactcatcaagcagccatctgacctactccgggtcttgctgcgtcgccattaccgcggacaacgaatcccccacatcctcgatgagcgttttatccaggtgcttcgtcaaaacggcctatttgaggattggcctctggaagccatcattccggacgagcaagcattctttgcgttcctgcaggagcgttggccggtgttcctggattcgctcgcgaattcaaacgatgatgccgtctacgcgggtgcggcggtctacggcttcaagtccccaggacctgcgctcttgcctttcgaccacgacgatgtccgcgtctacctcgacaacctgttcttcgaaggattgctccagccagttcttcacgagcaagcgcagacgcttgcacagtcttgggcagtgtgtggcgtgagaatctcgccagaggaagatcgcctacgccgcgtgaggggtcttctcgattttatcgagaagacgcttcccacagtagactcgcggtacgcggagtggcttgagtttgctcctcgttggtccgaactcgttgcgctgacgttggactcagacctgcctacgcgcgacgcacaggcaagcgctacgctaccacccggatacggggagcgtttggaggcattgaaagctcagatcgatgtcacgttcaccgaatggatcgtgaagcgctacgcaagtctcatcaaccttccgccactgccgccggtgatgctgcatcacatccctcccttcctcgctagaaaccttgacaatgcccacgatgcaaaagtcgctcttttgctcatggacggtcttgccttggaccagtgggttgtcttgcgtcgtgtacttgaggagtcagatgcgacgttgcggttccgcgacaacgtcgtattcgcttggattccgactattacttccgtttcccgacaagccacgtttgccggtaagccgcccatctatttcccaacgagtatccttaccacgaccaaagagtcggaactttggactcagttctgggttggggaagggttaacgaaacatgaggtgggctacatgaagggactcggagacggaagcttggacgggcttgccgagctcctgagccgacccaggttacgcgttgtcggattggttatcaacaaggtcgatcgaatcatgcacggcatggagctaggatcggcgggcatgcacaaccaagttcgactatgggcgaggcagggattcatgtgtgatctccttcgtttgctccatgaccgtggatttcaggtttatctcacctcagaccacggcaacatcgagtcggagggcataggtgaaccttccgaaggatcggtcgcgaaggaagctggcgagcgtgttcgggtctattcggatctcaagctcagggcccaggtcaaggagcggttccgaggggcagtagagtggccgcctttcggcctaccggaggactacctcgcccttattgctcctaaccgagccgccttcgtacagagagggaaaaccagggtcgctcatggcggtatcagtgtcgaagagcttcttgtcccctttgtcgaaattgagagacaagatcgatga

SEQ ID NO: 1310 - DNA, 1995 bp, Anaerobaculum mobile
atggctagttggcgtgatataatccttagtgagtttcagcctcaaatcgcacgcctaacattagttgcagatcctgatgatttgttgcttgaagagggcatctttgaagaaatgcgcgcaaggggttttgatctgataccttttgatgataatgttgcatttaggtacatttatgaatccaagttccgttctcgttgggacaatggtgaagagaccggttcaatggctgttcttaggttgacttcaaatgaactagatttattgccatatgacttactacaagctggacgcagggtttcgatttccttggctgatattttcccaaatttaagctatccagttgttgcgacacttgatttcatttaccttgatgctttattccaagctcaagataagttttcgccaggacgattgggggataacgttactaaaagtttcatacttcgctacgtatttgaaataatcccggagtttattaaagagcctaaggatctgcttttggtgttgcttcgtcgacattacctcggcatgagaattccgccgatcgttgatgagtaccttattcagtttcttcagcagaatgagatgttcaaagattggcctttagatattatcgtttcggataggcaggccttttttgcatttcttcaagaacgatggcctatatttttaaatacactagcattaaaaggcaatgaagtttgtgaagatccttcaagatatggattaaggttttcgggcccggcccttttgccatttgatcatgaggaaattcgcgtttatattgatgacctatttcttgaaggcttacttcatcctgttccttgcagagaagcgcaattacctaaagaacactggatgaaatttggcgtaacaattgaccctgaagaaagctattatcgtcgcattgttggattgatggattccgtcgaagaaaacttaaaggataatatgcggcatgagatgtggcttcactttgcctataaatgggctgaacttttagccttagaatttacatcagactttggtttacctgatacgtgtaaagaacgcatggatgcactaaaatcaaagatcgatggaatgtttcaagattggattttgaagcgttatgcgagccttataaatctttcgccggcatctccagtaatgttacatcatattcctagattccttgcgcgaaatctagcaggggataagcgcactaaaatagcccttttgttaatcgatggccttgctttagatcaatggataacattacgtaatgtcttaaaagagttggattcaagattgcagtttagagagtctgcggtttttgcgtggataccaactttaacgtcagtatctcgacaagcggcatttgctgggaaacctcccatgttctttccgacaaacattcgaacgactgatagggaatcgaatctttgggctcaattctgggcagagcaaggacttagtaccaatgatacagcttacatcagagggttaggtaatgaaatatctaataaacattatgaggttctaaaacaagatcgattacgaatagctggtttggtcgtagataagattgatcgtataatgcatggaatggagttaggtactgctggcatgcataatcagatttggcaatggactaagcagggattcatgagagaccttttaagcattttaatagataatgattttaaagtatatattacatcagatcatgggaacatcgaggccaagggaattggttgtcctaatgaaggggtaactgcagaattgcggggagagcgtgttcgtatatattccgatctaagtttaagaacaaagtgcaaaatgtcatttcccgattcactggaatggccgtctattggcctcccagaagattattatgctttaattgcaccaagcagggcggcctttattcgtaaggacgatgtgattgtaagtcatggcggcattagcatcgaggaagttatagccccatttatcgaggttgaacgagcataa

SEQ ID NO: 1311 - DNA, 1485 bp, Bacteroides vulgatus
atggatagttttatacaaagaataatagatagcatcacatccgaaacacatctgattagtgtcgttaacaatccggatggtttcttaagcagacctgatacacaagagaaaatactcaaagagtcaggtttgctcctactccctattgagtcttctattgaactaagagtacgttttgaactaagtgataaaaactccggaaacaaggtatgttacatttatgacgatgtggaaagtattctacctgatattatgatgcatatttatgtagcaccaacttttaagatatctaaattacttcctgcatgtaatgagatagtactactcaaggcaaaaaaccttacattcaatattgcatcttatatatacaaaaagaagtttaccaatacacttacagcacaggaaaccattaaattattggaagaaaccgatagcatatatggtacagatgaagaaacacttaaaaaagagttgactagaattccattaaaatgggaaaaggttgaaacaatagaaaaaatatcttacttgttactttccgcaatcaagaacaatttatacgacaatattgtttctgttctagaaaccattaatgaagattttcaaaagttcattgacagtaaatatgcttcaatgattaactcttcagccattcaaaggcctaaaatggtacataaaatattgcctaatatattacatcagcactccagaacagataaagttgcacttgtagtcatagatggaatgagttattggcaatatcttttgctgaagagagaactaagttttctagaaataggaactgatgataatcaaatcctttcatggattccatccattacaaaattatcaagacaggctatattcagaggtgaatctcctgttattgaatataatcagtcgccaaagtctgaaagcagtttatggattgatttctggacttcttcaaaacaaaaagctgcgaaacgattgcaaacttatgaagtaggatatattcacggcagtttgtgtctggataacatgcagtatcgtagaattgcgttagtagatacagatcttgatgaaaaaatgcattcttcatccagtaataaagagctgtatcttcttactgaaaattgggcacacgatacagctaaagatataaaagaattacacgaaaatgggtatcatatatatataactacagatcatggtaatgtatatacttccccatggagaaatctgacttcacaagaaaaaacttttctttttgaaaaagagagcaggggcaaacgccacttgatttattcaaaaaaagaatatcttgacagatttatatcatccaataatgatattgaaaatcaacttctcagtacggagaaatggactaataatagtgctgtatggagaaatctgtatagttttaataataatgaatgtataactcatggaggatctcactttcttgaagtagtaatacctttcatcacaattaaaaagaaataa

SEQ ID NO: 1312 - DNA, 1872 bp, Caldicellulosiruptor kristjanssonii
atgatagaagatgcaatatgggaaaaaataaattcaagtttgtatgatttcttgctggtttatgattttgacaaacttttatttaattttaatgtgatatctaaaattttcgatgaaggttatgaagtattcatttataaggacattgaggagtataggattttttatgaaacaaaaataagagatatgaataaaaaggttgttttaattgtaactgagaaagtttatcttccttgggatgtcaagcaagattatcatgaggtttggataagattaaaagatttattttttaaccttgatgttgatgttataaaacagattgatgttgaatatttcgacgttatataccagaagatgaaaagtctaaatagagttttgaactatgaggaaacatgtaattttattttgaggtacatttataatattgatatatcggttataaacaatcttcaagacttaataaaacagttgctgaggctttactttaaaggaactgagcttcctcaagtcttgtcagattttataaagaataagttagtgtttttacctcctgaggttagttgcattttaaattcgaagggtgagttttttaaatttttccagacagaatttgataaatttgtaggtaaagataaatatgacaaaatggatggagaagattatattgactttttggatcctgaaattagggtttatttggatgatttaattatggacaacataataaaactgaccaagccaactgaattaaataatagcctaccaataaagcaattaggtttggtatttaacctaaaatctcaagaagaggaatacaaacatttaagaaatagacttaagaaattattatgtgaaattaaaaattataaagactggtttgaggtagcagaaatatttggcagaataataaatttgtgctgtattttaaatgatgatgaatacgaaacattgagtcatgaaatcaatgtaaagtttaaagactggctgtttaaaaattatggtaaacttccctatttatcatattcaaatggacctattatggtgcaccatattcagccatatataattaatcttttgaaaaaggaaaataaaaataaagtggcttttattttagttgatggtatgtctgaatttaattggacaataattaaagaatatttagaaaatatggatttgagaattgaaaagaaatcttgttttgcctggatacctacgataacttctatttcaagacaatctatattttcagcagagcctcctttgagatttaaaactactatgttttcaacaaattatgatgaaaaacattttaaaaggttctttatgaatagtggttacaaggagaaagaaattgcttatattaggagtataaaaacgtttgaagaagaaaatttaaggagagctttagaagaggattgcaaagtgctttgcgttgtagtagatgtgatagatgagtttgtccatggacaaatttttaattacaaggggttacaaaatcagataaacttttatatgtctgaagggtatttacaaaaatttttagaagaacttttcaaagagaattatgaagtctttatagcttcagatcacggcaatgtattgacagtcggacaaggtaatgttaaagaaggagtgtatattgacactctttctaatagggtaaaaatatatcctaaggatattccaatagaatctccgactggaattaaaatcatcaaatggggtggaattgggctgcctgatgagtataattatgttgtatctgatgataatctatcatttcatgataagggaaagacaattttgactcatgggggaatatcaatagaagaaataattgtgccttttgttaggataatgccgtcattataa

SEQ ID NO: 1313 - DNA, 2034 bp, Chloroflexus aggregans
atgacgcaccatgcaccacctaccccacacaccgaatcatcctggcgcagtctcatcctgcgcgaattcacaccaaaggtcgcccggctgactctcgtcgccgatccagacggactactgctcgaagaaggtgtccttgacggaatccgatcccagggctttgagctgatcccgtttgacgatcacatcgcctttcgctatgtctacgaagcgaagtttcgctcacgctgggatcggggcgaggacaccgatctcgtcgtcgtgctgagatcgccatcaagcgatctcaccaccttaccttacgatctgcttcaggcgggccgcaagctctcgttcaacctcggcgatctgttcccaaagctcagctatcccgtggtcgcagcgctcgacaagacctggttcgacaccttgttcgaggcgcaggcgaagtacgcccaggagcagctcggcgataccgcaacaaaggcgttcgttcttcggcacgtgttcgagatcgcgccagaactcatcaaacagccatcagacctgctccacatcttgctccgccgccattaccgccgacaacgaattccggccatcctcgatgagcacctgcttcaggagcttcgtcaaaccagcctgtttgccgattggccgctggaagccatcattccagacgcgcaagcgttctttgccttcttgcaagagcgctggccggtgttcctcgaccgctttgcagccgagatgcctggtgagcagatgcacgtgcgcgagcgagcaccagcctacgaactacccgccctgcacctaccgttcgaccacccggatgtgcggatttatatcgacaacctttttctcgaaggtatccttcagccggttgctcacgatcaatcgcacgaactcgccaaaacctgggtgaagtacggtatcaaaatctcccctgcggaagaccgtctgcgccgggtcaagggattgctggcttcctgcgaaacatcgcttcctaacgagaaagcaaactatagagagtggatccattttgctcaacagtgggcacaactaaacgcattgattaccgaaggcgagctacaagcagaaactgatgccaagatccgacaatttaccaatggggtagatgcccaattcctcgcatgggtgaagcagcattacggaaatctcttcaatctgccggctaccgatccggtcatgcttcaccatctgccacgatacttcgcccactcactaccgccaaaatcaaaactcgcgtttctgctcgtcgatggtctctccctcgaccaatggatcaccttacgcgaggtgctccacgaacaagagccaacccttctcttccgtgagcgtgctgtgttcgcgtggattcctaccatcacctcggtgtcgcgacaggcggcttttgccggccaaccgccgatctacttctcagagagcatccataccactcataaggaaccggagctttggacaacattttgggaaaagcaagagctttctaaagcggaagtggcgtatctcaaggggttgggcaacgggcaaggtgatgtgcagaagattgacgaactcatcgctcaacctaagctgcgcgtcgttggattggtcatcaacaaggttgacgatattatgcacggcatgcagctcggctcggcaggcatgcacaaccagatccggcaatgggccagacagggattcatgcgcgatcttatcacgctactgctgggtaaagggttccacatctaccttgcctcagaccatggtaacattgaggcgagcggcgtgggacgaccgagtgaaggggtcgtagccgaagtacgcggcgagcgtgtccgggtctattccgattttcggctcaggcaacagacagaagcggtatttccgggatcgttggcatggggatcggtgggtctgccggccaattacttcgtcctcattgcgccgaatcgagctgcgtttgtcccgaaaaacgaaattatcgtcagtcatggcggcataagtgttgaggaactgatcgttccgtttgtccagatcgagaggaggagtcaatga

SEQ ID NO: 1314 - DNA, 1995 bp, Desulfovibrio aespoeensis
atgagtagttggcgagacgccatcctgaacgattttgtaccgaacgtcagcaagctgaccttggtcgcggacccggattgcctgctgaccgaggaaaagctggccttggaacttcgcgggcgcggcttcgacctgatagagttcagtgacccggtcgaattcagatacgcctatgagtccaagtaccgttcgatctgggaccggggtgagcacaccgatctggtggtggtcctccgcttgcagaatgcggagctggaatccctgccatacgatctgctccaggcgggccggaaactgtcattcaacttgggggatctctttcccaatctgagctatccggtcatcgagaagctcgaccggagcctgttggacgcgctattcgaggcccagcgcaagtcgccgccggatcgcatgggcgacaacgccaccaaggatttcattctccgtcatgtgttcggcattgcggcggaactgatcgccaacgaggtggagctgcttcgcgccttgctccgcctgcactacggaaagctccagattccactgatgctggccgagcggctcatccaggttctcaaaggccatgatgggttcaaagcctggccgctttccgagatcgttccggacgatgaggccttcttcgcctttttgcaggaacgctggccgctctttctttcccggctgggtagcgccaatcaggtgcgggaagattcaccggaatacggccttaagtatcccggccctgaccgcctgccgttcgaccatcaggacattaaggtctacatcgacaacctgttcctggaggggaaactcacccccgtcgaggccaaaggcattgaagtggatgccgggtcctgggttcgaagcggcatcgccacgtccggcgtggacaatgacgcacttcggatttcccacctgtttgaccttgtcgaaaaggaactgcccactgcggaagcgcgttactctgattggaccgcttttgcattgaaatgggccgaactctcttcgctggttcactgcggcaacagcaccgagtatcagacccggctcagggaaatcggcgatgcactgaacacgaccttcgccggttggctgacggaccactactccagtctgattaacttgccgccgaccaatcctgccatgctccaccatgtgccgcgccgcctggctcgggatatcgaggactccggtagcagccgtgccgcgctgatcgtggtcgatggcctggccttggaccagtgggtgaccattcgccagcttctgcaaaagcaagatgccaatctggtcatgcgcgaatccgcgaccttcgcctggattccgacgctgacctcggtatcgcggcaatcgatcttctcgggcaagccaccgctctatttcccgtcatccatcaactcgaccaacagcgaagagaaactctggaagcagttctgggaaggccatggtctgtcccggttggatgtcgcttaccaacgcggcctcggcgacggcgatgctgcgggcgtcctcgactccgcaatccaccccgggaagaccaaggtggtggggctggtcgtggataaagtggacaagatcatgcacggcatgcaactcggctcggccgggatgcacaaccagatcaagcagtggtgccagggtggttttctggctgcgctggtcggccaactgctggaatacggctatgaggtctggctgacggccgatcacggcaacatccaatgcgaaggtaaaggccgcccgtctgaaggcgtgattgcagaaactcgcggcgagcgggttcgtgtctatccaacgccggaactccgcgctcaggtggctggggcgctcccgtttgcccacgagtggcagccggtcgggttgcccgcagattatttccccctggtggccggtggccgcgacgcattcgtgaatccgggagatgccatcgtaggtcacggcggtgtagccatcgaagaagtcatcgtgccccttgtgaagtttgaaaggaggacacggtga

SEQ ID NO: 1315 - DNA, 2001 bp, Dichelobacter nodosus
atgagtagttggcgagacgccatcctgaacgactttgtgcccaacgtcagcaagctgaccctggtcgcggacccggattgtctgctgaccgaggagaagctggcattggagcttcgcgggcgcgggttcgacctgatcgagttcagtgatccggtcgaattcagatacgcctatgagtcaaagtacctttcgatctgggaccggggtgagcacaccgatctggtggtagtcctccgcttgcaggatgcggagctggaatccttgccttacgacctactccaggcgggccgcaagctttcattcaacttgggggatctctttcccaacctgagctatccggtcattgaaaagctcgacaggagcttgctggattcgctttttgaggcccagcgcaagtcgccgtcggatcgcatgggcgacaacgccaccaaggattttattctgcgtcatgtgttcggcattgcggcggaactaattgggggcgaggtggagctgcttcgcgcattgctgcgcctgcactatgggaagctacagatcccgcagatgctggctgagcagcttatccaggttctcaaagggcatgatggattgaaggcttggccgctctctgaaatcgttccggacgatgaggcgttcttcgcctttttgcaggaacgctggccgctatttctttccaggctcggcagcgctcatcaggtacgggaggattcgccggaatacggcctcaagtatcccggccctgatcgccttccgttcgaccatcaggacatcaaggtctacatcgacaacctgttcctggaggggaaactcacccctgtcgaggccaaaggcattgaagtggatgccgggtcctgggttagaagcggcatcaccacgtccggcgtggacgatgacgagctacggatctctcgcttgtttggccttatcgagaaggaactgcccactgcggaagcgcgttactcgaactcgaactggaccgcctttgcattgaaatgggccgaactttcttcgctggttcattgtggcaacagcaccgagtatcagacccggctcagggaaatcggcgatgcactgaacacgatctttgccgcttggctggccgaccactactccagtctgatcaacttgccgccgaccaatcctgccatgctccaccatgtgccgcgccgcctggctcgggatatcgaggactccggtagcagccgtgcggcgttgattgtggttgacggcctggccttggatcagtgggtaaccattcgccagcttctgcaaaagcaggacgccaatctggtcatgcgcgaatccgcgaccttcgcctggattccgacgctgacctcggtatcgcggcaatcgatcttctcgggcaagccgccactctattttccctcatccatcaactcgaccaacagcgaagagaaactctggaagcagttctgggaaggccatggtctgtcccggctggatgtcgcttaccagcgaggtcttggcgacggcgatgctgcgggcgtcctcgactccgcaatccaccccgggaagaccaaggtggtggggctggtcgtggataaagtggacaagatcatgcacggcatgcaactcggttcggccgggatgcacaaccagatcaagcagtggtgccatgcaggatttctttccgcgatggtcggccaactgctggattacggctatgaggtttggctgacagccgatcacggcaatattcaatgcgaaggcaaaggacgcccatctgaaggtgtgattgccgagactcgcggcgagcgtgttcgtgtctatcccacgccggaactccgcgctcaggtggctggggccttcccgtttgcccacgagtggcagccggtcggattgccagcagattatttccccctggtggccggtggccgcgacgcattcgtgaacccgggagattccatcgtaggtcacggcggtgtagccatcgaagaagttatcgtgccccttgtgaagtttgaaaggaggacacggtga

SEQ ID NO: 1316 - DNA, 1356 bp, Methanocaldococcus sp.
atgaggctatatttatgggttaaggataggttagaccctggaagaccaaatttaatccttgaccctgatttttctgtatcttatgatataattgataaactaaaaaatgaaggatacattattgaagatcttagagacaaaccaatacaacaacaaaaaaagaggattattgaaatttattccaaacattctaaatttagtggaataatattaatctcaagtgtcaaagaatcaaaaatctattcaataatcaaaaattctggaagaataaacacactatctaatttccctacatccacaaaaataaacttaaatgaaattcattcctatattgataaaatttcttcagacataaattcagtatttagatggattaagttagcaaaaactataggaaatttaaaataccaagctaaagatattgaaagtcgtaaatctataaacctctttttagaaagagttgtagatcctaaattctttgattttgtttttaattcatataacaaactttttacttacggttcaaaatttttaactataaataaagctatagattacataatctcattagtgaaaaataatagtacagaaaaagtgcttttggttgtaattgattgtatggcatgggatgattatttttccataaaagacttctttgaaaaaacatgtgatagagccatttttgccatgattcctacactaacgttttattcccgtatatcactttgttctggattaattccaagaaattttgacaatttaacaattaatgatgaaaaaaagttattttatcagaaaatcagtaatgaacttggaaaagaattaggaatttacataaagaacaatatagaagagttaaaaaatgcaatttctcaagataatcacaaaatgatatgttttatatatagcaaatttgatgaagttatacattcagaagatgtaaacaaaaaccatgcctatcataaactccaagaactctttaaaagagacctatatgacattataaaaactgctaaagatttgggatggagagtattcataacttctgaccatgggaatattgaaacgtttgaaaaaggattccatcttcctaaatatttagattatgaaggtaaacgatgtggacgtgtggatgatttaaatctaatagatgaaagcattaaaaatcaacttataatagtggaaggaaaaaaattcagacatttaaataacaatgatatttttattttccctaaaaaaagaatacccctctcaaaagagtcatattctattacacatggtggtattacaatagaagagctgattattccatttgtagaggttttagaggtgaagaaaattgttaataggtcttga

SEQ ID NO: 1317 - DNA, 2001 bp, Methanosalsum zhilinae
atgagtccatgtacttggagagatagtatacttaacgagtttgtgccaaatataagcaaagtcatcattgtaatcgatcctgatgacctgctgaccgaagaaaaactctcgcttgaactcaaaaaccgtggttttgatcttattgatttcaaagactctgttgaattcaggtatgcctatgaatcaggatacagaactctatgggaccagggacaacagaccaaacagacagttgtgattcgtgtgtgtaactcccagtgggatgccctgccttatgatctcctcaaagctggaagaatattgaaatttacccttggtaatattttccccaatctaagttattctataattgagaaacttgatagcagtttcctggacgaattatttgctgctcaaaacaaatattctccacgtaaactaggtaataatgacaccaaggattttgtaatccaatatgtttttggtattgtaccatatcttatcaccaacgatgttgaactacttcgtacactgcttaggattcattacaataagcttaaactaccgccaatcttgtctggtcgactggttcaaatcttaaaaggtaacagtcgttttaatgattggccacttgaaattatcgtctccgatgatggagccttttttgcgtttctacaagaacgttggcccccattccttgatgtgctggctcacggaaaccatatcattaaagaaacatcagcttacaatctgaaatatggaggaccaaccacattaccatttgatcatgaggacatccgtgtttacattgacaatctttttgttgaaggcaagctcattccagttcaaaaatctggcacaaatatagaaacaaatccctggataaaaagcggtgtatctgaaacaaatgacaatgatcctaacattcgtattaatggtcttcttgagattatcgaaaatgaaattcccgttccagagtcactttattcagaatggatcgacttcgcaatgaaatgggcagaattaagagcacttattcacacaaccaatcaagttaatgaattggaacgattcaagcagatcagtactttagtcaacaataagttcacaaactggatgcttgaacgctatgctggtctgattaatcttcctccaacaaatcctgcaatgcttcatcatgttcctcgccgaatggttagggaacttgaatctgaaaaaaacatgagtttggctcttgttgttgttgatggtctatctcttgaccagtgggtcactataaaaaaagttctccatgaacaagatcctaatttggttatgaaagaatcagcaacttttgcctggatacctacattgacttccgtatcaagacaggcagttttctcgggaagaacacctatttcctatccaaaatcaattaacacaacaaacaatgaaggaaacctgtggcgccagttctgggaagacaatggtgtatcacgtcagaaaattgcttatcagcgtagcttgggagatggtaatgtttgcgagattcttgatgatagtttcaatctaaaccaaacaaaggtcattggtttggtcgttgacaaggtcgacaagattatgcatggtatgcaactcggtgcttctggaatgcacaatcagattaaacaatggtgcgaaggaggttttcttttttctctaattgaatacctcttagataacaattatcaagtatggttaacatcagatcatggcaatatagaatgtaatggaaaaggacgttcatttgaaggatctatagccgaaaatcgtggcgagagagcaaggatttatcctactttggaacttagagattcagttgccaaaacattaccatttgcaataaaatggaatcctataggcttaccacctggttatttcccgttggtaactgagggagacgatgcatttgtcaaggaaggagaaactatagttggtcacggtggaatttcaatggaagaagtaattgttcctttggtaaaatttgaaaagaggagtcgttga

SEQ ID NO: 1318 - DNA, 2007 bp, Methylacidiphilum infernorum
atgagtagttggcgtgaccaaatcctgagtgagttcacaccccaggtcgcccggcttaccctgatcgcggatccggatcgcttgctccttgaagaaggtatccttgcagggatccgggaacggggctttgagctgataccgttcgaggatcatgtcgcctttcgctatgcctacgaatccaagttccgttcccgctgggaccgtggcgaggaaaccgatctggtggtcgtgctgagattggaatcacacgatctcaatgagttgccctacgacttgctgcaggctggccgcaagctctcgttttccttaagcgatctcttcccgactctcgactcttccgtggtcgcggcactcgatcgggctgatctcgacgccttgttcgatgcgcagacgaagcacgcaccggggcagctcggcgtcaacgctacgaaggacttcgtccttcgtcatgtgttcgggatcgcgccggaactcatcaaagagcctcaggacctgctccaggtcttgttgcgccgtcattaccgcggacaacgaatcccggccatactcgatgagcgctttatccaggtgcttcgtcaaaacagcctgttcgaggattggcctctggaagacatcattccggaagcgaaagcattttttgcgttcctgcaggagcgctggccggtgttcctggactcgtatgcaaagccgaaggacgatgccgtccacgaggacgctgcggactacggcttcaagttcccaggaccgccgcttttgcctttcggccacgacgacgtccgcatttacatcaacaaccttttcctcgagggcttgctccagcccgtacctcacgagcaatcacaagcgctcgccaagacatgggtggcttacggcatcaaagtctcacccgaggagaaccgtcgccgccgcatggaggggctgctggattccatcgagaagaagatccccacggtggaggcgcgtcatgaggagtggctccaatttgcctacccgtgggcggaactcgtatccttagagatgcagccggacaccaccctgcaggaagaataccgggagcgtctggaaggattgagatcccggatcgattctgcactcaaggattgggtgctgaagcactacgctagcctggtcaaccttccgcccgtgccgccggtgatgctgcatcacatcccgcggttcctcgcccgaaggctcgcggatgaccggaactcgaagatcgcttttctgctgatggacggtctcgccctggaccaatggatcgccttacgcgaggtgctcaaagagctggactcgaagctgctgttcgacgagaaggccgtttttgcttggattcccaccatcacctcggtttcccggcaggccgcctttgccggaaaagcgccgatctactttccggcaagtatccataccacagagaaggagcaggaactttggacacagttctggatcgatcaggggttgacgcagcacgaggtgacctacgccaagggactgggtgacggggacctggacaaggtctccgagtgtctcgcccggcccaggctacgtgtcatcggactggtcattggcaaggtcgacaggatcatgcacggcatggagctgggtgcagcggggatgcacaaccaagttcggcaatgggccaggcagggattcatgtggaaacttctcggcctgcttcagacccaaggtttccagatctaccttgcctcggaccacggcaatatcgagtcgaaaggcgtgggacggccttccgaaggggcgattgcggaccatcgtggcgtgcgtgttcgtatctactccgatcccaggctcagggatcaagtcaaggagcgattcccgaagtccctggagtggtcctcggtgggcctcccagaggactacctcgccctcatcgctccgaaccgggctgctttcgtaccggcgggtaaaaccctagtcggtcatggtggcattagtgtcgaggagctactcgtcccttttgtccagatctataggagggacggatga

SEQ ID NO: 1319 - DNA, 1539 bp, Moorella thermoacetica
atgatgagcgagaaatggtacgcaaagctggtcaataagataaaacgatcctaccacgacgtggtcgtggttgttgaccatgaccgcctcggccggttgccggagttgcgggcggcgctcgctgatacttttgcccttcacgactacaagggggagctgccattgcggcgtttcctcagggagcataccggccagcgcatgcttatttttaagcaccctgagcacggccacctgccgtacgatgtggagaccaggtcggacgtgatttcttggcatctccaggaaattttccctaaattgcacccggccgcgcttgaaggtttgtcggaagaggactaccagcgggtctttgaagcttacgtgcagaaggagaatacattccaggtgctgggcctggaggaaaccaaggaagtgctggccgggtggctgggtacgtcgatggtcggcgggttcgtcccggatatcgttgccagacctagtcaggaaggggaaggcgggataaaatgccgctgccaggccctggtccgggagattgagggactcctgtcgcgccgcccggttgactggcgggctgtagcccccctgtggggtgagttatcctattgttactgccaggcgaggagcaaaccgccggagatagatgctctggaccagaagattagtggagcatttaccgaatatatcctgactagttatcatgagcttttctacgaaagctatctcaccaggccggccaccgttgataaggtgctacccttcctggcctaccagccggctgccaaaaaggtattgatatgtatggatggcatggggttccaggaatggtgctgcctgaaacaatatctggctggtcgcgggatagatagctttagcgttacggctgtcttcaccctgctgcctaccttgacccgggtttcacggcgcgccctgttttgtggccggcctgctcttggggaccgcgtggaggaagaaaggggctttttgcagtttgtccgggagaaatggctagaaggagagcgacggcaggcgggggtgttcatgaatatagatggcaggtggcggcatgagtatttggattttgactacctcgccctggcctgtaacctggtggacgatctggctcacgcctctgtgagtgtgcaggatagcaaggaattgatgcagaaaagccttattatgcatctagatggctccggatttgccgagaccatgcagcggctgctggaggagggttaccgggtttacctcgtcgccgatcacggttcggtatggtgccggggcaacggccaccaggccagcaagtggctgttggaagagaaggccaggcgggcgctgttattccccaacaagcttctggcagaggattttgcggcggggaaaaacctaattgtatacgaaaacagcagtctttttggagatgcagtggccgtctttccgcccggtcgggagatgtttgggccaaagggggaaacggtgattagccacggcggcatccacatagaagaagttattgttcccttcatcgaagtgcaggcataa

SEQ ID NO: 1320 - DNA, 1995 bp, Nitrosococcus oceani
atgagtagttggcgagacgctatcctgaacgactttgtacccaacgtcagcaagctgaccctggtcgcagacccggattgcctgatgaccgaggaaaagctggccttggaacttcgcgggcgcggcttcgacctgatcgagttcagtgacccggtcgaattcaggtatgtctatgagtccaagtaccgttcgatctgggaccggggtgagcacaccgatctggtggtggtcctccgcttgcaagatgcggagctggaatcattgccttatgatttattgcaagtcggaagaaaactctcttttaatcttggtgagctctttccttatctgagctatccggtcatcgaaaagctggaccgcgcccttttggatgtcctctttgaggcgcagaggaaaacaccctctgaccgtctaggggacaatgccactaaggacttcatcctgcgacatgtgtttggtattgcgcctgaattgatagtgagtgaggtggaactcttacgattgctgctccgcttgcattacggcaaagtccagcttcctcgtatcttatctgatcggcttgtgcaggtgcttaaggggcagggtgctttccctacttggccgctagatgagatcgtgccggacgaagaagctttttttgcctttatccaggaacgctggccagtgtttttgagcaagcttgagccgggcaatgaggtgcgagaaagatcgcttgaggaaatcctcaactatcctgggcctagcgtgcttccttttgatcatcaggacatcagagtctatatggacaatctgtttattgaagggaaacttacgccaattcagaagccagaggttgctattgatgccgggtcctggattcgttgcggtgttatcgaagccagcgccggtgatgacgaaatgcgcatttcccgtcttttcgggctggtggagaagagcctgcctacatcggaatcccggtattcagattggatcacctttgcgctgaaatgggccgagttatctgccttggttcattgtggctccaacagagaggataaggctcggcttctgcaaaccgacaatgcgctgaatgccacctttgcccggtggctgagtgtccactatgccagcctcattaatctgcctccgaacaatcctgcgatggtgcaccatgtgccacggcgtttagcccgggatctggaaaatgccaagaatagccgtgttgctttgctggtggttgatgggttagcgctggatcaatgggccaccattcgcccgattctccaggagcgggaccgcagccttattatgcgcgagtcggcgaccttcgcctggattcccacgctgacttccgtgtcccggcaagcgattttttccggcaagccaccgctctattttccgtcatccattaagtcgacccataaggaagaaaagctctggaagcagttctgggaaggccatggcctgtcccggctggatgttgcctaccagcgcggccttggcgacggtgatgctgcaggcgtcctcgactcggcaatccaccccgggaagaccaaggtggtggggctggtcgtggacaaggtcgataaaatcatgcacggcatgcagctcggctcggccgggatgcacaaccagattaaacagtggtgccggggtggtttcctcggattactcatcggctacttacttgatcacggctatgaagtttggatgacatccgaccacggtaatatcgagtgccagggcaagggtcgtccctctgaaggagtcaccgctgaaacccgcggtgaacgggttcgagtttatcccactgcggaattgcgggctcaagtggccagcaaattttcttttgcccatgaatggctgccggtagggttgccatcagattatttcccgcttgttgccggtggcagcaacgcatttgctacccctgacgaagccatcgtcggccatggcggcattacccttgaggaagttatcgtgcccttggttaaatttgagaggaaaacacggtga

SEQ ID NO: 1321 - DNA, 1995 bp, Nitrosococcus watsonii
atgagtagttggcgagacgccatcttgaacgactttgtacccaacgtcagcaagctgaccctggtcgcggacccggattgcctgttgaccgaggaaaagctggccttggaacttcgcgggcgcggattcgatttgatcgagttcagtgacccggtcgaatttagatacgcctatgagtccaagtaccgttcgatctgggaccggggtgagcacaccgatctggtggtggcccttcgcttgcagaatgcggagctggagtcactgccatacgacctgctccaggcgggccggaagctgtcgttcaacctggggaatctcttccccgatctgagctacccggtcattgagaagctcgaccggagtttgttggattcgctttttaaagcccagcgcaaatcgccgccggatcgaatgggtgacaatgccactaaggacttcatcctgcgacatgtgtttggtattgcgcctgaattgatggtgagtgaggtggaactcttaagatcgctgctccgcttgcattacggcaaagtccagcttcctcgtatcttatctgatcggcttgtgcaggtgcttaaggggcagggtgctttccttacttggccgctagatgagatcatgccggacgaagaagctttttttgcctttctccaggaacgctggccagtgtttttgagcaagcttgatgcgggcaatgaagtgcgagaaagatcgcttaaggaaatcctcaactatccggggcctagcgtgcttccttttgatcatcaggacatcagagtctatatgggcaatctgtttattgaagggaaacttacgccaattcagaagccagaggttgctattgatgccgggtcctggattcgttgtggtgttatcgaagccagcgccggtgatgacgaaatgcgcatttcccgtcttttcgggctggtggagaagggcctgcctacatcggaatcccggtattcagattggatcacctttgcgctgaaatgggccgagttatctgccttggttcattgtggctccaacagagaggataaagctcggcttctgcaaaccggcaatgcgctgaatgccacctttgcccggtggctgagtatccactatgccagccttattaatctgcctccgaacaacccggcgatggtgcaccatgtgccacggcgtttagcccgggatctggaaaatgccaagaatagccgcgttgctttgctggtggttgatgggttagcgctggatcaatgggccaccattcgcccgatcctccaagagcgggaccgcagccttattatgcgcgagtcggcggccttcgcctggattcccacgctgacttccgtgtcccggcaagcgattttttccggcaagccaccgctctattttccgtcatccattaagtcgacccataatgaagaaaagctctggaagcagttctgggaaggggttgggttttctcgtctggatattgcctaccagcgcggccttggcgacggtgatgctgcgggcgtcctcgactcggcaatccaccctgggaagaccaaggtggtggggctggtcgtggacaaggtcgacaagatcatgcacggcatgcagcttggctcggccgggatgcacaaccagatcaagcagtggtgccggggtggtttcctcggatcactcatcggctacttacttgatcacggctatgaagtttggatgacatccgaccacggtaatatcgagtgccagggcaagggtcgtccctctgaaggagtcaccgctgaaacccgcggtgaacgggttcgggtttatcccactgcggaattgcgggctcaagtggccagcaaattttcttttgcccatgaatggttgccagtagggctaccatcagattatttcccgcttgttgccggtggcagcaacgcatttgccacccctaacgaagccattgtcggccatggtggaattgcccttgaggaagttatcgtgcccttggttaaatttgagaggaaaacacggtga

SEQ ID NO: 1322 - DNA, 2037 bp, Parvibaculum lavamentivorans
atgagccaatggcatcagcgcattcttggctctttcacggccgatctttcccggctgtgggtggcctgcgatccagacggcgtgctgctggacgagaagctgctggccgaactgcgcgcccgtggcttcgaggtgatgggatacgacgatccgttcggattccgcgcggagtacgaggaacggtatcgcgcagcgtgggatggcaacgagcagccgccatctccggcgctaatcgtacatctgcggcacgacaacgcgaacgatctgccgtgggacatcgtgcataacgcccgccctgcggtacggctcaatcttgccgaattgttccccaagctggcctatagcgcggtccggcaggtggaaccggaacgattggaaatcctgttcgacgcccatcagaccgagttgcagtcggcgcgcggtgaaagcgagtcgaaggacttcattctcgaacacgtctatcagttgacgccgcgatctatccgcgcgcccgtggacttctggcgcgaagtgctgcgactgcactttgccggtcgcgctttgccggagccgttcgccgagcatgtggcggccatcctgcgcggcagaggtttactcgtcggccacgcggttgcggagtggctgtcatccaggagcgcgcttctgcgcgtggtgcaggacgcctggtatctctatctggaaaagctgaaactggaaggcaggcgtatgtccgaccccgatccgccgccctttggcgtaggcgagatcggcacagcgattgagattcccttcgatcacaccgacgtgcgcaccatcgtagactcgttgttcctcgacggtagcttgcatccgctggcggtatccgacgttcccaccgccgtgcctggctggatcaaagcaggcatcgtcgaggatgtttggtcgcaattcgcgctggcggaaaaaggcatcgaggcgcttgccacagcggtgccggaagcggacgccccgcacaagttctggggcgacttcgcaagacgctatggcgagatgctgagccgggttcatgaattgcccggcaaggatgccggtgaaaggatggtcgcgatccgggagcgcttcaaggcgatccaggcgctgaccgacgaacggttgcaggcgtggattgccgccggccactacgccgacctgatcctgcaaccgacgatcaaaggcccggtgatggtgcatcacgttccgcgtttcctgcggcagcgccgtagtgcgggcgaagccaaggtggcgctgctagtgttcgacgggttggccttcgatcaatgggtacagatcagggaacacctgatcgccaaccagcagcctttggcattcgacgagagcacggctttcgcgtggttgcccacggtgacgtcggtatcccgtcaggcgctgttctcgggcctccggccacgcgagtttgacgattcgatagaccacaccaacaaggaagaagccttgtggaaggcgttttggcaaaacgaaggcggtattgcgtccagcgaggtgatataccagcgcgcactgcatcaggtcgagcaactggacgccctggaagccgacattgcgagccgcaagcccaaagtcttggggctggtaatcgatgaggtggatgaacggctacacaaagagcgctccaaggaagatgtagcgctgtggatcgggcgctggctcggctccggttttgtcgagcgcctgttttctttcctgctgagcgaaggtttcagcatctacgtcaccgcggatcacggcaatgtcgatgctgtcggcataggccggcccaatcagggagtgatcgcggaaacacgtggcgagcgggtgcgggtttatcgtagcgatccgttgcgcgccgagtccgcgatggcctacccgggcacggtcgccttggacatcgccgggttgccagcgaacttcaaacctctcttcgctggcgggcgcactgccttcgttccgaacggtgatcaggtggtcgtccacggcggcgtgtcggtcgaggaactggtcgtccccttcgtgagggtctcagatgtgaatggagctgggtga

SEQ ID NO: 1323 - DNA, 2037 bp, Parvibaculum lavamentivorans; identical to SEQ ID NO: 1322

SEQ ID NO: 1324 - DNA, 1950 bp, Planctomyces brasiliensis
atggctgattggcgagacagcattctcaaggagttcaagcgtgacatttctcgcctgacattggtatcggacccggacggcctgctgaccgaagaacgaacgctggcgacgatcaaggaacggggcttcgatctgatcccgttcgaggactcgattgcgtttcggtatgcctacgaatcgaagtaccggacgatctgggacgaaggcaagaagaccgatctggtggtggtcctgcgctccgaaggtgacttggagtcgttgccctccgatctttaccacgccggtcgcccactggaattcagcctgcacaagctgtttcccaatctgaactacccggtgctgcgggcgctcgacagttctcatttggatgctttgttcgaggcgtatcaacaacaacaggggtcggtgctcgccgagaacggaaccaaagagttcatcctgacgcattgcttccgcatcgtgcctcggttgatctccacgccggtcgccttgctcaaagagttgttgtcgatgcactcccgtggtgcttccatacccgacatgttgatcgaccatctcctctcatccttggaaggaaagtcggagttcaaagattggccgctgcgagagatcgtttccaatcgagaggcattgcaccgattcttgcaggagcagtggccggtctacttgaagtcgttgacgggcggcccggcgggccttgtgccgtttgaccatcaggacgtgcgtgcctacgtcgatacgctgttcctcgaagggcagttgaaacccgttgcggtcaaggactccgagtcgctgcccacttgggcgcagatcggcgtgaagcacgacccgcaagccgacgcactgaaacgtctcaaggggctgatcgatctctgcgagaagtcgctgccctcgacggacgctcctcacaaggactggcaaaagttcgctcggacatgggcggaatccgttgttctacgctggcaactcgacgccagcgtgagttcgaccgatcagcaaagttggagcgacctgcacgagagcatcgaagatcgctttgcggaatggatgctcagccgattcgcttcgctgcatagcctcccttaccgacccgagccggtgatggtgcatcgaatcccggactacttggcgtgggtgcgggccgagaataacctgtcgaaggttgctctggttgtcgcagacgggctggcgctggaccaatggctcttgctccgtcgatgtctcgacgagaagcaggtgtcatggcgctttgtcgaagaaacggcaatcttcgcttgggtgccgacgcttacctcggtgtcacgccagtcgatcttctctggattgatcccgcacttgtattcggactcgttgtacgacacgtctcgtgagccgaagcattgggagaagttctgggaggatgaaggcgttagccgggacgccatcgagtacgccaagatggtcgagtcgggccagtcggagaacctcgacttgtgcctccagaacccgcacctaaacgtgctggggatcgtggtcaacacggtggacaagatcatgcacggagaacatcaaggaaccgtagggatgcacgacgccattttgcgatgggcggatgatgcgatctcggtcgtggaccgtctgctcgacgagggcttcgaggtctttctgactgccgaccacgggaacgtggcggcggcagggatgggcttgccgagggaaggcgtcttggtcgaggtcggaggaaaacgagccagaatctacgagagtgcgaacgtccgtgaagaagcgaagtctgaatatccagagagcatcgaatggccgaacatcggattgccgccagagtgccatgtgttgttgccgaagggactccgggccttcacgccggaaggaaaacgagttgtgtcacacgggggcatcgccttggaagaggttgtcgtgccgttcgtgtggattgccaaggatgaagtatga

SEQ ID NO: 1325 - DNA, 1950 bp, Syntrophothermus lipocalidus
atgaactggcgcgaccacattcttaaaaacttacagccaggcgtatcaagacttactttagcggctgaccccgacggcttgctcctggaagaagatattctctcagccctaggggaaatggggtttgatgtccttgtttttagtgatcccatcacctttcgttatgtgtatgaagtaaactatcgctcaagatgggatcggggcgaagcggcacatttaatagtggtggtaaaaggcggcccgcaggaactgcgccgcctccccttcgatgtatggcagaggggccataagcttttcttcagcttagccgatatctttcccaaactcagctatccggtagttgcggctgtggagaagtccgacctggataagctttacagtgcataccagaattacaatggccctacgctgggggagaaggcgaccaaggattttatcttaaaacatgtttttggcataatacccgaccttatcaattcaccggtcgaactgatgaagatattgttatcgcggcattgcaattttgtgactgtgccctcggttttggacgaacaccttatccattgtttaagagaaaagagcgtttttaagaattggccgctggaagacatcattcccaggagggaagccttttttgctttcctgcaagaaaaatggcgtcgcttcctggagagcacggccaaaggagagaatttcaccgaggtcccctttgagcattatgacatacgggtgtacatcgacaacctgttcttggaaggcagtttaaggcctgttccggttgcgagtacggaaggtatgcccgcgtgggtcctggcaggtgtgctcttagataagcaggctaacgaaaggcgcaggattaagtggctattagagaagatacgacaagatttgcctggagaaacagcgtcccacagggactggcagcgcctggccgttctgtgggcggaattgcttgtgcttagccgggaactgaatcaggacatagaagctgaaagcaaactaaaaattgaggaattgcacgatcaattggaagagcgctttgcgagctggatgctcgtgcgctacggctccctggccaacctcccctatacttccagaccggtgatggtgcaccacatcccccgctatctcgcccatctgcgcctcaaagagggagcaaaaaagatcgccctgatcgtcactgacggcctggcattggatcaatggctggttatccgcaatttcctgagagacaggtacccggcgcggcgaatcgaggaaaaccaggtctttgcctgggtaccgaccttaacttctatctcacggcaggcgctgttcgctgcagagccgcccctgtatttcaaggacactctgacgacaacctcgaaagaagaacagcactggcacaaattttgggaagacagcggggtcaggagaggaaatacctactaccataaaggtttgggtgacgagtcggtaagtgaaattggagaatttttaggatcacagttcgagatcgtgggtctggttatagataaagtggacagaatcatgcacggcatggagctggggacagcaggtatgcaccagcaagtcaggttgtgggccgaacagggttacctgatacagctaattgattatctccttaaaaataaatttgccgtctatctgacttcggatcacggtaatattacggccaggggaataggccgtttgccggacggggtcctggctgaaacccgtggtgagcgggccagaatttatcattacgacgtttttcgacagcagatgatggaagaaatagaaaatgccatctgttggcctggttttggtttaccccagggttactccgtgctgctggccaggggccggtcagcctttgtctcaaatggtgaagaaatcgtaagccacggcggaatatctttggaagaggttgtcgttccttttgtcaggatttgggaggagcattga

SEQ ID NO: 1326 - DNA, 1920 bp, Tepidanaerobacter acetatoxydans
atgaaatcagcagttattgcaaaacttaagcaaagccctataccattcatattattatatgatattgatgatattacttcatcggaagatatcctaacttctattacctcacagggctttcaattagtaaattatgatgattccattgcatttaggtattttttcgagaaaaactttcgagaaaaacccgattgcaacgtgaaacttgtacttaaggtgacaggctatcacaactatatgccatatgatattgaaagcagtttctataatattactctttcacttaaggaattgtttccgggcctttcttatagtatattaaaggaactggacagtgagctttataataggctatatagggtatataagtatatgggccaaaaccttagccagcgggaaacactagattttattttaaaaaacctttttggcatataccctgaaacaattaacaaatttacagacctaataaaggctttgatcgatttttactatgaaaatgattcgctgcctcaagtagtttcagattatcttgctgatttactaatgtgcaaggaagattttaaggaatatccggtgaaaaaactattagagggtgccgactctttctttgattacctgcagggacagtgggaaatctttgtaaagggtttaactagcactttgcctataaaaagtgcggtggacttttctcataaagatattaaaatatatttgggcagtctttttgatgaaggctatctaactcctgtccgaagtgataacattgacaacgtgcctctgtgggtgcaccgaggaatactgatagatgaacttggccaacttagggcaatttataataatttattggatcgcctttatgatacactcgataatataacttcttataaagactggttacaagcagcaaaagattgggctgaaatattggttatttacaatgatgaacgaatccaaggaaggcttgatgagaaggctttcatatcgatttccgatatgctaaacagcaggtttcgcacttggctttttgacaactataatctattaccatcattgtcgtatgctcgtgctccggttatggttcatcacatcccctggtatattaactatagaatgggaaaagatgctacgcaaaaagctgctcttattgtagttgatggtatggcgcttgacgactggcttatcattagccggtatttgaatcggaattcgagttgccgctttgaagaaaaattttgttttgcttggattcccacgattacttcgatatccaggcaagcgatattctccgggcaaattcctaggtatttcggcaaaactattttcagcactagtgaagatgaacgtcattggaagaaattttgggcagagcgtggcattagacctgatgctatttattacatgcgaggcataaaacattttaacgaaaatggattaagagatatcgttgaaaaccctaaatctaagatgctaggcttggttgtaaatatgatagatgatatggttcatggtcagcaaatgcttcgagcaggactgcatcaaaatcttcggctttggatggaaaaagaaggttttaaaaaattcctgcagactcttttagaacggaattttgatgtttacattacgtcagaccacggtcatgttagcagtgtgggtcagggcaaccttcgggaaggcttggcggtggatagggccgctgacagggtaaggatttatgaacaggggaagaattatgaaacggctttaaaaaggtacaaggcatacaaatgggcaggttacggtcttcctgaggagtataactatattatcagtgacggatgttactcttacggcaaggataatgaaaaaaatcttactcatggcggtatttccattgaagaagtaatcgtaccatttatccatataaggaaggaagaataa

SEQ ID NO: 1327 - DNA, 1920 bp, Tepidanaerobacter sp.; identical to SEQ ID NO: 1326

SEQ ID NO: 1328 - DNA, 2007 bp, Thermanaerovibrio acidaminovorans
atgggtagttggcgtgaccaaatcctgagtgagttcacaccccaggtggcccggcttaccctggtcgcggatccggatggcctgctccttgaagaaggtgtcctcgaagggatccgggaacggggctttgagctgatcccgttcgaggatcatgtcgcctttcgctatgcctacgaatccaagtttcgctcccgctgggaccgtggcgagaaaaccgatctggtggtggtgctgagatcgccttcgagcgatctcgatgccttgccctacgacctgctgcaggctggccgcaagctctcattcaacctgggcgatctcttcccgaatctcagctaccccgtggtcgcagcgctcgaccgggctgatctcgacgccttgttcgatgcgcaggcgaagcacgcgccggggcagctcggcgacaacgctacgaaggagttcgtccttcgtcatgtgttcgagatcgcgccggaactcatcaagcagccatcggacctgctccgggtcttgctgcgccgccattaccggggcatgagaatcccggccatcctcgatgagcgctttatccaggtgcttcgtcaaaacggcctgttcgaggattggcctctggaagtcatcattcccgacgcgcaagcattctttgcgttcctgcaggagcgctggccggtgttcctggattcgctcgcaaagccgaaggacgatgccgtccacgaggacgcggcggactacggcttcgagttcccaggaccgacgctcttgcctttcgaccaccacgatgtccgcatttacatcgacaaccttttcctcgagggcttgctccagccggttcctcacgagcaatcgcaagcgctcgccaagacctgggtggcttacggcatcaaagtctcccccgtggagaaccgtcgccgccgcatggaggggctgctggtagcaatcgagaagacgatccccacggtggaggcgcgtcatggggagtggctccatttcgcctaccgttgggcggagctcgtcgccttggagctggagccagacaccaccctgccggaagaataccgggagcgcctggaggcattgagatcccggatcgattctgcgctcaccgattgggtggtgaagcgctacgcgagcctgatcaaccttccgcccgcgccgccggtgatgctgcatcacatcccgcggttcctcgcccgaagcctcggagacgaccggcgcacgaagatcgcttttctgctggtggacggcctcgccctggaccaatggatcgccttgcgcgatgtgctcggagagctggattcaaagctgcggttccgtgagaacgccgttttcgcctggattcccaccatcacctctgtttcccggcaggccgcctttgccggcaagccaccgatctacttcccggcgagtatccataccacagacaaggagccgggcctttggacgcagttctgggtcgatcaggggctgacgcagcatgaggtggcttacgccaaggggctaggcgacggggacctggacgaggtctccgagctactgagccggcccaggctacgtgtcgtcggactggtcatcgacaaggtcgaccggatcatgcacggcatggagctgggtgcggcgggcatgcacaaccaggttcgacaatgggccagacagggattcatgcgggaccttctcggcctgcttcatgaccgcggtttccaggtctaccttgcctcggaccacggcaacatcgaggcgaaaggcgtgggacggcctgccgaaggggcggtcgcggacctgcgcggcgagcgcgtgcgtgtctactccgatcccaggctcagggctcaaatcaaggagcgattcccggagtccctggagtggccctcggtgggcctcccagaggactacctcgccctcatcgctccgaaccgggctgctttcgtgcgggcggctgaaaccctcgtcggtcatggtggcattagtgtcgaggaactgctcgtccctcttgtccagatcgataggagggaccgatga

SEQ ID NO: 1329 - DNA, 1923 bp, Thermoanaerobacter brockii
atgattaaggattatatcagagataaattatctttagaaggttctaatcttatattgctggaggataaagatgacattttaaatgaagaaagtattatagagatgctgcataaggatgaatatgaggtatataattatcaggaaccggatagttttaggttttattatgaattaaattatagaaaattttatgattcttttgtagaacctaataagaaatttatacttaagtgtaaagaaataaatgaaattccttatgatatacagacagtttttcatcatgtgtccatatcattgaaagaaattttcccaaaacttgattatgctgttttaaaagaattgggtacggactttttggggaaaatttatgaggcatatcagttatacgatggaaatgtgttgggggaaaatgggacaaaagattatgtgatgaaggctgtttttggaattattccagaacacataaataatttaaatgagcttgtaaagacatttttacgactgtattacaaaaatatggaactacctaaggtgctttctgattatttggagtataaattaaagcagaaagagaatttgaaagatgtacctttaaatgaaattttatcaggaaaggatagattttttagatttgtaagggtacaatggaagaattatatcaatgatttaatagaagggacgcataatgccaaaattgattttagtgactatgacattagggcatatcttgataatattttttatgaaaaatatattgaacctatagaagtggaaaatattgaaaggcttcccaaatggacgtatgttggaattttgtatgatgagaatgaaaggtatttgaaagaatatagaaaaatgatagaaaaaataaaggagttgttgagttttagtaagtcgtatagggattggatgaatttgtcttctttatgggcagaggttttgaacattttttatagtaaaaaacttgctttaaatgagaatgaatttaatgagataagtaagttgattgaaaacagttttatggaatgggttgttttgaattatagcaatctcacttcaatttcttatgtaaatggacctgtaatggttcatcaaattccatggtatttgaattatattatgaaaaaacaaaaatatgataggatagcacttttggttttcgatggtatgtcggtagataattggtatttgataagaagatatttgaataaaaatgctctgtggaatattgaagagaaaaagtcttttgcatggatcccaactttgacatccatttcaaggcaggcaattttctctggtgatatacctttatattttaaagatacgattttttctacaaattacgaagaaaaacgatggaaaaagttttggatgaatcaaggatataaaggtgatgatgttttttacataaaaaatgttatggagttcaataaaagagaaataaatgatataataaataaccgtaatgcgaagatagtaggtattgttgtcaatattatagatgaactaatacatagtgcgattttatcaattgaaggattatatcaaaacatacagttatggcttgaaaagagtaggatggaggattttttaaaaaaattgatttctaaaggatatgagatttttatagcttcagatcacggaaatattgcatcaataggcaaagggaaattaaatgaagggcttcttgttgaaaaagctggagaaagggtaaggatatatgagagtggaatagattatgggagaagtttatatgatgataaatcttttaaatggattggttttggtcttcctaaggaatacaattttataatatgtaaagaaaataatgcttttggtgctcaaggagaacagatgataagtcacggtggtatttcaattgaagaagttatagttccatttgtgcacataagtcatatttaa

SEQ ID NO: 1330 - DNA, 1923 bp, Thermoanaerobacter italicus
atgattaaggattatatcagagataaattatctttagaaggttctaatcttatattgctggaggataaagatgacattttaaatgaagaaagtattatagagatgctgcataaggatgaatatgaggtatataattatcaggaaccggatagttttaggttttattatgaattgaactatagaaaattttatgattcttttgtagaacctaataagaaatttatacttaagtgtaaagaaataaatgaaattccttatgatatacagacagtttttcatcatgtgtccatatcattgaaagaaattttcccaaaacttgattatgctgtcttaaaagaattgggtacggactttttggggaaaatttatgaggcatatcagttatacgatggaaatgtgttgggggaaaatgggacaaaagattatgtgatgaaggctgtttttggaattattccagagcacataaataatttaaatgagcttgtaaaggcatttttacgactgtattacaaaaatatggaactacctaaggtgctttctgattatttggagtataaattaaggcagaaagagaatttaaaagatgtacctttaaatgaaattttatcaggaaaggatagattttttagatttgtaagggtacaatggaagaattatatcaatgatttaatagaagggacgcataatgccaaaattgattttagtgactatgacattagggcatatcttgataatattttttatgaaaaatatattgaacctatagaaatggaaaatattgaaaggcttcccaaatggacgtatgttggaattttgtatgatgagaatgaaaggtatttgaaagaatatagaaaaattatagaaaaaataaaggagttgttgagttttagtaagtcgtataaggattggatgaatttgtcttctttatgggcagaggttttgaacattttttatagtaaaaaacttgctttaaatgagaatgaatttaatgagataagtaagttgattgaaaacagttttatggaatgggttgttttgtattatagcaatctcacttcaatttcttatgtaaatggacctgtaatggttcatcaaattccatggtatttgaattatattatgaaaaaacaaaaatataataggatagcacttttagttttcgatggtatgtcggtagataattggtatttgataagaagatatttgaataaaaatgctctgtggaatattgaagagaaaaagtcttttgcatggatcccaactttgacatccatttcaaggcaggcaattttctctggtgatatacctttatattttaaagatacgattttttctacaaattacgaagaaaaacgatggaaaaagttttggatgaatcaaggatataaaggtgatgatgttttttacataaaaaatgttatggagttcaataaaagagaaataaatgatataataaataaccgtaatgcgaagatagtaggtattgttgtcaatattatagatgaactaatacatagtgcgattttatcaattgaaggattatatcaaaacatacagttatggcttgaaaagagtaggatggaggattttttaaaaaaattgatttctaaaggatttgagatttttatagcttcagatcacggaaatgttgcatcaataggcaaagggaaattaaatgaagggcttcttgttgaaaaagctggagaaagggtaaggatatatgagagtggaatagattatgggagaagtttatatgatgataaatcttttaaatggattggctttggtcttcctaaggaatacaattttataatatgtaaagaaaataatgcttttggtgctcaaggagaacagatgataagtcacggtggtatttcaattgaagaagttatagttccatttgtgcacataagtcatatttaa

SEQ ID NO: 1331 - DNA, 1923 bp, Thermoanaerobacter pseudethanolicus; identical to SEQ ID NO: 1329

SEQ ID NO: 1332 - DNA, 1941 bp, Thermoanaerobacterium saccharolyticum
atgatgataaattatatagttagcaaattgaataggtgcgataacaatgtaatattggtatttgatgaagacaatattttatcaaatagtgatataattagcatgctaaaggaaaatgggtatgatatctacgattttaaagatccagatctttttagatattattttgaaagtaaatttaagattgctccaagtgggaaattgaaaagtggtgtgaaattattaattagatatgacggtaagattacaataccgtatgatataaagatgtcttcttctaatattgcaattacattaaccgagctattcccgaaattaaattatactgttttaaaagagatgcatccagacatacttaaaaaactttattcgatttattcgtattacacaggcaagcaattaagtgaagcagaaactaaagaatatatattaaaaaatatatacggaattgttcctgaggttattaataattatattgatttaattaaaacctttgttaatatttattacaaaggaatagagctgcctgagattatctttgactatttcatagaaaagctaaatagcaaagattattttaaaaagataaaaaataaagaggtgttttatactaaagataatttttttgcatatttaggtgatgaatggaagacatatttaaatgatttattaaataagacttcaaatgcgacgattgatttcggcaataatgatataaaggtgtatatcgataatttattttatgaaaaatatattgatcctgtggtgatacataatattgatgcactgccaaaatggacacatgccggtataatctatgatgaaaatttaagaaggaagagagaattagaaaatattttgtcaagcgtaaaagaaaagattgataaggcaaaatcgtatagggattggcaaaatatttctgagctttggggagaatcattgtatattttctatagtggagatcgctctaaccatgaattccaggatgttcaaaaagaaatagaagatagatttagaaaatggcttattaatgaatatagttatctttcttcggcatcttatgttaatggaccagttatgcttcatcatgtgccatggtatataaattataagatgaaaaaagatggttttgataaagtagcgcttttagtttttgatggaatgtctcttgatgattggcatattattaaagattatctgaaagaaaaaggatattggcatatagagtcaactacgtcgtttgcgtggataccgaccttgacatcaatatcaaggcaatcgatttttgcgggtgaaatacctgtgtattttaaagatacattgatgacgaccaattatgaagaaaggcaatggaaaagattttggatgaaccaaggtttatatttggacaatgttttttatatgcgaagtgtaatagattttaaagatagcagattaaatgatataataaataatcgtaaggcgaaaattttaggctttgtggtggatattgttgataagttgattcatagacaaatactgtctgtagatggattatatcaagatttaaaattatggcttaaaaatagtgattttaatttatttctcgatagtttagcaaaaaacggatatgaaatttttataacatccgatcatgggaacgtatattctattggaaatggacggctaaatgaaggcagtattgttgaaatagctggtgaaagagtgaggatttacgaacgcggtttaaattatgataaagcgctcaataacaataacgcattcgtatggacaggttttggattgcctgatgattacagttttatactctctaatggaaataatgcatttgtagataatgatagaagaattataacacatggtggagcatctattgaggaagtgattgtgccatttattcgcgtaagaaaggaagaacataatgcaaaaagtgggctttga

SEQ ID NO: 1333 - DNA, 1941 bp, Thermoanaerobacterium thermosaccharolyticum
atgatgataaattatatagttagcaaattgaataggtgcgataacaatgtaatcttggtatttgatgaagacaatattttatcaaatagtgatataattagcatgctaaaggaaaatgggtatgatatctacgattttaaagatccagatctttttagatattattttgaaagtaaatttaagattgctccaagtgggaaattgaaaagtggtgtgaaattattaattagatatgacggtaagattacaataccgtatgatataaaaatgtcttcttctaatattgcaattacattaaccgaactattcccgaaattaaattatactgttttaaaagagatgcatccagacatacttgaaaaactttattcgatttattcgtattacacaggcaagcaattaagtgaagctgaaactaaagaatatatcttaaaaaatatatacggaattgttcctgaggttattaataattataatgatttaattaaaacctttgttaatatttattacaaaggaatagagctgcctgagattatctttgactatttcatagaaaggcttaatagcaaagattattttaaaaagataaaaaataaagaggtattttatactaaagataatttttttgcatatttaggtgatgaatggaagacatatttaaatgatttattaaataagacttcaaatgcggcaattgatttcggcaataatgatataaaggtgtatatcgataatttattttatgaaaaatatattgatcctgtggtgatagataatattgatgcactgccaaaatggacacatgccggtataatttatgatgaaaatttaagaaggaagagagaattagaaaatattttgtcaagcgtaaaagaaaagattgataaggcaaaatcgtatagagattggcaaaatatttctgagctttggggagaatcattgtatattttttatagtggagatcgctctaaccatgaattccaagacgttcaaaaagaaatagaagatagatttagaaaatggcttattaatgaatatagttatctttcttcggcatcttatgttaatggaccagttatgcttcatcatgtgccatggtatataaattataagatgaaaaaagatggttttgacaaagtagcgcttttagtttttgatggaatgtctcttgatgattggcatattattaaagattatctgaaagaaaaaggatattggcaaatagagtcaactacgtcgtttgcgtggataccgaccttgacatcaatatcaaggcaatcgattttttcgggtgaaatacctgtgtattttaaagatacactgatgacgaccaattatgaagaaaggcaatggaaaagattttggatgaaccaaggtttatatttggacaatgttttttatatgcgaagtgtaatagattttaaagatagcagattaaatgatataataaataatcgtaaggcgaaaattttaggctttgtggtggatattgttgataagttgattcatagacaaatactgtctgtagagggactataccaagatttaaaattatggcttaaaaatagtgattttaatttatttctcgatagtttagcaaaaaacggatatgaaatttttataacatccgatcatgggaacatatattctattggaaatggacggctaaatgaaggcagtattgttgaaatagctggtgaaagagtgagagtttacgaacgcggtttaaattatgataaagcgctcaataacaataatgcattcgtatggacaggttttggattgcctgatgattacagttttatactctctaatggaaataatgcatttgtagataatgatagaagaattataacacatggtggagcatctattgaggaagtaattgtgccatttattcacgtaagaaaggaagaacataatgcaaaaagtgggctttga

SEQ ID NO: 1334 - DNA, 1941 bp, Thermoanaerobacterium xylanolyticum
atgatgataaattatatagttagcaaattgaataggtgtgataacaatgtaatcttggtatttgatgaagacaatattttatcaaatagtgatataattagcacgctaaaggaaaatgggtatgatatctacgattttaaagatccagatctttttagatattattttgaaagtaaatttaagatcgctccaagtgggaaattgaaaagtggtgtgaaattattaattagatatgacggtaagattacaataccgtatgatataaaaatgtcttcttctaatattgcaattacattaaccgaactattcccgaaattaaattatactgttttaaaagagatgcatccggacatacttgaaaaactttattcgatttattcatattacacaggcaagcaattaagtgaagctgaaactaaagaatatatcttaaaaaatatatacggaattgttcctgaggttattaataattatattgatttaattaaaacctttgttagtatttattacaagggaatagagttgcctgagattatctttgactatttcatagaaaggcttaatagcaaagattattttaaaaagataaaaaataaagaggtattttatacgaaagataatttttttgcatatttaggtaatgaatggaagacatatttaaatgatttattaaataagacttcaaatgcggcaattaattttggtaataatgatataaaagtatatattgacaacctattttatgaaaaatatattgatcctgtggtgatagataatattgatgcactgccaaaatggacacatgctggtataatttatgatgaaaatttaagaagaaagagagaattagaaaatattttgtcaagcgtaaaagaaaagattgataaggcaaaatcgtatagagattggcaaaatatttctgagctttggggagaatcattgtatattttttatagtggagattgctctaaccatgaattccaagacgttcaaaaagaaatagaagatagatttagaaaatggcttactaatgaatatagttatctttcttcggcatcttatgttaatggaccagttatgcttcatcatgtgccatggtatataaattataagatgaaaaaagatggttttgataaagtagcgcttttagtttttgatggaatgtctcttgatgattggcatattattaaagattatctgaaagaaaaaagatattggcaaatagagtcaactacgttgtttgcgtggataccgaccttgacatcaatatcaaggcaatcgattttttcgggtgaaatacctgtgtattttaaagatacactgatgacgaccaattatgaagaaaggcaatggaaaagattttggatgaaccaaggtttttatttggacaatgttttttatatgcgaagtgtaatagattttaaagatagcagattaaatgatataataaataatcgtaaggcgaaaattttaggctttgtggtggatattgttgataagttgattcatagacaaatactgtctgtagagggactataccaagatttaaaattatggcttaaaaatagtgattttaatttatttctcgatagtttagcaaaaaacggatatgaaatttttataacatccgatcatgggaacatatattctgttggaaatggacggctgaatgaaggcagtattgttgaaatagctggtgaaagagtgagagtttacgaacgcggtttaaattatgataaagcgctcaataacaataacgcattcgtatggacaggttttggattgcctgatgattacagttttatactctctaatggaaataatgcatttgtagataatgatagaagaattataacacatggtggagcatctattgaggaagtaattgtgccatttattcacgtaagaaaggaagaacataatgcaaaaagtgggctttga

SEQ ID NO: 1335 - DNA, 2217 bp, Burkholderia thailandensis
atgaaggtccctgcacatcagatcagttttcaggcgaagcaggcgcacgaggcggacccgctagcaaggttcatccttttgcggctgcccttggatgccttcgatggcacggcggtggatgtaaacgcggcgagctggccggtctctacctgcagttcccctttagccgttcgcgacgctatgcgccgctatgccgctagcacgacaccagttgttttgctgtttgcaggggacgagagtgagttaggttccgacgtactggcacgctgcaccaagcgacgcgccatcacgcacgacctctggcaaaccgtgctggctctcttcagggcggcgcacattgatcctcgcttggctcgacatcgctggctggctgaactgctcgtgcgctacatgccagcagagggctacgcccctgttcgctcactcgttttggaccaggatcgcgcttggaaggagctgttcaaggttgtgttaggcttcgagtcctatccaccgactgaacttgacttgttgaggtgggctggcgatgctcaacggcgtgagcaaatcaaaactttggaagaccccgcgcgtcaagaaacggtccaatgccttcgggaaactctcggcgatttggtggacttcattttcgctgccatcgatacagggagcgccgatgagctggttgctattgcaatgctttgcgaagcattggaagacaaggccattggctcagagtccaacagggccaaagtcgcagcccggctggaagtcttgttcgatggactgacgatctcgtcgcacaccattcatcagctggccggagcagccgatgcttggttcgatcgagcctctgaagtcgccaaacagcagcaggttgcgcgctatgaatcgttggtgacgcagctcaaggccgagccactggcggcgcaggcaaggtatggaattactgcactgcgcgagaagactaaggcgtttgctgccgcgctgaacgacatcaatttaccggaggctatttcccggttcgggcgcttgatggcgcatcgaggcccggtcctgagcagtcactccgagcttaggtgcaagatggctctgcgcttggtgagctggctgaggaaaactgtcagtacttttccatcgtcgttgaacgcgctgtctgaacggtatcggaacgagatcggctgggttgactgggcgcaaaccgtgctgctggaaggtgacgactctccagacttggcgaacgcctatggcctgcttcgagagaaaactcggattcagagagacttgttcgaccagcgtttcgctgagtcgctggcggctgataagcctgatggcaccaccttgattgcgatcgaggatgcgctcgataaatgcgtcgcaccggttgtggtggccgggcgttgcttgctcatcgttgtggacggaatgagtgtccccgtatttctggaactgcaccacagtttaaaggagcacggttgggtccagttcgaacgctcagaaggggcctgttcgactttgctgaccatgttgccgtcgacaacagaagcatccaggacgtcgctgctttgtggcatcgcttgcgcaggatcggcatcaacggaacgcgcggcgttcagcgcctatccggctcttgttgccccgtctgtcgcaggcaagccgccagcgatatttcacaagagagatctgctcgacgcttctggcgtcgccctttcagacgatctcagaactgctctgagcgacacccggcaacgagtcgttgccgttgtgatcaacgcagtggacgatcatttgatgaagtctgaccagctgcggttgcgctgggacattgcgcagttcaagggtttagatgcactgctggcagaagcgcgttcctccgaacgtgctgtagttttcacaagtgatcacggccacgtgctcgaccaagatacggtcatgctgggggcaagccctaatgcccgatggcgcgagccgagcttggagtcctacccgggggagattgctttaacgggtaatcgagtcaaagccgccagcggcatggacgaagtcgtccttgcatggaacagcaagttgcgatacgcgaccaaacggaacggctaccacggtggctgcgcgccggctgaagcgctagttccgattgctacctaccgctatggagccaaagcatttgatggttggagcattcgcgacgaagtggctcccgactggtggcaggttgatcgaggcggatttagggaatga

SEQ ID NO: 1336 - DNA, 2850 bp, Candidatus Accumulibacter
gtgaatgtattgctcaacccgtcggcccgccagatcgtcgcccaggtcgatgcggttctgcgccacgatagaacagcagcggtgatcgccattcgtgcgcagcacaacgaagactggccatcgacgttggcggttggcgatcgggagttttcagtggcctggtgtccgtcgccgattgcggttcgggaacgactgctggcgcttgctgacggggcgatggccgatgcaggccaggtatccagcgaatcgccagggaaattgcctggtctggtggtattgacgcctctgtccgatcatgtgctgggcgccgacgtgcttgcacggttttcgcgtggcaaggttttttcggttgaagcgtgggatatgttgcgccatgcgtttcaggccaaggcaatcgattcgcggcttgctcgctggtcctgggttgccgaggcactgttggagaatctgccggcaggcggctatccaccagtcgccggcggcgttctcgatgttgacgcggcctggtcgcaggtcttgcgctgcgtccttgggatgaccaccgaacatgcggggcgtcccgacctcgcttcggtgttgcgctggaccctctcacccgaggcaacacgtcgctacggcgatcttcatgagaaggcacgccaacaggtcggtgaatggttgatcgagattctcggttcctgtggacggttggtcgcgcaggtgctggaggcgggctacggcggcgagttgctgccgatcgccctggtatgcggcatggtcctcaagcggcctgacgacacgccgcttgcaccggaattgctggccgcggccgtgcggctggagcgctacaccggcgggacgccaattccgcagcgtgagggactgcgtttgcatgcggcggccgttcaggtcacaaaagccatggatgcttcgactttgatgcccgtcctcgatgtggcagaccagcttgttgcatcccttcacctgatggcgttcgccgaaagatccagcgacttgtcttcagggttcagcgcacgcctgagcattttcgccaacgcaattacagaatttctcgcaacagggtccgagaagaagccggctgctcgctcggctgccacggctgcggtgctggtcgtgggaggctccgtcaaagagcatcgcctcgcggttcatcaggcacacggggtgcgccgtgtcgagatggccatgcggctggtccgctggctgtcgaacgctgagcctggccaacacatcgggctggattcgttggcgaagtcctatgccgacgaaggcgcatttgccgactgggcacgccttgccttgatgggaagcgatgacctggcggtcgtgactcgtgcctacagtgctttgcgcgaagcggcccgggcgagacgcgagtcgtcaaacaggcagttcgcgctggctctgtccgcctggaatcaggggggatgcccaaagctcgaccatgtcgtcccggtagagcagatcatcgccgacgtgctcgctcccgtggcaacgctggcgccggtgctgctgctggtcgtcgatggcctgtcgtttccgatttatcgggaattgcttgaggatgcacagcgacaaggctggaatgaagttttgccgagtgcgcaggaaaaggcatcggttggcttggcgaccattccatcgatcaccgagatctcccgcaccagtctgttttgcggaaaactgctgcaaggtcaggcagccaacgagaagaccggctttgcccagcatcccgcactcatccccctcgtaccatcgaaccggcctggtgcaagaccggtcttgttccataaaggtgacctgacatcggccagcgatggcgtcgccctgtccgaggtggtgcgcgatgccatcggcagccgagagcgaaagcttgtggccgttgtcttcaacggtgtcgatgatcacttgtcgggctcggctcaactgaaccaccgctgggcgctggatgacctgcgcctgatcaagccacttctctacgaggcacgcaacgccgggcgcctggttctgatcactgccgatcatggtcatgtgatcgacgaggccacacatgcccttgcgaatccggcgcaggacaaggcagttgcgagctattcagatcccgcaacgggtgatcgctggcgaactgttgccggcgctcctgtctctgccgaagagatcatgctctccggcgggcgggtgatgacaccgcatgggcaacggcagatcttcgttccgtggagcgaaaccctgcggtatggctcgcggaagaacggctaccacggcggcatcagtctccaggaaatgctggtcccgatcacgcttctgactactggcagtgtgctgccagagggtttgcgccatgcacccagcgccgcacccgcctggtgggagcttgctgccgagacaagccccgcgtcccccggctctcaggctcaggccaaagcgctcagcaggaaaagcaggccgccaacaccaatagccgcgggacagcagtccttgttcgaactgccagcgcttggggtggttcaggccacggcagtcgagcaggactggattgctgcattgcttgaatcgacggcattcctgtcgcagaaacagtgggtggctcgtgctggtgtgacggatgaagagatccgggcgctgctggaagccttgtcggagcgaggcggaaaagtgtccaagcaagccctggctgcacgcttgggcatgcctttgctgcgggtttccggcttcgtcagtgcagcgcgtcgcctgttgaacgtagaccaggctcctgtgcttagcctcgatgaagcggaggggacggtcgggctgaatcgagcgctccttgagacgcagtttggtgggcgcaccgggagagcacaatga

SEQ ID NO: 1337 - DNA, 2583 bp, Corallococcus coralloides
gtgagcgctgcccagctccttctccgtcggctcctcgagcaatctggtggtgccagcgagacgggctacctgctcgtgatcgacggcgaagggctcgagaacctgccggaccagatgccgacgccgaagggctcctacggcgtgcatcgaatctcgtccgagctcggacttcggcacttgttgtggaaggcgaaaggagcgccgctcatcgccgtgatgcccgaggacgtggcgaggcgtatccagaacgccccggacttgctgcggcgcgcgcgcaatcagcgcgtccacgcgctctcggtgaacgacgtgctcgaggtcgtactcggcgtgcgagtggtcggcgccgacgcgccctacatgcaacagctcgcgctcgagaacgtcgaacgcctgggcttcgcgatgagccaccgcacgctgcccacggtggtcgaccgccggctgcttacggagctgctcgtcgacgtgagcgtgggcgagcaggtgcggacgcgcagccccgcgcagcttctggccgcctgggtacaggagccgccacgctggtcgccgaacatcagccagctcgtgcgtgacgcgatgccctcacttcatggcgacgaggggcgccttctcgcatgggcgctcgccgagcccgagaagcgcctgcgcgatctcgttgtctacggcgcggtcctcacagtcgaagccgccgagctgccgaagcccgcgtggggcccgctttggagggcagccaccgagccgccgctcgagatggaccggcgcattcttcggcgcaccgtcgcgcgactcgcggaggagacgctggcgctcctgggcgacgcggcgggtgaccttctcgccggcgctgatcgcgtcgggcgcgagagcctcacgcccacccagctccaaaccagtcgcgtgcttccgctcgcattctctgaccgctgtcacgaactcgcgcagcaggcggccagcgggaaagcgatcagcgcagccgacatcacgtggctgtcgaaccaccgcgcggcgcgcatgcatcgcggcgacctcgcggtgctcgagtcgatggcgcgcatctcgcgctacctcaaccagcccttcagcccgaagctcgacctgcttgagcaggtgcgcgactaccagcggggtggtgcgttcgtcgacctggcgatgatgcaactgcgccgcgcgctcgcgagcagcgtccactaccacgccgaggccaacaagctgctcgccgcgtgccgtgagcgccgcgaccgcgagaaccgccacttcgccgagacactctccggcggttacgaggccgcgctccaccgcgaggggctcacgccgctgcaccgactctggaagcgcacagtcgcgcccgtgtggcagcatgagcccgacgcgcgcctcttcctcgtcgtgctcgacggctgcagttacccggtgttcctcgagttgctctacgcgctcgcgcaggacagctcgttcccactcggcatcaagcccgacgcaagtgggctcgtcgcaggccttccggcgctctcgccgctgccgaccatcacgagccacgcacgcggcgccatcttcctcggcgagctgccgaacgacccgctcatctccgagaccgtgttcagggaccaggacgaggcgaagaccgacaaagcgcgcttcaaccaaaacgccgcgctaggcagccgcaatcggcgtctcttcctcaagggggacctgaccgacggcggccaggagcttctttccgcacttgaggacgagtcgctctcggtggtcggcgtcgtgttcaacgcggtcgacgaccagatcggttcgtcgaatacgggcgcgacagtgaagatctcgccggaggacatcaccgccttcaagcccgccctgcgagtggcgctcaaggcgaagcggcgcgtgctcatcactgccgaccacggccacagcctcttcgtcgacaagtcgctccgctccggtaacggcaagacgccaagatacaccgcgctcggcaagcacgaaccggtgcccgagggcttcatcgagatcaacatcgccgggctcggcggaccgcccgagcggcgcgcctttgcctggcgttcgggcgcctatctcggcgggtcgcaggtcggattccacggcggctgtgggctcgaagaggtggtcgtcccgcttgcgtggctggagcgcgatggcctccatgccgacgagcccgcgtggtggtacggacgcggtgcgctcgccgaggtcaccaccgaggtgaagccggtacagccgccgatcgtgacgccgctgccgtcggacgaagtccccgcgaagccgaaggcgcagctctcgctgttcaacccggccgacaaggcggactcgctgcccatccccaaggagttgctcgcgaagctcagcctcgacgagaagagcatcctcgtgctcctgcgcgagaccggctctgcccgggcgagcgagctggccgagcgtctcaagaagaacccgggccgtctcaacggactcatgcggtcgctgcgccggaccctccacgaggggggccacgttctcttcagcgatgaagtcctgccgagtggggagaccatgtaccgctaccagccgaaggagggacgctga

SEQ ID NO: 1338 - DNA, 2856 bp, Corynebacterium variabile
atgagtgcccggctgcggatccggcagcgggacatcgacgaccagatcgactacctcaccggtaagaactaccgcgaggccgtcctcgtcctgcagaccggccagggctgggacgggccggcgacctggacccggcgcgatggccacgtcgcggtgacggccgtgcggacaccgctggctctgcgccacgcactggtgcaggcgcaccagcagaaaccgccggtgccgtggaccgtcttcctcaccccgctcggagacgccgatctgcccgccgatgtccgtgaccggctgcgcccctaccacgacgtccgggtcgtcgacccgacccgcagtctgctcagcaccttctccgcgaccggggttctgccccgcgtgatcgccaccggggatatcgcggagaccctcaccttcctcgacacctgtgggggcaccgtggtcccggcccctgccggacgcctgtccaccgaccacctcgccgcccagctgctgtcctccggactcgacctcgtcggggccggggtcgacgccttcggacagttctccctggccgacatcctgcgctggtccgcctcccctgtcgcagccgaccggtgggcccggttcaccgacgggctgcccgaggcggtgcagaccaccacgctcgactggctgggccgggccctgggtcccgacgctgccgcggccctgcggcatctgcgtaagcacggaccggccgatttgctgtcgcgagggctggcagccgaggtcctggtcgtcgacccgcaggccaccgaggccgagagcgcggcccggcaggtcgccacgatcgccttcaaggtcaccgcgagaaccgggacgccgactgccgcggaactcgccggctggtcgacggccgcggtcgccgcggtgcgcgcgtcgcggcagggcaccgacaacacccatgtcggtgggcttgaccggacggtgcggcaggccgaggagatcatcagcagccccgaccagctcgacgccggtgcacttctccaccggtcctcggtgtgtcccggcgggttcgccgcacgcatcgaccggctcgccgcggccctgtccgcgtccctctcccctgctgcgacggaccccactgccgcctacgatgccctggactacgcccgggcgcaccttgatgcgtccgacgccgcccggaaccgggacatcgccggggccgaggccgcgctgcgcctgtcgcagttcctgcgcaccaccgacgccaccgggcccacgggagctgccggacagcccacgaccgggctggcgaactggctgcacctgcagcgcacctcccgcagctgggcggacttgtgcgtgaacaccgcctggcagggttcggcgtcccccgcactccagcaggtcacccgacagatggccgaccgtgcccggcaggttctcaccaccggtgaccgtgtcttcgccgccgaggcgtcggtcgccggtgcctcccgggacctcgccgggaccaccctgctggtcgaggacgtgctggaccgggtcgtggcgccgctgctcgtcggcgacggtggcctccacccggtgctcctgctcgtgctcgacggcctgtccaccgccgcggcgaaccacctgctgacctcggtccacggggtctactacggccgctggcacaacatggtcaccgaggacgaggacctcgccaccgccctggcgatgtaccccacggtcaccacgaattcccgggccagtctgctgtccggccgtaccgccaccggtgggcaggacgtcgagacccggggactggccgagtggtacgccgcgacgacgaagggcctgcccggtgccgggacacccgtgctgatgcacaagggagacctgaccctgggagtcagcgacgaccactcgaccgacaaggtctcccagcaggtggaggacacgaccgcccacccgctcgtcgccgcggtgctcaataccgtcgacgacgccctcgacaagtccgatcccatcgaccggcagtggtcggtctcggacatcacccacctcaacgtcctgttgcaggccgccgcccggtccggacgcaccgtcgtgatggtctccgaccacgggcacgtcgtcgaccgtggacgcagctcccgggacccccggggcggcaacagtgcccggtggcgttacgcagagactccggtgccggagcgtggccatgtcgtggacggggaggtgacggtctctggggaccgcgtcctcaccgacgaccaccgggcggtcctcgccgtcgatgaggacctgcgctacaccgcgcgcaaggccggctatcacggtggactgacgctggccgaggcctccatcccggtgacggtgctgagccaggagccggagcagctgatcgcccggaccgcggccacgctgccgctggtcgacctggacgatgatctccgctacccgggctggtgggagctgcgtccggatgcggtttctgccaccggtgctacggacgtggtcccggccgctgctgcgcccactccggaggacctggggatgctgttcgacacgaccgtcgacatcgccgcgcctgccccgaccaccaccctgttcgccggactggagaagaaccccgggttcatccagggtgtggcggatgcacgggtgctcccgctggacgccgacggtgtcgccgaggtgctgcggaaggtcgcggcgaacaacaaccggatgacgcagaccgagctcaacccgatgctcggggtgtcccggatccggctgggcggggcgctcaccgacctgaagaggatcgtgaacgtcgacggtgtgccggtcttcgacaccgacggacgtgacgtggtcctcaatgccgaacagctgatccagcagttcggtctggggaccgggaggtag

SEQ ID NO: 1339 - DNA, 2682 bp, Frankia sp.
gtgaccgtggtagccgcgccggtcctggtccgggcgaaggtggccgaggtgctccgccgagacgagaaggcgcgcgtcgtcgccctggccgcggcgccggtgtggccgcacgacgaacgcctggaactgcccggtggccgcggcgtggtggtccggccatgcgtgtccaccctcgcgatccgcgacgagctgcaacaggtcgacgatctccctgccggggaggtactcgtcctgctcaccgagtacgaaaccggcgagctggggacgagcatcactgcccggctcgccggtcagaagatcctgccgcttgatcgctggcagcagctcaccagcctgtttcgggcacacggcatcgatccggccctcgtcgacgagcagtgggcggtgaacgcgctgctcgccacccccccgccggacgggtatcccgccgcgcgcaacggctacctggaccgggccacggcattggccacactcgccgagacccaggccgggctcaccccgctcgacctcgacctcgcgggcctgctgcgatggagcctcgacgccgaacacctcgcgcggtggcgcgcgttggacccggcggtgcgtaccggcatgagcggatggcttgccggccgcggcggtcgaggcgacgtggtggccgccgttctccggtgcttcgccgggccctacggtcccgacgccgtcgccgtcggactggtgctcgcggctctcagccatcccgaggtccgggacacggcgcaggtgccgcgcaccatgctggagacgcgggtggtcgacggcgctctcgccccgtccgtcgccgcggaatggggacgcgcggctgaagggctggttcagcggctgctcggccaggaggggcgggccgtggctggcggaatcctgcgacgcgccgaggagatcctggccgggcagggcgccgccgagctgtcttatcccagcgccgtcctcgaatccggtctcacccagcgcctgcggcacattggctcgcaggtcgccgcggtgctgcgcaagcggcggctacgcgccgaggatctggggccggtcgaacatgaggtggcgcggctgaacgcgcacgcgctggccgccgaccatgccgagcgggtgagtcgcgccgagatggccgttcggctgctgcgctggctggcccaggaggccgcgtccgcccgaccaccggcgccgagccttgccgaggcgtcccgtcggcagcaggaccaggacgcatgggtcgacctggcccgggcgcgggtgtgggagggcgacgtcgatcaggtggtcgccgcagcctaccggacactgtgcacgacggtcgacgcccgtcgccgcgaacacgaacggcggttcgcgaatctgctcgccgaccacacccgcaccgggtcgacgctgggcgagctgctgccggtggaggacgtgctcgaccagatcgtggtgccgctggccggccgatgccggctgctgctgctcgtactggacgggatgtccaccggggtggcgcgggagctgctcgccgacctgtcgacccggggctgggtagaacacaccctcaccccggcccgaccggtgctggccaccctgccgtcggtcacccggacctcgcggacgagcctgctgtgcgggcggctcgtggacggcacgcaaagccaggagaaggcatccttcgccgagcggggctggccgctgttccacaagggcgacctcgccgcggccggtgccggcgaggtgcttgagccgcgcgtcgcggacgcgatcaggggcgacgcccccgtggtcggcatcgttgtgaacaccgtcgacgacaccctggacaagggtgggcgcaccccctggaccgccagctcggtcgatcggctgctcgacctgctggccaccgcggacggatcgggccgggccgtcctgctggtcagcgaccacggccacgtccatgaacgcggctcccggctggtttccgacgacagcggcggcgcgcggtggcgatcatcggcgcgcccgcccgacgaggacgaggtcacgctcatcggcccgcgggtgctgctgggcggcggccggatcgtcgccgcctggaacgaacggctacgttatacggccctgcgcaacggctaccacggcggcgccagtgcccaggagatcgtgatcccgttggcgctgctgcgtcgggtcgacctcgacctgcccggttggactcccttgcaccatgccgcgcctccctggtgggtggagccgatggccacgggcaccacgccggccacaggcaccacgccggccacgggcaccacgccggccacgggcaccacgccggccacgggcaccacgccggccggacatgccggctcggccgcacagccggacctcggtctgttcgacgagtccgaggtgacgccgcaaccgtgggtggatcgcgtgctcgataccgaggtgatgcgggctcggctcgcccggatgcgtcgcggggccatgcccgcggaccggctcggggtgctcctgcgggcgctcgacgcccgtggcggcgccgccacgcgggccacggtcgcccgcgcgctcgacgtgccggacgcgcggatcgccagccacctcgccgcggcgcagcgggtgctgaacatcgacggctacgaggtgctgcggatcgatggtgacaccgtgcggctgaacgccgcgttgctggcgacgcaggccggtctgacgtga

SEQ ID NO: 1340 - DNA, 3132 bp, Frankia sp.
gtgaccgtcctgtcgcccacgacgagccccgctagcgcgggcgtgccccgggtgaccccggctgtggtgctcggccgggtcgcccggctgcggcgctccgccgccagcaaccacagctcgcagccgcaggtcctgctggtgcgcgcccagccggactggcccgcgcctgtcgatctggccgtcgccggccggccggtgcgagtggtgccctgcgtctcgccgctcgccgtgctcgaggaggtcacccgctgggcccgcgagcccgtcgaggacggctggctcgtgctgctcacggacgccgacgaggagcggctgggtgacaccgtgctcgcgcaggtctaccggcagcgggtcgacgtgatcgagccgtgggctgccgttctggaggacttcggcgccacgcaggccgatccgcggctgcacgcgcccgagtaccgctgggttgcccaggcgctgctggaggcacggccaccggccggctggccgcgccggcccagcggcctaatcagccgcgaggacgcgctcgcggagctcgccgtcgtccggcttggcctaaccgagtttggcctcggcgccgccgatctcgacatcgccaccctgttgcgctggacggccgttcccggcgcgatcgaggcgttccggcggctcggcgacgacgagcgcgccggcatcaccggctacctcggcgaccgcactggccgcgcgggccgggccttgttcaccctcgtcgccgctggcaacggcgagcaggcgctcgccctcggcctcgtctgtgactgcctctggccacggcgcgacccggacggctccccactgccgggcaccggcgacgccgccgccgtcgagcgggccaaggtccgcgtggagcgttacttcggcgacgcccgactcgacgaggcagccatgcgcgcgttcgccgacgccactcgagaggtcgtcgcgaccgcgctgacacagtcccgctcgggcgcgggccggctcgggctcgacagcggggcgacatcgttcaccctgcacccggacgacgaactcccagccctgctcgacaccgccgagcggctgctcgacgagctcgacggacgagccgccggcgccgtgagtgacatcctgcgggctgggttccagcatcggctatcgctcctcgcgacgacagttcgcgacttcctcgcggccgcggagtccggagtcgaccgcgcacttctcgcgactgccgcacgcgacgtcgtgaccgccgtcgtctcgctgcgcgcacactcgctggcgaacgtccaacgcgccgaggtcgaacgggccctgatggcggcgcgggtcgtcggctggctcgccgttcagccgaccggttcgctcggcgacagccaggtcggcgcggcacgcgcaggcggggaccgaccgggcaagccgacgacgctgcctgcagccctcgacgctcacctggacgactcggcctgggtcgacgtcgcgctcagccacctggcgggcggcgagctggcacccgccatcggcacggcgtacggcgacctgtaccgggtcgcggcccggcggcggcgcgccctcgacgcgtccttcgcacggctgctcgccgactgggcggccgggccgtcccggccagacgggccgctgctcgtcgaggaggtcctcgaccgggtcgtcgcgccagtcataaccgcccgcggcggcggccgggcgctgctggtcgtgctcgacgggatgagtgctgccgtcgctgcccagttggccgccgagctgcgccgcgaccgctgggaagagtgcgacccgctcggcgtcgattggggcgacaccgcaggtgagccagccggcgccgcccggcggcgagccgcggtcgccgtgctgccgaccgtcaccgccacgtcgcggacgtcgctgctcgtaggtcagctggtcaccggcgacaagacaaaggagaaggccgccttcgacggccacccacgctggggacggcggcccgcccgcctgtttcaccattccgacctcgacggcgcgcccggcgccccgctcgaccaggacctcaccgaagcgctgacctccgagaccccgctggtcgccgtcgtgatcaatacggtcgacgacaccctcgacaagggccggcagcgcgacgacggcggctggagcctggccgacgtcggcaagctgcgcgcggtgctggcctacgcgcgcacggccggccgagtcgtcatcctgaccagcgaccacgggcacgtcgtcgaccaccgggccacggggctggccgccgacgacgccgtctcggcacggcatcgagtcccggcggccggcatcgtcgcggccggcgacggcgaggtggtgctcgccgggccgcgggtgctagcgcccggcggccagatcgtcgctctctgggatcccgcgctgcactatctgggccgcaagggcggctaccacggcggcgcgtcgccggccgaggtgaccgtcccggtgctggccttcctgccgttccggctgtcgacaacgtccgcgagccgcgacctgccagtcggctggcgaccgctggctgaccagcgcccgcgctggtggtccctggagacgcccgatctgctcgccggcctcggtggtggcgacaccgccgtggtcagtccccgcagcagcggcagcgccgccgacctggccgaggggacggcgcttctcccgcgtaagcgccgacgggccgcagacgagcagaccggaccggcgctgttcgacctgccccagcagaccgacggtgcgggcgggccggtcgccgcccccggggcgccggacagcggcacggtggccgcacatgctgcgccgaccgagggtcaggagggcacagtagacgtcatcgtcgccgggttgttgcgctcggagctgttccggtcccagctcgaagggctggcccggaaggtgccggcggagaaagtcgaggccgcggtacgagcgctactgaacgcgaacggcaccctggcgacgagtgtcgtcgccgagcgagccggtgagctaccgcggcgggccggcggcttcgccgtcaacctgcggcgccttttcaacatcgacaactaccctgtgctggaggaactcgacgacggttacaccctgcggctcaatctcgacctgctgcgtgcccagttcgagctgagcgcgtga

SEQ ID NO: 1341 - DNA, 2610 bp, Haliangium ochraceum
gtgagcttctccgaggacgtgctgacctggatgctcaagcgcgtggagcagggccgcccgctccagcccgagcgctgcgacttgatgctggtgcgcgcgcaccgggcgctcgagcccgcgcccaagcggctcgccgtgcgcggacgcgagtggcgcgtggccgaggtcggcggcgagctggggctgcggcatctgctgctcgacgccacgccgctcatcgcgctgctggccgatggcttcgagccaccgctcgacctcaacgaccgcgcgtatcgccgtcaggtgttgcgcgtcgaggcccaggacctggtggccgcggcgtcgcgacgctacagcgcgcgcattcgcgacgagaccctggcgcggaccatcctcgaggcgcccgaggtgctggcgcagtcgagcgcggcgtggaccctggggccgagctcgaccacggtcaccgaggacgaggtcaagagcgtgctgctggctcgggcgatcggcctcgaccgcaagctggagcgcttcacgccggcgtcgttgctggcgcgctggatcgccgaaggggcgccgcagaccgcgctcggggccttgctcgacgcgcagctcgagcgcgtgttcggcgtcgaggggcggtggctggcgcaggcgcggcaaccccgggggctgcgcgcgttggtggccgctggtgcgctggccggcagcgaggcggggcgcgcgcgggcggccgcgttcgaggtcgacgggctcgacgacgagcgcgcctggagccggctgcgcgggctcgtcgaggaggccatgcgcagcgacgatcgccgcggcgccgaggccagcgaaggcctgcgcttggcagaagagcactatcacgcgctgcgcgccacgcccgacgaggccgggcgctttccgctgcttcggggcgcgctcgagaccgcgctgagcgagctggcgcgcgacgcggcgcgcggcatcgcgccgggctttggcgtgctcgactcgctgcgccgcaacctgcaccagggcgagctggccgagtcgctgcgcgcggtcgagcttgccggacgtctgtccgcattcgtcgaggcggcgtccgatacgcagcccgacgatgtcgccggctggctcgatgtcgctctccaccagaccgcctgggtcgacctggcgctgcggcgactgcgccgctgcgagggcgcgctgtcggccgacatcgccggcagcgtgggccgggttatgcaggcgacgctggcgattcgcgaccgatggaacgcgcgctttgccgcgcagctcgtggccgaagagccggccgtctacggcgagcgcgacgtgcgcgccgcgctgcccctgccgtcgctgagccgcgcgctgctacgtccgctggtgcaggccggtcatcgtgtgttcctggtcgtgctcgatggctgtgacctgtcgacctttctcgagctgatgcgcagcgaggacggcgaggcgtccgtgcacctggcgttgccctgcgccgagggcgggttcggcaaagagctggagcatctcggcgcgctgcgcgtcggtctggcgccgctgccgacgctgaccgtgcacgcgcggcgctcgctattcgccggctcgctgcccaagaaccccgcgctgcacgcggacgaggcctcggcggccaacgcctcggccgatcggcaagcgttcgccaacaacacctcgctgggcgatattccgcggcgactcctgctcaaggacgaggtcggcgtcgacggcgcgccggtgtgtgcggcgctcgacgatgcctcgctgaagctcgtggcggcggtgtacaacggcgtcgacgatgcgctctcgagtcacgagatgacggccataccggagtggaactgggccaacctcggcggcggtctgcgcgcgaccttgcggcacgccttcacgcgcaagtggaccgtattgctcaccgccgatcacggccacacgccgttcatcgcgcccgcgcgcaaggtggagaagggccgggggaagggcgggcatcgctggcgggacgcgccctttgcagacgcgatcgagctgccggtggacaatctgcggcctgcgccgctgtacgcgctcacgcgcacgggcgcctggaccggcccgcaggtgcgcggcttccacggcggcgtgagtctggaggaggtcgcggtgccgctggcgtttctcggacccgcgcgcgtgctgcacgagccctggcctgcgccggcgtggtggagcggtggcggcgagacccgcgcgcgagcgctggcgccggcgagcacggacgcgcccgcgtcgccgtccgcggctgctgtagtgcccgcgtcgccgcccgcggttgggggagccgcgccggctgcgcgtgtgcgagtgagcgcatcgatccgcgggacgaccctgccggctgcgctgcgcgacgagctcgcggcgcaggacagcgcgctcacgctcatcgagcacattgccggcaagcgccagatcgcgatgagtgcactcgccggcctggcgaagctgcccgcgttcatggtgcgcggccgattgagccaggcccaagcgcgcctgcacgcagccgggttgaccgtgccattcgacgaggaagagcgcgacggcgagacgtggtatttgtggaaggaactcgactga

SEQ ID NO: 1342 - DNA, 2739 bp, Microlunatus phosphovorus
atgaccaccgtcgcccggtcctcccatgccaccgttgtctcgccggccatggtgcacgccatgatcgactacgtcctcggccagcgctacggcagccgggacggtgtgctcggcatccgcggccggctggcaggcgaggatcggttgatcaccgagcatcgtggacgaccggttgaggtcagctacgccgagtcggccctggccgcgcgggaggtcttgctgggctggcgtcccgatcgctggtcggtgctggtcaccgaccgcggcgaggatgatctcggcgcgggagttctggctcatctgatcgggcagcggctgcgcagcccggacccgtggcaggccgtccggcagcgcttcggcgccgtcgctgtcgacgtacgactgacgtcgattcccgctcagcaggggattgcccagggactgctggaactgatgccggcccaggggtggccggccgcgcccgccgggatgctcacccgcgatcacgccttcggttccgtggcccggaccgtgctgggtctcgatgcctctgcactcgatctggtttccgtgctgggatggacgaccagagccgacgccacccgtggtctcggtgagctgcgcgaggccggtggcgacgccttggcggacgcaatcgtggactggattgcggacgctgccggtgaggcagccccggcggtccgccggctctttcgagatggtcggcccggcgatctcgtaccgctgggtctggtagtcgggttcctgcacgccgagacccgccaccgccatgaagccgaggtggctgttgcgcggctttcaggtcatctcggtggcatcggggacggtgccgtcgagcaggctatgcggttgatcggtccgcaggcggagacggtcaccgccacgctgctcaccgacgaccgcacgaggcccgatgccgatcggaccatagcggccgcggacgggttgatccgcgtcgccggagcagaaggcttggccgagcgatccgacctgttgcgaacgggcctacagcggaggctgcatcgactggctgacggcttgcgggcgccggtggcagctgccgaggagatcgagcacgcctggcaggcggtcctcgggcacgtgctggcgagggtggacccacggctgccggtgttccaggcatcggtccgactggcacgctggttgcaggtcgtcgagtcgtcggacacctcggtcaacgacacgctggcagcgctcagccgacgccaggcggataccgacgggtgggtcgacgccgcggtcaatgacgccgccggcggggtggacgatccggcattgggaacggtgctggaaggcctactgggactcgttcgtgccgtccgggatcgacatgacctcgagttcgcccagtccctggcgaacggcgtgcgggacgaggaaggagccgaggacggctacctggagcacgacggcagccgggtctacctgctggagcacgtactgccggaggtggtcttcccgctcgctcgcacggagttggtgctgctgctggtgctcgatggtctgagcaccggggtggccaccgaggtgttcaccgacctactggacaatccgactgccgtctgggcggagcggctggacgacgggagccctcgccgagccgccgcgttggcggtgttgccgagtgtcaccgaggtgagccggacgtcgctgttgtccggtgagctggtcgcgggtccacaggatcgtgagacgcgaggctacgaggagctgacccgtgctcacggcctgaccggatcgccgctgttccataagcgcgacttggaggtggccaggctcggccactctttggcggatcgagtgcggcacgccatcgacgatcccggcacccgtctggtcagcgcggtgctcaacaccatcgacgacgccctggatcggagcgacccggcgggcacccactggagcgtggacgccgtcaagcacctgcggcccctgctggaccgggcccgcgaagcgggccggaccgtggtgatcgcctccgaccatggacacgttgtcgagcgtcgtctcggtcagcagcgggcccaccccggcagcagcacgacccgctatcggaacgccgaagagccggtgcatgccgacgaggtgatgatcgaggggtcacgcgtactgagcgcggaccatcgcgcggtgctggccgtgtccgaacggctacggtacgggccgatgaaggccggctaccacgggggagcagcgcctgccgaggtcgtgataccggtgttgatcatggtcccgatcgaacgggcccaggatcccggggtgcgtctggccccgtcccagcaacctgcatggtggtccgagcctgtcggggccgctcatgccccccagtcaactggatcaccgaacgtcgatcctccgaccctgtttgatgacgagctggcggattcgtcgccgctgccgagaccggactgggtgacaaggctgctgcactcgtcggcgtatcgagcgcagaagcaggtggtcgggcggctggcgatcactgacgagcaggtgagccgagtgctcacgaggctcctgaccgcaccacagcaccgtctggcgtcgcagcagtgcgcgctcgttctcgaggtcgcaccggccaggctgccaggggccctggagcagatccgcaagctgctcaatatcgagggttacgccgtgatcgcgcgtgaaccggcgacgggcgcggtgatcctggatcttgagctcgcggtggaacagttcggggtaacgctgtga

SEQ ID NO: 1343 - DNA, 2733 bp, Micromonospora aurantiaca
gtgagcgttccgcgtgctgccgtccgccctgcggcggtccgacggaaggtggagtcgtggctcgccgaacaggacgaggcagacgccatcgtgctactcgcccggccgcagtggaacgacgaaccggtgctcaccgtggctggcagaaccgtgcgcgtcgtgccctgcccgacgccgctcgcagcacgtgccgccctcgccgaccggccgccgcacgagaagctcgtcctcctgaccgacctcacagacaacgagctgggagacggtttactggcccatgtcagccttcagcaggggcggagcgtggacccctgggacctggtcagccagacgttcgggggacaggtacgtccggactccacgctggtgcgtactggccggtgggtcgccgatgcgttgactgagcttgcgccggccgtgggctggccgccgccgaccggtacgatcctgacccgcgaccacgccctgagacaccttgccggaacggtgctcggactcgaacccgacgggctggacgctgcggggctgctgcagtggagcactgacgctccggcacagatgcgcctgggtgacctgccggtcgaatggatcgacggaatcggtacgttcctggtcgacgtcgccggtccggtcgcggtaccggtgctggcagccgtacgcgccgggcacggggtcgatgccattccgctcggtctgctggccggggtgctctggccgcgcgactccgcgcagtcctcggacgtcgaactcgcggtggcacggacccgcctcgagccgcgcttcgctggtacgcggctcaccgagacccaggcatgggcctacaccgaagctgccgaggcgtggatctaccgcgccctcgacgacgaggcagtgcggcacgacgcgcaccggatcctgcgtcgagccgaggacatcgccgaggagatcggtgtcgccggccggcttgccgcctcgcccctgctcccggccggcttcacccagcggatgcgcgccttcggcgccgcggtgcggttctccctgccggttgccgggccggccgtgcccgccggcgacctgatcgaacgggcacaggagcggctggccgaggtggaagcccaccggtcggccgaccggacgcgggtggagaccgcccggatggcggtccggctcttgcgttggctggccacccccgagcagcagccgcccgccaccatgctcgatgcggttcaccggcagattcgcgaggacggctgggtcgaccgtgctcgcctcgacgtcttcgacggtgacgtcgaccagatggtcggcgatgcttaccgggtcctgcaccaggcagtccacgcgcggcgctcccgccacgaccgccagtttgctgagctgtttcaggacgccaccggcgcggaacgggatccgggtgccctgttgcgggtggaggacgtgctggaccgggtgattcagccgatcatcgacaatggacggcgcgtcctgttgctggtcctggacggcatgggagcggcagccggaatcgagatcgccgaatcactggtgcgcagcggcgcctggaccgaattgaccccgcacggcggacagcgtacgggggtgctcgccgcgctgccgacggttaccgccgtcaaccggtgcagtctcttgagcggcatgatcagtgttggtgaccgcagcgacgagctgaagggattcgcggcccgctttccggacggggtgctcctgcacaaggccgacctgcggacgcctgctgggctggctgtcgaccgcgaagtcgccgccgcgatcgaggatccggcggtgcccgtggtcgccgctgtcatcaatgccatcgacgacgccctcgaccggagcgatccaggcaccgtcgagtggagcgccgataccgtcaaagggctgcgcgacctgctcgcgatcgcacaggaccgggtcgtggtgatggtctccgatcacgggcatgtcgtcgatcgcggctccgaggccgtggtgggcaagtcggagagcagcgagaacagatggcgtcccgctaccggtgatccggccgacggcgaactgctttttcgcggcacccgcgtggccctcgccgacggcgagctcatcctgccgtggcaggaggagctgcggtacggtccgcggaaggccggctatcacggtggcgcgagccccgccgaggcggtcattccgctgttgctcttcgcctctggcaacgacgagaccgtgcccggatggtcgggagctccggtcgccagcccgggctggtggcgggaaccgcttcgtcagaccgcacaggcggaccagcccgcggccgctgctccccgcaccgtggcagcccgcccgagccgccgcccgcgcgcagttgtacaggacgagagcctgttcgacctgcccgcggcatcgattccgccaccgcttgccggtccgccggctccagtcgatccggcatcggcgctcgtcgaagcgctgctggccagcccggtctacgccgatcggcggggaagccgggcacccatcccggacgagcgcgtggccgcgatgatcaccgctttgctggcaggcaacggccgggccactctggagacgttggccacccgggcgggagtgccggtgcaccgcatttccgccaccttcacggcactccggcggctcttgcaggtcgagggctacccggtcctcagcctggacccggacgggcggaccgcgaagctggacatcccgctgatgatcgaacagttcgtgctggcgccctcatga

SEQ ID NO: 1344 - DNA, 2661 bp, Mycobacterium gilvum
gtggctggaatgagcccgctcaccgccaccgagcccatcatccgggcccggttggacaaggccgcggccaaacgctaccgccggggcgtgctcggtctgcgcgccgaaccacattgggccggagactctttcgaccacaagggtatcccggtgacggtggtgccctgcccgtcggtgctggcgatctgggaggccatcgacacccgcgacgccgacggctggaccgtggtgctcaccgacgtcgatgacgacgagctcggcgacaccgtgctggcgcacctgctggacggccgactgatcacccccgacccgtgggatgcgttgcgcggcaacttctccgccaccaccatcgaacccgcgctctaccggggggtgggcaacgaccgcgcggtggcctacggactgctggccgtgctgtcccccgactcctacacccccgcccccggcggggtgctgacccgcgaccacgccatgaccaccctggcccgcgacgtgctcgagatcgtcaaggacaccggcgtcgaggtggactcgctggcgatcttggagtggacccgttccgcggacactccggccaacctggccgacctgcggacccgcggcggcggggacctgttcgacgcggcggccggctggctgggcagccgcgcgggcctgctggctgagccgctggaagccctgctgagcgccggccggatcaacgaactggtgccgctgggggtggtcgcggggctgttctgccaggacgacaccaccgacccgaaagcgctcgggatgttcctgggccactacgggctgaccagcctgggttccgaggccctgcacgcctggtacaccagtgcccgcggcctggtcaccaccgccctcaaagatccgcacaccgtgctgcaggccgccgcatcgattgccaacgacctgcgaatcggtactgctgcagcatcatcggatctgttgccgcaggggttgaatgcccgcatcaacgcgctggccgacgccctgaccgaggcgctgcctcaggcactgcccgccgacctggacgcggcactgatcactcctgccgtccaggcccgcatcgaggcgcgctgggccgaggtcaaccggcacttcctggctgccgactcgcagaccgtcgacgcgttctccggcgcggtccggctgtcccgctggctggcctcgccggtcagtgtcgccaccgggttgcccgaggccaccactgcctacctcacccgcgactcctgggtggacaccgcgctgaccaagacgcgccgcggcgccgagcagccgacggctgcggccgcgctgcgcgccgtcatcgacaccgtgctcgcgcggcgcgcccgccatgaccgggtgttcgcccacgcattggccgatgcacccaaaccccgagtgccgttggtggagaacgtgctgcgcgatgcggtggtgcccatcgcccgccagacccccacgctgctggtggtggtcgatgcgctgtcggtggccgcggccaacgatctggtgagcgccatccagcaggacggctggaccgaggtgtccgccgacggccgccgcggctgtgcgctggcagtgctgcccaccctgacccagcgcagccgctgctcgctgctgtgcggcgaactgcgcgagggcgccgacgacgtcgaacgcaggggctttctggcgctgatccgcgacgcccacctggaagccaccggcggcggaccggacccgatctttcacaaagcggcgctggacgcgatcacccccggcgcgtcgctggccaccgacgtcaccaatgcgctggccgacaccgaccaccggccacttgtggcggtggtgctcaactacgtcgacgacaccttgcatcacaccgatcccggcggcaccgactggaccatcgacaccatcacacacctgcgtgccctgctcggtgcggcccgcagcgccgggcgtgccgtggtgatcacctcggatcacgggcacctcatcgactacggcaccggcgccaaggtggaccgggccaatacctacggccaacgcgctcatggcgatctcgcgaacctcgaccccgagcgcgaagtcgtggtcgagggcccgcgggtgctcaccgacacccaccgggtggtgctggccgtcgacccagacatccgctacggcgcccgcaacgccggctaccacggcggcgccgccccggccgaggccattgtgccggtgctggcgttcgtggcgggccagctcccggcctgggcccatcaggtggctgcggtcgaaccgacttggtggcacgcgggcacgccggcgccgattccggcgatcaccaagcagggcggtgccccgagcctgttcgacgttgaggagccggtgcgggtgaacccgttgccggccaaggtgatcggcagcaggatctacgcagcgcagttcaagctggccgggcggatcgtgctcaccgacgcccagatcaagacactgttggccgaattgttggccaccggtgcgcgcgagctcaccctggcccaggccgcggccgcgctgggtgtggcgaccgccggcgtcaacggggcgttgatgcaggccaagcgggtactcgacgtcgagggatatgaggtgctggccgtcggcggcggcgtggtgaagttggacgaggccgcactgcgcgagcagttcggggtgacgtcgtga

SEQ ID NO: 1345 - DNA, 2820 bp, Nocardia cyriacigeorgica
atgaccggtaccaccgtcacaaccgcgatgcgactgtcgagaacgacggtcgcccagtacctctcctcgcacaaacggctcgccgaggttctcggcgcccccggtgaccctgtcacgctgctgttacgcggtgaacccgagtgggagggagacccggtcctgacccttgccgatggacggcgcgcgcgggtatcggtcggcacttccccgctgtcggtgcatgaaacagtcctggcacatgctcgggagatcgcgcccgatccgcgtgtgctggtggtgctgaccagtgtcgaggagcacgacctcgatccggccattctggtacggacccaccgcgggcgcgtgcacaccgtggaccgttgggacatcgtgcgggaaaccttcggtgccacggcggtcgaccccttgctcaaacgtgacgggtgggcgtgcgaggcgctgctagatgcggccggcgcgcacgggtggccgacggcccttgccggcggtgtcctctcccgtgttcccgctctcaccgcgctcgccactcgccgactgggcattcgggccgaggtcgaccggatcgatccactcagcctgctcgaatggtcccagcgtccgggcggtccgcaactgctactggatctgcgggcgcccgaacgagatgggctcatcggcttcctcagcgaaacggagcagtccggtgccaccggggcgataatcactgccctcgttcgcgccggacacgggcccgaatcggtcgcctacggactggtgtgcgcagccctgtggcagcatgccgccccggacaatgcggtgtaccaagcgcgtgggcgtgtagaacgttggctcggtgaacatccgcccgcggtggggcaggggctggaccggatgctggcaaccttcggccgcacctgcgaggactacatccgtgatctgctcgtgaaagcgcgctcctcgaccgacctgcacgacgaagccgacgaggcggctcggcatgcgcgcaagatcaccgataccgtactcgccgaagccgatctcctggtgcgccagttcggcgcagcaacggcggccgagcacagccccctgctccccgcgggtctcgaggctcgattcacggccgcgggccaggcactcggtggcggtgtgagcgacgatatcgataaggccgtgatcaggctgcgtgagcacgacctcgcccccgaccaccgagttcgagtcggtcgagttcggatggcgcagcgcctccaccggtggttgcgcaccaaccccgacccgaccggccgaagtgtcgccgaagctctcgaccagcagatgcgcgacaccgcatgggccgatcgcgccatcgattatctggaggcgggcggtgacgacgacccctcgctacgcatcgcgtaccacacgctggtgacaagagctcgcgaaatccgctacgagttcgatcgagagttcgcgacaaacttcgcggtgtggaccgaatcgggcagctcgccgggggaaatgttgaccgtcgagagcttcctgcatcgcgtcgttcggccgttggcctccgatcatcgtgtgctgctgctggttgtcgacggcatgagcgccgcgatcgcgaccgagctggccggcgaactgcgcggaaccttcgccgaatacgacccattgcccggcaccggcaccccctatcgccggtgcatggccgcggcattgccgagcctgaccgcggtatcgcgtacctccctgttcgcgggcaagctgatgaaaggtgaccagaaaaccgagcaacgattgttcccacaacaccggttctggggtgcgaagcgagcccaggtcttccacaagagcgacctgcgcagcacaccgggtgaacgattcggcgccgacctcggtgcggcactcgccgaccccgattgccatgtcgcgatcgtgctcaacaccatcgacgaccgactcgccaaggaagccaaactcgacgactccggctgggagactcgcgaaatcggagatctgcgagcgttgatctcggtggcaacggcccagggcatggttgtgctgatcaccagcgatcacggccacgtcatcgaccggcgcggaaagtcggtcgaagcggaaaacatcgagtcggcacggcaccgcctgccactcggcgagtacgaccgcctggccgaaacggaaatcgccctgcacggaccccgcgtcgtgtggcccgaatccggtgcgtcaatcgttgcgctgtgggataacgactcccgctacagcgcgcagaaggccggctatcacggcggcgccgcactggctgagatcaccattccggtactggcgttcctgcccttcggcgccccgccaccttctggatggcgcgagctcggcgatcagcgtcccgcatggtggcgcgacagcgccgaagcactgccgcaggcgagcgccgccgcggcagctccgacaacgcgggctcgtgtcgccggcaaggccgccgagaagttgaccgcccagatcacgctggatattccattgcctagcgcccagcctctgtcaccaccgactagcgccgccgacgggctgatcaacggactgctcagttctgagatctttgccacgcaactcgaacagctggcgcgtaagcccactaccgccaagttggagaaggcgattcgagcgctcttcgacggaccacaatcgacgaccgcactcgcccagcgtgtcggcgacccaccggcccgggccgccggcttcgccgcgatactcggacaactgctcaatgtggacggagcacaagtgctcgaggtccttccggatggacgcaccctgaagctgaacgtagcgctgctgcggtcgcaattcggtctgcgctga

SEQ ID NO: 1346 - DNA, 2727 bp, Polaromonas naphthalenivorans
atgagcgtctccgtgccccagatcaccgcccagctcgatgcggtgttggcgcgcgagcccggcgccctggccgtggcgattcgcgccgcctcccggcaggtgtggcccgactcggtgaatcagcgcggccgccgctttaccttgcgctggtgcgactcgatgctggcgatacgcgaagcgctgtgcgaggtcgagcaagcggatgccgctgatgcgggcctggtggtgctgacccccttgggttcccacgagatcaccgaagacattgcggcccgcttggcgctccgccaggtcttgcagcccaaaggctgggagatggttcgccagctgtttggcgccaaggagatcgatgcccgcctggggcgctttggctggatgccccaggcgctggtcgatggtgccgcgcagggggcttatgccccagtggccaatggttttctggacctggaaacggcctggaaggaggtgctgcagcgctttcttcaattgaatgtgccgcgtcccgatgctgccggcctgctgcagtggacgcagcagccgctgagcgatgcttcgctcaagctgctgccggccaacgcccgggcagacgccctgcgctggctggccgagtcggccggcacggcgggccggatggtgctggcctgcatcgaagcggggcgaaccggcgacgccatggcgctgggcctggtgtgcggggcgctgtacgctgcggccggcgaaggccaggcggcgctgggccacgcggccatccggctggagcggtttgtgggcgacacccatgtgggtgtgctcgaaggccgcgcctgggcgcaggcggcccaacaactggtttgtgagcccggcggcgccgaggtttatcgcccggccctggagcgggccgatgcgttgctcgccgagctgcgggtggccgaattcgcgcacctgagcgaggtgctgcccttgggtttggagcagcgcctgcgcgcatttgccatgctgctgagccagcatgtgcaggcccccaccgatgcgaccttgatcgcggtcgaggacgcggccaatcgcgcgctggcccacgagctggcgaccacccaaccccatcgggccgaccgcgtggaaatggccaggcgcctggcgcgctggctggtgcgccccgccactggcgccgccacggtggcagacatggtgtgctggcaggccgacgaaggcgcttttgtcgattgggcgcgctttcgcttgctgggcggcgatgagctggtggaggtgtcccacgctttcgaagcgctgcgcgcggccgtcatggcgcgccgcaatgccctggggcagcagtttgcgctggctctgcagcgctggaatgcgcaagcgcccagcgttgaggcgcgcatcgttccgctcgaatcggtgcttgaccgggtcgtgacgccactggccgccttgcatcccgtgctgctgctggtggtcgatggcctgagcaccagcattttccaggagctgtttgcccggcctgagcgcctgggctggagcgaatgggtgcccgctggcctggcacggcccctggcaggcgtggccgcgttcccgaccgtgaccgaggtcagccgcgccaccttgctgtgcggcaagctcaccacgggccagtcgtccctcgaaaagacggggttttccagccacgccgcgctgttggcccactcgaatgcgaatctgccgcccaagctttttcacaagggcgacctcagtgacgcgaccaacctgtcgagcagcgttcgcgcggccattgccgacccgaagcaaaaagtcgtcggcctggtctacaacgcggtggacgatcacttgagcggacccgatcagctgctgcaacgctggagcctggaagacttgcggctgctgctgcccatcctgcgcgaagcccgggctgcccgccgcgtcgtggtcatcacggccgaccatggccacatgctcgaagaaggcagcgcgcacatcaacggcggcgaaagcgatcgatggcgatatggcaccgaggccgctcacagcggcgagattgttttgtccggaggacgcgttcgcaccgccagcggcgccacgtcggtggcatgtttgtggagtgagagcgtgcgctacgcaggccgcaagaatggttaccacggcggcgtttccctgcaggaagtgaccgtgccgttgagcgtgctgctgcccacgggactgacgctgtccggatggcagcccgccttgcccgcccagccagaatggtgggacctgcccaatcagccggccatgctgcaaacgacagtgcgctcacccagtgcgcgcaagccaacggcgcgccagccggcggcacccgcgtcagcgcagacccccttgtttgacgcctccgtgacgccagtggcggcgccctcggcagcacccagcttgggactggcaccggcctccgactggatcgacacgctgcttcaaagccaggtgtatgcatcgcagcgatccctggccgcgcgggtggcgccccccgatgagcagatgcgcaagctgctgtcggcactgagcgagcggggcggaaaactctcgcgcgccgcgctcgcccagcggctgtcggtgcccgaggttcgcctcagcgggatgctcagcgccgtgcgccggatcctcaatgtcgatcaggccgtggtgctgggggtcgatgaggtggcgggcacggtggaactcaaccgcacgctgctgctgctgcagtttcgcatcacctcggtgggagacggccgatga

SEQ ID NO: 1347 - DNA, 2706 bp, Saccharomonospora viridis
atgaacaccgcacccgaagtcgaccggcgcatgttggaagcgctcgtcgaacactggctgccccaggcgaaaggacggcggctgctgctcgtccacggccgctatgtcgacggtgaccgggagttcggtgtcacgacgaaggaacaccgctgccgtgtccgcgtcgccgaccagcgctcgttgctcggagtcctggaagcctggcaggaccaccagcgggagtacggtgccgacgctgacacgctgctggtcgtcaccaccgacgtgcccgacgaacaattcggctgggacctgctcgcctacgccgtacggggacgagtgctctcggtcgaccgggtgcagatcatcgcgggacgattcggagcccgggacatcgacccccgaatccgtcaggaaccatggctcatcgacgccctactggacgccgaacccgccgaaggctggcctcgcaccggatcggtcctgacccgtgatcgagcgatccaggccctgatcagggtgcggctcgggcacgccgcgctcggcgaggacgccatggacatcggcaccttgctcgacttctccctcgataccgcggccaccacccggttcgctgcgttgcccgcggccgaacgggacggactggccgagtggctcacccacgccgtcggcgacgccgctggactactgctgcgcttggccgccgaggggcgcgcggccgatgccatgccgctcggcctggtcggcaccgccgccgtcggtgcgaacgcgtccaccgcggcggctctggcctttggtggacttctgggcggggtgcgtccggaacagctcggtgccttcaccgaagcggtggagggggcgctggaacgctggatcagccaggccgaatccggaagcagacacagcgacagtgcgcgggagaaagtactcgcggtcacacgccgggcggaggaactggccactcaggctgggctcaccacctacctggccgacaaccggttcctgccctcggcgttcaccgcacggctgcacacggtcgccaccgcactcatcgccgccctcgacggatccggggaactgagcgcggccgaggacgcactcagcgcggtgcgcgcccaccacctcgcccggctgcagagcgaccgggtgcgagcggtggacatggccatgcgactgacccggtggctcacccttccggtgcccgagcccacctcggtggccgaggcgatccaacggcacaacaccgaatgggcctgggtggatcgcgcgctgaccacgctatgggcgggagaccccgccggtgacccggtgctgggccaggcgtaccaagtggtgtgtcgggcagtgcgtgagcggcgcaccatcctcgacgaggcgttcgcgaaacacctggtgaattggaccaaacacgccagcatcgacgaccccggcgggtgtttgctcatcgagcaggtcctcgaccgcgtggcggcccccctcgtcaagcaaaaggtgccgttgatcgtggtgctggacggcatgagcggagccgtcgccgtcgagctcgccgagcaactcaccgaacgtgcgtggtgggaagcggcaccggaggagaaccggatcgccgcggtgtccgccatcccctcggtcacccgggccagccggcccagcctactcaccggcaccctcaccaccggcgatcagacggtcgaaaaggacggtttcgccgcgtattggaaacggcacagcaacggccgacattcgggtcgactgttccacaaagccgacatcggcggggacgccggacaccggctgtccgaccagttgctggaggcgatggccgatgagtcggtcgtggtcgcggtggtgctgaacaccatcgacgccgcactcgaccacggccgggaaggcgaccgcaccggctggcagcctcgcgacatcacctacctgcccgaactgttggacgccgcccgcaactacggccgccccgtcatcctcgtctccgaccacggtcacgtgctcgaccgagcggacggcacaccggtccccgcggaaggcgtcgagtcggcccgctggcgtctcggggagccgggaacaggtgagctcatgctgagcggtccacgcgtgctgttcggcgaaggcagcgtggtcgtcccgtggcgggaggacatccgctacacctcccgcaaagccggctaccacggcggtgcggcgttgtcggaaatggcggtgccggtgctggtgctactgccctcaccgaaaatcctgccctcgggttgggagctgctcggtgaccgcgtggcaccggcgtggtggcatcaacgtgccgaacagccgacgcctccggctccggccgaacgaaagccgaaagccaatcgccgggcggccaaggaacgatccgacgagatgccgctgttcaccatggacgattcggcggagcggccgtcgctggggcaacgtgttgtggcaggggaagtgtatgcaggacagcgggtcttcatccccaaagcgcccgacaagaaggtggtcgccgcggtcatcgacgcactcgtcgattccggtaaccggctgccgctgaacaccgtggcgggcatcgcgggccgtgctcgcagaccggagttcttcgccacgaccctgcaacgactgctcaacgtcgacggctacccggtgctgtccgtggacggcggccgatggctgaccctcgacgtggacaccctgtgtctgcagttcggagtcacgcgtgactga

SEQ ID NO: 1348 - DNA, 2673 bp, Saccharopolyspora erythraea
atgactccaccgcccacagtggaccaccgggtcatcgaggcgctcgtcaaagaccagctccagcaccacaccaaccggcggctgctgctggtctacgcccgctacgccgacacggtggagtctttcccgctaaccgggcagcgtcgtcgagtgcacgtagccgaccatcattcggtgctgggcatgtccgaggcgtggcaacggcatctggcggaccaccctgccgacgacgatctgctggtggtcaccaccagcgtgccggaggagcaactcggctgggacctgcgggcgtatgcgatcaagcggtcgatccgcaacgttgaccgggcgcggatcgtggcgcaacggttcggggcggtcgacgtcgatgcgcgggtgcgggccgaggaatggcttatcgacgggctgctcgacgccgaaccttccaccggttggccgcgcgccggctcggtgctcacccgggaccgagcgatccgggcgttgatcggcgcccggctgggccgcaccgtccccgccgacggaactctggatgcgggcacgctgctggaatggtcacgcggcgcggaggccggcaggttcagcgaactctccccggccgagcgcgacgggctggtgcgctggctgaccgataccgtcggaccagccgcggccgtgctgctgcgcctggtggaggagggcaaggcgaccgacgcgatgccgttgggcgtcgtcgcggctgtcgcggccggaccgaacccgcccttggaagccggacttgcgctcggcggactgctcgggagcgcacatggctctgaactgcgtgccttcaccgatgccgtcgaaggcaccctgacccggtgggcccacgaggccgaggtgagtcgtaacggcgaacccgcacgacgccgcgtgtgggaggtcgtgcggcggtcggacgagattgcggcccaggttaggttgacggagtcgttgcgagggaacgggttcttgccctcggcgttcagcgcgcgactgcaggcactcgcgactgccgtgtcggggccccgggcgcgcctaggcgacgcggagcgggcattggagtcgctgcgcgatcacgtggtggcccggttggcgccggaacgggtgcgggtcgcagagatggccgtgcgtctggtgcggtggttgcaggaggctcggaccgacgtggcgtcggtggccgacggcatcgcccggtacatctccgacacggcgtgggtggaccgggcgctgcaggtgctttggcacggcgatcctggcggcgacgcggtcgtgggccaggcgtatcgctcggtgtgggaggagatccgcagcgtgcgagaccgcatcgacgaggcattcgcggggcgattggagtcttgggcgcagcacgcgagcagcgttgagtcgagcggtgcgctgctgatcgagcaggtactcggtgagatcgcggcgccggtggcgcgtaagactgcccctctggtgatcgtgctagacggtatgaacggcgccgtggctgccggactcggcgaacagttggcggagtggtcggagaccagccgcgagccggggcgccgggacgcggcggtggcggcgatcccgtcggtgacgcagatcagccgcacgagtctactcacggggaccgtgaccgaaggcggacagaccgtcgagaaggacgggttcaagaaattctggcgcacacgacgccgccaggcccagttgttccacaaagccgacatcgtggggcaggcgggatcgtggttgtcggacgagctcttcgccgcgttggcggaccccgacatcgtggtcggcgccgtcctcaacacgatcgacgacgccctggaccatgggcaggagggcgaccgcgtcgaatggcgcctcgacgacatcacctacctgtccactctgctcaacgaggcacgcaactacggacgccctgtcgtgctggtctccgaccacgggcacgtgctcgaccgcggcgggcagcagacccaggccgacggagtggagtcggcacgttggcggcgcggtgcgccgagcacgggtgaggtcgcgttgcgcggcccgcgcgtcgtccccggtgacctcgtggcgccatggcgggaagaccttcgctacaccccgcgcaaggccggatatcacggcggcgcgtccctcgcggagatgacggtgcccgtgctcgtgctgttgccgagcctggaactgctgcccaacggctggcacgtgctaccacgtgagcgcaccgaaccaccgtggtggtcggcgcgcaccgtgcacgcagagacggaatcggcaccggtgaaggctccgtcgcggcggaagaagacacccgatcccgccgtagaagcgctgttccccgttgacgcggccgctgtcgagcccgtcacctcgctgggcgatcgggttgcctccggggaggtctacgaacaccagcggaagctcgtgccgcgcccgccggacaatcaggcggtcgcggcggtgatcgacgctctggccgcgcaacccgacggaatgctcaccacgagcgcggtcgccgcggcggcggggcgtgcggcacggcgcccggagttcttcatgagcgtgctcggtcgactgctcaacgtcgacggctatccggtcgtgtccgttgtggatggaggagcgcgcgtgaaactgagtctggagaaccttcgcacacagttcgggatcgacaagccgtga

SEQ ID NO: 1349 - DNA, 2628 bp, Saccharothrix espanaensis
atgacgccggcagacctcgactcggccgtcgagaacgccgtcgtcagccgggtttccgacatcgtcgacggcctcgacaaggacccgaccgcagtcggccgccgggtcgtgatcggcgtgcgcacccgacgcgagcccgtgtggcacggagaccgcgacggcgagatcggcggacatccagtccggtacgtcgcatgcccctccgtgctgtcggtgctggacgccctcgccgcgccgcccgccggcaagtccgcgtacgaggtgctcgtcgtgctcaccgatcgcgacgagcgggaactcggcgaggccgtgatggcccggctgcaccgcgcccacctgcacgacgtcagcaagtacaccctgctccaagacctgctcaaagtccgacagctggacccccgcctgcgcggtcgggagaacggctggctggtcgacgcgctggtcgacctggcccgcacgggccagttgccgaacaccacggggctgtcgttcggccgggaggtggcgctgcggcacgtggtgcgcgcccggctgtccgtggactccacggcgctcgacctcacgtccctcatcacagcggcggacgtgcccggcaaccgggcccgctggcaggctctcgcccccgccgaacggctcggcatcaccgcccacctcgtggagcggctgggcggtgcggccgatgtggtgctgcggttggccgcagcgcgcgacgacgtgctcgcggaactcctggtcgccgacgtgttgaccggcgcaccggaggacgacctgactgcggcccacgcgctcggcgcgttcacccactcccggttcggtcccgacgaacccaaccgtgccgcgatcgccactgcggccacggctgcggtcgagatcgccacgggcaccgactccccggacgtgtggccgcgaatccgtcacgcggacacgttgctcgcccagctcaacggttcggccatcgcctacgtgagccgcgtgctgcccagcggtttcacctcccggctggaacgcgccgcgaagaccctggacgaccgcgacctcgcggaagtccgagcgcaccacgacgccaccgagcagtccgcgcaggtgcgcaggctgcacgcggccgtgcggctgcgccgctggctggattcccggccgtccgagatcaccacaacctcggacgcgctgcgccggcacgcgagggacctggcctgggtggacagcgagctgatcagggtgcgccacggctcgtcgtccccggaggtcgccaaggcgttcgagcggatcgcgtcccgggtgggcaaacggcgcgcggaactcgacatccggttcgctggaactctcgccgaggccgcctacacggtgccgaacggcgtgctgggcgtggagaccgtgctgccggagatgatcgcgccgctcgctcgccggcacaaagtgctgttgatcgtggtggacggcatgtccggcgcggcggcggcggacatcaccttgtcgatcgcggagaacccgaggctcggctggaccgaggtcgtgcggtcggaggacggcggacgggaggcggtgctcgcggcgttcccaaccgaaacggcctacagccgcacgtcattgctcaccgcgtcactgtccagcgggaacgccgacaccgaacgacgtgccttcccgaagcacccgttctggccgccgcgcaccagggccaccgtcgtgcacaaggccggtgtcgccggcacctcgggcctggacctcggagcggccctcgacgccgagttcgccccgaggacggaaccgcaggtgctggcggtcgtgctgaacaccgtggacgacgcgctggccaagggcaggcagtccgacgacccgggctggcactaccgcgacgtcgcgtacctgccggcgctgctggaacgggctgccgagaacggctgggtcgtcgtgctcaccagcgaccacggccacgtgctggaacacggctcgcgccaccgccccgacccgaccggcacggcacgctggcggcaaccgggcgaccaggtccatgaggacgaggtcgtcctggccggaccacgggtgctcgtggacggcggcaccgccgtgctcgccgcgacggagtccgtccgctacgggtcccgctcccacggctaccacggtggggcgtcgctcgccgaggtggcgatcccgctcgtggtgctgctgccgcccggtaccgacgaactcgatggctgggccgtccattcacagggccagccggactggtggacgggcagggaaccccgcaagcccacccgcccaccgcgagccaggcgggagccggcacccgcacagccggacctgttcaccggggacgaatcacgcggtgcccggctggtcgccggcgagacgttcgtcaacacccaccggggccagcccgccaaccgggtgctcaaggccgaggtgttccgcgatgtcgtggacgcggtgctcgccgccggtgggcggctaccggtcgcggaagctctccaggccgccgggacgccgggacgcaatccacgcggtctggtcgccgcgctcggccgggtgctgaacatcgaccagttcccggtcgtggacctgatcgacggcgggcgcacgctcgtgatcaatgagaagctgctggacgagcagtttcccgaggggcgctga

SEQ ID NO: 1350 - DNA, 2691 bp, Singulisphaera acidiphila
atgagcgtcggagccctgagctcgcagcagttgcggtccatcgtcgaggagaagtggctgcgggacgaagacgcgctggccgtcggcctgcacgtcagcgtgccttggctcggcccgaccgaggtggagttcgagttcggcaaggcccaggtggtccgggccgacaccgtgttccaggtccggcaggcattgcggaacgccgagcgagaccagagccggatcatcttgctgaccaagctccagcaggccgacctgggacatgatgtcgtcgcccgcttggcgcgttgccgcctcttcgcgatcgaccactgggccagcctctgcgccctgttcaaggccaaggaactcgaccgttcgatttgcgacccggccctcgctcaggccctgatcgagtatgctccgccggacggctatccgccggtttcggcggggattctcgacggtgggacggtctggagggcgatcagccgccacgtttttgacatgggggagagcgagcccgacctggtgtcgctcctgctctgggccaccacgaaatccggggcgagtcgctacttgaatgcctcgccggagctgcggaccagcctgcgcgaccgcctcgtggccagcctgggggatgccgccgactcgattttgaagttcatcgagagtggcgccgggggcgatgccctcgctctggccgtcgtctgccaggtggtttacggcgatggcaagagttcgacgctggaagccgccgccgcccggatggagcaataccacggcaacacgccgatccccccgtcgatcggacgctgcctgggtcgactcgtcaccgacgccgttgccgacctggaccgcagggacgatgctcgaagcgcccaccagcatttgcagcgtgccgatgagttgctccgccagttccggtgtgacgctcatgccgatcgcaatcggttgacgcaacttggattcgagcaacggctggcccggttcggagcccaggtcgaagccaccatcagctcgccgagcgaggagacgattcagggatgtgaacggctcctgggtgagatcaacgaacaccgtgtcgccaagctcggccgacgacatgaccaaatctcaagggtcatgatggcgctgaggctcgtccgctggctcgctcgccctctgccgacttgcgggtcgttccccgagttcacccagacgtaccgtcgggacctggccttcgtggactgggcacgggagttgatcggccggggtgatgaggtcgttggcctttctcgagcctatcaagtcctcgatcgggcggtcctggagcggagggagcagttcaatcggcctttcgccgagtccttggcggactggactgccgtgggctcggattccgcaggggccttgggcgtcgaggatgtgctcggccaggtcgtcgccagggtggtcgaacccggcaatcgggtgcttctggtcgtcctcgacggcatgagctgggcgatctgccacgagctcctcgacgacatccggcaagagcactggtcccaggccactctggacgcggccgcgctcccccccttgcccgtcgtcgccgcgctcccgagcgtcacgcaagtctctcgtgccagcctcctctcggggacgctgacgagcggagatgcggcggtcgagacccggaacttcgagttgcacccggtcctcaggcacgtttgcgataagaagtatcccccggtgctctttcataaaaaagaagtgaccgaaggggcgcggggagcgatcggcgaggatctgtccaaggcaattctgtctctgaaccttcgggtcgtgggcgtggtcattaatgccatcgacgaccggctctccagtgcccagcagatccgggacgactggacgatccaccgcatcagccccctcggctcgctcctcaagctggcccgggacacggggcgggtggtcatcctggccagcgaccacggtcatgtctggcaccggcccgatgcgcgcaacatcccgttgcagacggggggcaggtggcgtcccaaggccgacgatctggctgaggacgaggtcgcgattacgggggaccgggtgcaggccggagcaagcggttcctcgatcatcgtcccttggtcggaacgggttcattacggtggaccccagaacggataccacggcggggcgaccccccaggagatggtctgtccgctggtcctcctgaccgatcagagcagtgcttattccggtctctactcgtgcgagtaccccaagccggactggtggtcgccagcaccgagcaaggctactgccgcggttgaggagacaaccacggttatcctgcattcgccgaagcgtcccccgacgcttttcgacaacctacgagacgaggtcgacgcgccgttgcccgtcacgaaaaggcccggagcgtggatcgaccggctgttttcctcccaggtatacaaggaccagaaggaacagatccgtcgccacgccccggaggacgaggtcgtgcggcggaccctcatcgtcctggaagcaggaggcggcctcatgacccctgccgccttcgcaaacgccgccgagatccccgccgcacgcctggacgggctcatcgctcgcattcagcgcctcttgaatgtcgacgggtacgagatcctcagcctcaaccgtaacgagaataagatcgagctcaatgtggtgaagctcagacgacaattcgacctgggttaa

SEQ ID NO: 1351 - DNA, 2832 bp, Sorangium cellulosum
atgagcctcgatctgccgacgctttcgacgagcgacctccaggaggagctccgtcagatccatcgacacacgcgccgctcgtatacggccgccgtcgcctgccggggtgagccgggcagggtcagcgtggatctcgacgacaagaaggtcctgttccgcgtcgcgccggtgcgatccgagctggagatgcggcgggtgctcgccgagggcggggaggacccggtggtgctcctcgtcgacttcgagcagcggctacccgcggatctcgcggggcgcctcgctggaggcaaggtgcacccggtcgatcgcgggcgtcagctcgcgcggatgttcggcgccacggccaccagcgccgagctgcaggcgtgccggccgctctgcgacgcgctgcgcgcgcgggcggtcccgtcgtggcgcatgcagggcagcaccgtcgatctcgagacggcgtggcgcgcgctcctcgcgcgggacgcgggcatcccgttcgagggcgcgctgaccgaggagcgcgtcgtcgacttctgcgcgtcgtccccggtcgcgccggcgttcgtgaaggcgctcgcggacaacggccccctccgggcggcgctgctccagcacctcggcgaggccagcgggccggtggcggcgatcgcctggcgcgcctgggagcgcggcgaagggcgcgccgtggcggcgctggcgctggttctcgaggtcgccgcgaagaagctgtcggggcacgcctacctgctcggccaggtgcggaccgccatggcccgcctggatccagagctgcggaagctgtcgcccgacgcgccgctgttcgcgcgctggggcgagctcggcccggtgatggcccggcggctcgcgcccccggtgctcgaccgcgcgctggcggacgcggatgccatcctccaggacgagccggtggccgatgtgctcgtcgagagccgctggctccctggggcgttcgagctctccgcgaaggcgctcggcgacgccctcgtcgcggcgacggcgagccccacgccggacgcgatcgagcgcgcggacgaggcgagcaagcggctccagaaccaccgccgcgcgcgggtggacgactcgaacgagaagcggctcgcggcgcgcgccgagatggctctcaagctggtggcctacctcgggacgcgcccgcagctcgaggccgagctccgggagctcggcgaccacgatcggatgcgctccctcgcggagcactacgccgagcacggggcctatgtcgacgcggccagggccgtcgcgcgcggcgaggagacggcgggcgcgctcgcgcagggcatccaggcggtgctgacggccgtggacgcggcccgcgacctcgacgacgagcggttcgcgagcgggctcgcttcctgggtgcaggcgggctcgccgggctcgtcgcgggtggtgccgatcgagcgggcgctcgacgagttcggggtcggcttcctgaaagagaagcggcatcggaagctcctcgtggtgctgctcgacggcatggcgtgggcgaacgccgtggagctcttgacgagcctggaggaggcccatgtcgcgccgatccggtggaagcgcggcaggctgccgccggtgctggcggcgctgccgacggtcacgacggtgagccgcgcggccctgttcaagggcaagcgcctcgatccgggcgaggccgaagatacagggaaggatccggcgcgcttcgccgggcacaaggggctgacgaagctgctcgatcaggcgccgcagctctacctgcgccccgacgtggagacgacgacgggggagctgtcgaagaaggcggccgcgctggtgcagtcgaaggaccgcgtcgtcgccgtggtggtcaacgccatcgacgaccagctcaaaggcagccggcagatgcgtgtaccgtgcgatctcgcgcacatcaagccgctcggcccgctgctgcaggaggcgaccgacgcgggccgcgccgtgctcctcatcgcggaccacgggcacgtgctcggcgcccggctcgcctcggtgagcgctcccgaggccggcgccaagcgctggcgacctctcggcgtgaacgacgcgcccggaccgaacgaggtctgcgtgtccgcggacagcacctggcgcccgcgcggcaaggcgaaggtggcgctgctgtaccgtgagacggaggcctatggcgggagcgcgcacgtgggcgagcacgggggcgcgtcgctggcggaggccgtgagcccggcgatcctcgtggcttccgaccggctgcgacagcgcatccagatcgaagagggagaggacgacgaagcgctcgaggtgacgccgttccagagcccgccgtggtgggacctgcgcgtccggaagcccgccgtacggacggcccccgccgacgcagtggtcgtggcggagccgtctccagcgccggccaggcagctctcgattccgctgatcgacgtggcggcgccgaagccgatcaaggagcgcaaagacgccgccaggccggcggcggccgcctccggggcgcccgccgcagcgcggaagccgggcccgagcgcgacgctggcgaagtcgaagctcctgaaagagcggcagcgcgagcgcggcgccgagccccgcgccgtgatgatggcgtggatcgatgtcctggcggcgcaccagggccggatggcggccaggctcttcacgcacgaggtgggcctgctcgcgcaccaggccggaggagcggtgtccgagatgggcgagtggctcaacgtcgatacgtaccaggtggtgtcctacgatcgcgtggcgcaggaggtcctgctggatctggacctgttgcaggggctgttcggagcggattga

SEQ ID NO: 1352 - DNA, 2925 bp, Streptomyces coelicolor
atgacggacaccactgtcgccgttcccggagcggtccggctgaacaccgcgaccgtcacccagtacctgtcctcgcagtcctccctcgtcgcctccctgacaggggacggcgggggcagacgccgggccgtgctgctgcggtccgcaccccagtgggacggacccgccgaacccgcctggggcgagggccgtacggccggcatcgcggtggcgccgtcgccgctcgccgtccacgaactcgtcctcgaccacctggcggcccgccgccccggtccccccgtcctggtcgtcctcaccgaccgggagcagcacgaactcgacccggcgattctcgcccgcgtccacaagctgcgcatcgacacggtcgacggctgggacgtcgtccgcgaggcgttcggcgcccggcagatagacccccggctcaaggacgtcaactgggccgccgaggcgctcctcgacgccaccccgcccggcagctggcccgccgtgcccggcggctggctgtcccgccagtacgccctcaccgcgctcgcccagcgccgcctgcgcctgggccgctacgacaccgagggcggcccgcgccgccccggcgacgaccggctcgacgcacaggccctgctgcactggtcgacccggcccggcgcccccgaacggctcctcaccctgcgcggacccgagcgtgccggactgactgccttcctcggcgaggaggaccaggcgggcctcgccggccgaaccctgctcgcactcgtcgacgccgagcgcggcgaggacgccgccgccttcggcctcgtgtgcgcggcactgtggcagcacgctgaacccgcccccgagacctaccgggcccggggccgcgccgaacgctacttcggcgaccggcccccggcgaccggcgaccagctcgacgccctggtgaccgtcttcgggcgggccaccgaggagcacgtgaccacactgctggcagccggacatcgcaccgcgggcaccgacgccgaccaggcccgcgaggcacgccgcaccaccggcaccgtgctcgaccgggccgccgcgctggcccgccagttcggcgcggaggaggccgtggcggccagccccgtcctgcgcggcggactcgaagcacggttcaccgccgtcggcagggccctcgccgcgggcgacaccaccgcggtggcggacgccgtccgccgactggagaaccaccggctcgccgccgagccggaggagtccgcccgcatcgagcgcgcccgcatgggccaacgcctcgcccgctggctggccaccgacccgcccaccgacgccctcaccgtcgccgacgccctgaggcggcacgtcgccgagaccggctgggcggacctcgccctggagcacatcgaggccggcggcgaccagggtcccgtcctcaaggccgcctacgacaccctcggcacccgggtgagggaccgacgccggcagatcgacgcgtccttcgcgcgctcgctggcggcctggacccagtccggcacccagcccggctccatgctgaccgtcgagaccttcctcgaccgcgtggtcggcccgctcgtgcggcgcggggaggaacggcggacgctgatgctcgtgctcgacggcatgagcgcggccatcgccaacgaacttggtgaggaactgcgtcgatcctgggcggagttcgacccgctgcccgagggtgataccccgtaccgacgggctatggccgccgccctgcccactgtgacagccgtctcccgtacctccctcttcgcgggcaccctgacgaagggcacccaggccgacgagaagaggctcttccccgcgctgaagctgtggggtggggcgccggccgccgtgttccacaaggacgacctgcgcaccgagacagcgggcgagaccttcggcccggcgctcacggaggcactcgccgacggcaggacccacgtcgccgtcgtcctcaacgccatcgacgaccggctcgccaaggaacagaagctcggcgacggcgcctggcggatcgacgacgtgcccggactgcgcgacctgctgcgggtggcggccacccagggcatggcggtcgtcctcaccagcgaccacggccacgtcgtcgaccgtcacggcacgaaggtcgaccccgccgccgctcccgagtccgcccgccaccgcctgatcggcggcggaccgctcgccgaacgggagatcaccctctccggaccgcgcgtgatctggcccgagcccggagcatccatcgtcgccctgtgggacgccgactcccgctacaccgctctcaaggccggctaccacggaggggcgtcgctcgccgaggtcaccatcccggcgctcgccttcctgccgttcggcgcggagccgcccaagggctggcgggaactgggcgatcagcggccggtctggtgggctccggaggagaccgggaaggcgccgctaccggacgagtacaccgctcggccggttgccgcgacggcttccgctcccaagaagccgacggcgaaggccaagaaggaccaggcggaagtcgcccgaatgcaccacggggcgctcttcgacgtggcgctgaccaccgagggagacgacgccctgctcaccccgaccgtcgtctcccggaccgagacgctggtgacggcactgctcgactcggagacgtaccaggcgcagctcggcggtctggcacgcaagccccagcaagagcaggtccacaaggcgctcaccaccctgctggactcgggcggcacgctgcccgtgaccgcgctcgcacagcgcgtcggcatgcccgtgacccggggcgtcggcttcgccgcagtcctgggacaactcctcaactacgacggagtgcaggtactggagacgttgccggacggccgtaccttgcggctccacgcggccctgctacgcgagcagttcgccctcggagcgggctga

SEQ ID NO: 1353 - DNA, 2946 bp, Streptomyces griseus
atgagcgtcacgagcacatcggcgatcgcccggctgaacgtcgccacgatcactcagtacctgtcgtcccagacctcgctggcctcgtccctcaccggagccgggcgacgccgtgccgtcctcctgcgttccacccctcagtgggacggtccggtcgaaccggtgtggggcgagggacgtaccgcccgcatctccacggccccctcgcctctcgccgtacatgagctgctcctggaccacctcggtaaaccgctcggggacgaggcgaaggacaccggcaccgcgggctccaccggtcccgccgtgctcgtcatcctgacggaccgcgaacagagcgaactcgaccccgcgatcctggcccgcgtccacaagaagcggatcgacacgctcgacagctgggacgtggtccgtgaggccttcggggccgagcaggtcgacacccggctccgccatgccaactgggctgccgaggcgctcctcgacgccaccccgcccggaggctggcctcccctggcgggcggcgtgctctcccgccggaaggccctgtccgccctcgccctgcgccgactgcgtctggggagatacgacaccgaggcggatgggccggtggaccgcgtccgcaggacggacgatgctctggacacccacgccctgctgagctggtccctgagccctggcggccccggtcggctgctcgatctgcgcggccccgaacgtgccgggctgaggcagttcctgggagaggaggaccaggcgggcctggccggacaagcgctcctggccctggtcgaggcggaacacggcgaggaggcggtggcgttcgggctggtctgcgccgcattgtggcagcacgccgttccggacgccgaggtctaccaggcgcggggccgggccgagcgatggttcggagaccggccgccagccgcgggagaacagctcggccacctggcgtccgccttcggaagggcctgtgaggactaccttggcgtcctgttgaccaccgccgcacggaccgcgggctccgagagcgaggagacccgggaagcacggcggatcagcgacaccgtcctggatcgggccacttcgctcgtccggcagttcggggcggaatccgccgctcggacgagcccgctgctgccgagcggtctggagtcgcgcttcgccctggtgggacaggtcctggaatcggggcagaccggtgctctcgaagaagccttccgacagctggaaacccaccggcgggccggtgcacctgaggcaaggacccggatccgacgggccaggatgggcgggcgcctgacacagtggctcgccggtgaaccgacgtccgcgtgtgactcgacaggcaccggaatagtgcgccacctcgcggagaccgggtgggtggaccaggcactggagcacatcgaggccggcggcgaccccgacccctctcttcggtccgcgtacgacaagctgggtgcccgtgtccgcgaacgacgcctcgacatcgaccgggaattcgcgcggtcgctggccacgtggaccgcggcgggcacgcaccccggttccatgctcacggtcgagaccttcctcgaccgggtggtgaagcccatcgtccgcggcgccgacggccgacgcgtgctcctcctcgtcctggacgggatgagtgccgcgatcgccaccgagctcggccaggagctgcgctcgacgtgggccgagttcgatccggtcaaggacggcgaaccgcaccgacgggctatggccgccgcgctgccgaccctgaccgccgtctcccgcacctctctgttcgcgggccgcctcatgaagggaacgcaggcagacgagaagaggcttttcccccagcagaagctgtggggcggagcgcaggcagcagtgttccacaaggacgacctgcgcacgaccagcgccggggaggtcttcggtcccggtctcggcgaagccctcgccgacggacgcactcatgtggctgtcgtcctcaacgccatcgacgaccggctcgccaaggagcagaagctcggcgacgggacctggcgtgcctccgacatccctggtctggtcgagctgctacgggtggcggcggcccagggtatggccgtgctcatcaccagcgaccacggacacgtcgtggaccgtcgtggcacgaaggtcgattcgagtctcccggagtcggctcgccatcgtctgcccggcgggacgctgtcggcggccgaggtagcgctcaacggccctcgggtcgtctggcccgaacccggcggttcgatcgtcgccctgtgggacgcggattcccgctacacgtctctcaaggccggctatcacggcggggcgtccctcgctgagttcaccatcccggttctggccttcctgcccttcggggcgacacccccgaaggactggcgcgagctgggtgaccagcggccttcatggtggttcctggacgagcgagcaccagctgctcctgtaccgccgtcccctgcactcacgcctcctgtgaagaagccggtccggcaggcgccgtccaagtcccaggccgagttggcacgcacacacgactcgctgttcgatgtcgttctggtaccggccgaggaggcaggggacgccttggtcacgacggagctgcgtacccagacggagagcctggtccaccggctgttcgggtccgctgccttccaggaccaggtcgagctgctggcccggaagccgcgcgagcgcgagctggacaagttccggcaggcggttcaggcactcgtcgacgcgggtgggactctccctgtgacggccctggcccaacgtgtggagttcccggtcacccgcgcggacggcttcgctgccgtcctgcgtcagctgctcaactacgacggcgtacaggtcctggaaacgctgccggacggccggaccctgcgcctgcaccagggactgctgcgcgagcaattcgagctgggctga

SEQ ID NO: 1354 - DNA, 2745 bp, Thermobifida fusca
atgaccactgccacgacaaccgttccgcccgtcaccgttgacgcggtccgcggcgcgctccggcgcgccctcaaacgccagcagcggcgcgcagaacgcgaccccgccgcggcccacgcccgcgcggtcgccctgcgtgccgccccccaatgggcgggacccgacgaaatcaccgtggaccacgacgggcgccacgtgaacgcccgcgtcgtccccgcacccaccgtgctggcgctgctcgccgaactcagccggccccgagacgccgaatacctggtgctcctcaccccatgcaccacccaagaactcggcaacaccctgctctcccggctcgtcgggcaagaagtcttcaccgtcaacaactgggaactagtcctcgaccagctcgacctgcgccacctcgacccgcgcctctactcccgggaatgggcgtggctcgccaacgccctctacgacatcagcctcggaaccgagtggcggaaaagcagcaccatcctcaaactcgacgacgccctccaccgggtcgctgcggcccgcttcggctacgaggacgctgaccggcttgacgcggccgcactcctcgactggacccgcgaccctgcccgcatcacccaatacacgtccctgcccgaagaagaacgcgtcgggctccgccacgcccttgaacagcacatcggcgcggtcgccaccgtcgtcttccgcctcctcgaccggcagcagatctccgacacgctgccgctcggactcgtcttccgcgaactcctcgaccccgccaacagcagcctgcccggtgtgaccgagacacgcatccgcatcgaagaacgcttcctcggcgcacccccgcccagcctcgacgaactgcgccgattcgcagacaactgcgaagccgcgctgctccgcctcatggacggtgcggaacacgacaccgccatcagcgccagcaggcgggccgaagaaatcctcgccgccgtcggcgcggacgcggtcgccaacaacagccaactcctcgccagcggactccacgcccggctcgccacgctcggcgaacacatcagcgaactcctccaccccggcaaagacgatccgcaaccccgcgacctggggcacgtcgaagaagcattcacccgagtccgcgaccaccggcgctgcgaccccaccgcccccgaattcgtgggcgcgctcaacgcggtccgcctgctccgctggctcgccaccgacccagcaccccccaccaccgtcgccgacggggtcgcctcccacatggccgtcaccgcgtgggtggaccgtgccgccagcgccctatacacctccgccaccgacaacccggcgctcagcgaggcctaccagcggctctacacgcgcgtccgggaacggcgcgcccgcatcgacgaagcattcgcccgccgtgtcgccgcgtggaccgaagtgtcctcgcacaccgacgaactgctcctcgccgaaaacctcctcaaacggatcgctgtccccgtcgcgaaacagcaagccccgctcatcatcctgctcgacgggatgagcgccgaagtcgccgtgcaactcggggaagacatcgccgccagcggacaattcatcgaagtcgcccgcagcgaccggggacgggaaggagcactcgccaccctgccgtccatcaccacctgctcgcgggcctccctgctgtgcggcaccctcaccaccggcgggcagagcgacgaacgcgccggattcgccgccttctggcggaaagccgccgccggagcccgccccagcgccctcttctaccagcgggaactcgccaccggccccggggaccggctgcccgccgacgtcgaggcggccatcgacgacaccgaacaggtcgtcgccgtcgtcctcaacatcgtcgacgactccctcgccaccggccgggaaagcgacaccgcgacctggcgggtccaccgcatcgggaaactccgcaccctcctcgacaccgcgcaccgcgcccaccggcccgtcatcctcgtctccgaccacggccacgtgtgggaccgcgacgaaaaccgcaaaaccagtgacggggaagccgcccgctaccgcaccggcaccccccacgacggggaaatcctcgtcaccggcgaccgagtgctcgccggaggcggcagcatcgtcgtcccctgggacgaacgcatccgctacacctcccgccgggccggataccacggcggcatctccaccgccgaaatggtcatccccgtgctcgtgttcctccccgacaaagaactcctccccgacaggtgggaaaccctgcggcccacccagcacgaacccgcctggtggaaccagtccatcgccacccgccttcccgacgacaccacacccaccccgagacgggctacacgcgcccccgccgtcgacgacgacaacgcgctcatcagccgcgccgaagtcgtgcgcagcctcggccagcggatcgtcgacacggccgtgttcgccgacgtccaccagcaaatccccaagagtccgcccaaggaagaaatcgcggccgtcatcgacacactcgccgaagtcggaggcgaccggccccgcctgcccgtcgaacgcgtcgctgaagccgctgggaaagaacccttccgcgcggcacgattcctgaaaatggtggccaaagtcctcaacgtggaaatgttcccggtgctcgtcctcaccgacgccgaccgagccgtggaactcaacatcccgctgcttaaagaacaattcccggaaggtgcctcctag

SEQ ID NO: 1355 - DNA, 2826 bp, Thermobispora bispora
gtgaccgagacccggcccatggcaaccgacaccgcctctccggccaccccctccggccctggcttgcggctcgccacgctgtccgcggtgcggtcgatcgtggcccaccagctgaagaagggaggctcgcggcggatcatcggcatccacgccctgcccgagtggcatggtgagccgtccttcaccgtggaggacgccgtggtgcacgtgcggccctgcccgtccgcgctcgccgtgcgcgaggcgctcacagagcacgcgctcacgaagcgtgacaccaaggactacctcgtcgtgctcaccgacgtggacgacgccgacctcggcgccggggtccgggtgcacctggccggcggccggctgcacgtgctccgcccctgggagatggtcaaggaggcgttcagcgcgcacaccatcgacccgctgctgctcgacgagcggtgggcggccgacgcgctcatcaaccgggaacccgccggaggctggccgcccgcgcccggcggcgccctcacccgcgaccacgccctcgggaacctggcgtccgcggtgttcgggaccgaccccgcgggccagccgtacctcaccccggagcacctcgacgcgcccggcctgctgctatggaccctcgacccggtcgccgtcgcccggttcaccgagctgcccgaggaggtccgcgacggcctgaccgggtggctcggcaccgtcctcgggccggccggccggtggacgctgcgcgcggtcacggccgggcacggcggggacgccgtcccgctcgccctggtcgccgggctgctatgggagcgcggcgccgggccgtccgccgccgaggcgcgcggcctggtccgcgcccggctcggcggggaggccctccccgccgaggaggcacaggcgtgggcgcgcgccgcccaggcggccctcggcaggctcgaccggccggacgccctgctggaccgcgccgaggagctgctccgcgagttcaacgccaccgaggtcatcgcccgctccaccctgctgccggaggcgtacgccatgcggctccgcgagttcgcgcgggcactgcggcaggccttgcccggtcccggcccatcgaggcgcgtaccggacgtggcagcgctgcagcaggccgaggacgcgcacgcccgcctgctcgcgcacgagctcgccgggcacaacccacgcacccggaccgccacgatggcgctccggctgctgcgctggctcgccacccccaagcggccggcggccaccctggccgaggccgtgcacgagcaggtccgcaccggcgcttatgtcgaccgggcgttggcggacgtgtggacgggtgaccaggacgacgaggtcgccgccgcctaccgggcgctgctggaggtcgccgccgagcggcgcaccgagcgcgaccgcgtgctcgcccgccacctggccgccgccgtcgaggccgacagcgagcccggaacgctggtcccgatcgagtccgcgctcggcacgctggtgcgcccgctcggccggtcgctccttctcgtgctcgacggcatgaccgcggccgtgctcgccgagctcgccgacgagctgatccgggaccggtggaccgaactggtggactcctcgctcggccaccgccgggccctgctgcccgcgctcccgaccgtcaccgaggcctgccgcaccagcctgctcaccgggacgctccgcatcggcgggcagcacgacgagaaggcggcgttccccggcgcggtcggcgacccgcaggcccggctgttccacaaggacgacctgcgcgcccccgccgggcacgcgctccacccggacgtgaaggccgcgatcgacggcccggcccgggtggtgggcgtggtgctcaacgccatcgacgactccctcgacaagatggatcccggcggcaccacctgggctctcgaccaggtgccgtacctgcgggcgctcaccgaggcggcccgcgcggccggccgccggctcatcctcacctccgaccacggacacgtggtggaacggggaggaaccgcactcaccgcgcatgccaccggggccgcccgctggcgtccggccggtgggccggtgtcggagggcgagatcgagatccggggccggcgggtcctgctcggcggcggcgccgtcgtcctgccgtggcgggaggacctgcgctacggtgccaaacgcgccggctaccacggcggcgcctccgccgccgaggtcgcggtgccgttcgcggtgttcagcacggtcgctggggatgacatcgccgggtgggcgccggcgcccgtgcaggaacccacgtggtggaacgcggccctcacccgggcccagctccgggagacgacgcgccacgccggcgcgcagccgggcgcgcaccgagcagcggcagcgcgtgggacgggtacccgttccgcgaagggccgcagccccgaggtcaccgggcagaccgagctggcgctcgacgcagtggcaccggaacccgcgggggaggagccggtctctccggtggagcggtacctggacgagctgctcgcctccgacctgttccgcgagcagtgcgcccgggctggccgggtggccccggacgtcgccctggtccgcaatgtgctggccgcgctgctcgaggccggcgggcggctccatcagtccgcgctctcggcgcaggcgaaggtgccggccacgcggatgaccgccgcgctcgccgcggtccggcgggtgctcagcgtcgacggctacgaccccatcggctacgaccccgatggtgagaccgtggtgctctcggccgacgtgctcgccgagcagttcggcatcccggtgccgcggcagccggacctctag

SEQ ID NO: 1356 - DNA, 2799 bp, Hahella chejuensis
atgaattattcaacgaaagttgagttaagtaagaatgaggcagacttatcgaaactgccttctccgctgttgacgcaaattcaggcggttttacgcagggcccccaatgcggacagaattgcaattttctggacagatacattagtaccgactgaatatacaggccgcctggaggacacgtcgataaaactggtttattgcgtctccgagttggccatgcgtgaggcattagtggagcacgacggtaataactgtttagtcctggtggctccttttggagtaactgacctcgcgcaagatgtattggctaggctgtggcgtaacgagcctcagcgtataagcccttggagaaccctggagcaactaacccgcgttcagtccattgatccacgtctacccaagcgctacggtaaatggatggccgaggccttattgagccgctacgaccgttacgaaaaaagcgttcattttggtgaagtgttggatcaggagaccgcctggcaagctttagcggtgggctatctcggctttaatcaacagcacagtgatctctccagtctatttcgctggtccatttctaacgcatcaaaacaccaacccagcaacgcgctacctgctgagatgcaggaatccatagctgattggctgagcattacattgaatggcttagcgccagtggttgggcagttgatagtccgtcaacccgttgaggatctgctcgcgataggtttggtttgctcggtaatttatcacccggatgccgtcaaggaaggtgcgctgagttacgagcaacagttcgctgcgaacattaaactgaaagagcgacaactgaacgggatagcttgcaatactgattctctggcgaagtttggagaaaaggctgcgctgtttgtgaaggatctgatcgttagcgagcccgacgggtatcaaaaggttaaaaactcaatcaccaaagcagagcaattattagcaagcgttgatgcgagtgatggagccatttgctcaaacgtattgccagccggctttcgcttacgtttgatcacctttggcaaagcgcttgaacaagccataaagaaaggcgatacacaacccgcacagttagcttttagagaactggaattgcacgtactaggtgcgttaccaggccaaagagatcaaatagaacgggcaaaaatggcgttgcgccttgtccattggctacttgactctcaagaaaccacgcaaaaggctttagaaaagaacacgaattgctctcagctgctaaagcgatatatggatcatggtggttttgtggattgggcaagaacccaaatttggtttggcgatgccgaagacgcgctaagtcaggtgtaccagcgtttagcagagaaaatcggcgatggacgcgaagctgaaaattttgagtttggaacctcgttagagtctattgccaaaggtgatcaactacccagtcgcctgttgtatgtagaacaagcccttgaaaaaatcgtcgctcccatagccgagcagtcgccagttttgctgttggtactagatggcatgagccaagccgtttaccgcgagttgattgaagatttcgctaatcacaattgggtggagctgcagcgtgaagacataggtgaatcacaaagcctggtatctgcactgccttccattactcaggtgagtcggtatgcgctcttatcgggagaacttgggagcggacttgcgcaagaagagaaaaagaattttacaaatcacccgttattaaagcgtatagcttccaccaaattccccccaaaactgtttcataagcaggatctgcagcaatctggtagtggatcacttaattcagaagtgagagccctcattgccggtacggagcataagatattggcggcggttatcaatgctgtcgacgaccagctcagtagtagttctcaggttgcgtttaaatggcagttggattctattcgtccattaaagcaagttctggaggcggctcgtgagtccgggcgcgttgtgatagtaaccagtgaccacggacatactcttgagcacgagaccacttattactcatcgagcacagaatcgggtgaaaggtaccactcggataccaaggcgatacgagagaaggaagtgattacgaaaggcattcgcgtggtcggtaaagacaataccgcagttgtaccttggtctgagaaagtccgttatagcaaaagcaaaaatatggggtatcacggtggggccagtttgcaagaagcctccataccactgggtgtgttttcaaactctggcgcagagaacaaattgtcgggttggaaagaagtccccctctaccggccagattggtggactcttaacacaatttctgttgtatctgaaacacctacaccagaaataaaacaagaagagaagaaggcggaaacaaaaacagcgtcaaaacgcaaagcgacagaagaacggattgacgatttatttgccgagccagaagcaaccaaaaaaattactagtgaggattgggtcgagcagttattcgattccgcagtttataaagatgcacagagtcgtttaggacggatggcaatatcgaaatcggagttgaaagagtttttgacactgctgagtgccaatggcgggcagataatgcaagctgtggttgtaagagaactcaaaaagcccgagctccgcatgagaggatttttatccgccgcacaaagaattttgaacgtggatggctaccccattttaaaagtcgaacgagattctcaaactatcatgcttgatgttcgagccctaaaaacacagtttgaattatga

SEQ ID NO: 1357 - DNA, 2388 bp, Aciduliprofundum sp.
atgggagtagaagattttcattctcttaaagaattgtatgctcgaataaagcaggataagaattctaaaatgccctctgacagaagatttccggtaaggttaatcttccttaattctttcgaagaattacgagaaattattagatttctagttaaaaattgtaatgttgaaagtagagaaataacggaactcctatctgataaaaatagatggctaacaacagatgaaatagtaaattggataagggaaatatctaacaatgctgttgtggttccactatcagaatttctgagatttcaaagtaaagaagatttttatataactttaaaaagcctaactgaaattgaaaagcaaaacaatataagaatctatatacccttagttggtttgtgggagagatttgaacaagagttctggactaacttttacagaaaggaagaatgggcatcagtttggaagttagaaacatcttctcaaaaaacaattatatatcaaataaattttgatttagattataagaatcttctcttagaaaactttgtattagtatctactactgaagaatggttaagtgtttggaaaagagagaatgtgaaaggtatcctatccctgtcccaatccttgtcatatttttataaaaattttctcccagatcaagcattcgagttaaaggggatttcaaatcaaaaagaatttcttgaagagatttttgaaatcaaagttccggtaaagtttaaagatgacgaaatagagttttggaacgaactcataaaggaggtaggcagatacaatagaaaaggattaaccatagaaggtatatttttaagacattttaattttagaagtatagaaaaattaacacctaaagaatttctcgattgctatttgaaaactaatgattattatgaaagatggttaatcagaaacctcttcttagctttagataagtttaagtcttcctatttacacaaatgtttcgaaagactggaagaattaaaagaggaggatttaatagaaaaactatggttggagatatttcagctaccttctgaaacaccaactaaggatgttttttccgagagaaaggaatttttaaactacatacataagaatctcaacttctcagctcgatttgtagaagagaaactttataatgaacttgataatataaaaagctacccgttgaagaaaaagctcgaatatttaaccaacataacatttactgagaggaaatacctaatttctgaactaaaaaatgttgatatccaagaaattcaaagacttcttcctaacttaaaagatgtttatccagaattggcttactatttagattgggagttaataaagcccgataacgaagtggataattggatacttgaatattttaaagagtacaattattcaaaaataaggcatagtaaatctctaaaaatagaagaactaattaataacaaaaacagaaataagtctactttttcagattggtattattctttgcctaaagcaaaaatagaagaggagattaaatatgtgtggatagatgggttaggagcggaatggttttcattagtagttcatctgctcaataaatatggaaaagaaaaaggaaaaatcgtaaaaaataagttacttacgcgggtaaatttgccaagcattacagaatgcaatagatacgaatttgaaaaagttggaaatttagataagcacatccataatcaaaatccatataaatatccagatgatctaatcaaagaatttgaactcgtagaaaaaataataaaagaaattattgagatgcaatatgaaaaaattggcatcctttcagatcacggattcagttttttgtgtttgaaggattttggtaattttaaaagactcgatttgccaaacactgaacatgagggaagatgtatgtggatcgacgaggtaaattacaaagaggacgaatattttattgtgtggaacattgatgaggggaattgccggggtagaaaggtccttgttgcattgaaacatgtttcattaaataatactccttatagagaggttcatggaggggccactcctgaagaagttttagtaccttatattgtaatagaaactgaaaaagacaaaactgaatatgaaattgaacttattaattctgaggtctggataactaatcctgtagttcaatttaaaatatacccacagcctttgtatattcctgaagcttttctcaatgagcgatcattgaatgtgtcttacgagaaagaggatgatatctataagatagatctaagaggcttaaaagttggagaacacacgatagtattgaaaataggagataaggactaccaaataaaggtaactattataggaggatttaaggagagggatctactatga

SEQ ID NO: 1358 - DNA, 2274 bp, Anaerobaculum mobile
atgaaatgttttaggaatatcaatgaattaatatctgatattagggaagaaaagagtaaaagctgcagatttgctactcgcttcattcttgtgcagggatgccggacttgggatgagcttgtcgctaaacttatccatgaggtggatagagttgttcatctgtcggagttttgtgatggtcatgacgtatttcctgacatgacaaagctgcaatattaccttaaagagaaaatattaaactgtaaagatgttttgctaatcccactggcagaatgtatcagacttgatcccgaaagtgccataattatccgttctttagctgaatggcctgctgaaaaaatacgacgactctatataccgctgttatcaataaatgagtctttccttgctgaaatggatcatgtaccacgttatgaagagggcctccttcccgacatattgtcgattgagggagaaggtgattgcgaggttgtagtggcaccctttcatatcgagtctgaggattttctgattattagtggaataaaagaatatctttccagatgggaaagcagcaacgttaataaaatatggttgcaaacggatatggctgcttggttgccaaaactgagattagggggtagatgtaaggtatgtatatatccttctccatttgattatgtcagcagaaatgccaactgggaggaagttagggaagaatggggatcttcggagaactggaattggttggctactcaaatgagggaagaggaaagtctggatagcgttgccagtcgcatattaaatgttgcagattataattctcaacagctgtttgtaatgtggaaaaacttggatgagagaaaacgttggcttgtatggctatggagcaaggcaaaaagcaaccccgattcttatctatatcatgttattgagaaaagcaatagcgtgagcgactttattgataatgttataatggcaattttttcactccctaagtcgctgtcctttagcatggagcgaaaagagcttttaaaactcctcggcgtcactgtcatgccacctgaattttggaaacaatatgatgaactatcaagtcctttagaacggattgcggtgttgactgatctttcagtgaccgagcgagaaaaactagtgtcctctgctggtgaacttctatcgagtcattccactgccctttggtgggattatcttgaagtagccttccccaagttaacatggtatttggggtttccttccactgacgatgagtttgctgatgcttactttttcgcttataaccgttgtagattgatcgatagagcagatgatagcttacatgatctaatcgataaatgggcgagtgaacaattactttggaattaccaaggaagaagcgatattgtagctaagcaacgttccaatggttcaaaaatactttgggttgatgctatgggggcagaatggcttggattattgattaagttgctgacaatggatggagaggttgaatgcgaagtgatgttggctagagctaacatacctaccataactgatgctaataaagaatgggaggaagacgaggaagtcattcgcgatctagacgacatagcccatcattacgcctacacgtttcctcaatcttttcttaaggaaatggagctcattgacaaattggctattaaagtccaggaattgctatctcaattttctgttgtggttgtcacttctgaccatggtcttagtagatttgcagctataagcaaggaaagggtggatcctcctcaagggactacagttgattcaagaggtcgttttgcagcattacaggatgatgtcctcagtgaaaattatgacgctaatacattatgggttttagtaaacaacgtcatttgcctgcttacccattgcaggtttaagggttgtatggcttcccctggagaggttcacggcggcgctgcgcctgaggagtgtctatcgccggtgattgctgttagaaaagcaggtgttgaggctccactgaaatttgagttgattgcagagactatcaaattgaatcctaagggtgagggtgttattgccgtgagatgcaatcgagcgataagaaatcttaagctgcaagtagctggcagtagtttaaaaggacaagaagcagaggctttaacttgggaatttaaattaaagggctggaaagcaggcaaatatactggaacgctgtatagtgctaatcgtaatgtaggagaaattaccttcgaagcagtaaaaggctttattcaggatgatctgggattgtga

SEQ ID NO: 1359 - DNA, 2319 bp, Candidatus Desulforudis
atgagccttcaactcaaatctttttgcagtacagatagttttatcaaagaactgcgcgaagatgccaagcgtgcggagagatttccggtgcggattattctggttgaaggtcttggctcttggcagaagttggtgaagcgtctacaaccggaagttgatactgtgcttcgcctttcttctttttgtgggggagaagatacgtatccctgcggcacgtcggcgagacactggttgacagaaaggttgcgggagcattcaccaagtacgatacttatactaccgctggcagaatggctgcggttagaagcggggcacgaggaacaagaggctttcgagctattagtgaatctggtgcagatggaaaaagtaggtgacaagcggatctatgttcctctgctggaggctgcagaagcagtacgcagattggaggagcgcgttgtgcgttaccacgcacagggcgaactgccacccgtatggaaaatagcaggccaaggctcggtgacggtgaaggtcttcccgtttgttcctaaatacgataccagccgcgtaatccaaggaattagggcatacttagaatgttgggagaccggaggcgctgaacaagtagttctcgtcaccaaatgggctgagtggttgaaaggatgcaaagccacgtttacgctcgaggtccttaagaacgcctatgaagtactggccaagagggtggcttcgtggccagttgaccttagggaggaattgggttcgaaagatgattggttctggctcgcacaggagagtcgcaagggcgaatccttttcccatctggctgcccgacttctgaacatgaaggaatatgacagtttgggattgatggaacgatggaaaggactggagccacggcagcgctggctgggctggctttggagcaaactcgagcaagctcagacaggatatttggggaaggtggtaacagccagtactggtgtgaacgattttgaaagacgcttgatatggtctgtgttagaggcttggccgactccgaaagaggcacgagagaaaaaaagcttgttagtaaacatgggattagaagaaatcccccgggcatttctggagaaggtgagggaactccgcgatcctttacaccgtcttgcctgtttgacaggtttttctgaagatgataaggaattggcgttgctcgccgtaaaagaactgatggaaagtgatgcctcgggagacgaatggtgggagtatcttgaggtggcatacccggaacttttgtggtacttgagggtgcctccagtaacggaggttccagaggcccaacttcaggagtatttctggttatacacgcgttcgcgggtacgtgacgaacctgacgcgaggttgctcgaactggcccagcagatagctaccgaccagattctttggaaatgccgcacaagggatcaggtactggaagaactgaagtgtcagggcgtgatgaacatattatgggttgatgggttgggcatggagtggctcggtgtgcttctggagacccttcgcacgcgcgaagatgtgagcgtgactattgaagtggcacgtgccaatctgccgactactacggagaataataggggttgggacacggaaaaagcagtggtgcgcactatagaccgtgatgggcacgaagttccctatccctgggcactaatcaaacaactgagtactgtccgtgaggtggcaaaccgggccctgagttttctcgatacaatggaacaggtcgtcattaccgccgaccatgggttaacccgctttgcaaaaacaagtggcggcattcgtttggctggtaacgttcaagtgcacaagtggggacgctgtgctactgtgccgagcgggttttctctcaagccagagctccaggccgactgcttgcttcagggctgtacacttattcttcttacgcatgagaagttttatggccagagcgggacagcatatcaagtacacggaggagctacacccgaggagtggctggtgcctgtggtgagggtgcgcaggatcgatcgcggctacggtgtgcaagcggtgagggtgcttacgccgcaagttttgttcaatgtccggggagaaggagaactaagggtagaactggtgggctataaaggaaaagcagtggaattgcgtaccagccagtacattttcgaaggcaagcagacacccggaggagtatgggtgttttaccttcgtggtctgaaaggtggtcgttatcagggtttcttgcagggtgacgccggagaactggccgaaatagaatttgacgccgtaagggggttagtcgaagaagatctcggtctgtga

SEQ ID NO: 1360 - DNA, 2310 bp, Coprothermobacter proteolyticus
atgaatgtgactggctttgatgaacttgctgctttggttaaccaggataaggcgtcaaatattccttctgcaacgcgttaccctgttcgcttcatctttgtgaaagatgtgtggaccgtaaagaacattgtggaaatgttgaaacaaaggtcggccatggtagttgatgtgtccaatgtttttccgctgaatttcagctcagacggttttcctacagctagtactcttttacaggagataagcacacaagacggagacttagtcgttgtctctgcagggaacttgattcgtttttggtcagatgatgagtttggcctccttgtgagcagtctcatggagtttgagaattcgcttagaacacctaaccgccgtatatacgtaatcctggagggtttggctgagcgttttgatgcggtgttttgggacaaacgtagaaggcatattggtattgatcccagatgggtactggacagcccaagaagtacggttcgtgttaacatgctgcggtttgactaccaaatcaacggaagaaatgttttgcccgatgtcaagtcgctagctggactttggcaaggacccaagcagaacgagttcatatgttgttctcaaactttgcgcacgaaaacctgttattgctcagacgacgttgtatcctttattgatttagatacgccgcctgaattcttacaaaaggtaatgcacatcgatgttagctgtattccatacgaaaagggtgaagagggcttttggaccgagctaattaatgagtttagaaatactaaattacattcagtgaggacgctgctggagaaaaaatacaacctcaacaatgcagaagaagctaattggacagatatttttgttagtaaatcgaaaaatgattatgaaagatgggtcattaagaacttcgttgtgcgttgtactgatgacgatgcgttagagtttgttagattaacatttggagccatgcgtggtatgtcggttgaggagtttgttgaacagtgttggatgagtccttttcaagaaacgctttcaaaagagttgttggctcagcgcttcgttgttcttcgcgacatacatacactcttaggcaaacgggttccgattcaaatagaacgtgagctggaagagaagctaagcacgggtgatccatcgactttagcgcccttggtaaccggaattacctttgctgagaggaaatggctagttagaaactgggagttagtgaatgacttaaaagataagtattctgctcttcactactacctttcagatgtgaacgtggttagcgattcgccatttactgataaactacttgcctacataaatgaatacaagcgctgcaagttaagaaatacaattactgacgaattagaatccttgctggaagacttaaacaaggatgaatcttctttttacgattggtattactctttacctacggccgcaaagttaattggtggtgatatttgcggctcactccattgggtagatggtttgggcatggagtttgcatcattggtgtgcaaaaaattggaggaaatgggatacgaagcggaagttcatcttgccagagcgaacttgccaagcaccacaggttctaatatgtttcaaggtattgaaagaattgatgcactggacagctacattcatggcaaaaccacataccaatacccggatgatttagttaaggagctggagttggtcgcagacgaaatcctcccgcctttggcttctttgaagaaggacttttgcctggtttctgatcatgggtttacggtttttgcatgcaataagtttcaaaaagtacataagtttaagttcgagaaggttcgcgacgaagggcgttacgccgagcttgacccgggacagaaggtgccacacgatgaggatgttgttgtttacgaggatccagaaagtgagagaaaattcgtacttgcgttaaggcacatatccgtttcgcaaacgccaaaaagagagtcccatggtggggcaacacctgaagaagttttggttccggtcattttcgccagagtggctaagaaagtagaatacgaagtagagttggagacacctagcatatctgtgcgaaaccgtgtacttcgttttcggttaaaacccgaacccaaagctgttccggaggtagtcattgggtctaacaggtatgaagcaacacgaacaaaggattggttcgaagttagcctgaaaaacctccgatcaggtgattatgtggctaaaatcacagtacccggatttgaacaggaagtacaattcaaagttaagggtgggattgaagaaaggggcttatga

SEQ ID NO: 1361 - DNA, 2220 bp, Cyanobacterium stanieri
atgacaaaaataattttagatcccactaatttatatcccatagagcaaaattacattattattagtaacgaggtagaatggctaaaatattttactttaaaggatgacgcttattggattaaaaataaaataccttgtgcttggacaaaagaatggttaaaagcttgtaataaaacaaatttaattattgaaataaaagaaaatccacgctctttattagcttctatgttaaaccctttatctattccgaatcaatggaatgatcaacaagtgttaggtattttaaatcaactaaatacttatccagataataaaattgctcatttattagcagaaattactaacacagaattaaaactatgggaatgtataacaccctcagaaaaacatcttgcccaatggctatgtgttaatattccagaagaatatcaagtatttgagcaattttggttagaaaacttcatcagccataaccatgataataaattaatcgaatattatcgaataaataataaattaaatttactcaaagattgggtaggtatcaggttaaataaaattgataatttaggtatttttccattgtcattaccagtgattatcgaaaaagaatttatcaacttttgggaggaaaaaatagttcaaactcaaggggagataattgaaaatttaattttacctcaagaatataaaaaggaactgattgctgaaatagcttataatattttcctagaaaaaactaactggattacccgtgatagagtagcaaaaattagtatttatctcaatgcagataaaagacaaaaacttaatcaacttattcctccttcaccaccaaaaccattagatattaatgctaaaccagatgactgtttacaatgggtaacgaatcattatttaccttttagattatgggaaattaatcataacatgagtaacaatcatgaagacaaaaatcaaattagtagcaaattagctgataattttgtgaattggattgtgaaaaattatcccgaattaaaattagatagtgtggaaaaatcatggttaaattatagtgtcaccccacaagtggaaaaactagcgaaaaataaccccattctttgggttatagttgatggtttaggatggttagatcatcgagagcttatttttaaattaacagagaaaaactcattatctattcaacaagatattcagcctaagtttagtattttaccaactaaaacagaatatgcaaaatggagtttatttactcaacttttgcctaatcataattcttggaataataatgcaggagatggtttttctcttattaataatgggcatcgttatacagatagaaataaaccaaaattaatagaagatttgcaacaaaaaaaatatcaaatttattgttgggataccactcaattagacgaattatatcatcatcaaaacgattggcaaactttgtataaactagagcgtgaaaaagttttggatggaattgtcaaagatattttacactttttacagcaatatcctgaaccagaaaaattacaaattattattgcgagtgatcatggtcaaataataggagaagttgataagatgaacaattatcctaataatttaaaacctcaaggtagaatggcaataggtacaactgatgactctcgttttgttgtactttctgctcaaaaatttgatttacctcatgatattagtattgtgagaagtcaggattctttaggctcttttaactatacacaaaatcagaaaattatcggtaatcatggaggcttatttcctgaagaagtagtagtaggattctcaattttaagtcaacaaatttcccgtttacctgtattgataacttgcaggggagaaggaaaagcaaaagatagaggagaattagaaatgattattaataatcataataaattatctttaactaatctatgcttatatattaatgaaattggagaattaaaaatgggaaaaatactcgatatagtaattccccctaatcaaacaattaattataaattagagataaataaatgtccagaattactaccagataatagtaataattattatactttatcaggaaaactaacctttaattttgctaatactgaagttggagaagcagaattagacgctcaatcattactaacaattaaacaaatatttaccagtggatttacaggaggtttagatgaatttttctaa

SEQ ID NO: 1362 - DNA, 2250 bp, Denitrovibrio acetiphilus
atgttaagtagagctgtcggtagattcttaaagtctacaacatattatcctttttttatcacagttggtgatgaaaactattgtgacattaaaaacaaactatcaaatcttggattacattttattaaattaagtgactattgcaaagaagatgataagttaccggatttagatgctctatacgaacagcttaaaactaccaataaaatgttaggtgttaatacaattgctattcttgggcttggggagtatttagctctttgcggaaaaagtgaagtaaatagagttttgacacatttacaagcaatgaatacatctaaaacaaaagttgtattgctactacgtggtgtatcctcgtatgtaaataacttgtgttcagatatccgctttgatagcagtagatttttttgtgcgggtagcactgattgtaatttatctataacagtgagtaagctttctacttcttatggagtcttgaaaggattcaaggctttgcttaatgaattagaaaatgggaaacgtgaaaatattatagtcaatacaaacattgatttaagtcagtcgctttttactaagcgtgagagatcaaatgcttatgacgaaattctgtttattctggaaaacttcagtttagcagagacttgtgggactaatgaatattggtctgagcttttaaaggtattgacagcgaacgacaattcccttgaggctgttcttgaaaaatacggtttaactgttgatcttgaattgaacatacatgataaaatatttggtagagaatatcgaaattggttgttttttattgctctaaaaatcaatatagatagattgtcgaacagttatttgagacttgtgttagagaatactcatgactacaaaaatctaaaactgaatttacttaattatattattaatatatcacatactgataaaaaacataatactctctatttagagagaaaagaccttattagagacttcccagagcccgatattgctgaattcattataagaaaccgcaagaatctttcagaaagtatttacaaattgacggataataccatagttgagcgtgaagagataatagcttgggtatcacaaaatggtattattgaagaaatcgctgaaatatatcccgtgcttaatacctatttgaaaaagtttgtatttaattgtggagatttatctgatttgcttacgaattatttcagtaattacaaagagcaaaaagtctctaacaagctaaataaagagtttattgatcaaattgaggtgcttgctgaaaatcgaatttataatcgtttacctacgcgcaacgaaataattgataagttagagaaatctgactcacatctatattggcttgatgcacttggcgtggagtatctttcatttttttcagaaatggcgagagaatatggactttacatatctataaaaattgcacgtgctgaacttccgacaataacttcgataaatagaaattttttcgacgactggcaaggaaatagcaaagaaaaagacaacaaactagatgatatcaaacatagcgatgaaggtggttataattacgataacaacgttttaccaatacatcttgcaaaagaattagaaataattgagacggttatcaaaaaagcagcgacagcactaaagcttagaaaattcaaacgttttttagtagttagtgatcatggtgcttctcgcctagctgtattaatgaagaaagaagaaaagtacgaaactaatacaaaaggggaacattcagggcgttgttgcaagttatttgaaccttacgatctaccttttgctgccgaagaaaacggctatcttgtgcttgcggattacggaagattcaaaggtagcagagctgcaaatgttgaagtgcatggcggtgctgcactagaagaagtgattgtccctattattgaattaacactaaaagatgatagcggtgtggtagtagaattagatgacagcaaacttataactgtagactatagaactggtacagaaataatcttattcataaactattcacaggacgaggtatctgtgatatttaacaacaaaagatactttgcggaacagattgataataatcactataaggttgagctcacagatatgaaacgtgctggtgaatatcttgttgatgtttacagtaaagataatttgattgctactataagctttaaagcacatggtaaaagtggcaaaattattgacgaatttaatgacttattttaa

SEQ ID NO: 1363 - DNA, 2061 bp, Desulfitobacterium dichloroeliminans
atggtatacacactcaacgaatattgccaattcggtgactgtaagtctgcgcgtgtagtagtttatccgaatatcgatacggcggcatacttacttgcccaccataaaaatgaagtgaagttgtcagttagcgattgtatttccgatggtgcggttcttttgcctatgcccgacacgctcttcgcatgtcttgacaatagtattgcaacacaaaacggacgtgttgtcattaccggcattgatgcctatctatcattactctccaaacaaaatattgatgctttctttgttgcgttacgccatcggattgacgaagggaacctgaatgccacttatctgctgagtagtagctataacatcgaccggtacttcgtcaatccgaagtatgaacagtcactagatgttgttaaaatagcgacagtggaaatgataaactctgtcgagccgccaaaagttgaggttgtttcatctaaatggttcggatctgcaaacaatctcaatgattataaaacgcttctaaaaagactcggtgattctgtctcaacaggcaaacacttacttgtcttaaatgatctgcgttataaacaagcaggactaagtgaaaacatttcgttctacgttgatgtgcagcaagtggcggagcgtttctacagtttcaatgtcgttttgaaaccctctacgatggaaactctactactgaaagcaaaagagaaaaatgtatcgccggaagcgtggcttgaggtccaattcggcaaagaaaatattggcgttcgctatgcgcttaataggttgattgaaatgcttgacgatgaactttggatggcatatgtttggctgctccaaaagaagttaccgatggatacctacttgtcaaaggttctcgacgctgaaccgacacatgaaaatttacttcgtaaatatgtggttgaaacggctgtgactctactcggagatgatgatgctaggcgacttgcagttgaacgtgccgatgctcttagcccattgatgaatacagtagaacctttgattgtggagtttatcgggcaaacaaagaataatgtgactgcagcagaattccttaactgcggcacaaaagcggaaatgcgtgagattgttcgtcgtgctgcaaaatatgacttgatattgggcttaccggatatattgaaacgcatatgcccggtactttcggattatttgtcggattatgactacggtgataaagatttgactgcttacttcaaggaatatcgtagatttaaggtaaacgacaccgtcacagatgtgttcgctaaaaaagcgttcaaccttgtattgccgacttcgcttactgctcgcgattcggttctgttgaagctgtcaaccgacgatgatatggcccttcttgttgtggacggaatgggtgcagaatattatccgctcttgctggcaatggctaagcggcgaaatatgaatattgaatcacatgctgtcgtctcggtcaagttacctacttcaacaaaatataacccgctcaaatgggctaatgacaggacacttgacgaggtaaaggacatagataacattgcccactacggggaggcgaagcacgagcattgcccgcccgaacgaaacatagcggcatctttgcgagtttttgaatcagaggtatttccgcgcatttctactggacttgagaaatactcccgtgtagttttgacttccgaccacggctcatcaaggcttgccgtactcgcgcgcaataatggattgggtgccactctaccgtggaacgggaatccgcttgattggcggtattccgttgctccgcaacacggaaatcgtccgccggagttcgagtcgcaatacagcgcgagcgatggcaagacgtattgggtggttcgtggatataaccgattgcctaagcaggggggcaagcttaacgaactacatggcggtgcctctcttgaagaacggcttgttccaattatcgttttctcgagagtgaaaactacagaaaagccatctcaacttggtaaaaagacaatggagcaaatcctagatagaatgggatttgatatttaa

SEQ ID NO: 1364 - DNA, 2103 bp, Geobacter sp.
atgaccctgagcgaatattgcgaatacatcagtaatccacttgcggaggccaaggcgcgggtggtgatcgtgcctcctggagaaagctggaccgcgttgcgccggttctgccaggaccgtggtgatattgtgatgcgtttgagcgattttgtgcaggaagacgcgtggctcccaatgcctgacgaagtgttcggaagggtgcgcaatgctatgacggcacaggaggtgcgcggtaccgctgtggtattgctggggatgtccggctatcttgcgttattgacagacgagaacaaacgggctgcgatagtcgcattgcgcgaatgggtagatggtacctcagagcggcattcggtctgcttcttgcggagtgatgacggcacggatttgttactcaagaatgtctttgcgaatccgcgttaccgtcaagggaagcaactgattgaaatttcaggagatgctgcgccgcgtgttgctggtcgtacggaggtcatgctggtcggggatgatttagcaccattcgtcccggatgcgtgcgacacgtttcagaaatatttgcgatataccgaagaacaaccgagtgacagctttatccgacggattgtggtgacctcagaagggcgtgaattggcggggcttagcgccgaagtgcgccaggtggtttgtctgcgtgattttgcccgcgtgttttacggcgtagaagatttgggattgaccgaagatgccctgtggtggatgtgcgaacgtggtaaagaaggtgctgggaaaacattgttggatacgcttaaggcactgtttttttcgggaagtggagttacaaagtgtgtcctgcgtgtatttgacgaacagagaggggcggaacgcgaggcgttactgtggttggtaaaacacatcgcctacaagggaagttaccttgagcgtgtcgtaaggcacgagggagttcacgtcagtaacttccgctccgcatatgtaacgggtgccctggagtggctggatgaatcgttagtacatgccggagaacgtcgggatgctatacgggaagctgacgttagcaggtccgacgcggatattcggcaattcattgcgcgttgtgcgggcgaatccacatcgcgagttgcgccttggttgaattgcaggacggatgcggagcgcgcggaattactgcggcgctgctcggtagataacattgtgtcaaacgtagtaaaagaagtgtacccggaaacggcaatgtatctcagcactgatatcgtttttggcaacgttgctctggaaggatatttcaaggaataccgtgaactgaaaatggctgaccgcgtgacgccgacgttctacgaaaaggcacgggaagcggttcctccaagttcggttaaatcgcgggatgcaatagtgcaacggtatgcttcagacaatgggtgcgcactgctggtggtggacgcgatgggtgcggaatggctgccgatgttggtgactattgcgcggcagcggaatataggggtggattcgattgatgtctgcaaagtgcatttaccgacgtcgacgagattcaacaacatccattggccaaatgccctacggcgattgccggacattaagcgatttgacaacatcgcacacaatggagccgaagcgcacgagccccggcgcgttgaggaaaatttggctgcggcgctggatgtgatcggcagcgaggtattaccacgcgtggcggaggggctgacaaaatttgaacgggtgcttgtcacagcagaccacgggagttcacggctagcggtgttggcgtggcaggcggaaccgaggctggccaggacgcttgtatgtgaggctggcacggacgttgctgactggcgctaccgagagcgggcggcgcaaggtgcatgtccaccagaactagaagaaactttggatggcaggtactgggtgatgcgcgggtatgacaggctacccaagaggggcggtggacagggctttgagttacacggcggagcggcgctagaagagcggctggtacctgtagtgattttctcacaaacggggcagttcctggcgaaggcaaagactgacggtaaacgtgcgcagattgtagaaaaagacgatttcgatttgtag

SEQ ID NO: 1365 - DNA, 2397 bp, Prevotella denticola
atggatgccctcaagacatatattgaggaggataaacaggcgaaaggtattgatgcttttacgcttgatagatatccaatacgatttgtactatttgataattttcgagactgttatgactttgtggatttcctacaaacagaacaaggtatacatgttgaaagtgttgatcattggatagattccaattatccagacttactcattacacatgtggaacttgcctctcgtatagctgaacatataaagagaaaaagtcctaatgactgtgtgattgcccctttctctgagttagcacgattttatgacaatgaagataaaaagtcttttgatgctttgataaaaactattaaagcaattgaggcaacaccaaaagctcaggaaaagcaccaacgtgtttatattccacttgtcggtcttgaaggtaaaatggataccttcaagaatgacagccaaatcaatatttggagattgatatcagagactaaagacctaacatataagctcattcttacaaaagacacagacttcggtgtaagtggtctgaatgctaattataccattgtaaacaatatccgggaatggttgaatatatggaaagatagtaagaaacaaatatctccacaaataatttgcaaatcaaaggctatatttgctaatgctcggtttgcacaaccagacaatgccttctcttatcaggcttgcagtaatgcatatcaatttttgactgtaggtttaaatcttgaatttggtgctattgagccattagaaagtgatggggataattggaataaattagcagagagtattgatgttagtaatggcttcaattttgacaaatatgttaaacaatactttagtataaataacatagaaacatataaggagtttattcgtctatggtttgacaatccttatgtattcaatcgttggcttttaacacgtttctatattagtaaagcaaatggtgaaggttatttatgcagatgccttaatgccacctcttcttatggtacaaatgagctgatagagaaaatagcaggggatataacggaaattgatgcagaaatggaagtacgaaaatactgccttacctatgctgcccaaaagaatattcaattgtcggatgctgcagaaaatatgatggtaaaatctttacaaactttacctgcaaagatggggtattctggcactttaagatattttacgggaatcacacaaaaagaaaaagaactagcagtaagttggttggcacaaggctttattgtgcctaaggacattgctacattcttcccagatctttatacctatatgaatgaaggtattgggggtgcaactggagtaccagactgggtgaatccatacattgagcaatataaaaaagctaagattactaatcgatacacaacagaaatcgaacaacttataaataaacttaatggctcagagtcttcatttgatgtgtggtacaattctttctgttctacttataccttactacaaaaccgtggagacattgaagttttttattggattgatggattggggatcgactggattcctctaattaaaagcattattgcagagagaaaagaccagcagattttcctcaacgaaataagaatagcccgttcccttcttcctactaggactgaaataaataagaaagatttacagcgccttcttcctcagggagttcaattggagaaatccggagatcttgacaccttggctcatcgccctgataatataagtccatttacaattatcaaagagatagatgttatacgaagaagcattgaagaaattttgcagaaatatataggtaagaaaattgcgattatttctgatcatggtctgacctatttatcgcaattgcttaagggtaaaaatatgcctagtgttgaaagcgatcatcacggacgtattgccattcgtgaaaaggcggattctactatggatagtagctatttccgtttagaggataataaaactttatgtgcgttaaagcatgaatcgctttgtgccaaagttccatctggacaaggtgcccatggtggctgtacgcctgaagaggtattagtacccatttttatcatttcaagtactcctatggcaactaactggtcattcaatctactcacttgtgaaataagtggatcaaatccacgcatacaatttgaaattaagaatatgccgtcagctgaagttccttacgtactttatagtggggtaaaatataatgttcatcatctgagtggtgatacatatgaaacagatgatataatcttaaatgccaatattttagattttacgcttcatatcggaggaattgttcgtccaatgaagattaaggtaacaacaggcattcaagaagaagacccgtttgacttttaa

SEQ ID NO: 1366 - DNA, 2394 bp, Thermotoga petrophila
atgaaaatagagaacttttattctcttgaaaaattatacgatagaataaaacaggataaaaattctaaaagaatctctgacaggaggtttccaataaggcttatcttcattaattctttcgaagaattacaagaaattattagatttctgaaggatgattgtggtgctgaaagtaaagaaataacggaacttctatctagcaaagatcaatggctaacaccaaatgaaatagtaaattggataaagggaatatataacaatgctgtcgtaacctcgctctcagaatttttgagatttcaaaataaagaaaatttttatataactttaaaaaaattaactgaaatcgaaacacaaaataatataagaatttatataccattagttggattatgtgaaagatttaaacaagagttctggacaaatttttacagaaaggaagaatgggcaccgatttggaagttagaaagccattctcaaaaaataattatatatcaaataaattttgaattaaattatgaaaatctttttctgccagaaaactttgaaatagtacttaccactgaagaatggctaaatgtttggaaaaagggaaacatgaaaggtattctatccttgtctaaatctttgtcatgcttttataaaaattttctcccagatcaagtatttgaattgagagagatttcaaaccaaaaagaatttcttaaagatatttttgaaatcaatgttccgatagagtttaaagatgatgaaaaggagttttggaatgaactcataaaagaagcagttagatataatcaaaaaggactaactatagagaatatatttttgagtcattttaatcttggaagcgcagaaaaattaacatctgaagaatttcttgatcgctatttaagaactaatgaacattatgaaaggtggctaattagaaattttttgttatctttaggtaagtttaaatcttcttatttatacaaatgtttcgaaagattaggggaattaaaagaaaaggatttgatagaaaagttatggttagaaatatttaacttacctttcgaaacactaactgaagatattttttccgagagaagagaatttttaaatttcatacataagaaactcaatatatcagctcaattcatagaaagaaaactcgataatgcgcttgataacataaaaagttatccattaaagaaaaaactcaaatatttgaccaacataacatttattgaaagaagatatattatttccgaattaaaaaacactaatattaatattcaagaaattattcctgatctaaaaagagtttatccagaattagcatattatctggattgggacttaataaagcccgataatgaagtggataattggatacttgaatactttaaaaagtacaactgttcgaaaataaggcatactaaatctcaaaaaatagaagaattaattagtaacaaaaacaaagataagtctactttttcgaattggtattattctttgcctaaagcagaaatagcaaaagatttcaaatatgtgtggatagatggattgggagctgagtggtttccgttaatagttaatctacttaacaaatatggcaaagagaacggaaaaattataaaaaagaaaatgcttacacgagtcaatttgccaagcattacaaaatgcaatagatatgaatttgaaagaattgaagatttagataatcatatacataaccaaaaatcatataattatccagatgatttaatcaaagaaattgaacttatagaagaaattgtgaagaaaattatggaaatgccggacgatagaatatgtattgtttcagatcatggattcagttttttgtgtttgaaggattttgataacttcaaaagattcaatttttcaaacgccgaacatgagggaagatacatgtggattgacaagatagattataaagatgacgaatattttattgtttggaatgttgatgaaggaaattgccgggatagaaaagtccttgtggcattgaaacatgtgtcattaaataacactccttatagagaagtccatggaggtgccacgcctgaagaagttttggtgccttatattgtaatagaaactgaaaaaaataaagatgaaattaaatataaaattgaacttactgatcctgaggtatggataaccaatcctgtagttcaattcaaaatatatccacaaccttcgtatattcctgaagctttcttcaatgaacaattattgaatatgtcgtacgagaaagagaatgatatctataaaatagatctaaaaggtttaaaagctgggacatacacgataatgttgaagataggggatatgaactatcaaataaatgtaactatcagaggaggatttaaagagagggatcttttatga

SEQ ID NO: 1367 - DNA, 2550 bp, Actinomyces sp.
gtgagcggaatcgatgcctctcggctggcagaggaactgaacgccctgctcgagcatgggcgcattgtcacgtggttggatcgcaacggcgaatacgccgaggaccttgacgccgtccgagagctgctcgacggggctacacttatcacgatcaacgccaacctcttcgaaaccaaactccgcatcttcgccgaagacaccaagtcccgctacgttctctactgcggaggcgagctcccgcccctcgaagaagacctcctcgccgacgtgcgctgcggataccccacattcaaggccgacgcttcgaccctcctcgtgcgcgaactcggcgtcgaccccggcctggccgcagtcatcgacgaatacgcccccttcttcaactccaccgcccgcgtcgccgaccttaagaagcacctcggagccatcagcgacgccgacaagcgctccgaccgcaggaccttcctcgccgcgatgagcgccgttctgctcaagacgcagcagcgttccttctccgtcctcttcgccaagctcgcctccatgacgcaggacaacccgctcgacgccctcaagtggggcctcgacgcgtacttctgggaaggtgcccacgccatctgggggtacgacggcgaacacagctttgacgctctcatgacatggcttttcgtcatgaacgcgaacggctgggaccaccggcacaactccgcccagcgcgacttcagcatgtggacccgcgacgtggccacgcgagacgacgcccgccgatgggccaggcgcgtcgatgaggcaaccggtgccagcgccgccctgcgcgatgcggctaccgacgccctcctcatcgacacgaccacgcccggcgttgaccgagaactcatctcccgcctcgtccgcggaatcatcgacggatccgttggcgtcgctcaagtcgaagaacagcgcggaaggcgccgcgaaggcctctggttcgacgacacggaggcgctgtgggacgctgcgcgcgcgggggcgcgtctgctcacccacctgcgtgcgctcccgggcatcgccttctcggacgcggccgagggcttcgcccgctacacgaacccggacagcggcttgtgggccattgaccaggagtaccgccactacgtgcgcgcctcccgagccgttcacgtcgatgatgtcctcaccgacctcgaccggcacgtcgaaaatgcgtactgtgacgactacctgcgccccctttcgcgcacgtgggacgacgcgctgcgcggcatgcgcacatgggatatcgccgtgccctcgtctagcgggcgcattgactcgttccaccgtctcctcgtcgcaggctcccacaggcgaaccgtcgtcatcatctccgacgctctccgatacgaggccggcgtcgagctcgccgaccacctgcgctcccttggacgcggcgcgatcgccctgaatccctggtacacgatgctgccgtcgatcaccgccctcggaatggccgcgctgctcccgcatcgagagctgacccttaacgtacgcggcaaagaccaagtggtcgtcgaggctgacggccgaccgacgtccgggatcgatgcacgccggacaatcctcgaaggtgccgatgggcgtgcgtttacctatcaggagctcgcgagcgactccgtcaagtcgatgcgctcgaagttcaagggtgcctccgccgtgtacatctaccacgatgtcatcgacgcgatcggcgaccacgcggcctcggaaagtgatacccccgatgccgtcaaccgtgcgattgccgagctctccggcctcgtcggcaagctcatttccgcggacatcacccgcatcctcgtgaccgctgaccacggcttcctcttccaggacagcgaacccgccaacgacgacaccgcgaaacaggacggcgttccgcgcgggcgttccgtctccgtgaagaagcgtcgctatgtcctcggcaaggacctggggtcgacggatgacttcgtcgctttcgacgcgacgagcgtcggcctgacagacgggccgagcatcgccctaccctacggcacccgccgcattcgcacccagggccgaggaaaccgcttcgtccacggaggagcctccctccaggaaatcacaacccccgtcattgaggtgtcggtgggtagtaggggtgccgaggacgtccgcgacgtcggtatcgccctgcattacgacgacatgtccctgaaggttaaccgtttcagtccacgtgtcatccagcgggaacccatcagcccgacgcgacgccctctgaccgtcacgattggtctcgagagcatgttgggtgagcaactgtcgagcactcgagtccttactctggatgcggctgagcgctccgaggtgtcgctcaagcagagcagcgaactcatccttttcgacggggtgctgcagagacactccggcgaagccgtcaggatcgtcgcctacaagactgttcacggacaggtcgtcggcgaggccgtcgccacccacgagctgaccctcaacgacaacgggttcggagggttcggaggattcggaggattcgacctatga

SEQ ID NO: 1368 - DNA, 2658 bp, Vibrio cholerae
atgcagattagcgaactggcacaaggtgtcgctgccaagctcgaacaaagtcgcattgtgttttggtacgacccagagcaaagctttactgaagagcttgagcatttagctaacgtcctatctattgcaaaagaagtaggcgatagcgcggcagatataactgctagggtactgccaaatgatttgaccatcctcaatatgggcaatgagtctgtattagcagtgaaaaagcgcattgaagtggatgagcctgaagctaaattccttatctattttccaagcgctgagccagagcccgaccgcgattggttgttagacgtgcgtttgtatagcgagcagttttttgctgatcacagctcaatgctgcttaatgaactaggtatcccgaaaatggcgcttcgcacgcacattcgtaagcgccagagtttttttgccaataaacagcgcatagccggtttaaaaaagtgggtgactgagaacgaagacgaactgtcgttagacaggaagatgatggcagtggttgtaaaagctgattctgcgtctttgtcggacattctgcttgggttactacgcgagtatgcggcttatatcgaagatgaaagccttggccaacctttatggagccagctaagtaagtttgatcttgagacctcactctgggcctatctgagtgagggttttggctatacagtcgaagagccaaccttctcagacttcgtgttgaaattattctgtactgaattctggagccaaattgaaggtgttgaacgcgattggttgcttaacaatgttctaaaaagcgcatcaggccgggcgacagccttggcgtttatggtgagctggcgcgacagccgctctttcgctgcttactacgagagcatctctaaggtgcttagccaacagctggaaatttcgactcgtgctggccagtaccatccggtagagcttatcgaatgcgaaacgtttgaagctgtggaacaggccataatccgtggtttagttcgtgatttgctcgatagcagtaaagcgctagaccgggttcagtttgatacggttttatcaagacgtcttgctagccactggacattgtcacgcaaagaatatttcgcaatttatgaagctatccgcaacgctgaagagttgatgcacttgcgaaatcgctatgtggacgggttccactttgataacgcgaaggcaatgtacgacgcctataccacagacatttatcgttttgaccaagcttaccgtttgttcaatgaacatgtgcactctgtattgagtaaaggtgcagacatactgcgtcagctcgacgacgaagtcgaaagcatttataccaactggtacttatatgagcttggccttgcctgggatcgtcatttggccaatgagaaactacttgaaaagtggcagatttctggcgtaccgcaccagtatgacttctatgaaaaagaagttcgcacacgactgagtctgaaacagacaaaacgagtgtttgtgatcatctctgatgccctgcgttttgaaattgcgaatgagcttggcgctatcattaacaacgagaagcgatttaaagctgaggtgtctacgcagttgggtgttttgccgagttatacccaacttgggatggcggcattattgcctcataaggcgctcagttaccagccagagcaaggcacggctgtttatgtggatggtatttcttcacagggtttagagaatcgtaactccatcctacagaaggttggtggtatggcagtgagttctaaggaactgatgagctggagtaaccaggaggggcgtgacaaggttcgagacgtagaagtagtttatatctatcacgataccattgatgcgattggtgataaggctgcaactgaagagaaaacgtttgaagcctgtcgtagtgccattgaagagctaaaagacctcgttgggcgggtcatcaaccgtctaaacggcagccgagttgtgatcactgctgaccatggcttcctcttccaacaaaaagcacttgtagcggctgacaaaacctcgttgaaaaccaaacctgctggtgcgatagaagccaagaaacgttatatcgttggtaataacttaccttcagatgaagcctgttggaagggatcaattaacgatacggctcatggctctagtgataccgagttcctgcttccaaaagcggctcaacgcttccacttcgttggtggtgctaagtttgtgcatggcggagcgatgctacaggaagtctgcgtaccggtactacatgtgcgagagctacaaaaagaacaagcagcaaaacatgagaaacaaccggtaggtgttgttgcagccactcagcccataaaattagtaaacaatatcgacaaggtcagatttattcagacagaccctgtaggcgatcgttttgttgcacggttgttggatgtctatatcgtcgatgcacaaggtaatgaagtatccagtcgtgaaacgattaactttgatagcgtgagtaaagtgatggatgagcgtactcgcgaagccaggttaaagcttattggctctcagttcgacaggaacgctcaatacacattagttcttgagaatgcggaaatgagaacccgttatagccaatacgcggtaaccattgatttggcattccaagatgattttttctaa

SEQ ID NO: 1369 - DNA, 2700 bp, Vibrio harveyi
atgaacatagaccaaatatctcagggccttttaaacaaatttgaacatagccgtttagtattttggcaagataccgacaaagagttcattgatcagcttgatgagctttctattgacggcatcgagatcatccatttagatgataagtcccacttcgaagtaaagacacgtgtcgagttacttgaaccagccacccgatttgttctgtacagtaacactgagaccaacaaacctgaacgcgattggttatatgacattcgcctatactccgaggatttctatgctgactcaagctcaatgatccttaatgagattggcatgagaatggagtttcgtcaggttatttcccattaccgcgccttttttacagctaaggttcgccgtgaacgcctcaagaagttgctgcctcacagtgcaaataaggaagagctggaactagcactactagcagcgacacttaaagttgagtctccaaccttccctgctatcttgaaccatctgttattaaagcttgcagatggcatcgatgttaatactattttcagtgatctagaaaagtacaacttggttgatactttctggcgctttgctttcgatgtgatgggatatcaagttgaaaaatttgatgatacagagcaaattcaacctcatctaaacgatttggtgaccaaacttctattcacagagtgctaccagtctttactaaatagtggaatcaacggcaatcacgaggtctttgcaagattcaagcagcacctgctaccaatcaatttagatgaatcaggtaaacgggattataccgagcgaagaacatttaactcctctaaacgagcgacagcgatcagttttattaagggtatgcgagaaaatcgaaatttatcaaatgcatataacacccttgcaaaacaagttgagcaagaattcgagataaaacacatcttgtcgatggttaagtcccctacgcaccttcatcgtgtcgatacttttgaatatgcagagcaacatttcattatcttactcgctcaacaattgagcgacctcgatcaagttgaagtcgattcgttgatctctcatcgcttaacgacacattggactcatcatcagccaaattacgcagctatcttaaaagcaattcgagctgccaaacagttttatgcgttaaagcagcagtatattgacggctttaatttttcgtctgccaaagaaatgtaccgagcgtatgaaactgacttgtataagttcgattctgcataccgacgtttctgtgagcatgctttaaaagtcgctcataatggctctgatatattgaaaaaaacagggttggtttctgatatcgaaacactctatgtggactggtacttacacgacctagcgatcgcttggggtaaactcgtcgatgaagagtctctgttagataactggaagatttcaggcgtaccaaaccaaaatgagttttatagacgacaagtcgaaggcatttttaatacaacacaagtcaaaaaagtatttgtcattgtctctgatgcacttcgttatgaggttgcccatgcgataagtgaccaaataaataatgaaaagcgctttcattccgagattaaatctcaacttggtgtagtaccttcctatactcagcttggtatggcttctttgctaccacacaatgaaatctctacacacatcaactcaacggtcgaatacaaagtcgatggtatcagtgctcgtggtacagacaatcgaaataagattttggctaagcgcaatgggatcgcgtttaaagcttcagaagtgctgaactggactaatgaggaaggcagagaaaaagttcacgatgctagagtgatctatatctaccacaatgaaattgacaaggttggagataaaggtgaatcagagcatcaaacgtttgaagcctgtgcgacagctatcagtgaaatcaagcagttaattgaacgtatcatcaatcgcttaaatggtagtcgtgtgttgattaccgctgatcatggttttatttttaaatccagcgatgttgtcgattcagatagaacggctttaaccgtcaaaccaaaaggcgcggttgaagctaaaaagcgctacatcattggtgaaagccttccaaacgatagcttctattggcacggtaagatgaccaacacagcgagtttaacagtaaactcggaatgcagtgacggtgaatttattgttcctcgtggatcaaatagatttaacttcgttggaggggcaaaatttattcacggtggcattatgccacaagaaatttgtgttccagtcatccaagtaaaagaactgactacaaataaattgcagtcacgatacgccaaagagcgagtacccgttgttccgctttcaaaccctatccgtcttgtctctatggcagataaaatcgagcttttccaggcagcagctgttggcgaaaagtacacggctcgtgagctagagatttggattgctgaccctaatggtcaacccgtatcccacaaacagaaagtgatgtttgatgcgacctctgaaaagcaagatgatagaaagcgaaatattgtgatcatgctcaacggtacgggatttgatcgcaccgtatcttataagttaatgatgaaagacgtcagcgatccgactaagacacaagagctacaacctcactccgtcacgatcgatatcgcgatagaagatgacttcttttaa

SEQ ID NO: 1370 - DNA, 2643 bp, Lachnospiraceae bacterium
atggatacagataaaataatacaagatttaaatcgcagatttgctgcacctctgcctgagttttatcagcgtcgtatcattttctggtacgatgaagataaggaatttgaggataaactggatgaagtggttttggaaaatgcaaaggtgattgcgctgacagaaaataatgcgttttctgtaaaaaaattactttcagtagatgatttgactacaaattatctggtttatagtccatgtgtctataactgccctgatgataactggcttctggatgtggagctttacagcgaggagtttcgggcagatttgatttctatctggatggatgagatgggacttatatcaaatccggcaatgaggaaacaggttaaaaattatcgtgcttatttcaatgcgaaagaccgtcgtttgaaagtcagtacacagaataaagttccggaaacaccggcacagttacacatggctgtcatggcggcaatctgtggattgaaagatgcacagcccaatatgattctccgtagtgtgtttcaggcgggacttgatttgaataataatacggtttatcaggattttgtaaaatatcatgcagacgcagcattttgggcgatggttcgtcagggatgtggatttgtggaggaagaaccagaccttgggcggttggcaattcatctgcttttaactgcagcgacccgtaccatgcggcaggaatatcttgccggactggacggttttatttccatgccacatcaggcatattgctatgattttattgctgaatggcttcatagtgacaacattcagcaattatatgatgtggcacgttatgttgaggatgaagcccgtctgcatcagcgttttgaaaagctgacggtagaggctttggtaggaacagaatgcttcccgtgtattaatgaagtgattctgacaaagctaatgacagagattagtgaccatatcattgatgtggataccattacgaataccgttgaaaaacggagaacatgtgtatggtatgagccatttgaaaatttttatgacggtatcttacaagtggcgaatatgcaaagtttctttaaggaacattctgccggattccataccgcagaagcaaaaagtatctggaaagaatatacagaaagttactatcagatggacacttattaccgcttgtttcatcttagttttcaaaagagtttggagacttccaatattctgctggatgatttgttcaagcacgttgtcgataaagtggaaggactctataatcattggttcttaggtgagttgggcaacaactggtcggatgtatgtgcggatgaactggcaacttacggtaaagttctggaagtaccgcaacaggaggatttttaccgttcccgtatccagacctcagatacgaaagtatttgtaattatctcagatgccatgcgttatgaagtggcggctacgatggctgatcagctccagcgagaaacgcaaagtaaggtttctatcagcagtatgcagagtatcttcccttctactacaaagtttggtatggcagctttgttgccgcacaaagaactgacagtagaggttcggaacgatattttgacggttttggcagatggtcagtctacggcaagtacttatagggataaggttctgaaaacagaagattcggcaagcgtggctttaaagtataatgacatcattgctatgaaacgagcggaaagaagtgctttggtaaaaggtatggatgtgatctatatttaccacgataccatagatgaagccagccacacttcggatactgctgtttttgctgcgtgtgacaaggcgatttcagaattaaagaaccttgtgcgtattatcgtaaatgaatttggtggaacgaatattctaattacggcagatcatggatttctttatacatacagtcctttgaaggaagaggacaaagtagataaaagaggcttttttgatgtggatgtaacaaactctgacattacaaaaaaagaaagtatcaagcgatgtgtggagtatggcagaagatatgcaattatgcagaagggtgtgcaaccagattacttgatgcctgtaaaatttctgggaggaaatacagaatttgatggatttgcaccgagagaaagtattcgtatcaaaatgaatggtggcggtatgaattttgtgcatggtggtatcagtttgcaggaaatggttgttccggtgattgagtatcattatctccgcaacgattctatggaatataagcgaaataagcagaaatatgatactaagccggtaacggtcaatttactgtctgcaaaccgtaaaatcagcaatatgattttttcattgaacttctatcaaaaagatgcggtcagtacaaaccgtgaagcagcaacctatcaggtttactttacggatgagtatggcaagcagattagcgatgttcagaagattattgcagataagaccagcgataacggtgcagaaagaactttccgttgtcagtttaatttgaaatctctgaaatacagcaatacagctacttattatctggtgattgcagatgaacagggattacagctaccacagcgggagccattccagattgacatcgcctttgcggtggacgagtttgatttttttagttaa

SEQ ID NO: 1371 - DNA, 2598 bp, Escherichia coli
ttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctgtcggtgaaaaaacgcatcgagattgatgagccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccactgtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcgcccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagtaaatactggtgtcagacacaaccagagtattacgccatctatgacgcactgcgccaggcagagcggttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccagtgggcgaactttatgaaccgcgtatcctgaacatttacattgtcgataacgctaataatgtggtgtcgggcaaagagcgcatcagctttgacagcgataacagcaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1372 - DNA, 2598 bp, Coprobacillus sp.
atggatgccgaaaaaattatacaagatttgaaccggcgatttgctgcccccctgccggagttttatcagcgccgtatcatcttctggtacgatgaggataaagagtttgaggataagctggacgaagtggttctggaaaacgccaaggtggttgctcttacgggcagcaatacgttttccatcaagaaactgctttcagtggacgatttgacgacaaactatctggtttacgaccctctggtatatgaccaaccggatgacaactggcttctggatgtggagctttacagcgaggagttccgggcagacctgatttctatctggatggatgagatgggtcttgcatcgaatcaggccatgcggaagcaggtcaagaattaccgtgcttacttcaatgcgaaagaacgccgccagaaagtaagcagccagaataaaattcctgctactccggcacagctacacatggctgtgatggcggcaatttgcggcttgaaagaagcacagccgaataagattcttcgcagcgtgttccgggcaggactggatttgaaccataatgcggtttatcaagacttcgtaaaataccatgcagatagtgcgttttgggcaatggtgcgtcagggatgcggatttaccgaggaagaaccggatctcggacagctggcaattcatttgctgttgaccgctgctacccgtaccatgcgacaggaatatcttgctggactggataagttcatttccgtgccgcatcaggcgtactgctatgatttcatctctgaatggcttcatggtgaggatgttcagcagctttatgatgtggctcgatatgttgaggaggaagcccgccttcatcagagatttgaaaagctgacagtagacgatctggcagtgacagagtgcttcccttgcatcaacgaggtgattctgaccaagctgatgacagaaatcagtgaccatatcattgatgtggatacgattgtttccacagtcgaaaaacggagaacctgtgcatggtacgagccgtttgaaaacttctataacggcattttgcaggtagccaatatgcagagcttctttaaggaacattctgccgggttccataccgcagaagcaaagggcatttggaaagaatacacggaaagctattatcggatggacacctactatcgcctgttccatctgagcttccaaaagagtctggaaacctccaatattctgctggatgacttgttcaagcacgttgtcgataaagtggaaggactatatacccactggttcctgggtgaactgggcaacaactggtcggatgtatgtgcggaagaactggcaacctacggcaaggttctggaagtgccgcagcaggagaatttttatagttcccgaatcagaacttccgaaaacaaggtgtttgtgatcgtttcggatgccatgcgctatgaagtggcagcagctatggcagaccagcttcaaagagaaacgcagagcaaggttgctatcagcagtatgcaaagcatcttcccgtccatcaccaagtttggtatggcggcattgctgccgcacaaaaagctgactgcggagcttcggaacgatattttgaccgtgttggcagatggacagcctaccgccagcggctatcgggacaagattctgaaattggaagattctgcaagtgtggcgctgaaatacaacgacattattgccatgaaacgagccgagcgcagcgctttggtaaaaggcatggatgtggtttatatctatcacgatacgattgatgaagccagccatacttctgatactgccgtattcgctgcctgcgataaggcaatttcggaattgaagaaccttgtccgtattatcgtgaatgaatttggtggaacgaatatcttgattaccgccgaccatggattcctttacacatacagccctcttactgaggacgacaaggtggacaagtccagctttaacggcatggatgtggaatacggcagacgctatgcaatcatgcaaaaaggcgctcagccaaactatctgttgccggtgaagttcctgggcggcaatgcggaatatgatggctttgcaccgagagaaagcatccgtatcaagatgaacggcggcggcttgaacttcgtacatggcggtatcagcttgcaggaaatggttgttccggtgattgaataccactatctccgtaacgattctatggaatataagcgcaacaagcagaagtatgataccaaaccggtaacggtcaatctgctgtctgcaaaccgcaaaatcagcaatatgatattctctctgaatttttatcaaaaggatgcagttggtgcgaaccgtgaagcagcaacctatcaggtttactttacggatgaaaacggcaagcaaatcagtgatgttcagaaaatcattgcagataagacaagcgacaacggtgcagagcggacattccgctgccagttcaatctgaaatcgctgaaatatagcaacacggctacttattatctggtaattgcggatgagcagggattacagatgccacagcgtgaaccgttccagattgacattgctttcgctgtggatgagtttgatttctttagttga

SEQ ID NO: 1373 - DNA, 2523 bp, Enterococcus faecium
atgacagatataaatacgcaacaaattgaagaaaaattaaatcaacgttttcctaattatggatgtaggaaaatcattttttggtttgattcaaatcaggattttcttgaagaaattgactcattggtcattcaaaatgcaaaaatctatcgattagaaaaggacgcacaatttaaaactaagcgtttattggaatatgaagatcccgaaactaactatttaatctatgcgccatttcctcgttgggatgataaagatgaagataatcatttgttgagtgtattgaattattcagaggaatttagtgcagaccgcttagcgattatcatgaatgaattggctattccacttagatttcatcagacagttaaacagtatcgtaatttctttaatgcaaaggatcgcatgagaagttttggtgaatttagtacgcatatgacaattaataaatcagaaacgattgaattaatgataatggctgttttgttgaaatcgaaaagtattcgattaaatgatttactgcgtgtagttctaaaaagctttacagaaagtagggagaatcctttaagggaacttgataagtatcagttaacagctaaattttgggaatttattcaaatgaaatttggctttacggatagccagccaacattggaaaagctgacgatgtgtctttatttgaactatttttattatcaaattgatcaagagatgccgaagaagttcaaaggatttgaaatactacatttgaaagcaaacattattactttcatggatcagtttatgaatgatacacgttacatggaaagctttgaacagctatctaaaaaagtatatcaggctattgatggtgatggattattagacagtatagaaattgatgatctaattgaagcagacgtattttctgagattcatgcaaaaatattaatgttttatgcagaacgattaaaggcttctgacactacaacgaaaattgcaggacaaacaatttttgatagtttaaagcagcgcgaaaaaatgcatttcgcatcggattatatttatgagtatcaattattgaaacatgcttattatcttgtggataaaaacagattgtgcttgccgatgaacatggataatttgctaactcaatatgagaaggaaatgtattgggttgatacgcattatcggaaatttatttggaatagtgatcatatagaagaaaagcaaaaatatggccaattgtatcgattagttgaagcaaattattcgaagtttcttgatcaatcaggacaaatttggaatcaaacttttgaatttaagaatcgtccatccattcgaaaattttataatcaagctgtaatgaaacgctctgttaaaactgtagttattatttcagatgcttttcgatatgagttagggatgaatttagaacgtaagttagttagagaaaagaagtattcaacaaacatggctagctttctttctgtattaccttcagttactgaattcggtaaagccgccttattaccaaacaatcaactaacttacaatgaaggaacagaagtactgattgatgggaaaaaaacgaatggtttatccaatcgaaatgcgattctccagcaacgagatgcaaatgctgtagctttaaattatgatgatgtggttaagatgaataaggctgaggtacgagaagtatttaatggcaaatcagtcatttatatttatcacgatcaagtggatagaacaggtgatcactcgaatgaaaatcgagtttttgaggcctgtgatttagcgataagcgaaatttcccgacttattaatcgcttgcataatgatggcagtatctatcgttttatagttacggctgatcatggatttatttataaaagaagccacgttgaagaagtagataagattgaaaatccatctagaaatgaaaaagatcgtgtagaacgtcgttttattcttagtgaagaagaatacgaaataattggtacgaaaaattactctttgggagattctttaggaaatgatgacactagaaacatttgtgtcccgattacttcaagtatttttaagaaagctggcgggggacaaagctacgttcatggagggtcatctattcaagaaatgctagtccctgttctagaaattacggtagccaaaggtagcaatgcaaaggaaccagtagcaattgaattaatgactagcaaccgcagaattacaggattatcaaccacgttagaattctatcaaaaaaatgcaattagtgatgtttatgaccccgcatctttctggctttattttgaagatgaatatggtgaacgtatctcaaatgaagaaatctatgttgcggattcaaaaacagaagatgcaaatcagcggtttactaaatttgtttttgaatttgtaaatcgtcgatatacagttgaagatacttattatttagtgataaaaaatcaaaaaaatgatttgaccgagcgaataaaattcattatagataatccttttgcagaatcatttgattttgatatataa

SEQ ID NO: 1374 - DNA, 2304 bp, Vibrio cholerae; identical to SEQ ID NO: 1292

SEQ ID NO: 1375 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgcgtcacagctggcggtgaaaaaacgcatcgagatggatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgtacgcaggcgctgaaaaacctggtgacggaacaggaagatgaaacctcgctggataagaaaatgattgcggtgatcgctggcgcaaagaccgcgaaaaccgaagacattttgtttaacctgattacccagtacgttaaccaacaaacagaagacgacagcgaactggaaaacacgcaggcgatgttgaaacgccacggtctggacccggtattgtgggaaatgctcaaccacgaaatgggctaccaggcagaggagccatcgctggaaaacctgctcctgaaactgttttgtaccgatctctctgcccaggccgacagacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggcggccctgcgcccggaagatcattaccgactcagttcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaaccagagtattacgccatctatgacgcgctgcgccaggctgagcgtttgctgaatctgcgcaatcgccacatcgacggtttccactatcaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcactctacagcaactggtatctggcagaattaagccgtaactggaatgaagtgctggaagcggaaaatcgtatgcaggcgtggcaaattcctggcgtgccgcgtcagcagaacttcttcaatgagatggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgatcgcagctcggcgtgctccctagctacacccaactgggaatggcggcgttgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaaccaggaagggcgagaccttattcgcgattacgaagtagtgtatatctggcataatacgattgatgccactggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacaccatcaagaaccacaaacgctttattatcggccaccagcttcccgccgatgatttttgctggaaagggaaagtggcggataccgcaggcgtgagcgacaacagcgagttccttattccgaaagggatccagcgcttccatttctctggcggcgcgcacttcgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacagcaccatggaaaaacgcgtacgcgaagttacgctgaagctgattggcgctagcttcaaccgtcgcaatgagtactggttgatactggaagacgcacaaacggaaacggggtatcagaagtacccggtcattatcgatctggcgttccaggatgatttcttctaa

SEQ ID NO: 1376 - DNA, 2511 bp, Lachnospiraceae oral
atggcggaattaaacctaaaacagataatagatcgtctgaatgaggaatttatgggtgataccagaaagctggtattttggtatgatgataaggcagagtttgtcgaggatatacaaggtatagaactcataaatgcaaaagtatattttttaaaaccggataatcagttctatacaaaatattttttggagagaaaagatttagagaacaattatttaatatatgccccatttaaaaaacctgatgtaaaggacaatcatcttgaggatacattgctgtattcaaaaaagttttttgcagatagggcttctttgcttactctggatttgggaattgatgaaaagtataaggcggtaatagagaaacatataaagttctttgcaaataaggagagaagtagaagattttatgatttggaaatagaaaacttcaatgaggaaaatattattatcggaattttaagcagtatctgccatacaaaaacatcttcttttgaagaggcggttcgtgtgattttgacggatggaggattaaatgataataaattcatctcagagattaaaaagtatgacttaataaatgatttttggaaactggctgagaagtattttggatatacagatataaatcctactcttgaaaactttttgaatacactttttgtaacatatactgcaaagcatatttcatcagaaataccaaaggaatggaagacattgctctcatataaatcaggaaatattattgcatttattgacagtatgatgaacagtgttttatacagtgaaaagtatgatgaactttcagattttgtggatgccgctcttggagtaaaaaaaatatttacagaataccctcctgaggcattattaaattgcgatacattcttatgtattgataagattttgattgattggatagtagatcgcctgaatgtagaagatataggtgcaaagctttgtgatttatccatacctgaaattgccgataaaagagagaaaatgcattttggatctaaaacaggatgtatttatcgtatgttaaaaagtgcataccatatagtagcagttggaaaatacagctgtcctgataatttttctgatattttggagcaatatttaagtacagattatagaattgatcaggagtacagaaatttttattttgaatttgacaagcttgaggatacacatatttttgaaagacttcgtgagcttgtagaaaatatttataccaatgaatatttgaatactcttttgcctaagtggaatggagcattaagggaagaggaagcatttacaaagtttccgctacagattgatttttatgacagtaatatcagaaatgcaaaggagcgtacagtagttatcatatcggatgctatgcgttatgaagtcgggcaggaattatataagaacttggcagatgatccgaaatgcagggcaaagcttgatacacagctttcggttttgccctcatatacaagacttggaatggcggcattattgccacataaaagtattacaatgactgacgggtttcaggtcttggtggatgatatactttgtgataacctaaccggaagacagaatgtattgcagaaacattctccaaacagtatatgcattcagtttgatgatattaagaatctaaaaaagattgagcttagagatatttttaccggaaagcaggtggtatatgtatatcataaccagatagatgccagaggcgataaggcaaatacagaggatgaggtatttgtagcctgcaaggaggcagtggaagagatagtggatttaattcgccgcatatcagtaaacgcaaatacatatcattttataattacagccgaccatggatttatttataaaagagataaagtcacagaaagtgataaaatcagtggtgtaaatgataagaatgcatttgtgaatcgcagatttattgtagctgagaatgctctaaaagaagatggaataatggctatctccatgggaaagattttaagaaatcaggatacaaaggtagtctcattccctataagcagtaatgtatttaaggtctctggaggcggacaaaactttgttcatggaggttcctcaccacaggaaatgctcattcccgtactggatgtgaagatggagcgtggacatatagatacaaggaatgccggtatagtacttatcagtatggttcaaaaaatcacaagaaagactataatgcttgactttatacagtcggagcctgtaagcgatacaataaaggcaacaaaatataagattttctttatttcagatgacaatgaaaagatttcaaatgaagtcagtctatttgccgacagcagagaaacagatgctaataagagaatctttcgcatgaagttcgggtttaaagataaaaaatacgacaaagataagagatattatcttgtggtagtagatgaaaatacaggagaagaaatattaagacatagcgtgattatggatttggtattcggggatgaattttga

SEQ ID NO: 1377 - DNA, 1509 bp, Lachnospiraceae oral
atgtcagaattaaacctaaaacaaataatagatcgtctgaatgaggaattcatgggtgataccaggaaactggtattttggtatgacgataaaggagagtttgctgaggatgttaaggacaagcatcttgaagatacattgctgtattcaaagagattttttactgatcgtgtttcattgctttcgttagatttggggattgatgagaagtataaggcagtgacagcaataaattatagttgtaatgatgatttttcatccattctggaacaatatataagctttgattataagattgatcaagaatatagaaatttctattataaatttgataatttggatgatacatatatttttgaagggctgcgtgagcttgtagaaagtatatataccaatgagtatttaaacaagcctatacctaagtggaatgatacgttacaagaagaggatgtttttacaaagctaccattgcagatagatttttatgatagcaatgtacaaaatgcaaaggagcgtacagttgttattatatcagatgcaatgcgttatgaagttggtcaggaactatatagtaatttagcagatgatcccaaatgtatggcaaagcttgataaacagctgagtgttttaccttcatataccagacttggaatggcggcattgttgccacatgataatattataattacggacaattatcaggtcttagtggatgatgtactttgtgacaatcttttgggaaggcagactgtattacaaaagcattcaccaaatagtatatgtgtgcagtttgacgatattaagaatttaaaaaaagctgagcttagagatattttcacaggtaagcagataatatacatatatcacaaccagattgatgccagaggtgataaagcaaatacttatcacttcataattacagctgatcatggatttatttataaaagagataaggttacagaaagcgataaaattagtggtgtgaatgataagaatgcattcgtaaatcgcagatttattgtggcagataatgctgtgaatgaagatggtatcgcaagtatttctataggaagggttttgagaaataagaatacaaaggtggtttccttccctattagcagcaatgtatttaaggtttcaggtggtgggcaaaactttgtacatggtggctcttctccacaggaaatgctggtgccggtgctggatgtgaagatggagcgtggacatatggatacaaagaatgcatctatattttatggcaaagtcaagctttgtgttgaaaagtttgagtcaaagaaagataaggaagaatattataggcttaaaatctatactaagaaaaaaaacggatcgtgggtatataagtcagaagtatttcgtggaaaacaagaggatataatacaagaagacagggtttatgaaattgctatgtttggacacttggactttacatatagcaatagtcccaaaataaaattggaaacaaaagacgcactactgtatagataa

SEQ ID NO: 1378 - DNA, 2604 bp, Salmonella enterica
gtgaccttgcaaaatcaggaatttattgccggccttaaagcaaaattcgccgaacaccgcatcgttttctggcacgatcccgataagcgtttccttgaagagctggataacctcgaactggagaacgtcacgctactcgatatgaccgaccagtcacagctggcggttaaaaagcgcattgaaattgatgagcctgaacagcagtttttgctgtggttccctcacgacgtgcccccaaaagagttcgactggctgctggatattcgtctttacagtacggagttccacgccgattttgccgccatcacgttgaatacgttaggcattccgcagcttggcctacgcgagcacattcaacgccggaaggcatttttcagcactaaacgtctttctgccctaaaaggcctggtcactgagcaggaaaacgaggcctctcttgataagaagatggttgcggtcatcgctggcgtaaaaacagcaaaaacggaagagattctgttcagcctgattacccaatacgttaaccagcagaaagatgacgacagcgacctggaaaacacgctggcgatgctgaaacgccacgacctggaaggtgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccttcaggcagagcctccgcgctggcctttatggtcacctggcgcgccgaccgtcgctacaaagacgcctatgattattgcgcacagcagatgcaggatgcgctgcggccagaagatcagtaccgtctcagctcaccgtatgatctgcacgagtgcgaaaccacgctgagcattgagcagaccattattcatgcgctggtgacgcagcttctggaagagagcaccacgctagaccgtgaagcctttaagaagcttctgtctgaacgtcagagcaaatactggtgccagacgcgtcaggaatactacgccatctatgacgcgcttcgtcaggctgagcggctgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaaatctggatgactatatcgaagcgctgtattccaactggtatctggcagaattaagccggagctggaataaggttctggaagccgaaaaccgtatgcaggattggcgtattgcgggcgttccacggcagcagaacttctacaatgaggtagttaagccgcagtttaacaatccacaaatcaagcgcgtattcgtgattatctccgacgcgctgcgttatgaagtggcagaagagctgggcaaccagatcaataccgaaaaacgctttactgccgaactgcgatcccagttgggcgtgttacccagctatacccagttgggaatggcggcattgctgccacatgacgagatatgctaccaggcgggtaatggtgacatcgtttatgcggacgggttgtctacctcaggtacgcctaaccgcgataccattctgaagaaatataaagggatggctgtaaaatccgacgatcttctgaaatggaaaaatcagcaaggacgagatcttattcgcgattacgaagtcgtctatatctggcataacaccattgatgccatgggtgacagcgcatctacggaagaaaagaccttcgaagcgtgccgcaacgcggtggttgaactgaaggatttagtgactcgtgtgataaaccgtctccacggtacacgcattatcgtcacggcggaccacggttttctgttccagcagcagcccctttccgggcaggataaaaccacgctgcagatcaagccagacaatacgattaaaaaccacaaacgctttattatcggtcatcagctccctgccgatgatttttgctggaaaggaaaagtggcggatactgcaggcgtcagcgatagcagcgagttcctgatcccgaaagggatccagcgtttccatttctcaggtggagcgcggtttgtccacggtggcgccatgttacaggaagtctgcgttcccgtattgcaggtgaaagcgctgcagaaaaccgctgccgagaaacaacctcagcgtcgtccggtagacatcgtgaactaccatccgctgatcaaactcgtcaataacattgataaagtcagcctgctgcaaactcatccggtaggtgagttatacgaaccgcgtactctgaacatctttatcattgataacgccaataatgtggtatccggtaaagagcgaatctgctttgacagcgataacaacacaatggaaaaacgtgtgcgtgacgtgacgctgaagctgattggcgcgaatttcaatcgccgtaatgaatactggctgatactggaagatgcgcaaacggaaacgggttaccagaagtaccctgtgattatcgatctggcatttcaggatgatttcttttaa

SEQ ID NO: 1379 - DNA, 2598 bp, Pectobacterium wasabiae
ttgcaaaataaagaattagttgctggacttactgacaagttcttacatcaccgtatcgtcttctggcacgacccggaacaacgcttcaccgattcgctccatgagctggatctcgacaatgttacgctgctggatatgcgcggcgtttctgtgttcgcgacaaaaaaacgaatcgaaatcgacgagccagtgcagaaatttttactctatttcattagcgaggttcctgcccgtgagcaggactggttgctcgacatccgcctctatagcaccgaattccacgctgattatgcggcgatcaccctgaattcgctgggtatcccgcagctaggtttacgcgaacatattcagcttcgcaaagccttctttaccgtcaaacgcactcagattctaaaagggtgggtcaccgaacgggaaacagaaagctcactcgataagaaaatgctggcagtggtggtcggggccagtacctttgaaaccaaagaaattttgtttgctctgattcagcagtttatcgcggcacggcagcatgatgatagcgcactggagaacaccttcgccgtactgaagaaacttggcctggatgaggtcctctgggagattcttcgccttgagctagggtaccagtctgaatcttcttcactagataacatgctgctgaaactgttctgtaccgatctctgggcacagggagatgaagctcatcgcgactggttgagtaaaaatgtactggctacagctgctggtcgagcgtcttcactggcctttatgggggcgtggcgtaacgatcgtcgctataaagcagaatacgattactgtgcagaagatttacagcagacactacagccaaaagagcactacaactacagttcaccttacacactggcaaaatgtgaaacgttcgagtctattgagcaactgattatccgtggtctggtgacacagctgcaggaagagagcaccactctggacagagatgcgtttaaagcgctggtgtctgaacgaagtgcgaaatactggagccaaacccgtccagagtatctcgctatctggaatgccatccgccaggctgagcgtttgctgaatttgcgtaacctctacaccgacggctttaattttcctgatactggcacgttctggaaagcctactgcgacgaaatttatcgctttgatcagacctatcgtttattcaatgaatatgccacaccggtgcacagcaaaggggcgatgatcctacatgagctggataagttcatcgaagagttgtacagcaattggtatctgtctgagttgagtcgctgttggaacaaactgcttgaagcagaaagccgtatacaggcatggcagtttagcggtattccgctgcaacgtaatttctataaagataacgttaaacgtcagtttgacacctctcaggtaaaacgcatttttgtcgtgatctcggatgcgttgcgctacgaggtggcggaagaactgggcagacacatcaatcatgaaaagcactttagtgctgaacttcgctcccagactggggtgctcccgagttatacccagttgggaatggctgcactgttaccccacgagtcgctaagctatctgcctgataactctggtgtggtttatgctgacgggatgtccacttccgggtttgaaaaaagagccgctattctggctaaggtgaatggtgtggcgctgaaagcgaaggacttacagaacgccaacaatcaggaggtgaacgatcaaatccgtaatgcctccgtagtgtatatctggcacgacactattgatgccatgggagataaggcttcaacggaagataaaacatttgaggcctgccgaagtgcaatcactgagctaaaagatctggtctcacgtctgcgtagccgatttaatgccagccgaatttttgttaccgccgatcatgggttcttgttccagcaacaagcgctggtggagcaggataaaacgaagctggacagtaaagccgcaaatacaatcgaagcgaagaaacgctacattgttggtcaccagttgcctgaaagtgaattttgctggcatggcaaactggcagataccgcaggtgcaagcgatgagagtgaatttctgttgccaaaaggtatacaacgtttccacttcgcaggtggtgctcggttcgttcatggtggagccatgctacaggaagtgtgtgtccccgttttgaagattcgcgcgcttgagaagaaagcggctgagaagcaaccacagcgacaacccgtgtccatcgttgcgcgggatcaggtaataaagttggttaacagtattgataaagtcggctttattcagactttggcagtgaatgaattaaatgagccgcgtacgctgaatatctttattgtggatgaaaacaaccaggtcgtctccggaatggaaacagtttgcttcgacagtgataacgaagatatgggtaaacgtacccgcgatgtaaccatgaaactcatgggtacggcgttccatcgtaaaaacaaatatgttctgatcttggagaatgcagacagcgctacagagtatggtcgctacccgatcacgatcgacctggcattccaggatgacttcttttaa

SEQ ID NO: 1380 - DNA, 2598 bp, Escherichia coli
ttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctggcggtgaaaaaacgcatcgagattgatgaaccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcgcccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagtaaatactggtgtcagacacaaccagagtattacgccatctatgacgcactgcgccaggcagagcggttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccagtgggcgaactttatgaaccgcgtatcctgaacatttacattgtcgataacgctaataatgtggtgtcgggcaaagagcgcatcagctttgacagcgataacagcaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1381 - DNA, 2589 bp, Ruminococcaceae bacterium
atgtccgaagaacgcatacaatttgatctaatagaacgctttaccgcccctctacctgagttctatcaaagacggatcatcttctggcaggacgaggatcgagagttcgagtctatgcttgacgagctttacatccccgatgtaacaattctcaagctcaccggcacgaacaactttgccgtgaaaaagttgcttctgcacgatgatctaacagacaattatctgatttataatcccttctcttatgctgacccaaaggataattggctgctggatattgaaaaattcagtgaagaataccgttccgacctcatctccacgcgcatgaatgagctgaatattgaggcaagtccggcgatgcgcaagacggtaaaactgtacgcaaaattctttgacagcaaagagcggattgaaaggctgaaaagaattgggcgagaataccatacaccgttgcagcttcatattgacattatggctgtgctggcaggactaaacggcggctctgcgcaggatgtatttattgctgtcctttctgcaggacagggtgaggaaaacaatgccgtcctcagcaatatcaaaaagttcggcaacattgacgctttctggcagcttgtccgcaagtacacgggctacatccatgaggatgaaaaagcgcttgacctgttcgctgcccatgtgctgctgaccgcccttgcgcagacgatgaatcccagcgttctcaaaggcttggagcgtttcatctctgattccaacaaggcgtattgttacagtattgtccacgaatggcgcaaccgcgaggacaacggtgcgctctgggaattgtgccgcagtgtggagcaggagttgcatcttgcttcccgatttgaaaagcaggatattgaaacgctgctgacagcagacattttcccgtccattcatgaggtcatcctgagccgcttcttctccgaaattgcagatcatgtagtaaagaccgagctgatgctgaaaactgcggaaaaccgccgcacttccggatggattgagcggttcgagaactattatgacagtctctactatgttgcaaagatgcagaacttttatcaggagaatgcagcaggcttccatatcgtagaaccgaaagcaatctggaagctctatacggagaaggcgtatgagatggatagcttctatcggcacttccactatgccttcggatgcactctcaagaacagcaatgtgcttctggaagataagctgaaacacgcagcagattacgttgaggggctgtatcagaactggttcctcaaggagttgaccggctgctggacaaaagcaatttctgacaaccttgccgcattgggttatgtgtccgagatcggcaaacaaagagacttctactctcactatgttaagccgcttgcggggaaaaactcccgcgctttcgtgattatatccgacgctctgagatatgaagttgctgcggagctatgcgataccatcacccggacaaccaagggaacagcgaagctcgatgctgttcaagcagtttttccctcaatcacaaaattcggtatggcggctcttcttccggggcgaaagctgtctgtcaatgacggcatggatgttctcgtggacgaaatgcccacccgttctactgatgagcgtggcaagatactctgtgctgctaacatgaacagcgtggcagttcaatacatggacgttctgaacatgaaacgcgccgagcggcgtgagcttgtgagcggcaaagaagtcgtgtatatctaccacaacacgattgatgctattggtgacaaagctccaactgagaaaaaggtgtttgatgcttgcgaagacgctatgcaggagctttccaatattcttcgtattgtcatcaacgatatgcagggaacagacattttcatcaccgcagatcacggtttcctctacacatacagtcctttgaccgaaagcgataagctgggtaaggacgcgatcagcggcaaggtctatgaaattggacggcggtatgtgctggcagaaccctccgcagcagcagagtaccttgtgccggttcagcttgacggtgagatcgtcggtactccggtcaagggctacacgccttttgattccacacgcatacgggtttctggtggcggtgagaactatgtccacggcggtatcagcttgcaggagcttgttgtgcctgttattagcttcaagaatctccgctccacaagcaagaagtatgtggaggtttccaacgcagaattgaagctgttgagcgaaagccgcaaggtgtccaacctgctattctctctggatttctaccagcgtcagccagtcggggagaagattcagccctgcacctactacatctatatgacggatgatgagggcgtggtcatcagtgaccgtcagactgtcattgcagaccgcacaagcacaaacgcttccgagcgcgtcttccgtgtgcgcctcaatttgaaagccggtgcctatgacaaaaacaagatttaccgccttgttattgccaacgatacagatgtcccggaagaggctgagttccatatagacattgcctttgcggatgacttcggatttgacctgtga

SEQ ID NO: 1382 - DNA, 2640 bp, Holophaga foetida
atggccaagcctgaacaggaactgaaacccattctggatgccctgcaacgcttctacgaccaggagggcagccgcatcgtcttctggcatgatccggcccgggaattcgtgaacgccctggcgggctgcatgctgctggatatcggttcccatgccgtgacggtcctggacctgacacccccccgctcggacctggccctgaaactgcgcctggagcaggaggatccccagggcaagtttctcctctacgcccccttcgaggagccggacgccgaccgggactggctattggatatccgcctttacagccagaccttccgggccgatcgcgcctccatccacctccaggagctggggctggctagccaggatctgcacggtcacctgacccagcgggccaagttcctggatgccaaggaacgggtggagaagctccgcaggctggtgaatcccggggatggtgcattggacctggacctcaagatgatggcgctggtgctgaaggccgagcaacccgaacccttcgtgctgctgcggaccctcttccacgccttcctggatggggaggcaccggatctggataccccgcccagcccctggaaggacctggtgaagttcgatctggcccccaccttctggggcctcatgaaacagctcttcggctacggggatgcccagcccagcttgcagaacctcctgctccgcctgctagtggccgatttcggccatgccctgagggagccgttgccccaggccctgagggccctggatctgcccaaggacaaagtaccgaatgtggtggcctgtctcgcccagtggcgggatagcagccgccacgccgcgagctacgacgccctggccctccaggtggaaagcaggctgaagctcaaggaccacctcagtgggtttgaaggggaggccctcgcgggggtgatgaccttccccatcgtggaaagggccatcgccagtcgcctgaaggaccgggtactcacggtggtgaatgctgagcatgtccaggcgatccaggccatggccgtgcgaaggcaggcgggccattgggccactccccagatcggcagcacgccggaggtcccccgggagaccttcttcgccatctacgaggccctgggagccgccgcgtcgctcttcgaactgcggatgcaggtgcagaccggcggattcccgacttccagccctgaggccctctatcaggcctatgaggcgaggctctaccgcttcgaccagctataccggcagttcaacgagggggcagtgaaggccctcgaactgaacctcctcaaggatctccagaagccggtggagaacgtctacctcaacggcttcctaaagcccctggccatggcctgggatggttgcctggagtcccggcttcaggactggcggctgagtgatgtggtggggcagccccagttctgggatcagtacgtggcccctcgccaggatggccgctcccgaaccttcgtcatcatctcggatgccttccgctatgaggcggcccaggagttgaccagcgagctgaacgggaagtatcgcgtggaggcggacctgagttcctgcctgggggttctgccttccatcacctccctgggcatggccagcctgctgccccatcaggtgatgaccctgaccgaggagggccagccgctgctggatggccaaccggctgcatccctggagcagcgcgccaagatcctccaggcccatggaggcatggcctgcaaggccgaggatctcatggccatgaagaaggacgagggccgggcctacgtggagggagcgaaggtggtctacgtctatcacaacctggtggataccaccggggaaacgcgtggtagcgaggaggacacatttaaggccgtgcggggaaccatcaccttccttgcccggcttgcgaatcacattgtgaacagcctcaacggcaaccatgtggtgatcacggcggaccatggcttcatcttcacccagtcggatcctggcgagaccgaaaagagcaagttggggagcgaggtccagggggccttccccaagaagagcaagaagcgctatgtaatgggccggaagctgcccaaggtggacttcgctttccaggggaaggtggcctgcgccaagggggatgcggaattcctggtgccccgcggcatccagcgcttccacttcgtgggcggggcccgcttcatccatgggggggccaccttacaggaggtagtggtgcccgtggtggtcattcgccaccgtcgcggcagtgccgccaagggcaccgagatccgcacggtgcaggtgcaggtcctcggcgcgagccacaagatcacgaccgccaagcatgggttcgagctgatccagactgatgccgtgagcgagcgggtgaagcccctcacggtgaagctcgccatctatgagggcagtgatctgacgacccccatcagcgatgtacagaccctgaccttcagcaatacttcggatagcctggagcagcgaaagcaacgggtgctcctgaccctgcgcgagggggcgtacaatcggaccaccccctaccgcctcgtccttcgggaagccgaaacgagcattgagctgcaaagcgtcccggtgaccattgatcgagccttcactgatgacttctga

SEQ ID NO: 1383 - DNA, 2604 bp, Escherichia coli
gtgaacttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctgtcggtgaaaaaacgcatcgagattgatgagccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccactgtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcgcccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagtaaatactggtgtcagacacaaccagagtattacgccatctatgacgcactgcgccaggcagagcggttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccagtgggcgaactttatgaaccgcgtatcctgaacatttacattgtcgataacgctaataatgtggtgtcgggcaaagagcgcatcagctttgacagcgataacagcaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1384 - DNA, 2523 bp, Oribacterium sp.
atggcagagcttaacctaaaacaaatcattgaccgattgaatgccgagtttacgggggatactcgtaagcttgttttctggtatgacgataaggctgagtttgcagaagatattgatgctatagaactggataatgccaaagtctataagctagagcctgataatcaatttatgacaaagcgctttctggaacgcgaagatacgagtacgaactacctgatctatgcgccgtttcctaagccggatgtaaaggataatcacttggaagacacgttgctatactccaagcgtttttttgcagaccgggcatccttactttctgtagatcttggcattgaggagaaatataagcccatcatcgaaaagcatatcaagttctttgctaataaagaaagaacgcaacgtttttatgatttggaaattgaaaattttaatgaggaaaatattctagttggtcttttgagtgcaatttgcaagactcgtacttgcacttttgaagaggtgctacgcgtcgtacttacagagggaacgttggaagagaataaatctctcttagaaatggaaaaatacgatctccagaattctttctggaagctttgcgagcagcaatttggttatactgatgaaaaaccgactttggagaaattggttcttaccctgtttgtgacagaaaccgccagacaacttggtaataacgtgccacagagttggaaggcttttatctcatacaaggctggcaatagtatagcttttctggacagcttaatgaacagcgtattatacagtgagcgttttgatcaattatccatgcatgtttccgatagcttgaatatatcggcaacatttaaagagatggaagcggaggaactgacggaagtagatacctttattgcagctgaccaggttttggtaaaatggattgtagaacgcctgatagcggaagacactggtgcaaagctcaatcagactggtataccggagctctgtgagaagcggatgaaaatgcactttggaagtcggacaaggaaaatatatcgattactacttagtgcatatcacctgcttttagcagcaaattataattgcccagatgagttcaaggagatcattaagcagtatcgggaaaaagattataagaccgatcaggaatacagaaaattctactataactttgatcagatcgaggataccggagcttttgaaagccttcgaaatttagtcgaaaatatctataccaatgagtatcttggcaagattatgcccatgtggaatgaaggaatcgaagagaataatgcttttcatgagattcctttgcagcgtgatttttataaccactatctaaagtatgcgaaggagaggactgttgttatcatttcggatgctatgcgttatgaggtgggagaggaactgtttaaacggatgatagatgatccgaagtgcattgccaaaatagaagttcagctctccgtattgccttcttatacgcggctcggtatggcggccttgcttccccaccaaaaacttgttatgacagacgacttccgtgtattagtggatgacgtactttgtaatgatctagtaggaagacaaaaggtgctacaaaagcatcaggaagatagtatctgcgttcagtttgatgaaataaaaggactaaagaaaaatgaacttcgtgacattttcaccggtaagcagctggtctatgtctatcataatcagatcgatgcacgtggggacaaggctacgacggaggacgaagtgtttgttgcttgtgaggaagcgatagctgagattatggagttgattcgtaaaatctccaccaatgcgaatacctatcgctttgtggtgacatcggatcatgggtttatttacaagcgggacaaactctgcgaaagtgacaagattagcacaatcagtgataaacaggcattcatcaatcgacgatttgttgtggcgaaaagtgctttaatagccgagggtgtgaagagcctttctatggggcggatcttggataatgatgatacaaaggttgtttctttccctgttagtagcaatgtttttaaggttactggaggaggacaaaactttgttcatggtgggtcatctccacaggaaatgcttgtaccggtattggatatcaagatggaacgtggtcatatggaaactagaccggcacagattgcccttgttagtattgtccagaagattacaaatttaattacaaccatggatttcattcagtccgaagcggtcacggatatgattaaaaagaccacctataaactgtacttcatctctgaggataatgaaaagatttccaatgagaatacgtatattgcagacaaccgcgaagtagatgcgcagaagagaattttccgcatgcgatttacattcaagaataagaaatacgacaagaataagcaatattatcttgttgtttatgatgatgcaactggaattgagagcttccgtcatcctgtaattatggatttggcgtttgctgatgattttggtttcagcttttaa

SEQ ID NO: 1385 - DNA, 2598 bp, Escherichia coli
ttgcaaaatcaggactttattgctggccttaaagctaaatttgccgaacatcgcatcgttttctggcacgatcccgataaacgttttattgaggagctggaacagctcgagcttgaaaacgtcacgataatcaacatgacccacgcgtcacagctggcggtgaaaaaacgcatcgaaattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacctggtgacagaacaggaagatgaagcctcgttggataagaaaatgattgcggtgatcgctggagcaaagaccgcgaaaaccgaagacattttgttcaacctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaagccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcacccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagcaaatactggtgccagacacaaccagagtattgcgccatctatgacgcgctgcgtcaggctgagcgtttgctaaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcaatgatcctcaagagcctggatgattatatcgaggcgctctacagcaactggtatctggcagaattaagccgtaactggaacgaagtgctggaagcggaaaatcgtatgcaggcgtggcaaatccccggtgtgccgcgtcagcagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctcccaagctacacccaactgggaatggcggcgttgctgccccatgaacaactttgctatcaaccggggaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcatgccgcacggcggtgactgaactgaaagatttagtcaccaaggtaatcaaccgtctccacggcactcgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtagatattgtcgcttaccatcccatgattaagctggtgaataatatcgataaagtgagcctgttgcagacgcatccggtgggcgaactttatgaaccgcgtatcctgaacatttacattgtcgacaacgccaacaatgtggtgtcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1386 - DNA, 2622 bp, Acinetobacter johnsonii
atgaatctggatcagctacagaagggtctggaacaggctttctacactgaaaatcaccggattgtcttctggtacgatgcggaacaatctttcagtgatgaaatacaggcgttaaaactgaaagatgtccagattctgaatatggcagaagagtcgagtttggcgatcaagctcaaactggaactgcaagatcagcagggcaaatacttgctgtatttccccagtgctgagcctgaaactgaaaaagactggttactggacatcaagctgtattcacgcagcttctatgccgatcgtttctcgattattttcaatgagctgggtttacagcagcagagtctaagagaacatctggccaaacgtgaagaattccttaaagccaaagcccgtctgagtacattgaaacgctatatccagcctgatgcagatgcacaggatctggatatggcgatgattgcagctgtggtcaaggccgacagtgccgagctgatgcatatcgttctggcactggcagatgaaatggtacagcagaatctggggttggaagtaaatccggaatcctttgctgaactggaaaaattccaactggtgccggctttggtcaccgcattacaggcggaaattggttatccagcatcggttgaagaattgaatggggaagcaccattcaagctcggtacgttctttatccgtttgatgagcacaggtttctgtgaaagcctgggcgatataccgctatgggctcaagaactggtgatgtcatctgtcagctcccgtgcgacggctagagccttcttgtcacgctggagagacagctccaaatactacccaacctttgataagctttcccagagcgtggccaatgcactgcggatccaggagaaggtcggggcctttgatctggagcagctgctcgatgtcatgacttttgaagtgattgaacaaaagatcattgtcgatctggccagccagatccctgcagcaaccaaagctgaactggaacatttcagaacgattatttctacccgtctggatggctattgggcgtccaaacataaggacgatgcaacccgccgtaaataccgtaccgtctataccgcgttgcaggcagccattgacctgttcagcctgcgactgcagtttgatgccggtttctatttcgactctagcgaagccttgtataaagcctacgagcaggagttgtatcgctttgatatggcctaccgccactacagtgctgcttctcaacgcgctcatgtcgatatcctgaaaaaactcgatgaagaagtcgaaaattgctattcctactggtttattgaccacttggcacgaaactggggagagcggattgaagctgagcaacgcttgaatgtctggaaagtggcagatatcccaaaccagcagaacttctacgatattcacgtcagacccttactcagttctgcaacgaaacgccgtattgtggtaattatcagtgatgcttttcgctatgaagctgcggtagagctgcgtgatcgtattaatgaaaagcgttattccgaagcgaccttgtcttcacagctgggcgttgtcccaagttacaccacacttggcatggcctcgttgttgccgcatcagactttggagtacaaagaggccgcaggggatgatgttttagtagatgggcagtccagcaaagggactgcagcacgatccaaaattctggctgcctataatggattggcggttaccgctgaaacggtaaaaggctggtcgcgtgatgaaggccgtgaagcacttaaagaccatgagctgatttacgtttatcacaacgtgattgatgcacgcggtgacagcgcctcgacagaatcagaaacctttatggcggtggaacatgccattgaagaactgaccgaacttagccgcaaaattttaatgcactttaatatttctaccctgttgattacagccgaccatggcttcttgttccagcataaactggaatctgcggatcgttcaagcttgactgaaaaacctgccaatacattgaagagcaaaaaacgctatgtgattgggcatggtttaccagagagcaaggaagcctggaaaggctcaacccaagctacggcaggcacattatctgcgactgatttctggattccaaaaggggcgaaccgtttccatttcgtaggaggctcacgtttcgtgcatggcggcatcatgcctcaggaaatcgtagtgccggtactgacggtaaaacagctacgtggtgaaaaggctggacagcggaccaagcgtaaagttgaggtcatttctaccaaatccacgctgaagatggtcaataacatccagaagtttgatttgatgcaaaccgaagctgtcagtgagctggtcatgccagtgactttatccattgccatttatgatggggatcttaaagtttccagtgaagaaactttgacttttgatagcagtaccgactctgttgccgatcgggtcaaacaggtcagattgtcattgtctggcactgattttgaccgtaagaaagattacttcctggtactgaaggacaaagacctgaatatcgagatgcagcgctataaggtcaccattgatctggcatttaccgatgacttcttctga

SEQ ID NO: 1387 - DNA, 2592 bp, Selenomonas sputigena; identical to SEQ ID NO: 1274

SEQ ID NO: 1388 - DNA, 2625 bp, Acinetobacter junii
atgaatttaagtcaactacaacaaggtctggaacaagccttttatactgaacaacaccgaatcgtcttttggtacgatgcagaacagtcatttactgaagaaatcaaagccctagagctaaatgatgtccaaattttgaatatggcagaagaatccagccttgcgattaagcttaaactggaacttgaggatcagcagggtaaatacttgctgtatttcccaagtgctgagcctgaaactgaaaaagactggttactggacattaagctatattctcgcagcttttatgccgatcgtttctcgattattttcaatgagctgggtttacagcagcagagtctaagagaacatctggccaaacgtgaagaattccttaaagccaaagcccgtctgagtacattgaaacgctatatccagtctgatgcagatgaacaggatctggatatggccatgattgccgcggtggttaaggctgacagtgccgagctgatgcatatcgttctggcactagcagatgaaatggtacagcagaatctggatctggaagtaaatccagactcctttgctgaactggaaaagttccaattggtgccagctttagtcacagcattacaggcggaaattggttatccagcatcggttgaagagttgaatggggaagtaccattcaagctcggtacgttctttatccgtttgatgactacaggtttctgtgaaagcctgggcgatataccgctatgggcccaggaactggtgatgtcttccgtcagctcccgtgcaacggccagagccttcttgtcacgctggagagacagttctaaatactacccaaccttcgatacactctcccagaccgtggcaaatgcactgcggatccaagaaaaggtcggggcttttgatctggagcagctgctcgatgtcatgacctttgaagtaattgaacaaaagatcattgtcgatctggccagccagatccctgcagcaaccaaagctgaactggaacatttcagaacgattatttctacccgtctggatggctattgggcttccaaacataaggacgatgcaacccgccgtaaataccgtaccgtctatacagcgttgcaggcagcgattgagctgttcagtctgcgactgcagtttgatgccggtttctatttcgactccagcgaagcattgtataaagcctacgagcaggatttgtatcgctttgatatggcctatcgccactacagtgctgcttctcaacgcgctcatgtcgatatcctgaaaaaactcgatgaagaagtggaaaattgctattcctactggtttattgaccacttggcacgcaactggggcgagcgggttgaagctgagcaacgcttgaatgtctggaaagtggcagatatcccaaatcagcaaaacttctaccatacccatgtcagccccttgctcagttctgcaacgaaacgccgtattgtggtaattatcagtgatgctttccgctatgaagctgcggtagagctgcgtgatcgaattaatgaaaaacgttattctgaagcaactttgtcttcacagctgggcgttgtcccaagttacaccacacttggcatggcctcgttgttgccgcatcagactttggagtacaaagaggccacaggtgatgatgtatgggtggatggacagtccagcaaagggactgcagcacgatccaaaattcttgcagcctataacggattggcggttaccgctgaaacggtaaaaggctggtcgcgtgatgaaggccgtgaagcgctgaaagaccatgagctggtttacgtttatcacaacgtgattgatgctcggggagacagtgcctctacagaatcagaaacctttatggctgtggaacatgctattgaggaactgaccgaactcagccgtaaaattttaatgcacttcaatatttctaccctattgatcacagccgaccatggcttcttgttccagcaaagtaaactggaatctgcggatcgttcaagcttgactgaaaaaccgaccaatgcattgaagagcaagaaacgctatgtgattgggcatggtttgccagagagtaaggaagcctggaaaggctcaacccaagctacggcaggcacactatctgcgactgatttctggattccaaaaggggcgaaccgtttccattttgtaggaggctcacgttttgtgcatggcggcatcatgcctcaggaaattgtggtgccggtactgacggtaaaacagctacgtggtgaaaaggctggacagcggaccaagcgtaaagttgaggtcatttctactaaatccacgctgaagatggtcaataacatccagaagtttgatttgatgcaaaccgaagctgtcagtgagctggttatgccagtgactttatccattgccatttatgatggggatctcaaagtttccagtgaagaaactttgacttttgatagcagtaccgactctgttgcagaacgggtaaaacaggtgagactgtcattatctggcactgattttgaccgtaagaaagattacttcctggtactgaaggacaaagacctgaatatcgaaatgcagcgctataaggtcaccattgatctggcatttaccgatgacttcttctga

SEQ ID NO: 1389 - DNA, 2766 bp, Shewanella baltica
atgcagattagtgaactggcgcaaggtgtcgctgccaaactcgaacaaagccgtattgtgttttggtatgacccagagcaaagctttactgaagagcttgagcatttagctaatgccctatcttctgcaaaagaatctattgcgaaagaagcgctttcaaaagaaacaaatgataaagcagctgatataactgcaagggtactaccaaatgatttgaccatcctcaatatggataacgaatctgtattggcagtgaaaaaacgcattgaagtggatgagcgtgaagctaaatttcttatctattttcctagcgccgagcctgagcctgaccgtgattggttgttagacgtgcgattgtacagtgagcagttttttgctgatcacagctcaatgctgcttaatgagctgggtatcccgaaaatggcgcttcgcacgcacattcgtaagcgtcagggattttttgccaataaacagcgtatagcaggcttaaaaaagtgggttactgaaaacgaagacgaactgacgttagacaggaagatgatggcagtggttgtgaaagctgattctgcatctttgtcggacattctacttgggttgttacgcgcttattctatggcacaggatgtgcccgccgcaggcgttgacggcctatctgaagatggaagccttggccagcccgatgtatttcagcaagtgtggagtcagttaagtaagtttgctcttgagacctcactctgggcatatctgagcgaaggttttggctatacagtcgaagagccgaccttctcagatttcgtgctgaaactgttctgcactgagttctggagtcaaattgaaggcgttgaacgcgattggctgcttaacaatgttctaaaaagtgcatcaggccgagcgacagccttggcgtttatggtgagctggcgcgacagccgctccttcgccgcttactatgaaagcatctccaatgtgcttagccaacagttggaaattgcgactcgcgctggtcagtaccatccggctgagcttatcgaatgcgaaacatttgaagctgtggaacaagccattatccgtggtttagtccgtgatttgcttgatagtagtaaagcgctagatcgggttcagtttgatacggtcttatcaagacgtcttgctagccactggacactccctaattcaaagaacggtaaagaatacttcgcgatctacgaagcgattcgtaacgctgaagagttaatgcacttgcgaaatcgttatgtggatgggttccactttgataacgctaaggcaatgtacgacgcctataccacggacatttatcgttttgaccaagcttatcgtttattcaatgagcatgtgcactcagtattgagtaagggcgcagacatactgcgtcagctcgatgatgaagtcgaaagcatttacaccaactggtacttgtatgagcttggtcttgcttgggatcgtcacttggcgaatgagaaattgcttgaaaagtggcagatttctggcgttccgcaccaatatgacttctatgaaaaagaagtccgtacacgactgagtctgaagcagacaaaacgagtgtttgtcatcatctctgatgcccttcgttttgaaattgcgaatgagcttggcgctatcattaacaacgagaagcgatttaaagctgaagtgtctacgcagttgggcgttttgccgagttatacccaactgggaatggcggcattgctacctcataaggcgctcagttaccagttgctctcttcctctggcgcaagcggaggaacggctgtctacgttgatggcttgtcctcacaaggtttagataaccgcaacactatcctacaaaaagtaggtggtatggcggtgagttctaaggagctgatgaactggagcaaccaggaaggccgtgaaaaggttagagacgtagaagtggtttatatctaccacgacaccattgatgcaattggtgataaggcagcgactgaagagaaaacgtttgaagcctgtcgcagtgccattgaagagctcaaagaccttgttggccgggtaatcaaccgtcttaacggaagccgtgtggtgattaccgccgatcatggcttcctgttccagcaaaaagcacttgtagcggctgacaaaacatcgttaaaaactaaacctgctggtgcgatagaagccaagaagcgctatattgttggcaataacttgccttcagatgaagcctgttggaaaggatcaattaacgatacggcccatggttctagcaacactgagttcctgcttccaaaagcggcgcaacgctttcattttgttggtggtgctaagtttgtacatggtggagccatgctgcaagaagtttgtgtccctgttctacatgtgcgcgagttgcaaaaagaacaagctgctaaacacgagaaacaacctgttggtgtcgttgctgccactcagccaatcaagctggtaaacaatatcgacaaagtcagatttattcagacagacccggtaggtgagcgttttgtagcacgtctgctggacatttatatcgtcgatgtaaaaggtaatgaagtatccagtcgcgaaatgatcaactttgatagtgtaagtaaagtaatggatgagcgtactcgcgaagctaggttaaagcttatcggttctcagttcgacaggaacgctcagtacacattagtacttgagaatgcggaaacgagaacgcgttatagccaatacgcggtaaccattgatttagcattccaagatgattttttctaa

SEQ ID NO: 1390 - DNA, 2304 bp, Vibrio cholerae; identical to SEQ ID NO: 1292

SEQ ID NO: 1391 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgagtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacttggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcagaccgccctgcacccggaagatcattaccggcttagctcgccatatgatttgcacgaatgcgaaaccaccctcagcatcgaacaaaccattattcatgcgctggtaacgcagctgctggaagagagcaccacgctcgatcgggaaacctttaaaaaattgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggagcgatgatcctcaagagcctggatgattatatcgaggcgctctacagcaactggtatctggcagagttaagccgtaactggaacgaagtgctggaggcggaaaatcgtatgcaggcgtggcaaatccctggcgtgccgcgtcagcagaactttttcaatgaggtggtgaagccgcagttccaaaatccgcaaatcaaacgcgtgttcgtgatagtttccgatgccctgcgttatgaagtggcggaggagctggggaatcaaatcaataccgagaaacgctttaccgcagaactgcgatcgcagctaggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaaaaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaagtaatcaaccgcctccacggcacacgcatttttgttacggcggatcacggtttcctgttccagcaacaggcgctttcggttcaggataaaacaactctgcaaattaagccggaaaacaccatcaagaaccacaaacgctttattatcggccatcagcttcccgccgatgatttttgctggaaaggtaaagtggcaaataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1392 - DNA, 2631 bp, Halomonas sp.
atggattcaaagcaactaacgcagggcttacaacacgccttcttcaccgaccaccatcggattgtgttctggtacgacgcccccggccactttgccgagtcgctgagtgagctcgcgctggaaggcgttcaggtgatcacgatggcgggggagtcgaccctgggcgtaaagctacgtttggagctggaagagcctgacactcccacgctgctctactttccttacgccgagccagcactggaagacgactggctgctggatataaagctctactccggccggttttatgcggatcgcgtctcgatgatctttaatgagctgggcctaacgcgccatgtgatgcgcgagcatttagcacagcggcaggcgtttttagccagccggaagcgtattgaagggttaaagcgtttagtcacgccttccatgagtgaagatgagctggaccttgcgatgctggccgtggtggtgggggcagcttcagtagatgtggcgacgctgctgtttcatctagcagaagaggcggtgacccacgagctggggttagaggcgaatccggcagctttagttgagtccgaaaagtacgccctggtgcctgcgtttgtacgtgtcctacaagccgaagtcggttaccccgccagccgtgaagagctgagtggtgaaacgcctctgaatttcggtcagctaatgttgcggttactgattactggctactgcgagagtatttctgatattcctgactgggcacgccaggtggcgattccttctgttaatgcccgtgcatcttcgcgggcgttgctgactcgctggcgggatagctcgcggttttacccagcgttcgatgtgatctcaggttgggtagctgatgcgcagcgtattgatgacaaactgcataatgtgccgctagagcagcttagcaatgtggccacctttgaggtggttgaaaaacagatcattgtggatctctgccaagcgattcccaccgctgatgttcgcgacctgcggctattcgatagcattattgttgagcgattagatggctattgggcgtctcggcataaaaacgatgcccgccgcgagcgttatcggcagctgtacgcagcgctcaccgccgctattgcactgttcagcctacgccaccaacatgccaaagggtttcactttgagagcgttgaggcgctgtaccacgcttaccaaaccgatctataccgttttgatacggcttatcgccactacgcggtggcatctgacgcgaccagtgttgagctgctgaaaaacctggataccgccgtcgagcgttgttacgacgagtggtttttaggccagctgacccgcaactggagcgagcgtgtagaggccgagcagcggctgacgcactggaagctgcccaacattcctaatcaacagaacttctaccgtgattgggtgcaacctcagttagccgctagccgccaaaaacgcgtggtggtggtgattagcgatgccttccgttatgaagctgccgaagagctgcgcgagcgcatcaatgccaagcgttacagtgaagcgacgttaaaaagtcagttgggggtggtgcctagctataccacgctgggcatggcctcgctgctaccgcaccgtgagctaagctatcaaccaggcagtgatacggtgttggtgaatggtcaatcaacccagggcaccgtcaaccgtagcaaactcttaaaggaggcgctgggtggtgaggctatggcggtcaccgccgacgaggtgaaaggttggtctcgggaagaggggcgcgaaaaaatcaaaggcgtccagctgatgtacgtttaccacaatgtggtggatgctcgtggagattcagctaacaccgaaagcgagacgtttgcggcggtggaagatgccattgatgagctagatcagctgacccgcaaaattttgatgcatttgaataccagcacggtgctggtgacggcagaccacggtttcttattccagcgtagcgccttagacgccactgaccgcacggcgcttacggacaagcctggctccgcgttcaaaagcaaaaagcgctatgtgctgggtgaatcgctgcccgataatcccagcgtttggcacggccatacccgcgataccgcaggcaccacctgcgagacacagttctggatacccaaaggcgcgcaccgtttccattttgtgggcggggcgcgctttgtgcatggtggcatcatgccccaagaaatcgttgtgccggtgctcacgatacagcagctgcgtggcgaaaaagccgagaaacgcagcacccgcaaggtggaagtgatctcaccgaaggcatcgctgaagatggtcaataacattcagcgcttcgacctgctgcaaaccgaagcggtgagtgaacgcttgcggcctgtcaccctttcagtcgcgatttatgaaggcagtcacgtggtctccagtgaagaggtaatcacctttgatagcgccagcgacaacatgaacgagcgcatgaagtcggtacgcctttcgctctcgggcacttcgtgtgaccgtaaaaatgactacttcctggtgctgcgcgataaagacttaggcaccgagcgggagcgctaccgggtggtgatcgacttggcctttacggatgatttcttctaa

SEQ ID NO: 1393 - DNA, 2646 bp, Bifidobacterium angulatum
atgagtgagaatagccaagtaacaagactgctcgccagacgtttcagccagccaggcgagcgtgggcgcatcgtgttctggcgtgatgacaagaaacagtacgcggatgttgtggaaacgttggtgggggagcgcaccactgatgagatactgcgtgaggttgaactcatcactccggaaattggggatgagaacgacaggcggtacattccgttcacggtgcgctaccgcatgttccacgagcagccgaatcaaaaattccttgtatatctgacggagccggccccggcagttcaggacaactggctgttggatttggaactggcatacggccccacgttcaccatggacaaactcgccgtgacgcttacggaaacactgccgggagcttccgccgacacccgaaacgagtggttggaagttatgaagcgtgtaccgaagttcttcgacagcgaagaacgcgccaagcgcttcgcaaaacgtcttaacgtgcacgacgacgtcaccgattttcaggcgaagatgatcgccacgttgctgcaactgaaagacgatcggcacagcatgcaagacatctgggctgagctgcttacacaatattcgcagggtgacgattccggtatcaccgcgatcgaacgcatgggattaagcatgttccattggactggaacacggcgcatttatcgttttgatgtggatactgatgccggcaacgagccaacggtgaaagacttcgtgctatggctgttccagctggcatggaacggattctccgatggcaggaacgccgtttccgcttatgcgaacattattcgcgactgggacgactggtataaaaacatcgacatgcgcacggtgttgcagaatctttccgagaatgccgtggaggaactgcacctgtccactcgaatcgccgatatgagtgtggaggagcttgccgaccgtgacctgttccgcgacgtggacgagatgatcgtcaacaagctgttcgaacggttgggctcgcaatccattacggatgacgaggtgcaacggatcatcaacgggcgtaagcaaaagctctggtatgcagaatataccgaccaatacgagtgcattgccgccgcaagcaggcttcgcgccgtgttgactgaatgcagcggactcattagcaccatcagctcgccggaacaagggatgaagctgtatgccgaaaagctgtacaaggccgatggtgcatacagaaaatatgtgctcgcatggcatcgtgccaacccggatgcggtgagcgtggacgatgatctgcaaagcgcctacgaggcatatcagcaggatttgggtcaggcatggcaaaaacaagtcgatacgcttagccaatggaagttcatagacatggacacacaaaccaatttctatgaacgtgaaatcgcgccggtattgaagtccggcagaaaaatcgccgtgatcatttccgatgcgctacgttacgaggttgcgcaggaactgtccgaacgcatcgacagggaaagccgtttcagcacgaaactgaacatgcaatacagcgttctgccatcctatacgcaacttggcatggcggcgttgctgccgcacggttcgctcgaattcgatggcaaagaccgtttgtatgttctagcggatggacgcagcaccaaaggaatcgaagcgcgcgccgccattctttcggccgtaggcggcaaagcgattagatatgacgatttgacaaagctgaaagtcagcgaaatcaaagaactatataaatcttgcaacgtgctatatgtgtatcacaaccatatcgacgccaccggtgatacggagaaaacggaatcggaaacagcggaggcatgcgagaagacgttcaaggaactgggcgaagtagtcaaaaaacttgccagcggcaacgttcataacatgatcatcactgcagatcacggattcctctatcaggaccgagatctggacagtacagaatggttgagcgaacagcccaagggtgatgcagtatgggtgagaaagcggcgattctccatcggggccaatcttgctccaggtcgtgcgttcgtgacattcaatgccgcgcagataggaatggacgatcctcggaatgaaggcataagcattcaagtgccgaactccatcatgcgcttgcgcatgcagggcgccggtgtgaagtatgtgcatggaggagcagcattgcaggaaatcgtcgttcctgtgctgcatgtcagtaaggggcgttccgcggccgacgatgtgagggctgtggaattcactattctgcaacgaaccgacaggctttccagcagacagttgactgtggaattcttccagaacgagcccgttggaggaaaaatccgtgcacgtaccgtattggccggattgtgggggcgcgatacggcaggcaataatgtgctcatctccaatgagacaccggtcgccttcgatctgctcgggcaggagaaaagcgaacgccatgtgacggctacgctcatgctgaccagtgacgcggaacgattcaatggaacgaatatcgaactgcgcctgcgtgagaagacagatgggtcaaatgtgctggtcatgcttgaccagaaggcacgatacttcttcaaacagggcgtggtggccgacgatgccggattcttcgactga

SEQ ID NO: 1394 - DNA, 2304 bp, Vibrio cholerae; identical to SEQ ID NO: 1292

SEQ ID NO: 1395 - DNA, 2499 bp, Alcanivorax pacificus
atgagtgaccgtattagtcaggcgctgagcaggcttttcgataagcaccgcatcgtgttttggtacgacgccaagcaagagctgcgtggtgactttgaagctgtttccattccggacgtcgaaaagctggagattgccaacaacgagtacggtatgaaatatcgtattctgcgagattcaccggaacagaagttccttttgtacaaggagggtccgcaaccggaggatctggataactggttgctggacgtacagctgacccacggtgaattccggactgaccaggtggctatctggctgtccgaactggaattgggcctggagtttgccgaagtagcccaggtccacgcggaattctttcaggcgaacaagcgcaaggatgcgttgaagaagctgctgaaaccggacgacaccgccggtcagctgcgcctgaagatgctggctgtatgtgccggtagtgagccccgtatggactcggtggtggaaaccctgctgcagcaacaggcggaagagcgcgatgatggcattcggctgattgagcgttgcggtctggacagcttcctgggggagcaactggcccgtttctacggctacgaggccagtgaacccagcctgcgcgacttcgtgattgagctgttcaagtcctgctatgccatgggcaccgatggcgaggtcaaactgaccggcgacgccctggtgttcctcaaacgctggaaagacagccggcagttcgagcaggggtttgaaaccctgtctgccgagtgtgccgaggtcctgggcattgagcaggatctcggtaagcgggacttccgagacctggttgagctcgattacttccggctaatcgaccagaagattatcagtgacctagtgcgggcggtggttggccgcacggtgaccagcggtgatgtggcactgtgggtacggcagcggcgccagggccactggtacggggagtttcgccacctgtatgaagccattgagtttgcggctcgttttgtccagatgctgggtgaggctcgtctcaccatggatagcctctccgacggcgttcagcgatacagccgttcctggttccaattggatcagctctaccgcaagtttacctaccatgtgcgcatgtccggccaggcatcgttgatgggcgagcttagtgagcaggtggagaacctttattccaacaactacctgctcaagctgggcgatggcttccaggttcacgtggacgccgcgccgcgctgggaggcctatccagtcattcagcaaaaggcctttttcgagcactgggttcgcccgtacctgcgcaaggacaaacggatctgcgtgatcatttccgacgccatgcgctatgagattggtgacgagctgctgggccttatccggcaggaagatcgctacagcgcggagctcgagccggctctctcgaccctgcccagctatacccagctcggtatggcggcgctgctgcccaacaagtccttggcgatcgccgacaacgataccggcacggtactggtggatggccaaagctcacagggcacggtcaaccgtaccaaaatcctgcaggccgccttggatggtcggggccaggccgtcaaggcggaggattttatgcagctcaaccgggaagacagccgtgagctgctcaagggtaatgatgtgctgtacatctaccacaaccgcatcgatcacaccggcgacaagatgcattcagaggggcaggcctttgaagccgcagaacaaaccctggatgacctgattcgactgatcaagaagctcacggcggccaacgccaataacctgctgatcaccgctgatcatggctttatttaccagaaccgtgagctggatgagagtgatttcctgggtgacgtcgtttctggcgatgatattcgctaccgggaccgtcggttcgtgctaggtaaggggctgtccgcctctccggctttccatcacttctcgtcggagcagcttgggctggatggcgatatggaagtgcagattcccaagtccatcaaccggctgcgccttaaaggctcaggcagccgctttgtgcatggcggcgcatcccttcaggaggttgtgattccagtcctgaaggttaacaagaagcgccagagtgatgtcagcgccgttgaggtggacatcctgcgtgggtccagctcggtgatcacttccggccaactggccgtcaccttgtatcagtccggaccggttaccgagaaagtacagcctcgctacctccgggctgggatttatacccagtcaggggagctgatctcggacagccacgagctgtcgtttgacctgacctcggagaatccccgcgagcgggagcttcaagtgcgctttgtgctcagccgcaaggcggacgaggccaacggccaggaggttttcctaaagctggaagaacagcacgccggcacctcccactacaaggaatacaagtcgctcaggtatttgatgcggcggtcctttaccagcgattttgatttctga

SEQ ID NO: 1396 - DNA, 2304 bp, Vibrio cholerae; identical to SEQ ID NO: 1292

SEQ ID NO: 1397 - DNA, 2304 bp, Vibrio cholerae; identical to SEQ ID NO: 1292

SEQ ID NO: 1398 - DNA, 2550 bp, Gamma proteobacterium
atgacacaaaaccgtattcaacaaaatctcgctcgactgtttgagcgccagcgcattgtcttctggtatgacgacaagaaagagtttcgcgaggcgtttgaaagtcttgagatggagggcgtggagaaggctgaaattcagtcgaatgaatttactctcaagcatcgtatcttgcgggaagagccaaaacagaacttcctgctgtactgcgaagataaagagcccgagtatctcaacaactggctgctcgacgttcagctgcacagtgcagtattccggactgaccagtccgcgatctggctgagcgaaatgaacctcccgccagactttgccgatgtcgttacggaacatgaagccttttttgatgcgggtcgcgcgcctaagcaagccgagacccgcaagcaaaagcttctcgatttactgcaacccgacgacctcaaacagcatgtgcggctcaagatgctggctgtctgcgcagatcttcatcagctggccgatgtacgcttagatgtcatttgcgaaaatctgtttgatgagttggttgaggatacccaaccacgatttgcgctgatcgaacgatgcaatctgacgggcgtgctatgggagcagatcgagcgtcactacggatacgtctcagagacgccatcggtcaaagacttctcaatcgagctgtttaagtcgtgctacgcactctcaatcaccaatccaaaagctagcgataaggccgcgctaaataacgatgcactcgtactcttcaaacgctggaaggacagtcgcaagcacgaggacgtctttgaatccctctcaggcagctatgcagagctactagacatagagagcgatctaaacaatcgggatctgcgcgatgtcatcgagatggattactaccgcttgattgaccaaaaaatcatcgtagatctggtcaaagccgtgagccaacgcacgctgtcggaaggcgaggtcaccaaatactgccgtgagcgtcgtcaaagtcactggtacggtgcgtttaaacacctctacactgcgatcgaagtcgccagtcagttcctatctgcgctagatactgtgcagctcaacatgagtagcacgtccgatgccgtgcatggctacgtgcgccactggtacaagattgatcagatgtaccgcaagttcatccacgccctgaaatcctctgggcagatgaccctgctgaataacctggtcgataccgtggagaacctttataccaatcgtttcttaagtccgctggctactcaatggcagggtcaggtggatgcgatggataaatggtccgtaccggatgtgatcccgcaacgccagttctacagcaattgggtaaaacgctattccaaccgcggcagcaagatctgcgtcattatctcggatgcgtttcgctatgaggccgccgaagagatgatcggccgcattaacggggaaaagcgctatcaggcctcactcagccacatgctgtcgtccctgccaagctatacgcagttgggcatggcgtcgttgctcccatccaacggcggtgaattcaccatttcggatagcgatggttcggtgtcgattgggggtgtatcgactcagggaaccgcgaatcgagacaagctgatcaaagctgccctgggtgataccgcctgtgcgcagcaagccaaatccatcttggatatgacgcaaagcgaggggcgtgagctctttaaaaaccacgatgtcatctacatctatcacaaccgcatcgaccatgctggcgacaagatgcagtccgagggtgaagccttcgatgctacggagcgtacgttcgacgacttgatgatcctgattaagaagctcgctgcttacaacgcatctaatatcttgatcaccgcggatcacgggtttatctatcagaacaagccgctcgatgagagcgatttcttgtctgccgatgccagtggtgaggtgcattaccgcgaccgccgcttccttcttggcaaaggattatccgccccggaatccatcaaggtgttcagcccagaacaactaggactgtcaggtgatgtgcacgcggccattccaaaaggaatccagcgccttcgcttgagtggctcgggcagtcgctttgttcacggcggagcgaccttgcaagaagtcattgttcccgtcatctcagtgaataagagccgacaggatgatgtcgcagtcgttgaagtcgatttgcttcgcggtggtaccaacatcatctcggcagggcagctctcagtcacgttgtatcagaccgaagcggtgaccgataagctcaaaccgcgccagctacgctgtggcatttacacgtcgtctggtcagctgatctctgacgcacacaacgtcacaatggatctgacatcggataacgcccgcgagcgcgagatgaagttgcgtttcgttctgactcaagatgccgacgctgcgaacaatcaggaagtgagcctgaagctagaagagcaagttgcaggcacaaaccagtacaccgaatacaaacagttgaaatacaccattcgccgctcattcacgagcgacttcgatttttaa

SEQ ID NO: 1399 - DNA, 2598 bp, Escherichia coli; identical to SEQ ID NO: 1222

SEQ ID NO: 1400 - DNA, 2538 bp, Enterococcus faecalis
atgtcagatttgaatttaaatcagattcagaacagactaaatgaactttttgtaacatatggagagcgtaagcttattttttggttcgatccaaaaaaagaatttgaagaggatattattaatgggaaaattgaattaaaagatgcgaaagtttttatccttgaaccaaatactcaatttatgacaaaacgtttctttgaaattgaagatactgataataactatttaatctatgcaccatttgaaaagataagtgatgacgaccaggataatcatttactaagtattttgaaatattctagcgagtttagtgcagatcgtatttcattggtgatgacacaattaaatattccaaatgagttacatgatgctatggtacattatgctaaattctttggtgcaagatcacgaattactgcttttaacaaactaataactactgaaattaaatcaaagcaagaacttgaaatagcaatgatggccgtcctaaccaaagctaacactgcccaattttatagtatcattcaatctttactggtcgaatatgcgtatgaatcaagtagcctgtatgaacaattagtgacttttgatttacagaatgctttttggaaatatgtatctctttattatggctttatttcagagacaccaactatccaaaagttgacagtttctttttttgttaatgctttttatgggcaattaggacatcaagaattacctatacagttaaaagagtacgaagttttagaacaaactacagcaattatttcctttatggatggggtaatgaatgactctcgctatacgcaagctttcgataaattgagtggaaatacatatcggttaattagcggagagaagttgatttcactggtgcccattgaggaacttattgcagctgatatttttgaatctgttcataataacataatcaagtattatattggccagctattgagtggggatttaacaccgataattaatgggatgacactttctgaagttattacattgaagcagcgagcgcactttggtgcaaagtatattcatgaatatgaagtaatattgaatgcacaaaaattgttgaataatactttttcttctaatattaaccaattttcagaagttgttaaaaattatgaaaatatctcgtttaatattgatcaatcttatcgtaaatttatttggcattttgataaagttttatctccagatttatttacagaacttaaattacgcatagaaaaacaatacaaaatatttttaaatgagagtgcccgtttgtggaatgatctattgtctttagaagaacgttcgtcactccttgatttttatgacgactttgcaaataataaaacaaaaacagttgtgattatttctgatgcacttcgttatgaaattgggaaagaaattcaagaagtactgcagtatgaaaagaaatttacaacaaagatgaatacacttttttctgttcttccatcagtaacggaatttggaaaagcggctttgttaagaagtggacacgaaacgtatgaatatgttgaaggaaccgatattcgggtaaatggaatgaaaacacaggggactcctgcacgagataaaatattaaaagcaaaaaattccaactctttggctattacgtatgaagaagtgatgactaaaacgaatgcaaaagaacttcgtgagatatttaatggcaaagaagtgatttatctttatcatgatcaaattgataggacaggggatcatggtcaggaatcacaagtttttgatgctgcacaaaaaacagttgatgaaatcaaagctttaataccatttatttcaaacggagcgaatgtttatcgatttttgatcaccagtgaccatggctttatctatacaagatccaaagttgaagaacatgaaaagattgaaaatccatctgaattttctgaagatagagtagaacgtcggtttataattagtgaaaatcattatgatgaaattggaattacttcaatgaaattaggagaaatattgcgcaatgatgacaaacgctatgtacattatcctgaaacatctgctatttttaaaaaagtaggcgggggtcaaagttatgtacatggtggttcttctccacaagaaatgcttgtccctgttttagaagtaaacgtttctcgaggatcgtctcaaaaagaaccagtgagcgttcagttaatgacagcaaaaagaaaagttataggactttctatatctttagagttttatcaaacggaagcgttaagtgactcaatcactaaagcaaaatatacgttatattttgaagatagtaagggaaacttaattacgaatcaacatacctattatgccgattctacctcagagcaagctagtgaaagatttacaaatttcacttttgactttataaatcgtaattatgatacaaatgaaaaaatttatttagtagtgaaaaatacagagacgaaaattcaagtggaaagaattgactttgtaattgataatccatttgctggcggttttggttttgatatttag

SEQ ID NO: 1401 - DNA, 2628 bp, Pseudomonas syringae
atggactcaaagcagctgacccaaggcctgcaccaggcttttttcgctgaaaaccatcgaatcgtcttctggtatgaccccgagcaaaactttgccgatgcactgaacgagctcgacttgcctgatgtgcaggtgctgaacatgcagggcaagtcgacctttggcactaagttgcagctggagcttgcagatacccagggtaaatacctgctctatttcccctgtgccgagcctgacgcggaagatgactggctgcttgatataaaactgttctcacgtagcttttatgcagaccgggtgtcgatgatttttaacgagttgggtttgcagcaagtgagcctgcgtgagcatctatctcgtagagaaagcttcctcaaaagtaccgcgcgggtttctgcgctcaagcgccttatccaatcaaatgcgactgccgaagagttggaccaggccatgattgcggtgcttctggggtctgcggcgtgcgatatcaccaccttgctttgcacgttggcggatcaggtcgttcgggatgatctcggtcttgagagcaatccaggagttatcgacgagttgtatcagcatgagctgatgccagcgttactgcaggcactacgtgacgaggtgggttacccggccagtgctgaagaaataagtggtgagaagccattcagctttgggcattttctgattcgccttttggcaaccggcttctgtgaaagcatttctgagatccctgactgggcttctgcaatcgcaatcccgtcagccagcgcccgggccacatctcgcgccctgctatcgcgctggcgagacagctctcgattttacaaaagctatgacgttgtatcttcctgggtgggagaggcattgcgcatctccgacaagcttggcgagttctcgctggaaaccctggccaatatcgccaccttcgaggcagtcgagcgtcagatcattatcgatctgacccaagctatccctagcgccgctccaagcgaccttcaggtgttttctcgaatcatcggcgagcgcctggacaactactgggcatcccgacacaaggacgacgatatacgtcgtaagtatcgactgctctacagtgcccttgccgcagccatcgagttattcggtctacgcctgcagtttggtgccggctttcattacgccggcacggaggctctctacaaggcttacgagggtgagttgtaccgctttgatagcgcatatagacgctatgtggcggcgtcgcaacgtgctcgtgtggaactgttgaaaaagctcgatgaagccgttgagcactgctacgcctactggtacctggatcaattaggccgcaactggggtgactgcgtagaagccgaacaacgcctggcacattggaatattgccggtgtgcccagccagcagaatttctacgagcgttgggtacaaccgcagttcgagaagcaccgaagtaagcgtgtagtcgtgatcatcagtgatgctttccgctacgaggccgcagtcgagctacgcgagcgcatcaatgaaaaacgctacagcgaggcaaccctgtccagccaattgggcgttctacccagctatacgaccctgggtatggcctccctcctcccacaccagaaacttgaataccgagagagtgccgccgatacagtttttgtcgatggccagtccaccgccggcaccgtacagcgagacaagatcctcgctcagtaccagggtatcgccgtaacagctgatgaggttaaggcctggtcgcgcgacgaaggtcgcgaaaggctcaaggataaacagttggtttacgtctaccacaatgtgatcgacgaccgcagtgacagcggtggtccgtcagagtcagataccttccagcatgtggaagtggccatcgaagagctgaccgagctgacccgcaagattctcatgcacttcaacaccagcacggtggtcgtcactgcagaccacggttttctcttccagcaaagcaagctggaggcggctaaccgcactgcgctggtcgacaagccagatagcgctttcaagagtaaaaagcgttatgtccttggccatacgctgccagaggccaaggatgcctggcaggggtcaacaaagcagacggcgggcaccgaatcggatacacgcttctggatacctaagggagccaatcgctttcatttcgtcggcggcgcgcgtttcgttcatggcggtgcgatgcctcaggagatcgttgtaccagtgctgacagtcaatcagctgcgaggtgagaaagccggaaagcgcacgcgccgtaaagtaggggtgatttcgcccaagtccgttctcaagatggttaacagcattcagcgcttcgacctgatgcagactgaagcggtcagggagcaggtactcccggtgacggtagcggttgctattttcgaaggcggacagatgatttccagtgaagaagtggtcactttcgactgcacgactgactccatgaatgaccgcttgaaacaggtacgactatcgctggcaggcagtgactttgatcgcaagagagattatttcctggtcatccgcgacaaggatctgaataccgagttggagcgctaccgggtcacgatagacctggccttcactgatgatttcctttaa

SEQ ID NO: 1402 - DNA, 2598 bp, Escherichia coli; identical to SEQ ID NO: 1225

SEQ ID NO: 1403 - DNA, 2514 bp, Pseudanabaena biceps
atgaacgaacgcattgctcaagccttaatcaaacaattcgatcgcgatcggattatcttttggtatgacagcaaacaagaattacgagatgactttgaaagcttagaactcgatcgcgtcatcaaaattgaattaaaaaataatgaatttgcaatcaaatatcggattttgcgagagcagcccaaacaaaagtttttgatctaccacgaaggcgctcaacctgcggatattgataactggttactcgatgtgcagttagcctatggacagtttcgcaccgaccaagtagctctgctattagctgacttagagttagggctagaatttgccgaagtcatacaggcacatacagaattttttcaggctattaaacgcaaagactccttaaagcgtttgcttgctgctaatgatactcaaggaatgatccgtttaaaaatgttggctgtctgtgcatctgctgacccacgccttgatgcgatcgtcgagcagctattggcagaacacgccaacgatcaagataccaaaatcaaattaattaatcgctgtggattagatggtttcctatgggaacaaatgcaaagaacctatggatatatatccgcagaaacaagcatcaaagacttcgcaattcaactcttcaaatattgctatttccaaaatttcgccaataactccccacttcccacttcccattcctcactatctaccgatgcgatcgtcttcttaaaacgatggaaagatagccgtcaatttgcggaatcctttgaaaagctctctgataactgtgctgagattctcaatattgagcaggatttatataaacgcgatttgcatcaactgatcgagctagattattttttaataatcgatcaaaaaattctcagcgacctagcaattcagctaactgcaaggacaatttctctaagtgatatcacctccacaatttatcaacgccgcacctgccattggtacgctcgctttcgtgatgcttatgagtgtattaactttgcggctcagtttatctatacccttgctgaagctaacttgagcatggactcgatcgccgatggcattcaaaaatatagccaaacttggttccgtttagaccagtactatcgcaaagtcatttatcacagtcgctcaagcaatagtaaagcgatttcagatctaaaagatcagattgaaaatctatacaccaataactatcttttaaaacttagcgatcgctggcaaaccttcatcgatgccgcgccaaaatgggaagcaataccgatcccttcccaaaaaaacttttatgagcgttgggtgcgtccatttctcaaccgtgataacaaaatttgtgtgatcatctccgatgccatgcgatacgaaattggcgatgaatttttgagcctaatccgccaagaagatcgctatgaagcgaccatagagccagccctatcgatgctgcccagctatacccagttaggtatggcagccctattaccaaatactagcttagctattgccgacaatgaaactggtcatgtccttgtcgatggacagccctccaacggtactgctaatcgtgacaaaatcctcaaacaagcaggcgatcgggctagggcgatcgcggctgaagatttaatcgccctcaatcgtgacgaatcccgcgaactcctgaaagcaaatgatgcgatctatatctatcacaaccgcatcgaccacactggcgacaaattgcaatctgaaggacaagcctttgaagctgccgaaagcaccctcaaagagttaattcaattagtgaaaaagctaactgcggcaaatgcaaataatatcctgattaccgccgatcatggatttatctaccaaaatcaagacctcgaacaaagtgattttctgagccaagatgtcacaggtcaaactgttctctaccgcgatcgccgatttgtattaggtaaaaacctcaatcgcaccgatagcgtcaaattcttcgactcaaatagcctcggtctagcaggtgatattgaagtttgtattcccaaatccatcaaccgattacgcctcaaaggttcaggtagtcgatttgtgcatggtggagccacactccaagaaataactattccgatcatcagaattaataaaaagcgtcagagcgatatatcttccgtagaagtagagatcctgcgcggtagtagctcaacgattacatcaggacagttagcagtgactttttatcaagtgcaacccactactgataaagtgcgatcgcgccatctccgtgcaggtatttatacacaatcaggggatctaatttctgattcccacgatctcaattttgatatagcctcagaaaaccctagagaacgtgaactacagatcagatttctgcttaccaaaaaagccgatgaatccaataatcaggaagtgattttgcgcctagaagaaaaactatcgggaaccacccactatcaagaatataaatcaatccgctatttaattaggcgatcgttcaccagtgattttgatttttaa

SEQ ID NO: 1404 - DNA, 2304 bp, Vibrio cholerae; identical to SEQ ID NO: 1292

SEQ ID NO: 1405 - DNA, 2304 bp, Vibrio cholerae; identical to SEQ ID NO: 1292

SEQ ID NO: 1406 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgagtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacttggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagctatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcagaccgccctgcacccggaagatcattaccggcttagctcgccatatgatttgcacgaatgcgaaaccaccctcagcatcgaacaaaccattattcatgcgctggtaacgcagctgctggaagagagcaccacgctcgatcgggaaacctttaaaaaattgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggagcgatgatcctcaagagcctggatgattatatcgaggcgctctacagcaactggtatctggcagagttaagccgtaactggaacgaagtgctggaggcggaaaatcgtatgcaggcgtggcaaatccctggcgtgccgcgtcagcagaactttttcaatgaggtggtgaagccgcagttccaaaatccgcaaatcaaacgcgtgttcgtgatagtttccgatgccctgcgttatgaagtggcggaggagctggggaatcaaatcaataccgagaaacgctttaccgcagaactgcgatcgcagctaggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaaaaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaagtaatcaaccgcctccacggcacacgcatttttgttacggcggatcacggtttcctgttccagcaacaggcgctttcggttcaggataaaacaactctgcaaattaagccggaaaacaccatcaagaaccacaaacgctttattatcggccatcagcttcccgccgatgatttttgctggaaaggtaaagtggcaaataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1407 - DNA, 2535 bp, Actinomyces sp.
atgagtggaatcgacgcctccgcattggccgacggcctgcgcgagctgctgacgcgcgcgcgcttggtcacctggcttgaccagggccgcgagtacaccgaccaggtcgacgaggtcgccgccctggtgccggacgcacagctcatcaccgtcgaccacaacgagttcgccaccaaactccgcgtcctccgcgaccaaccgaaagacgcgttcatcctctaccgtcccggcgaccttccgcccctggacacggacctgttggccgacatccgctgcgggtaccccgcgttttccgccgacgcctcgtcgatgctggcccgcgaactggacctggacgacgacctgacgcccattcttcgcgaatacgacggtttcttcacccgtgagcgcatccgccgcatcaaagaccgcaaaatccagatcaacgacaagaacaagctgctggccgtcatgagtgccgtcctgctgggcatccacgaccactccttctcctcgatcttcgtcgaactggccaactccgacgcgtgcgaacaggctaagatcggcaaactcaaatgggggctcgccgacttcttctgggaaggggcgcgctccatctggaagtaccagggggacccagagctcaacaacctcatgacatggctcttcatcgagcagcgccggggctgggaccccgccctcgcctcggcccaacgcgacttcgccacctggatgggcggcgtcaagaaccaggacgccgtcaaagtctgggcgacgcgcatcagcgaggaccttggcctggccgaagaactccccagcctcgacaccgccgacctggagcgggacctggtcaccccgggcgtcgacgaccagctgatccgccgcgcggtcacctccctgatcgacgggcgctccaatgcggccgacgtgcgcacgcagaggagcaggcgcgcctcctcgctctggaaggaggaatccgccagcgcctgggaggccgccgaggccggcggccggttcctccacctggtccacacccaccgggacgccgcgttccgcaccgcgggtgagggattcgccctctacaccgacgctgcgaacggcctgtggcaggtggaccaggcgtaccgccactatgtccgcgcctcgcgcgccgccggggaccccgacgtgttcggagagctcgacgcggccgtcgagaccatctacctccacgacttcctgcggcccctgtccgcctggtgggacgcggcggtccgcgcgctccccacatggcgcattcccgcccacgcctcgtcgaacccgggccgacaatccgacttctacgacctcatggtccgcaacgcgaagaaaaccgcagtcatcgtctccgacgcgctcaggtacgaggcgggggccgaactggccgaaagactcatcgcccgcgggggcgccaccgtcgagatcaccccgtggtacacgctgctgccgtccgtgaccgcgctgggcatggccgcactgctgcccaaccgcagtctcagcaccggtgtgcgggccgacgcgttggaggtacgggccgacggcgagcccacgggtggcctggccgcgcgcgacgcggtgctgcgggcagccagcggcgaccggatcaccgcgcactcgtaccagacgatcgcgggaatgctcagggacgacttgcgcgccctgggcaagggcatggcagcgatctacgtctaccacgaccacatcgacgccgtcggcgaccacgcggcctccgagagcggaacgcccgaggcggttgagagggcactcacggatctcgctgcgctggtcacgcgcctgcgctccgcggacttccaccggatcctcatcaccgccgaccatggcttcctctaccaggcccggcccctgcccgacgacacgaccgccaagcaggggaccgcgccccgcgccgagaagatcctcctcaagaaacgccgctaccagttgggcgacgccatggagagcagcgacgacttcgccgtgttccccgccgccgatgtcgggctcgcctccgggccggatgtcgcactgcccttcgggatgcgcaggagccgcattcagggccggggcgaccagttcgtccacggcggcgccagcctgcaggagatcagtgttcccgtcatcgaggtcaacacaaccgccgggctcaaagcccacgatgtcgaggtcgagctctcctactccacatcgcggatcagcatgacccgcatcaccccgaaagtcatccagaaggaccccatcgccgagcgcatccgccccattgagatcacggtcggcatcatcgacgccgacaccggaaagcccctgtcgaacgtggagcgcctcaccctggactcggtcgaggccacgcgccttgaccgcgccagaaccgttgaactcatcctgttggacgggatcctgcaggagtacgcgggaaagacggtactgctggccgcacacaaggtcgtcaacggaatgcgcgcatcggacgcccccgtcgcgtcactggagttggaagtccgggacaccggtttcggcggactaggaggattcaccctatga

SEQ ID NO: 1408 - DNA, 2127 bp, Fusobacterium necrophorum
atggaaaaagaaaaaatcaaggaaatgttggaagaacgctttaaagtaattcctgcataccctagaaaacggcatattcttttttggtatgatgggcagaaagcatttcaagatattatagaggaattacagcttgataaagtaaaaatctttcgtttgcaaaaaggaatcaatcgaaatggagaagaaattgataccaatctttttaaaataaaatatactttggagattttggatacggattctcattatttaatttatagtgctaatccaagaccttctaagcatgaaaattatctcttagatatagaaagctattctgatttttttgaagcggataagtctgctatcttagtagatgattttggatttgatagaaagaaccatggtattcatgatacaattcgagaatactcggagttttttgtaagtaaagagagaagagaaaaactaagaaaattattagaaaatcctttaaacacaagcgaagaaaaattaaagctttccgtacttgctgtggttgtaggaactaaaatagtagatttgcaagaaattttaaaaaatattatatttgattccagtaaattggaacaaattaagaagtggatgggactttcttttttatatgaacaaattttaaggaaatttcatctttccatagaaagttgggaagaatttttaaaaatcttagtggtagttcatttttatcgagaaatacaacaaaaaccttctattcatttggaatcctactatcttggaaaaaccaatgaactttttatttttacttcttctttgtttcaaaatcaaaacgactctaaacatattcaagaaattttctatgaagtaggaaaggaattgaatatgaaagatagaattgaagaattggaatttgaaaaaatgttattaggaaattcttttgaatatttcgagaaaagaattttacaggagttggtggaccggttacagtttggagttgtggattattcccaatatatatcatggattcaagaacgttctcattacagtttgtggaaagaaaagtatttctatttctatgaaactcttctttccgttgcccatttattgaaagaaaaagaacagttagaaatccaagatagaaaaacactttctgaaattttggaagattatacagctcattactacaaaattgatcaggagtacagaaacttttactattcttatgaccagattaaaagttcggaactagcttctattttcgattcctttcatagtaaaatttctcatttttatgaagtggaatatttagaagttttgttagctctttggaatgaacatttggaagaaagaaattctttagtacaacagaaggatttttatgagagatatattaaaaattcgaatactcgtgttgccgtaatcatttctgatgctctcagatatgaagtgggagaggaaattacaagacaattagaaaaagaaggaaatgccaaagaaattcaaatttctcctttattaaccaacttaccgagcattacttctgtgggcatgacacaattattgcctcccggaaaagaccgaagcatagatctttttcataacaagatgacagtcaatggaatttctacattttctacagaaaatcgtgaaaaaattctaaaagaaagttgtttggaatcttctgctatttcttatgatacttttaaaaataagagcagaggagaacaggaagcttatgtcaaaggaaaaaaagtactatacttttatcatgacagtattgatgctataggagacaaagcgaaaacagagcatagaacttttgatgcttgtaaaatggcaatgcaagatattctttctttgacaaaaattttatccagtcttggaatcgtcaatatttttattagcagtgatcatggatttttatatgaaagaaaagaaattgaagagtataataaattagaactgcaagaagaatattttcttttaggaaaacgatatgctttttctacaaaaaaagtggaagagaaaggttgtattactattcccattgaagatttttttggagtttttccgcaaaaaatcaaagaatcaaagtgggaggaagcggtttgcaatttgtacatggaggaagtagccctcaggaaatga

SEQ ID NO: 1409 - DNA, 2625 bp, Acinetobacter radioresistens
atgaacttaagtcaactacagcaaggcctggaacaagccttttatactgaacagcaccgaattgtcttttggtacgatgcagagcattcatttactgaagaaatcaaagccctaaagctaaatgatgtccagattttgaatatggcagaagagtcgagtttggcgatcaagcttaaactggaacttgaggatcagcagggtaaatacttgctgtatttccccagtgctgagcctgaaaccgaaaaagactggttactggacatcaagctgtattcacgcagcttctatgccgatcgtttctcgattattttcaatgagctgggtttacagcagcagagtctaagagaacatctggccaaacgtgaagaattccttaaagccaaagcccgtctgagtacattgaaacgctatatccagtctgatgcagatgaacaggatctggatatggccatgattgcggctgtggtcaaagctgacagtgccgaactcatgcatatcgttctagcactagcagatgaaatggtacagcagaacctggctctggaagtcaatccggaatcgtttgctgaactggaaaaattccaactggtgccagctttagtcaccgcattacaggcggaaattggttatccagcatcggttgaagaattgaatggggaagcaccattcaagctcggtacgttctttatccgtttgatgactacaggtttctgtgaaagcctgggcgatataccgctatgggctcaggaactggtgatgtcatccgtcagctcccgtgcaacagccagagcctttttgtcgcgctggagagacagctccaaatactacccaaccttcgatacactctcccagaccgtggctaatgcactgcggatccaagaaaaggtcggggcttttgatcttgagcagctgctcgatgtcatgacttttgaagtgattgaacaaaagatcattgttgatttggccagtcatatccctgcagcagccaaagctgaactggaacatttcagaacgattatttctacccgtctggatggctattgggcgtccaaacataaggacgatgcaacccgccgtaaataccgcaccgtctatacagcgttgcaggcagcgattgagctgttcagcctgcgactgctgtttgatgccggtttctatttcgactctagcgaagccttgtataaagcctacgagcaggagttgtatcgctttgatatggcctatcgccactacagtgctgcttctcaacgcgctcatgtcgatatcctgaaaaaactcgatgaagaagtcgaaaattgctattcctactggtttattgaccacttggcacgaaactggggcgagcgtgtagaagctgagcaacgcttgaatgtctggaaagtggcagatatcccaaatcagcagaacttctacgatacccacgtcagacccttactcaattctgcaacgaaacgccgtattgtggtaattatcagtgatgctttccgttatgaagctgcggtagagttgcgtgatcgtatcaatgaaaagcgttattctgaagcgaccttgtcttcacagctgggtgttgtcccaagttacaccacacttggcatggcctcgttgttgccgcatcagactttggaatacaaagaggccgcaggggatgatgttttagtagatgggcaatctagcaaagggactgcagcacgatccaaaattctggctgcctataatggattggcagtaaccgctgaaatggtaaaaggctggtcgcgtgatgaaggccgtgaagcgctgaaagactatgagttgatttacgtttatcacaacgtgattgatgcacgcggcgacagcgcctcgacagaatcagaaacctttatggcggtggaacatgctattgaagaactgactgaactcagccgtaaaattttaatgcactttaatatttccaccctattgattacagccgaccatggcttcttattccagcaaagtaaactggaatctgcggatcgttcaagcttgactgaaaaacctaccaatacattgaagagcaaaaaacgctatgtgattgggcatggtttaccagagagcaaggaagcctggaaaggctcaacccaagctacggcaggcacattatctgcgactgatttctggattccaaaaggggcgaaccgtttccattttgtaggaggctcacgtttcgtgcatggcggcatcatgcctcaggaaattgtggtaccggtactgatggtaaaacagctacgtggtgaaaaggctggacagcggaccaagcgtaaagttgaggtcatttctaccaaatccacgctgaagatggtcaataacatccagaagtttgatttgatgcaaaccgaagctgtcagtgagctggtcatgccagtgactttatccattgccatttatgatggggatcttaaagtttccagtgaagaaactttgacttttgatagcactaccgactctgttgcggaacgggtaaaacaggtcagactgtcattgtccggtactgattttgaccgtaagaaagattacttcttggtactgaaggacaaagacctaaatatcgaagtgcagcgctataaggtcaccattgatttggcatttaccgatgacttcttctaa

SEQ ID NO: 1410 - DNA, 2304 bp, Vibrio cholerae; identical to SEQ ID NO: 1292

SEQ ID NO: 1411 - DNA, 2544 bp, Bifidobacterium bifidum
gtggatgatgtggcaacattggtaggcgagtgcgccaccgatgagatactgcgtgaggttgaactcatcactccggaaatcggggatgagaatgacaggcggtacattccgttcacggtgcgctaccgcatgttccacgagcagccaaatcaaaaattcctcgtatatctgacggagccggccccggcagttcaggacaactggctgttggatttggagcgggcatatggccccacgttcaccatggacaaacttgccgtgacgcttacggaaacgctgccggaagcttccgccgacacccgaaagaagtggttggaagtgatgaagcgtgtaccgaagttcttcgacagtgaagaacgtgccaagcgcttcgcgaaacgtcttaacgcgcacgacgacgacacctatttccaagcgaagatgatcgccacgttgttgcaactgaaagaggatcggcacagcatgcaagacatctgggctgagctgcttgcacaatattcgcagggtgacgaatccggcatcgaagaaatcgaaaaaatgggattgagccaattccactggaatggcacgcgaagaatctaccatttcgatgtgaatactggtactggagccaaaccaacggtgaaggacttcgtgctatggctgttccagctcgcatggaacggattctccgatggaaagaacgccgtctccacttatgcgaacattattcgcgactgggacgactggtataagaacatcgacatgcgcatggtactgcagaatctttccgagaacgccgtggaggaactgcacctgtccactcgaatcgccgacatgagcgtagaagagcttgccggccgcgacctgttccgcgacgtggatgagatgatcgtcaataagctgttcgaacggttgggctcgcaatccattacggacaaccaggtgcaacgaatcatcaacgggcgcaagcaaaagctctggtatgcagaatataccgaccaatatgagtgcattgccgccgcaagcaggcttcgcgccgtgttgactgaatgcagcggacttattagcaccatcagctcgccggaacaagggatgaagctgtatgccgaaaagctatacaaggccgacggcgcatacagaagatatgtgctcgcatggcatcgcgccaacccggatgcggtgagcgtggacgatgatctgcaaagcgcctacgaggcatatcagcaggatttgggccaggcatggcaaaaacaagtcgatacgcttagccaatggaagttcatagacatggacgcgcaaaccaatttctatgaacgtgaaatcgcgccgatcttgaaggccggcagaaaaatcgccgtgatcatttccgatgcgctacgttacgaggttgcgcaggaactgtccgaacgcatcgacagggaaagccgtttcagtacgaaactgaacatgcaatacagcgttctgccatcctatacacaacttggcatggcggcgttgctgccgcacggctcgctcgaattcgacagcaaagaccgtttgtatgttctagcggatggacgcagcaccaaaggaatcgaagcgcgtgatgccattctttcggccgtaggcggcaaagcgattagatatgacgatttgacaaagctgaaagtcagcgaaatcaaagaactatataaatcctgcaacgtgctgtatgtgtatcacaaccatatcgacgccaccggtgatgcggagaaaacggaatcggaaacagtggacgcatgcgagaagacgttcaaggaactgggcgaagtagtcaaaaaacttgccagcggcaacgtccataacatgatcatcactgcggatcacggattcctctatcaggaccgagatttggacggtacggaatggttgagcgaacagcccaagggcgatgcggtatgggtgagaaagcggcgattctccatcggatccaatcttgctccgggtcgtgcgttcgtgacattcaatgccgcgcagataggaatggacgatgctcggaatgaaggcataagcattcaagtgccgaactccatcatgcgcttgcgcatgcagggcgccggtgtgaagtatgtgcatggaggagcagcattgcaggaaatcgtcgttcctgtgctgcatgtcagtaaggggcgttccgcggccgacgatgtgaggcccgtggaattcactattctgcaacgaaccgacaggctttccagcagacagttgactgtggaattcttccagaacgagcccgttggaggaaaaatccgcgcacgtaccgtattggccggattgtgggggcgtgatgcggcaggcaatgatgtgctcatctccaatgagacaccggtcgccttcgatctgctcgggcaggagaaaagcgaacgccatgtgacggctacgctcatgctgaccagtgacgcggaacgattcaatggaacgaatatcgaactgcgcctgcgtgagaagacagatgggtcaaatgtgctggtcatgcttgaccagaaggcacgatacttcttcaaacagggcgtggtagccgacgatgccggattcttcgactga

SEQ ID NO: 1412 - DNA, 1854 bp, Bacteroides ovatus
atgaagtacaattgcatcacgcaattacttgatgctatgccaggggattcgtacaagcaatataaaatcagcaattcggtaatccttgaccaggtaaacaagatttatgagtggggcacccacgaccgtatgctgagcgagaaatttatccagtcaatgagaatattgtcttcagatattaaagaagaggaaatcatcaacatctatggtattgatgcaaactacttctattttactgaagcactttgctggccgattctgaaggagattttagaaaagaaactcatggctgatccagaggacgtaaacgatcgtatgcgagaattggctctgaaattacctgttgacagttacatccagattgtcattcgcttcatcggacagtcagctctgttctatatgcagatacgtggccttggcacactgaaattaaacagtacaaaagaatacgtaaataaatatattacggagttctatcaggtagatatgttctatcgtagaacactcgaagcctatcatgagctactcacgaaagagaatcctatcgaattggtattgaatgctgccaaaagacaattggatttggagtatgccaagatagccaacctgcttaacctcgaatggttgacttgtgtggaagaaaaaggcacctggtttacagaaacggggttgaagcatcaggaagacttctatgctaacgagtctgatccaaatgtgaaacaggtagtcattatcagtgacgctctgagatacgaagtggctatggaattgatgcagagactggccaaggaaaagcatatggctactattgaagcttatcaagccatgttacctacggaaaccaagttctgcaagccatcacttcttccacatcactcccttgaactgttcggcacagatatggccgtagatggagttgtattaactacaacagaacaacgaactgctcatctgaataaataccgagacggaggaatttgtgttcgctatgaagatgtgatgaacggtgaccagacttcaacacgagagctgtttaaacggcctttggtatatatctttcatgaaacaattgatgaagcgagtcattctcaaagcccgtttgaagttatcagtgcctgtcgtaaggccatagaccaacttgcagtgttaatcaaacgtttacatgcttcatggaatgtgactaatgtcttgcttacagcggaccatggattcctatataatgacatgaaatttgaagataaggataagcatagtatcaccgatatttcagtagagaagaaaacaagatactatctcactgacagcacagctaaagtcgagggtatcgtcaaattcccactcaaaaaggtttctgccataaaaagccagacacctctttgggtaggtgtatctgtcggtaccaacagattggcagcctctggggggtataattttgcacacggtggtgcatcccttcaggagatgattattcctgtgattcgcagtcagcagaagagaacaaataagacggaaaaggtaggcgttactcttatgaaccacaacctgaatatggtaagcagccgactcaagttccagctaattcaatcagaagcagtaagcatgacgatgatggaacgaaaaatcgtatgctgcatttacaacggtgacgaacctgttacgcaggaaaaggaacttactttaaacagtacagatgctacaaacctgaataaccgagtgtatgaggtgacgcttaatctgaataaatcaatcagtgcgagtatgctacagcttcgtatttatgctacagacgaccggttaaatccacttatccgtgagacagttaaaaataatacaatgatagaacaagatttttag

SEQ ID NO: 1413 - DNA, 2304 bp, Vibrio cholerae; identical to SEQ ID NO: 1292

SEQ ID NO: 1414 - DNA, 2541 bp, Parabacteroides sp.
atggtacaagaaagaatatataactactttgaacgaaacccacagcttcatgtgctctttatcttcgaccggatggatattatccagacagagcttggagaggtgaaggaatgggctgacggatatatatataaagtattcgatggagcctggttcaatacaaaatatgctattgaaaatacttggaaagacaaacgcattgttctgctttttcctgtggaaacctatcctcattcagaggaacagcaactacaatttccattgcttgatatgctgaaagccaacatggaatataaggaagatgattatgcctcttttatgcagcagtataatctgccagaacggttccgtagttttatcaagaaaaatattgcggaaatcatgtcttctaaaatccataatattcttaatgggcatattgattcaagtacctttagtgaggatttggtttgccgtgctttcatctccaattatctcggcgagaaaaagttgttggattgggaaacaatcattgtaaagatggttgttcttgacgttacttcggaagggaaaaaacatgctgatttttggcataaactttcaaagaacgtagatgccagcaaagcaatcaatgataaattgacaaaactttttggagtaagttataatctgaatttgccacaaaagatgaagtgcgttgcagaatgcatgaagtacaattgcatcacgcaattacttgatgctatgccaggggattcgtacaagcaatataaaatcagcaattcggtaatccttgaccaggtaaacaagatttatgagtggggcacccacgaccgtatgctgagcgagaaatttatccagtcaatgagaatattgtcttcagatattaaagaagaggaaatcatcaacatctatggtattgatgcaaactacttctattttactgaagcactttgctggccgattctgaaggagattttagaaaagaaactcatggctgatccagaggacgtaaacgatcgtatgcgagaattggctctgaaattacctgttgacagttacatccagattgtcattcgcttcatcggacagtcagctctgttctatatgcagatacgtggccttggcacactgaaattaaacagtacaaaagaatacgtaaataaatatattacggagttctatcaggtagatatgttctatcgtagaacactcgaagcctatcatgagctactcacgaaagagaatcctatcgaattggtattgaatgctgccaaaagacaattggatttggagtatgccaagatagccaacctgcttaacctcgaatggttgacttgtgtggaagaaaaaggcacctggtttacagaaacggggttgaagcatcaggaagacttctatgctaacgagtctgatccaaatgtgaaacaggtagtcattatcagtgacgctctgagatacgaagtggctatggaattgatgcagagactggccaaggaaaagcatatggctactattgaagcttatcaagccatgttacctacggaaaccaagttctgcaagccatcacttcttccacatcactcccttgaactgttcggcacagatatggccgtagatggagttgtattaactacaacagaacaacgaactgctcatctgaataaataccgagacggaggaatttgtgttcgctatgaagatgtgatgaacggtgaccagacttcaacacgagagctgtttaaacggcctttggtatatatctttcatgaaacaattgatgaagcgagtcattctcaaagcccgtttgaagttatcagtgcctgtcgtaaggccatagaccaacttgcagtgttaatcaaacgtttacatgcttcatggaatgtgactaatgtcttgcttacagcggaccatggattcctatataatgacatgaaatttgaagataaggataagcatagtatcaccgatatttcagtagagaagaaaacaagatactatctcactgacagcacagctaaagtcgagggtatcgtcaaattcccactcgaaaaggtttctgccataaaaagccagacacctctttgggtaggtgtatctgtcggtaccaacagattggcagcctctggggggtataattttgcacacggtggtgcatcccttcaggagatgattattcctgtgattcgcagtcagcagaagagaacaaataagacggaaaaggtaggcgttactcttatgaaccacaacctgaatatggtaagcagccgactcaagttccagctaattcaatcagaagcagtaagcatgacgatgatggaacgaaaaatcgtatgctgcatttacaacggtgacgaacctgttacgcaggaaaaggaacttactttaaacagtacagatgctacaaacctgaataaccgagtgtatgaggtgacgcttaatctgaataaatcaatcagtgcgagtatgctacagcttcgtatttatgctacagacgaccggttaaatccacttatccgtgagacagttaaaaataatacaatgatagaacaagatttttag

SEQ ID NO: 1415 - DNA, 2598 bp, Escherichia coli
atgcaatttaaagaactggaatcagggcttcgtcagaagtttaccgacaaccgtatcgtcttctggcacgacccggaacaacgcttcactgattcaattaatgagctggatctcgacaatgtcacgctgctggatatgcgtggcgtttctgtgctcgcaacaaaaaaacgactcgaaatcgacgagcctgagcagaaatttttactctatttcacctgtgaggttcctgctcgcgagcaggactggttgctggatatccgcctctatagtaccgaattccacgctgattatgcggcgatcaccctgaattctctgggtatcccgcaactcggtttacgcgaacatattcagcttcgcaaagccttctttaccgttaagcgaactcagatcctgaagggatgggtcaccgagcgcgaaacggaaaactctctcgataagaaaatgctggcggtggtggtcggggccagtaccttcgaaaccaaagaaatactatttgctttggttcagcagtttgtcgcagcacggcagcaagatgatagcgcactcgagaacactttcgccgtactgacgaagcttggcctggatgaggtactttgggaaattcttcgccttgagttgggataccagtctgaatctccttcaatggaaaatctgcttctgaaactgttctgtaccgatctctgggcgcagggtgatgaagcacatcgtgactggttgagtaaaaatgtgctggctaccgcggctggtcgggcctcgtcactggcctttatgggggcgtggcgcaacgatcgtcgctataaagtagaatacgattactgtgcagaggatttgcagcagacgctccagccaaaagaacactacaactacagctcaccatatacactggcaaaatgtgaaaccttcgaggctattgagcaacttattatccgtggtctggtgacacagttgcaggaagagagcaccactctggacagagatgcgtttaaagcgttggtttcagagcgcagtgcgaaatactggagccaaacccgcccagagtatctttctatctggaatgctattcgtcaggcagaacgcttgctgaatttgcgtaaccgttacaccgacgggtttaatttccccgatacaggtgcgttctggaaggcctattgtgacgaaatttatcgcttcgatcagacctatcgtttgttcaatgaatatgctgcaccagtgcacagcaaaggggcgatgatcctgcatgaactggataaattcatcgaagagttatacagcaattggtatctgactgaactaagtcgcggctggaacaaactgctggaagcggaaaaccgtatgcaggcctggcagtttagcggcatacccctgcagcgcaatttctataaagagaatgttaaacgtcagtttgacacctcgcaggtcaaacgtgtttttgtcgtgatctcggatgcattgcgctacgaagtggcggaagagctgggcaggcatatcaactatgagaagcacttcagtgcagagctgcgctcccagaccggagtgctcccaagctatacccaactgggcatggccgcactgttgcctcatgagtcgttgagctatcttcctgataattctggtgtagtatacgccgatgggatgtccacttccgggtttgaaaaaagagccgctattcttgcgaaggtgaatggtgtagcgctgaaagcaaaggacttgcagaacgccaataaccaggaagtgaacgagcaaatccgcaacgcttccgtagtttatatctggcacgacactatagatgccatgggtgataaggctgcaacggaagataaaacgtttgaggcctgccgaagtgcaatcactgagctaaaagatctggtttcacgcctgcgtagccgatttaatgccagccgaatttttgttaccgccgatcacggcttcctgttccaacaacaagcgctggtggagcaggataaaacgaagctggaaagtaaagccaaagacacgattgaagcgaataagcgttttattgtaggccatcaactgcctgaaagtgaattttgctggcacggcaaactggctgatactgcaggcgcaagcgatgaaagtgaattcctgttacccaaaggagtacagcgtttccacttcgtagggggtgctcgtttcgttcatggcggagccatgctgcaggaagtgtgtgttcctgtgttgaagattcgcgcgcttgaaaagaaagcggctgagaagcaaccccagcggcagcccgtgcccgtcgttgcgcgggatcaggtgatcaaactggttaacagcattgataaaattggttttattcagacttcggcagtgaatgatttaaatgagccgcgcacgctgaatatctttatcgtcgatgaaaacaaccaggtcgtctccggcacggaaacagtatgcttcgacagtgataacgaagatatgggtaaacgcacccgcgatgtaaccatgaaactcatggggacggcattcaatcgtaaaaacaagtatgttcttatcctggagaatgcggacagcgcaacagagtatggtcgctacccgatcacgatcgacctggcatttcaggatgacttcttttaa

SEQ ID NO: 1416 - DNA, 2643 bp, Lachnospiraceae bacterium; identical to SEQ ID NO: 1370

SEQ ID NO: 1417 - DNA, 2304 bp, Vibrio cholerae; identical to SEQ ID NO: 1292

SEQ ID NO: 1418 - DNA, 2541 bp, Bacteroides ovatus
atgactcaagaaagaatatacagttattttcagcgtaacccacagttgcatgtacttttcatcttcgacaaggcgaatatcattatgaatgatttggcagactgttcgtggggaactgaatatatctataaagtatttgatggagcttggttcaacactaaatataacattgaatacgcatggaaagagaaacgtgtggtattactcttcccattaggcacctatcccataagtgaggaacaacagctcagattccctcttatggacatgctgaaagctaatatggaatataaagaggaagattatgccgcgttcatgcaacaatataaacttcctgagaaatatcgcgcctttatcagccgccatatcggtgaattgatgtcgaataagataaatgcaatgctgaaagaccggtttacgccggaagcattcagtgaggatgtagtagtccgcggttttatttcttcttacctgagtgaaaagagactcttggaatgggaaaacatcatcataagaatgttcatactcggattggattcagaaaataagaaacggttggatttttatcataagttggaacgaaacaaggatgccaagacagcggttgatgagcgtttgactaagatatttggcttcagttacaaacccaaccaagaggcgaaggtgaaagagttggtggagagtttgaagtataatagcatcacccaacttcttgatgtgattgccgatgatccctacaaggcttacaaaataaagagcagtatagcacttgaacaaatgaatcgtatctatgaactgggcacacgtgaccgggagtttgtagataaattcatgaaagtgatgaaagaactaggtgctgatattcgtgaaagggagctgactaccatctatggcatggatgcttccttctattacttgacggaagaattaggttggcctatattgcaagaaattgccggtagcaaacttgtgacagaacctgcaggaatgcaagaacgtttgcgtttgctttcccaaaaacttcctgccgatagtgtgcttcaacaagctataagcttcttgatgcaaatggccttttattatgaaatggtaagaggactgggcagcctgaagttgaatactccggaagcttatgtgcaactctatacgaatgacttgtacaggcttgacaccttctatcgttgtgcattggaagaatatcatgaattgttgtcaaaggatgttcctatacttacttgtttgaatggactgaaacaacagtttgacggagagtatgcacgtatggttaatgttttcaatctggaatggatgacctgtgtgatagaaaaagggaactactttaacgacctgtcgttgaaaaaacaagaggatttttatgcaaatgaatgtgtcagcaacagtaagcaggtagtaatcatttctgatgcgctacgctatgaagtggcggcagaattgatgcaggaactggctaaagagaaacatatagcaaagttatctgcttatcgggccatgctgcctactgaaaccaaatactgcaagccggctcttctacctcatacctcgttgatatggaagaacaaagaaatgctggtagatggtgaagtattagacacattagagagccgttcggtacaggtggcaaaatacaaagaaagtgcttgttgtgtagactatgaaactgtaatcaaagcagatgtaaaaacagcacgcgaactatttaaacgtccgttagtctatattttccatgatacaattgacgctgctagtcatggggctggagccggagatgtaattgcggcttgtcgcaaggctattgaacagctcgctgtgctggttcgtcgccttcatgcctcttggaatgtgacgaatgttgtgctgacagctgaccatggttttctctacaatgacgtggaatttgcagagaaggataaacatgcggtgacggttgcgggtattatcgagaagaaaacgcgttactacgtgagtgatcaagttagcgcgcaagaaggggtggtaacaatgccattggacaaagtatcgggtatgaaagccgagactcctatatatataggagtacctatgggtaccaaccgtttggctgcttctggtggatacagctttgcccatggcggagcgaccttgcaggaaatgcttattcccgtgattcatagttcgcagaaacgctctgataagactaataaagtgggtgtggcattggttgatcacaatctcgtgatggtaagcagtagattgaaatttcaattgatacaaagtgaagcggtttccatgacggtagttgaacgtaaggtcgtttgtcaagtgtatcaaggcgatacacccgtaaccggaaagcaaactattatgcttgacagtgctgatacgatcaatttgaataatagagtatacgaggttgtgctgatcttgaatcattcagtacattcaggtatgctacaactacgtgtgtatgatgaagaagactgtttgaatccacttattcgtgaagtggtgaagaataatacaatgatagaacaagacttttaa

SEQ ID NO: 1419 - DNA, 2523 bp, Enterococcus faecium; identical to SEQ ID NO: 1373

SEQ ID NO: 1420 - DNA, 2598 bp, Yersinia ruckeri
atgcaatttaaagaactggaatccgggcttcgtcagaagtttaccgacaatcgcatcgtcttctggcacgacccggaactacgcttcatcgattcgctcattgagctggatctcgacaatgtcacgctgctggatatgcgcggcgtttctgtgctcgccacaaaaaaaagaatcgaaatcgacgagccagcacagaaatttctactttatttcaccagcgaagtccccgcccgcgaacaggactggctactggatatccgcctctatagcacagaattccatgctgactatgccgcgatcacactgaactcactgggcatcccacagctagggttgcgtgaacatattcagcttcgcaaagccttctttaccgtcaaacgcacccagttacttaaaggctgggtcaccgaacgcgaaacagaaaaatccctcgataagaagatgctggcagtagttgccggagccagcacctttgaaaccaaagagatcctgtttgctctgatccaacagttcgttgccacaagccagcaggacgatagtgctctggaaaatacttttgccgtgctgaaaaagctggggctggataagttcctctgggaagtccttagtcttgaactgggctaccaggcagaagcaccaacgcttgaaaacctactgctgaaactgttctgtaccgatctttgggcacaaggtgatgatgctcatcgtgagtggttaagtaaaaatgtgctgactactgccgcaggtcgtgcttctgccctggcctttatgggggcgtggcgaaacgatcgtcgctataaagcggaatatgattattgtgcagccgatctccagcagacactgcagccgaaagagcattacaactacagctcgccgtatgcgctggcaaaatgtgacactttcgaagctatcgagcaattgattatccgtggcctggtaactcaactacaggaagaaagcacgaccctggacagggacgcgtttaaagcactggtatcagagcgcagcgcgaaatactggagccagacacagccagtgtatctatcaatctggaatgctatccgccaggccgagcgtttgctgaatttgcgtaaccgttacaccgacgggtttaatttccccgatacgggtgcgttctggaaagcctactgcgacgaaatttatcgcttcgatcagacctaccgcctgttcaatgaatatgctgcaccggtgcatagcaaaggagcgatgatcctccatgagcttgataaattcattgaagagctgtacagcaactggtacctggcagagctgagccgtggctggaacaaactgctggaagcagaaaattgcatgcagacctggcaaattagcggcgtgccattgcagcgtaatttctataaagagaatgtgaaacggcaatttgacacttcgcaggtgaaacgtgtttttgtcgtgatttcagatgcgttgcgctacgaggtagcagaagaactgggtcgacacatcaatcatgagaagcacttcagtgccgaactgcgctctcagacgggagtgttgccaagctacacacagctaggtatggcggcattgttacctcatgagtcgttgagttatcagcctgacaattccggcgtagtgtatgccgatgggatgtctacctcggggtttgaaaaacgcgccgctatcctgacaaaggtaaatggtgttgcacttaaagcgaaggacttgcagaacgccaacaaccaggaagtgaacgatcaaatccgcaacgcctccgtggtgtacatctggcacgacactattgatgccattggtgataaggctgcaacagaagataaaacatttgaggcctgccgaagtgccatcactgagctaaaagatctggtctcacgtttacgtaaccgatttaatgccagccgaatttttgtcactgccgatcatgggttcctgttccaacaacaggcgctggtggagcaagataaaacgaagctggagagtaaagcagtaaatacgattgaagcgaataagcgattcattattgggcatcagctgcctgaaagtgaattttgctggcacggcaaactggcagataccgcaggcgcaagcgatgaaagtgaattcctgttgccaaaaggcgtacagcgtttccactttgtaggtggagcgcgtttcgttcatggcggtgccatgttgcaggaagtgtgtgttcccgtcttgaagattcgcgcgcttgagaaaaaagcagcagagaaacagccacagcgccaaccagtgtcagttgttgcacgggaccacgtaataaaactggttaacagtattgataaaatcggcttcatccagactacggcggtggatgagtacaacgaaccgcgtaacttgaatatctatattattgatgaaaataatcaggttgtatcaggcaccgaaacggtctgcttcgacagcgacaatgacgatatgggtaaacgcacccgcgatgtgaccatgaaactcatgggtacggcattcaatcgtaaaaacaagtatgttctcattctggagaatgcggacagcgcaaccgagtatggccgctacccgattacgatcgatctggccttccaggatgacttcttttaa

SEQ ID NO: 1421 - DNA, 2598 bp, Pantoea sp.
ttgcaaagcaaagaattaattgccggacttactgacaagttcttacatcaccgcatcgtcttttggcacgacccggagcaacgcttcatcgattcactcaatgagctggatctcgacaatttcatgctgctggatatgcgcggcgtttctgtgctcgccacaaaaaaaagaatcgaaatcgacgagccaacacagaaatttttactctattttaccaatgacgttcctgctcgtgagcaggactggcttctagacatccgcctctatagcaccgaattccatgctgattatgctgcgatcacactgaactcattgggtatcccacagctagggttacgtgaacatattcagcttcgcaaagccttctttaccgtcaaacgtacccagttacttaaaggctgggtcaccgaacgcgagacagaaaaatccctcgataaaaagatgctagcagtggtggccggagccagcacctttgaaaccaaagagatcctttttgctcttatccagcagttcgttgccgcaagtcagcaggatgatagtactctggagaatacttttgctgtgctgaaaaagctggggctggataaggtcctctgggaagtccttagtctagaactgggttatcaggtagaagtgacgacgctggaaaatctactgctgaaactgttctgtaccgatctttgggcacaaggtgatgaagcgcatcgagagtggttgagcaaaaatgtgctgactactgccgcaggacgtgcctctgccctggcctttatgggggcatggcgaaacgatcgtcgctataaagcagaatacgattattgtgcagccgatctccagcagacactgcagccgaaagagcattataactacagctcgccgtatgccctggcaaaatgtgacactttcgaagctatcgagcaattgattatccgtggcctggtgactcaacttcaggaagaaagcacgaccttggatagggacgcgtttaaagcactggtgtcagagcgtagtgcgaaatactggagccagacccgcccggaatatctctccatttggaatgcactacgccaggctgagcgcctgctgaatctacgtaatcattatactgacgggtttaatttccccgataccggcgcgttctggaaagcctactgcgacgaaatttatcgcttcgatcagacctaccgtttgttcaatgaatatgccgcaccggtgcacagtaaaggggcgatgatcctccatgagctggataaattcattgaagagctgtacagcaactggtacctggcagaactgagccgtggctggaacaaacttctggaagcagaaaattgcatgcaaaactggcaaattagcggcgtgccgttgcaacgtaatttctataaagagaatgtgaaacggcaatttgacacttcgcaggtgaaacgtgtttttgtcgtgatttcagatgcgttgcgctacgaggtagcagaagaactgggtcgacacatcaatcatgagaagcacttcagtgccgaactgcgctctcaggcgggagtgttgccaagctacacacagctaggtatggcggcattgttacctcatgagtcgttgagttatctgcctgacaattccggcgtagtgtatgccgatgggatgtctacctcagggtttgaaaaacgcgctgctatcctggcaaaggtaaatggtgttgcgctgaaagcgaaggacttgcagaacgccaacaaccaggaagtgaacgatcaaatccgcaacgcctccgtggtgtatatctggcacgacactattgatgccattggtgataaggctgcaacagaagataaaacatttgaggcctgccgaagtgccatcactgagctaaaagatctggtctcacgtttacgtaaccgatttaatgccagccgaatttttgtcactgccgatcatgggttcctgttccaacaacaggcgctggtggagcaagataaaacgaagctggagagtaaagcagtaaatacgattgaagcgaataagcgattcattattgggcatcagctgcctaaaagtgaattttgctggcacggcaaactggcagataccgcaggcgcaagcgatgaaagtgaattcctgttgccaaaaggcgtacagcgtttccactttgtaggtggagcgcgtttcgttcatggcggtgccatgttgcaggaagtgtgtgttcccgtcttgaagattcgcgcgcttgagaaaaaagcagcagagaaacagccacagcgccaaccagtgtcagttgttgcacgggaccacgtaataaaactggttaacagtattgataaaatcggcttcatccagactacggcggtggacgacctcaatgaaccgcgcacgctgaatatctttatcgttgatgaaaataaacaggtggtatccggaacggaaacagtttgcttcgacagtgacaatgacgacatgggtaaacgtacccgcgacgtgaccatgaaactcatgggcactgcattcaatcgtaaaaacaaatatgttctgatcctggagaatgctgacagcgcaacagaatatggccgctacccgataacaatcgacctggcattccaggatgacttcttttaa

SEQ ID NO: 1422 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaagcgtcacgctaatcaacatgacccacgagtcacagctggcggtaaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaatctggcgacagaacaggaagatgaagcctcgctggataagaaaatgattgcggtgatcgctggcgcaaagaccgcgaaaaccgaagacattttgttcaacctgattacccagtacgttaaccaacaaatagaagacgacagcgaactggaaaacacgcaggcgatgctgaaacgccacggtctggactcggtattgtgggaaatgctcaaccacgaaatgggctaccaggcagaggagccatcgctggaaaacctgttcctgaaactgttttgtaccgatctctctgcccaggccgacccacagcagcgcgcctggctggaaaaaaatgtcctgctgacgccatccggcagagcatctgccctggcatttatggtgacctggcgtgccgatcgtcgctataaagaggcttatgactactgcgctcagcaaatgcaggccgccctgcacccggaagatcattaccgactcagctcgccgtatgatttgcacgaatgcgaaaccaccctcagcatcgaacaaaccattattcatgcgctggtaacacagctgctggaagagagcaccacgctcgatcgggaagcctttaaaaaactgctctctgagcgccagagcaaatactggtgtcagacacaaccagagtattacgccatctatgacgcattgcgccaggctgagcggttgctgaacctgcgcaatcgccacatcgatggtttccactaccaggacagcgccaccttctggaaagcctactgcgaagaactgttccgcttcgaccaggcttatcgcctgtttaatgaatatgccttgctggttcacagcaaaggagcgatgatcctcaagagcctggatgattatatcgaggcgctctacagcaactggtatctggcagagttaagccgtaactggaacgaagtgctggaagcggaaaatcgtatgcaggcgtggcaaatccctggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaatacagagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgatatcattctgaagaactataagggaatggcgataaaatcgaaggaccttctggagttaaaaaatcaggaagggcgagaccttattcgcgattacgaagtggtgtatatctggcataacacgattgatgccactggcgacacggcatccacggaagataaaaccttcgaagcgtgccgcacggcggtggctgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaagggaaagtggcggataccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccacagcgccgcccggtggatattgtcgcttaccatccgatgattaagctagtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1423 - DNA, 2304 bp, Vibrio cholerae; identical to SEQ ID NO: 1292

SEQ ID NO: 1424 - DNA, 2598 bp, Escherichia coli
ttgcaaaatcaggactttattgctggccttaaagctaaatttgccgaacatcgcatcgttttctggcacgatcccgataaacgttttattgaggagctggaacagctcgagcttgaaaacgtcacgataatcaacatgacccacgcgtcacagctggcggtgaaaaaacgcatcgaaattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacctggtgacagaacaggaagatgaagcctcgttggataagaaaatgattgcggtgatcgctggagcaaagaccgcgaaaaccgaagacattttgttcaacctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaagccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcacccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagcaaatactggtgccagacacaaccagagtattgcgccatctatgacgcgctgcgtcaggctgagcgtttgctaaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcaatgatcctcaagagcctggatgattatatcgaggcgctctacagcaactggtatctggcagaattaagccgtaactggaacgaagtgctggaagcggaaaatcgtatgcaggcgtggcaaatccccggtgtgccgcgtcagcagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctcccaagctacacccaactgggaatggcggcgttgctgccccatgaacaactttgctatcaaccggggaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcatgccgcacggcggtgactgaactgaaagatttagtcaccaaggtaatcaaccgtctccacggcactcgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaataatatcgataaagtgagcctgttgcagacgcatccggtgggcgaactttatgaaccgcgtatcctgaacatttacattgtcgacaacgccaacaatgtggtgtcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1425 - DNA, 2595 bp, Collinsella intestinalis
atgaagctatccgatattcagcaggagctgcgcaggctcttcgacgagcaagatgccgcagcgggcgccgtcgtggtgtggcacgacccggacggcgcgttcgccgaatccctcgacgcgctcgatctgccgggcgtcgacgtgatgcgcgaggaggagcacgggctgttctcgctcaagcgcacgctgaacggcgacctcgcgggacagcgcatcctgctctaccgaccgcgcccgcgccgcctggagggcgattggctcgccgacatcgaggcccggtccgcgagcttcgccgccgactacacctccatgcagctgcgcgagctcaacgcggccgatacgcgcgagatgcgtgagatgctcgccacccacaaggcgcaactcgccaagaagaccgtgctacgcaaactcacgcggttgagcccctcgtacgaacagccgcagcagctcgcctgcggcctcatggccatcgccctggacgcgccatcactggacgcgcaggccatcgtgcgcgcgcacctcgtcgcggcgttggccgcagatggcgccgaggcgctcgcccgggttgagcgcatgggctgtaccaacgagttccaggcggcaatctccgcatggattggctatacgggcgacgcgagcgacttcatcgcgctcggacggcacgtgctcctgtgtgcgctcgccggcgccttacccaacgacgccgcctcggcgctgcccgcagacgtgacctcgggcaccaccgcgctctgtcaggatatcgtgcgtggctggtgtcagagcgccgagcgggactccctgttcgaactcgcgcagctcgtggaggaggtcacacccgtcgagcagatgcttgcccaggtgccgctcgaaaccctgggcgatatcgatgtattcccctgcatcgatgcactcattttgcgccgcctgttccatgacgtcgcggcgtcacccgaaagcgcacccgctgcgctttcactcgcccaagcacgccacagcacggcctggtatcgggaattctccctttgctatgacgggcttgaagcagccgcacgcatgcagcgattccgcaatgagcacccggtcggcatcgacgctctttccgcagagagcgtctggggactctacaccgacgagctataccgcctcgacacgtggtaccgccagatgcatctcgcactcgggcgtgtcctcatcagtgcgccatacgggctcgatgaggacttccgcgcatgtagtgatcagatcgagaacctctacaagaactggtttttcgccggcgtttcgcgccggtgggaagatgccgccgagaacgagctaactcgcaacggatatgttgacggcatcccccgacagctcgacttctttatgagctccgtcgagccaatcgttcgcacgggcaaacgcgcctgcgtcgtcgtctccgatgccttgcgctacgaagtcgccgcggagctggcggaaactctcgagcaaaacaccaagggaacatgcgagctcgcctccatgcaggccatattccccagcataacctcgtgcggcatggcgtccctgctgccctgcgggaacctcaccatggacgcgggcgagcccgggcggctgcgcgtgctgctcgacggctcggaggtggctacgaccgccgcgcgccaagagcaactgcgccgcagcgacccgcacgccgtcgccatcacctacgactcactcgtcaacgagctgagcacgagccaacgcaaggacctcgtcaaggacgcgcaagtcgtctacatctaccacaacgccatcgatgcgatgggcgacaaagcgcccaccgagcgcaaggtgttctccgcctgcggcgatgcaatcgaggagatcttcggcctggtgcagctcatctgtcgcgagcgaatcgcaagccaagtcgtcgtcaccgccgaccacggctttctctataccgacgagccgctcggcgtctcggagcacaccgtcgcggccgagatcgacggagacccgctcgtcatcgggcgccgctacgccatcgccggcgacggcacgcgctccgacgtgctcatgcccatcgcgctgccgtacgcggaaggtgggctcaagggcttcgccccgcggcgctgcacgcgcatctcccgggcgggggcgggtgagaactacgtgcacgggggcatctccctgcaggagctctgcatccccgtgctcacgttcaccaacaggcgcgcgggcagcaagggatatgtggaaagcgagcaagcaacgctctcgctcatcaccaccgtcgacacgatctcgaacagcatcttcaagctggacctgttgcaggacaagcccgtgggcgggaaggtcctccccgcctcgtacgacgtgttcgtggggagcgcatcgcacgagcccgtgacggacgtcgcgcacgtcgcggccgaccgcacgcaggactcggcagacgagcgcatcatccccatcacgctcaatatcactccgggcgtcgccgtgagcgagcaggagccgtatttcctctacgcgcgcaactgcgatacccgcgccgtggacgctttgcgcgagctgcgcatgcgcatcgcctttgccccttcgtttgattttggatggtaa

SEQ ID NO: 1426 - DNA, 2598 bp, Salmonella enterica
ttgcaaaatcaggaatttattgccggccttaaagcaaaattcgccgaacatcgcatcgttttctggcacgatcccgataagcgtttcctcgaagagctggataacctcgaactcgaaaacgtcacgctgcttgatatgaccgaccagtcgcagctggcggttaaaaagcgcattgaaatcgacgagccggaacagcagtttttgctgtggttcccccacgatgcccccccaaaagagttcgactggctattggatattcgtctttatagtacggagttccacgccgatttcgccgccattacgctgaatacattaggtattccacagcttggcctacgcgagcacattcaacgccggaaggcatttttcagcactaaacgtctttctgccttgaaaggcctggtcactgagcaagaaaacgaagcttctcttgataagaagatggttgcggtcatcgctggcgtaaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgagcatccgaccctggaaaacctgatcctcaagctgttctgtaccgatctttccgcgcaggctgatccgcagaaacgcgaatggctggaaaaaaacgtgctggccacgccgtcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccatcattcatgcgctggtgacgcagcttctggaagagagcaccacgctagaccgtgaagcctttaagaagcttctgtctgaacgtcagagcaaatactggtgccagacgcgtcaggaatactgcgctatttacgatgcactgcgtcaggccgaacggttgctgaatctgcgtaatcgtcatattgatggtttccactatcaggacagcgcaacgttctggaaagcgtactgcgaggagctgttccgctttgaccaggcctaccgcctgtttaacgaatacgcgctgttggttcacagcaaaggcgcaatgatcctgaaaagcctggatgactatatcgaagcgctgtattccaactggtacctggcagaattaagccggagctggaataaggttctggaaaccgaaaaccgtatgcaggagtggcgtattgcgggcgtaccacggcagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgccgaactgcgttcccagttgggcgtgttacccagctatacccagctgggaatggcggcattgctgccccatgacgagatatgctaccaaccgggtagtggtgacatcgtttatgcggacgggttatccacctcaggtacgcctaaccgcgataccattctgaagaaatataaagggatggcagtaaaatcggacgatctgctgaaatggaaaaatcagcaaggacgagatcttattcgcgattacgaagtcgtttatatctggcataacaccattgatgccatgggtgacagcgcatcgacggaggagaagaccttcgaagcgtgccgtaacgcggtggttgaactgaaagatttagtgactcgtgtaataaaccgtctccacggtacacggattatcgtcacggcggaccacggtttcctgttccagcagcagcccctttccggccaggataaaaccacgctgcagatcaagccagacaatacgattaaaaaccacaaacgctttattatcggtcatcagcttcctgccgatgatttttgctggaaaggaaaagtggcggataccgcaggcgtcagcgataacagcgagttcctgatcccgaaagggatccagcgtttccatttctcgggcggcgcgcggtttgtccatggtggcgccatgctacaggaagtctgcgttcccgtattgcaggtgaaagcactgcagaaaacggctgccgagaagcaacctcagcgtcgtccggtagacatcgtcaagcatcatccgctgatcaaactcgtcaataacattgataaagtcagcctgctgcaaacccatccggtaggtgagttatacgaaccacgtactctgaacatcttcatcgtcgataacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1427 - DNA, 2604 bp, Escherichia coli
gtgaacttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgcgtcacagctggcggtgaaaaaacgcatcgagatggatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgtacgcaggcgctgaaaaacctggtgacggaacaggaagatgaaacctcgctggataagaaaatgattgcggtgatcgctggcgcaaagaccgcgaaaaccgaagacattttgtttaacctgattacccagtacgttaaccaacaaacagaagacgacagcgaactggaaaacacgcaggcgatgttgaaacgccacggtctggacccggtattgtgggaaatgctcaaccacgaaatgggctaccaggcagaggagccatcgctggaaaacctgctcctgaaactgttttgtaccgatctctctgcccaggccgacagacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggcggccctgcgcccggaagatcattaccgactcagttcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaaccagagtattacgccatctatgacgcgctgcgccaggctgagcgtttgctgaatctgcgcaatcgccacatcgacggtttccactatcaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcactctacagcaactggtatctggcagaattaagccgtaactggaatgaagtgctggaagcggaaaatcgtatgcaggcgtggcaaattcctggcgtgccgcgtcagcagaacttcttcaatgagatggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgatcgcagctcggcgtgctccctagctacacccaactgggaatggcggcgttgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaaccaggaagggcgagaccttattcgcgattacgaagtagtgtatatctggcataatacgattgatgccactggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacaccatcaagaaccacaaacgctttattatcggccaccagcttcccgccgatgatttttgctggaaagggaaagtggcggataccgcaggcgtgagcgacaacagcgagttccttattccgaaagggatccagcgcttccatttctctggcggcgcgcacttcgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacagcaccatggaaaaacgcgtacgcgaagttacgctgaagctgattggcgctagcttcaaccgtcgcaatgagtactggttgatactggaagacgcacaaacggaaacggggtatcagaagtacccggtcattatcgatctggcgttccaggatgatttcttctaa

SEQ ID NO: 1428 - DNA, 2508 bp, Nitratireductor indicus
atgactgaccgcatcacctccggcctgatgcggctctacgaggatcaggggcaccgcattgtcttctggtatgacgccgcccgtgatctccgcggggcgttcgatgcggttgacctgcccggcgtgacaaaggtggagatcgccaacaacgaattcggcttgaaataccgcatgctgcggcaggagccgaaggggcggttcctgctctacaaggacggccccgagccgccgatgcctgagaactggctgctggatgtgcaactggccagtgccgtcttccgcgccgatcaggcggcaatctgggtggccgatctgggcattccggcaaaatacgaagccgccgtgcgcgaccatgccgatttctaccgttcgggcaaacggctggatgcgctgcggctaatggagcgcgagcgcccgtcgcaaagcgccaatgatgtccgccgcaagatgctggccgtctgcgccggtgcggatggcgatctggatacggtgatcgaggcgttgctggcggagctcgccgatggccatgatgatgcgctgcgcctgatggaccgggccggtctgacggacttcttctggaaagaggtttccgcgcgctatggctatacggctgccgagccggattttcaggatttcgccatcacgctgttttccagcgcctgggcgcgcgcgatgggagaggaagggcggctgaacagcgatgccgcgctgatgttccgccgctggagcgcctcgcgccgatggggtgaggcattcgagactctgtcgggcaactatcaggatgtactgaagatcagggacgatctggcgtcccgcgatttccgcaagctgatcccgcatgaccatttcgaagaagtggaccggcggatcgtcgtcgccctggttgaagggctggcgcagcagagcctggcaggaacagatgtgctgaaatgggtgcgcgaccgccgccagagccattggtttggccgttacgaggacgtctatcaggccatcggctttgcgactgagttccagcaggcgctggccgaagcggacctgaccatgaccagcgtgtcagacggggtaaaacgctattccgcaagctggttccggctggaccagctctatcgcaagttcatctatcacatgcagaaaagcgggcagtcggggctgttgtccgcgctctatgaagcagtcgagaaccgctataccacgaatttcgtgttgaagctgaacgatgcctggcaggatcaggtatcgcgcctgacggactgggcggttccgggctttccgcgccagatggatttctatcgggaacaggcggcggagttccgccgcaaggaccagaaagtcgtcgtcatcatctcggacgcgctgcgctatgaggtggccgaagaggcgctgcgcgagatccgcaagctgaaccgcttcgacgccgaactgaagccgatggtcggggctttgcccagctatacccagcttggcatggcggcgcttttgccgcatcggcaactggcgatccgcgatgacaatgatctggtgctgctggacggtgaaagcaccatgggcgctgccgcccgcgaaaaggcgctggccgctggccgcgcaggggaccgggtgaaggttctggcggcgaaggatttcatgaatctcggctcatcagagggcaaggacctcttccgggatcatgatatcctctatctctaccacaatcagatcgacgcgattggcgacaagctcgccaccgaggaaaatgttcctgcggccgcagagaccgccatcgaggatctggtgaagctggtgcgtaagctgacctcggccaatttctcgaacatcctgatcactgccgaccatggcttcctgtggcagcacaaggctttggaagagagcggcttcgcgctgagcgagccggaaggagacatcgttacgcgcaaccggcgctatgtgatcggacggggcctcagcagcagcggtggcatgaagaagttcacagccacgcagcttgggctgggcggtgatcaggacatcctgatcccgaactcgatcaaccgtctgcgcgtgaaaggatcaggcagccgctttgtccatggcggtgcgagcctgcaggagattgtcctgccggttctgcgagtcggcaagcagcgcaaggaggatgtcgggcaagtgtcggtgcagatcattccgccagctcgtgcccagatcaccacgggccagattcaggtcaccttctatcaggcagagcccgttaccgagaagcagcagcctcgacaggtgcatgctgcgatctttgccgccgatggaacgctcatctctgacgaagccgagctggagtttgatttcgcatccgagaacccgcgcgaacgcgagcagtcgcacagcttcctgctgtcgcgggccgcagacacctacaacaatcagacagtcttcctgaagctgcaaacgcgcatcggcaagacccgtcatttcgaagatcacgcgtcgcagcccctgatgctgaagcgcgggatcagcacagatttcgatttctga

SEQ ID NO: 1429 - DNA, 2598 bp, Escherichia coli; identical to SEQ ID NO: 1422

SEQ ID NO: 1430 - DNA, 2625 bp, Acinetobacter baumannii
atgaacttaaatcaacttcagcaaggcctggaacaagccttttatactgaacagcaccgaattgtcttttggtatgatgcagaacagtcatttagcgaagaagtaaaagctttaaatctgggggatgtccagattctgaatatggcagaagagtcgagcctggcgatcaagctcaaactggaactacaagaccaacagggcaaatacttactgtattttccaagtgctgaacctgaaaccgaaaaagactggttactggacatcaagctgtattcacgtagcttctatgccgatcgtttctcgattattttcaatgagctcggtttacaacaacaaagtttaagagaacatctggccaaacgtgaagagttcctcaaagccaaagcccgtctgagtacattgaaacgctatatccagcctgatgcagatgcacaggatctggatatggccatgattgccgcggtggtcaaggccgacagtgccgagctgatgcatatcgttctggcactggcagatgaaatggtacagcagaacctggctctggaagtcaatccagaatcctttgctgaactggaaaaattccaactggtgccagctttggtcaccgcattacaggcggaaattggttatccagcatcggttgaagaattgaatggggaagcaccattcaagctcggtacgttctttatccgtttgatgagcacaggtttctgtgaaagcctgggtgatataccgctatgggctcaagaactggtgatgtcatctgtcagttcacgtgcgacggctagagcctttttgtcacgctggagagacagctccaaatactacccaaccttcgatacactctcccagaccgtggccaatgcactgcggatccaggagagggtcggggcttttgatctggggcagctgctcgatgtcatgacctttgaagtgattgaacaaaaaatcattgctgatttggccagtcatatccctgcagtaaccaaagctgaactggaacatttcagaacggttatttctacccgtctggatggctattgggcttccaaacataaggacgatgcaacccgccgtaaataccgtaccgtctatacagcgttgcaggcagcgattgagctgttcagtctgcgactacagtttgattccggattctatttcgactccagcgaagccttgtataaagcctacgagcaggagttgtatcgctttgatatggcctatcgccactacagtgctgcttctcaacgcgctcatgtcgatatcctgaaaaaactcaatgaagaagtcgaaaattgctatgcctactggtttattgaccacttggcacgaaactggggagagcggattgaaggtgagcaacgcttgaatgtctggaaaatggcagatatcccaaaccagcagaacttctacgatacccacgtcagacccttactcaattctgcaacgaaacgccgtattgtggtaattatcagtgatgctttccgttatgaagctgcggtagagctgcgtgatcgtattaatgaaaagcgttattctgaagcgaccttgtcttcacagctgggcgttgtcccaagttacaccacacttggcatggcctcgttgttgccgcatcagactttggagtacaaagaggccgcaggggatgatgttttagtagatggacagtccagcaaagggactgcagcacgatccaaaattctggctgcctataatggattggcagtaaccgctgaaatggtaaaaggctggtcgcgtgatgaaggccgtgaagcactgaaagactatgagttgatttacgtttatcacaacgtgattgatgcacgcggtgacagcgcctcgacagaatcagaaacctttatggcggtggaatatgctattgaagagctgactgaactcagccgtaaaattttaatgcacttcaatatttctaccctgttgatcacagccgaccatggcttcttgttccagcaaagtaaactggaatctgcggatcgttcaagcttgactgaaaaaccgaccaatgcattgaaaagcaaaaaacgctatgtgattggacatggtttaccagagagcaaggaagcatggaaaggctcaacccaagctacggcaggtacactatctgcgactgatttctggattccaaaaggggcgaaccgtttccattttgtaggaggctcacgtttcgtgcatggcggcatcatgcctcaggaaattgtggtgccggtactgatggtaaaacagctacgtggtgaaaaggctggacagcgcaccaagcgtaaagttgaggttatttctaccaaatccacgctgaagatggtcaataacatccagaagtttgatttgatgcaaactgaagctgtcagtgagctggtcatgccagtgactttatccattgccatttatgatggggatcttaaagtttccagtgaagaaactttgacttttgatagcagtaccgactctgttgccgatcgggtcaagcaggtcaggctgtcattgtctggcactgattttgaccgtaagaaagattacttcctggtactgaaggacaaagacctgaatatcgagatgcaacgctataaggtcaccattgatttggcatttaccgatgacttcttctaa

SEQ ID NO: 1431 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaagcgtcacgctaatcaacatgacccacgagtcacagctggcggtaaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaatctggcgacagaacaggaagatgaagcctcgctggataagaaaatgattgcggtgatcgctggcgcaaagaccgcgaaaaccgaagacattttgttcaacctgattacccagtacgttaaccaacaaatagaagacgacagcgaactggaaaacacgcaggcgatgctgaaacgccacggtctggactcggtattgtgggaaatgctcaaccacgaaatgggctaccaggcagaggagccatcgctggaaaacctgttcctgaaactgttttgtaccgatctctctgcccaggccgacccacagcagcgcgcctggctggaaaaaaatgtcctgctgacgccatccggcagagcatctgccctggcatttatggtgacctggcgtgccgatcgtcgctataaagaggcttatgactactgcgctcagcaaatgcaggccgccctgcacccggaagatcattaccgactcagctcgccgtatgatttgcacgaatgcgaaaccaccctcagcatcgaacaaaccattattcatgcgctggtaacacagctgctggaagagagcaccacgctcgatcgggaagcctttaaaaaactgctctctgagcgccagagcaaatactggtgtcagacacaaccagagtattacgccatctatgacgcattgcgccaggctgagcggttgctgaacctgcgcaatcgccacatcgatggtttccactaccaggacagcgccaccttctggaaagcctactgcgaagaactgttccgcttcgaccaggcttatcgcctgtttaatgaatatgccttgctggttcacagcaaaggagcgatgatcctcaagagcctggatgattatatcgaggcgctctacagcaactggtatctggcagagttaagccgtaactggaacgaagtgctggaagcggaaaatcgtatgcaggcgtggcaaatccctggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgatatcattctgaagaactataagggaatggcgataaaatcgaaggaccttctggagttaaaaaatcaggaagggcgagaccttattcgcgattacgaagtggtgtatatctggcataacacgattgatgccactggcgacacggcatccacggaagataaaaccttcgaagcgtgccgcacggcggtggctgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaagggaaagtggcggataccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccacagcgccgcccggtggatattgtcgcttaccatccgatgattaagctagtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1432 - DNA, 2523 bp, Enterococcus faecium; identical to SEQ ID NO: 1373

SEQ ID NO: 1433 - DNA, 2592 bp, Alcanivorax sp.
ttggccaagctgctgcaggcaggcaaccggattgtctggtggtctgatcctgacggcgaatttgctgatgccgtggctgacctttccctcgaggaggcagacgtggtctccttgggcgataccccggcactggccgtgaagcgacagattgagctggagtcgcccgcgagcccctttgtgctttacgaaggccaggaagcacctgacccagaacaggactggttgctggatattcgcctttatgccgagccgtttgctgccgatgccacctccatgctgcaacaggatttggggctgcaacatgccagcctgcgccactacctgaaagaccgtgcccgcttttttgccagtaaagaccgcaccgcgcgtttggccagcttgctgcatgcggatgatatggagcgggacatcgatgccaagatctgggcggtgctgtcccgaagtggctcggcggatccttttacgctgctgctggatttgctctgtgacgtggctcagctcgacgagggcgtggcctttgatgattcccctttgtggcagaacctggtcaagtatggcctggaaccgttcgcctgggccctgcttgagcggcatttcggctaccgggatgacgcgcccagcctggcacgtttcattccccggctgttggtgactgatcttgggcggggcctgaaaaagcccttgccgaccggcttgatcaagcttgcgttgccgcaagcgaaagccggcaacgtggcggtgctgttgtcccaatggcgggattcgacggcgcggcagaaggattacgacgcactgtccgcccggttggccagtgacctgcaacttacccatcacctttctaatctgacacccgccgatgtcgctaactgcgcgacctttgtggatctggagcgcattgtcgccaatgcgctgcgcgatcagctgctggggaatatggccagcagtgtcatggccgatgtgcgccgcacggtgaatagccgcctagccagttattgggtgagtgaccgctatcctgatacagaggtgggtaagcgcagtatttggcgggggtattatcaggcgctgttatcggcgaccgatctgtttgaggccattgaaacccgcgcccagcattttggcttcaccagcccggagcaggcgtataccgcttataccgagtctctgttcgaaattgatcagttctatcgcctgttccacgaggcagcggatgtggtgtctgcccgcttcccggatgccattgcccctctggctgatcaggtggaggcggcctacctcaaccgctacctgaacaagctggccacccattgggatgggcatctccagaatggtttgctggagaagtggaagctggagggtgtcgtcaatcagcagaacttctaccagaaagtggtggcgccctacctggcaaaaggcgatgagcgccgcatgtttgtcattatcagcgatgccctgcgctatgaagtggccgatgagctgaagacccagatcaatggtcgcgaacggattgatgccaccctgcgtagccagctgggtgtgctgcccagctataccaagctgggtatggccagcctgctgccgcacaagaccctgacctacaacgcgaaagggtctgtggatgtggatggccgctcctctgagggcctggataaccgcaacaagattctgggggctgtcggcggcactgcggtgaaggcagaaaccctggccaatatgggcaagcaggccctgcgggaattcgtcaggccgcatcgtgtgatttacatttaccacaacaccatcgatgcggtgggtgattccgccagtacagaatcgagcacctggatcgcctgtcgccaggcgatcaatgagctggcagatctggtgtcacggctggtgaataatgccagtgcgacagcaatcacggtgacggcggatcatggcttcctgttccgtgaaacgccaccggatgcactggaaaagagtgccatggccagcaagcccgccgggacgataaccgccaagaagcgctatctggtcgggaatgacctgggcgaggccgagtacgcgcaccatggcaaaacggccgtcaccgctggaacgggctgtgaaactgagttctggttgccccgtggtgttggccggttccactttgtgggtggggcgcgctttgttcacggtggtgccgctttgcaggaggtggccgtgccgatcatcgagatccgacagaaatacggtaagtctgcagaaagcgcccgtgtttccaaggtgggcgtgaatgtattgggccagcaacatcgcatcacgaccaactttcatgtctttactttgctgcagaccgagccggttagtgaaaaggtgttggcgacaaggattaccattgaactggtgaatcagcacggggagggtatttcttcccgagagatcttgaatctggacagcgatgctactgagctgggtgagcggcaaagcaaagtgtctttaagcctggccgctcaggcggtgaagcctggtaatgaccactttctggtgctcagcgatgctgagagcgaaatcgaacttcagcgcattccggtgcgcatcgacttggcaatagagaatgacttcgacttctga

SEQ ID NO: 1434 - DNA, 2304 bp, Vibrio cholerae; identical to SEQ ID NO: 1292

SEQ ID NO: 1435 - DNA, 2304 bp, Vibrio cholerae; identical to SEQ ID NO: 1292

SEQ ID NO: 1436 - DNA, 2658 bp, Escherichia coli
atgcagattagcgaactggcacaaggtgtcgctgcgaaacttgaacaaagccgcattgtgttttggtacgacccagagcaaagctttactgaagagcttgagcatttagctaacgccctctctatttcaaaagaagtaggcgatagcgcggcagatataactgctagggtactgccaaatgatttgaccatcctcaatatgggcaatgagtctgtattggcagtgaaaaaacgcattgaagtagatgagcgtgaagctaaattccttatctattttccaagcgctgagccagagcctgaccgcgattggttgctagacgtgcgtttgtatagcgagcagttttttgctgatcacagctcaatgctgcttaatgagctgggtatcccgaaaatggcgctgcgcacacacattcgtaagcatcagagcttttttgccaataaacagcgtatagccggtttaaaaaggtgggtgaccgagaatgaagacgaactgtcgttagacaggaagatgatggcagtggttgtaaaagctgattctgcgtctttgtcggacattctgcttgggttactacgcgaatatgcggcttatatcgaagatgaaagccttggccaacctttatggagccagttaggaaagtttgatcttgagacctcactctgggcctatctgagtgagggttttggctatacagtcgaagagccaaccttctcagacttcgtgttgaaattattctgtactgaattctggagccaaattgaaggtgttgaacgcgattggttgcttaacaatgttctaaaaagcgcatcaggccgagcgacagccttggcgtttatggtgagctggcgcgacagccgctctttcgccgcttactacgaaagtatctctaaggtgcttagccaacagctggaaatttcgactcgtgctggccagtaccatccggttgagcttatcgaatgcgaaacgttcgaagctgtggaacaggccataatccgtggtttagttcgtgatttgctggatagcagcaaagcgctagaccgggttcagtttgacacggtcttatcaagacgtcttgctagccactggacattgtcacgcaaagaatacttcgcaatttatgaagctatccgcaacgctgaagagttaatgcacttgcgaaatcgctatgtggatgggttccactttgataacgcgaaagcaatgtacgacgcctataccacagacatttatcgttttgaccaggcttaccgtttgttcaatgaacatgtgcactctgtattgagtaaaggtgcagacatactgcgtcagctcgacgacgaagtcgaaagcatttataccaactggtacttatatgagcttggccttgcctgggatcgtcacttggccaatgagaaactacttgaaaagtggcagatttctggcgtaccgcaccagtatgacttctatcaaaaagaagttcgcacacgactgagtctgaaacagacaaaacgcgtgtttgtgatcatctctgatgccctacgttttgaaattgcgaatgagcttggcgctaccattaacaacgagaagcgatttaaggctgaggtgtctacgcagttgggcgttttgccgagttatacccaacttgggatggcggcattattgcctcataaggcgctcagttaccagccagagcaaggcacggctgtttatgtggatggtatttcttcacagggtttagacaaccgcaacgccatcctacaaaaagtaggtggtatggcagtgagttctaaggaactgatgagctggagtaaccaagaggggcgtgacaaggttcgcgacgtagaagtcgtttatatctatcacgataccattgatgcgattggtgataaggctgcaactgaagagaaaacgtttgaagcctgtcgtagtgccattgaagagctaaaagatctcgttgggcgggtcatcaaccgtctaaacggcagccgagttgtgatcaccgctgaccatggcttcctcttccaacaaaaagcacttgtagcggctgacaaaacctcgttgaaaaccaaacctgctggcgcgatagaagccaagaaacgttatatcgttggtaataacttgccttcagatgaagcctgttggaaaggctcaataaacgatacggctcatggctctagtgataccgagttcctgcttccaaaagcggctcaacgcttccactttgttggtggtgccaagtttgtgcatggcggagcgatgctacaggaagtatgcgtcccggtactgcatgcgcgagagctgcaaaaagaacaagcagcaaaacatgagaaacaaccggtaggtgttgttgcagccactcagcccatcaaattagtaaacaatatcgacaaggtcagatttattcagacagaccctgtaggcgagcgttttgtcgcacggttgttggatgtctatatcgtcgatgcacaaggtaatgaagtatccagtcgtgaaacgattaactttgatagcgtgagtaaagttatggatgagcgtactcgcgaagctaggttaaagcttattggctctcagttcgacaggaacgctcaatacacattagttcttgagaatgcggaaatgagaacccgttatagccaatacgcggtaaccattgatttggcattccaagatgattttttctaa

SEQ ID NO: 1437 - DNA, 2646 bp, Bifidobacterium bifidum
atgagtgaggatagtcaggtaaccaggctgcttgccagacgtttcagccagccaggcgagcgtgggcgcatcgtattttggcgtgatgacaagaaacagtacgcggatgtcgtggcaacattggtgggggagcatgtcactgatgaagcgctgcgcgaggtcgaactgattaccccggaaattggggatgagaacgacaggcggtacattccgttcacggtgcgctaccgcatgttccacgagcagccgaatcaaaaattcctcgtatatctgacggagccggccccggcggttcaagacaactggctgttggacttggaactggcatacggccccacgttcaccatggacaaactcgccgtgacgctcacggaaacactgccggaagcttccgccgacacgcgaaacgtgtggttggaagtgatgaagcgtgtgccgaagttcttcgacagtgaagaacgcgccaagcgcttcgcgaaacgtcttaacgcacatgacgacgctaccgatttccaagcgaagatgatcgccacgttgctgcaactgaaagatgatcggcacagcatgcaagacatctgggctgagctacttacgcaatattcgcagggtgacgattccggtatcaccgtgatcgaacgcatgggattaagcacgttccattggactggaacacggcgcatttatcgttttgatgtggatgccgatgccggcagcgagccgacagtgaaggacttcgtgctatggctgttccagctcgcatggaacggattctccgatggcaggaacgccgtttccgcttatgcgaacattattcgcgactgggacgattggtataagaacatcgacatgcgcacggtgttgcagaatctttccgagaatgccgtggaggaactgcacctgtccactcgaatcgccgatatgagcgtagaagagcttgtcgaccgtgacctgttccgcgacgtggacgagatgatcgtcaacaagctgttcgaacggttgggttcgcagtccattacggacgaccaagtgcaacggatcatcaacgggcgcaagcagaagctttggtacgcagaatatgccgaccaatacgagtgcattgccgcagcaagcaggctccgtgccgttctgactgaatgcggtgaactcatcagcaccatcagctcaccggaacaagggatgaagctgtatgccgaaaagctatacaaggccgatggcgcatacagaaaatatgtgctcgcatggcatcgtgccaacccggatgcggtgagcgtggacgatgatctgcaaagcgcctacgaggcatatcagcaggatctgggtcaggcatggcaaaaacaagtcgatacgcttagccaatggaagttcatagacatggacgcgcaaaccaatttctatgaacgtgaaatcgcgccagtattgaagtccggcagaaaaatcgccgtgatcatttccgatgcgctacgttacgaggttgcgcaggaactgtccgaacgcatcgacagggaaagccgtttcagtacgaaactgaacatgcaatacagcgttctgccatcctatacacaacttggcatggcggcgttgctgccgcacgactcgctcgaattcgacagcaaagaccgtttgtatgttctagcggatggacgcagcaccaaaggaatcgaagcgcgtgatgctattctttcggccgtaggcggcaaagcgattagatatgacgatttgacaaagctgaaagtcagcgaaatcaaagaactatataaatcctgcaacgtgctatatgtgtatcacaaccatatcgacgccaccggtgatacggagaaaaccgaattggaaacggtggacgcgtgcgagaagacgttcaaggaactgggcgaagtagtcaaaaaacttgccagcggcaacgttcataacatgatcatcactgcagatcacggattcctctatcaggaccgagatttggacggtacggaatggttgagcgaacagcccaagggcgatacagtatgggtgagaaagcggcgattctccatcggagctaatcttgctccgggtcgcgcgttcgtgacattcaatgccgcgcagataggaatggacgatcctcggaatgaaggcacaagcattcaagtgccgaactccatcatgcgcttgcgcatgcagggcgccggtgtgaagtatgtgcatggaggagcagcattgcaggaaatcgtcgttcctgtgctgcatgtcagtaaggggcgttccgcggccgacgatgtgagggctgtggaattcactattctgcaacgaaccgacaggctttctagcagacagttgactgtggaattcttccagaacgagcccgttggaggaaaaatccgcgcacgtaccatattggccggattgtggggacgtgacacggcaggcaataatgtgctcatctccaatgagacaccggtcgccttcgatctactcgggcaggagaaaagcgaacgccatgtgacggctacgctcatgctgaccagtgacgcggaacgattcaatggaacgaatatcgaactgcgcctgcgtgagaagacagatgggtcaaatgtgctggtcatgcttgaccagaaggcacgatacttcttcaaacagggcgtggtggccgacgatgccggattcttcgactga

SEQ ID NO: 1438 - DNA, 2598 bp, Escherichia coli; identical to SEQ ID NO: 1415

SEQ ID NO: 1439 - DNA, 2604 bp, Salmonella enterica; identical to SEQ ID NO: 1180

SEQ ID NO: 1440 - DNA, 2658 bp, Vibrio cholerae; identical to SEQ ID NO: 1291

SEQ ID NO: 1441 - DNA, 2643 bp, gamma proteobacterium
atgaatctgaaccagcttcgagagggccttgatcaggccttctacaaagagaaccatcgcctggtgttctggtatgacccggagcaatcttttttggatgagctgccgtcgttgtttgaaggtaaagagtctctcgtggacgtgcagatcctcaacatggccaatgaatcagcattgggtaccaagctcaaattagagctggaagacaaggctggtaagtacctcctgtacttcccatttgccgagccagatgtagaaaaagactggttgctcgacatcaagttgtactccagatgcttctacgccgaccgcttctcaatcatcttcaatgagctggggctacaccagcaaagcctgagagagcacctggccaagcgagataaattccttgccagcaaagcaaggctaacggctctacaacgctatgttcaacctgactttgatgagtctgatctggacatggccatgatcgcttctgtcgtgaaggcggaaagctgtgaccttcctcatgtgatcctggcgcttgcggaagagacggtagcggatgaccttggcctggaggccaatccagcttccctcaacgaacttgaaaagtacgacctgatcccagcattggtagctgcgcttcagtccgaaattggctacccggctacggtagaggagttaaagggtgaagcgccattcaagctggggcatttctttatcaggttgctggtgaccggcttctgcgagagtgtcggtgatgttcatggctgggcgcaagaattggtcatgtcttcggccagctcccgtgcgacggccagagcactactttcacgctggcgagacagctcacggtattacaaggcattcgatgctgtgtccgggtgggttgcagccgcgctacgcattaaagacaagatggggatattcgacaccgaccagctcagcgatgtggtcacctttgaggccgtggagcagaagattattgtcgatctggctgtatccattcctcatgctcctaagggggagttggaacgtttccgcacaatgatagcgtcgcgcctggacggctactgggcttccaagcataaagatgacacgacgcgtcggaagtaccgcaccgtttataccgcattgcaggctgctatcgacctcttcagcttgcggattcagcatgaaagcggattccactttgaaacgagtgaggcgctatacaaggcttacgagaaagacctgtaccgtttcgatatggcctaccgtcactactgtgaagcgtccctgcgtgcgcatgttgagatcctgaagaagctcgatgacgaagtggagaactgttacgcctactggtacatcgacaacctggcgaagaattggggggatcgcatagaagcggagcaacgtctcagccagtggcgtttcgctgacgtacccaagcagcagaatttctttgaagatcaggtgatgccccttttctcaaagggaaccaaacgacgggtcgtggtcatcatcagcgacgccttccgctacgaggcagcagttgaactgcgggatcgcatcaacgataagcgctactctgaagccacgctatcttcgcaacttggtgtagtgcctagctatacaaccttaggcatggcctcgctattgcctcacaagtcgcttgcctaccgtgagtcggtttcagacgatgtttttgtggatgacctgtcaaccaagggaacggcagccagatccaaagttctcgccgcacatggcgggatggcggtaacggcagaaaccgttaagggatggtcgcgggatgaagggcgagaggcgcttcgggaccaggagttaatctatgtctaccacaatataatcgatgaccgtagtgacaaaggtggcccgtcagaagtcgatacgtttaagcacgttgaagatgccattgaggacctgaccgagcttagccgcaagatcctgatgcactttaacacctccaggatcttgattacggccgatcacggctttctgttccagcaaagcaagctggaggctgccgatcgcacgtcgccggcagagaagcctgccaatgtgctgaagaacaaaaagcgctatgtggtgggctttggtttgccggacaccaaagaagcctggaaggggtctacccagaataccgccggaacaacctctgagaccgacttttgggtaccgaagggagccaaccggttccatttcgttgggggttcgcgctttgttcacggcggcattatgccccaagagatcgtcgtgccggtgctgaccatcaagcaacttcgtggcgaaaaggcagagaagcggacaaaacgcaaagtaggcgttatctccacaaagtcgaacctgaagatggtgaataacattcagaggttcgacctgatgcagaccgaagccgtcagcgacttcgttattcccgtcacggtgtccgtcgccatctatgacggcgatagcaagatctccagtgaagagttggcaacgttcgatagcgccacggattcagtcgccgagcgagtgaagcaagttcgcctttctttgtcgggaacagactttgatcgcaagaaggactacttcctggtgctcagggacaaagatctgaatacagaaatagagcgctacaaggtcaccatcgacctggcatttactgacgacttcttttaa

SEQ ID NO: 1442 - DNA, 2523 bp, Pseudomonas psychrotolerans
atgagtatccagacgttcattcaacaggaaatctttgctccgcgactcgctaaacgtggtgtattggtcatttacgacccagagcggcgctaccgggaaacctgccttgggctggccgatgagcgttgcgagatagttgatgcttccgagagcagcatcctgagtcgtgaacaggcgatcatgtcgttgctttcactgggcaaggggcaggccgactggttgttggtatatgttccagcggcgcagccgctgactgaggaggccaagcaggctgatccttttgcagccgttggcgtgtgtggcgaggttttccctggtggcgacagtgacagcttctttagcctctgccttaaagccaagcctgatcagaccatggccatccggcaaatttttgagtcagatcctaacccgagcttcgctgtgatagacgccgtcggtggcggccttggctggccgaacctgcgtgcccttctcaaggtagagtcgagtcgcgacatcctctttgcgctgctagcgccaaacacccagcaagaggctgccttaaagggaagtgatgcttgggtgagcgaagcgcgtgacctgctgaagaactcaattgggctgtctctcaagacgaagggtaaggcctggtcttctattgccacggagttgtggcgcttcgttttgtttagcgagtttgtctttgatctacctgaccaattgccggctgcgttggtcgacattccgcgtgcagacaccattgccagggccgtgattgaggggctgtgtgacgacctgcgcaatgatcgccgcactcagggcctgtatatcgatagagccgaggaaattgaggaagagctgggccttatagggcactgtgctcagctagctgacttggggcggcgggatacattccccttcgaggagcgcacctttcttaatcgtgcaatctccgcaatcctggctgacgacacagatcaagtgcgtagggttctagagcagcaacagcgttctgtgtggacggggaagggcgagagtcgtgggcaatgggatctccttcgttcagcgctcgacttgatccagagctgtgatgacttggatcgtcaattaggggatcacactcgtagtctggaaaccctgctggagttttacgtgagttcactgcgcgaggtggatcgcctgcaccgtgagttcgagcaggccgtcagcgacttcgagtggcaggacacagatggtgtgatgacctcagtgaagcatcaggctcgcaagcagtacggcaaattagccgagaaggtacaactggtcttcacccgtcatttgcaaaatagcggatggccgctcccgggctatctagccaacgcagatgtttttgatcgcctggttgcccccagactgcaacagaatggccgcaggatcgcttacctgatgattgatgcccttcgctatgaactgggcgtcgccttggagcgtcaactcgcggaggatgggattgtcgagctgaaaactgctttggctcaactgcccagtgtcacgccggttggtatggccagcctgttgccgggtgccggtcagcaactgttcttacgcaatgccgatcagagcatcgtgccgatgctgggcgatcaggtggtcaatactgtggcgcagcgcatggaggtgatcaggaaacgctacggtcagcgattcgctgaaggcaggctcgaagactttgttcgggatcgcgttgattttgatgcggacatcgatctgttggtgctgcgcgctgtggagatcgatagccacttcgagaatcatcctgatactgcacccgctgaaatcactaacgcgttgcggcgtattcgggtggcgatccacaagctcacccagcgtggtttccatgagatcgtgatcgcgactgaccacggctttttcatgaacaatcatgctggcgccggagatgtgagttccaagccatctggggattggttagtcgttcatgatcggtgcgcactgggggacggtagtgccgattctaatcacctgattgccagcgctgaaaagttgggaatacggggcgacttcgccaagtttgcggggccgcagacgctagcggcctatcgcaatggcctgctgtactaccatggtggcgcatcactgcaagagtgcgtggtgccagtcatcaccatgcagttgaaagcccaggagcagcccagtctgaataaggctgccatcaacatttcctacaagaacggtgcaaagcgcgttactacgcgtgttccggtgatcgatgtggtcgttgatgctgccgatatcttctcaacggagagtgacttcgagattctgctagaagcgcacaacagcaagggcgaggttgtgggtgaggccaaggctggtggtgctgtaaacccggcaacgggtacgctgaccctccaggccggtcagaaggtgcaggtcactctgaaaatgcagatggagttcgagggcaaattcaaggtgaaggcactgaaccctaagactaatgccatctacagccaaattgagctggaaacggactacgcggtgtaa

SEQ ID NO: 1443 - DNA, 2562 bp, Acetivibrio cellulolyticus
gtgaatattgaagaaattgttaagtctctccaaaatgtatttaaggaaccgttgaaagatggacaagttcgtaaaatagtattttggctggacagagataaaaaatttataaatacaatagatgaaatagaactcgaaggtgtaaaaaaacataagcttgaaaacaacaactatttttatataaagtatcttcttgaagaggaagatacttattctgattttttgatttataccaatgaagacctcaaggaggatatcgacaactggcttattgattgcttgttgtattcaaagagattttttgctgataatatttcattaattatgagggatatgggtattgatccttctcttagggctgttgtaaaagaaaatgagaaattttttgataataaagaaagatataagaagtttaaatcctttgctattgagaattataatgaggaagttattgaaatagccatcattagtgctttatgcggtttgaaatcacctgattttgaggaaagcctcagagttattttaatagaaggcttaaacgatgaagaaaacaaataccttgatcgaatagatagcttttttagccttaacagattttggggctatgtagagaaaaattatgggtataaacttgaagaaaaaacacttgaaaagttaatgatgcaccttatgattacagcactcagccataccttggacgagaatgatctggaaaatgttaaggtttatattggaaaggcttccagatccaattgcctgatttttatagataggtggatgaaccatgttaaggattctgctgcctttgatgaatatgccttgatgattgaaaaggaaattggaattgaattcatctgtagtaaggtagagataacagatatattggaaactaatgtgttcccttatgtagatagagcaataattgtatacataaccaacgcaattgaacataaattagaggattatgagctttatataaagctgatagatgcaagaaaaagcaagcatttttatagcaagtatgaagcgatttatgaagcgttatattttactgtcaagatgtttgaattcaagaagttatataatatgggtattcctatgacaggagcggaagaaatctataaagcttactgcaatgaatactacaaaatggatttgtattatcgcaagttttatgttgcctatgattcagacaatgacagtgaaataatcaagaaattaaaagatcttgttgaaaatatttacactaactggtttgtcagtgagcttagctatgcatggtcaaagtctatagatgatatggactttgaggaggttcaaatacaatcagtaaaaagacagagaagcttttatgatcaggttatcaggcataaagtaaattctggggatagagtatttgtaattgtatccgacgccctaagatatgaagtggctactgaaattcttgacaggctgaataccgaaacgatgggaagtgcggaaatcacttcaatgactggagtattaccttctatttctaagtttggtatgccagcattactgccaagcaccagtatagaacttaaagatagcggccttgtatatgtcgatggcattaattcgagctctttggaaggaagaaataaaatattaaacgaatatgtaagtgatagtgttgcacttgatgctaaagagctttttgcgatgaataagccaaaaaggcgtgatttcttcaaagggaaaaaacttatatatatataccacaacagcattgatgcatttggggataagtatcctacagagatttatgcctttaagggtacggaagaagctattaatgatatttgtgatttaatcagaattatcagggatgacttaagtggaaccaatatatatgttacagctgatcatggcttcatatatcagagagatgcattagaggaaagtgataaaattgaaaaggaaaagcttgattttattgaaagtggaaggagatatgcactttccacgaaaaagcgaagtatagatggactgcttggcttttcgatgaagcctttgcttggaaatgattcaaatatatctgtatatataccgaaggcaaatataagatttaaaatccaagggccaggattaaactttgtacatggaggagcaagccttcaggaaattgtattaccgcttataagctataaaaatatacggcgaggacaagttggcagtaaagatattgaaaaggtagaagtaaagcttaccaatgcaataaggaaaataacaaatagcatctttacactcaatttctttcagtctgaaaaggtggaaggaaagagggttgaagcaagttataaagtttatatggtggatgaagccgaccaaatgattagtaatgaagaaataattattgcaaataaaaagactgacactcctgaaagccgtaatataagtgtcaaatttgtattgaaatctatggattatgataaaaataaagattactatttgataataaatgatgtagacactggaataacaaaagaaaaaataccttttaaaataagtcttggaatcgtaagcgattttgatttctag

SEQ ID NO: 1444 - DNA, 2511 bp, Fusobacterium sp.
atggaaaaagaaaaaatcaaggaaatgttggaagaacgctttcaagtaattcctgtataccctagaaaacgacatattcttttttggtatgatgagcagaaagcatttcaagatattatagaagaattacagcttgataaagtaaaaatccttcgtttgcaaaaaggagtcaatcgaaatggagaagaaattgataccaatctttttaaaataaaatatactttggagattttggatacggattctcattatttaatttatagtgctaatccaagaccttgtaagcatgaaaattatctcttagacatagaaagctattctgatttttttgaagcggataagtcctccatgttagtggatgattttggatttgatagaaaaaattctgaaattcataatacgattcaagaatattctgatttttttgcaagtaaggagagaagagaaaaattaaaaaaattattggaaaatcctttccatacaagcgaacaagaattgaagctttctatacttgctgtgattgtaggagctaaaacagcagattttcaggaaattttaaaaaatattatatttgattcagggaaattggaacaaattaagaagtggatgggactttcttttttatatgaacaaattttaaggaaatttcatctttccatagaaagttgggaagaatttttaaaaactttagtggtagttcatttttatcgagaaatacaacaaaaaccttctattcatttggaatcctactatcttggaaaaaccaatgaactttttatttttacttcttctttatttcaaaatcagaatgattcggaacgtattcaagaaattttttatgaagtaggaaaagaattgaatatgaaaggcagaattgaagaattggaatttgaaaaaatgttactgggaaattcttttgaatattttgagaaaagaattttacaggaattagtggaacgattacaacttggagtcgtggattactcccaatatatatcatggattcaagctcgttctcattgcagtttgtggaaagaaaaatatttttacttttatgaaactcttcttgctatagcatgtttattggaagaaaaagagcagttagaaattaaaaatcgaaaaacactttctgaaattttggaagattacacagctcattattataaaattgatcaagcatacagaaatttttactattcctatgatcagattaaaagctcggaacttgcttctatgtttgattcttttcatagtaaaatttctcatttttatgaagtggaatatttggaaattttgttggctctttggaatgaacatttggaagaaagaaattctttagtacaacagaaagatttttatgagaaatatattagaagatccgatactcgtgttgctgttatcatttctgatgctcttcgatatgaagttggagaggaaattacaagacaattggaaaaagaaggaaatgccaaagaaatcaaaatttttcctttattaaccaacttgccaagtattacctctgtcggaatgacacagttattgcctcctggaaaggaacgaaatatagatctttttcataataagatgacagtgaatggaatttctacattttctacagaaaatcgtgaaaaaattctgaaagaaagttgcttggaatcttctgctatttcttatgatatctttaaaaataagaatcgaagtgaacaagaagcttatgttaaaggaaaaaaagtattatacttctaccacgatagtattgatgctataggggacaaagcgaaaacagagcatagaacttttgatgcttgtaaaatggcaattcaagatattctttctttgactaaaatattatccagtcttggagttgtcaatatttttattaccagcgatcatgggtttttatacgaaagaaaagaaattgaagagtataataaattagagttgcaagaagaatattttcttttaggaaaacgctatgctttttctacgaagaaagtgaaagagaaaggctgtattaccatttctgttggagatttttttggaattttcccagaaaaaaaccaaagaattaaagtaggtggaagtggtttacaatttgtacatggaggaagtagccctcaggaaatgattattccatgtattcactatcgtggaggaacgaatgtgaagaaagcaaaaaaagtaggagtttgtatcaaggaaacgggagaaaagattacttcccatttcataaaatttgcagtataccagctggagcctgtcaattcacaagaaaaattgatagaaagaaccattgtggcagctttgtatgacggtaatgtccgtgttagtaatgagtttaaaattctactatgtgcagaaactgaaaatacagaataccctttttctttgactttaagtggagaacatgagaaggtaatattacgaattatcgacgtagagtcaaaagatattttagaacaaaaagaatatcaagtcaaaattggaattgcatctgaatttgacttttaa

SEQ ID NO: 1445 - DNA, 2523 bp, Enterococcus faecium; identical to SEQ ID NO: 1373

SEQ ID NO: 1446 - DNA, 2304 bp, Vibrio cholerae; identical to SEQ ID NO: 1292

SEQ ID NO: 1447 - DNA, 2598 bp, Salmonella enterica; identical to SEQ ID NO: 1426

SEQ ID NO: 1448 - DNA, 2304 bp, Vibrio cholerae; identical to SEQ ID NO: 1292

SEQ ID NO: 1449 - DNA, 2514 bp, Fusobacterium nucleatum
atggaaatagataaaattaaagaaatgcttgaatatagatttagtttaactactgaacttccacaaaaaagacatataattttttggtatgattcaaaaaaagaatttaaagatttaattgatgagttaaatttaactgatgtaaaaataattaaattaaccaagtctgttgataaaaaaggagaagctatctatacaaatatatttaaaacaaaatatactttggaagttattgatactgagtctaattatttaatttatagcgaatatcctagagctattgacagtgaaaattatcttttagatatagaaaaatactcagaattttttgaagcagataaatcagcaatgatagttgaagaattaaaattagataggacaaattacagatttggagaaattataagggaatattcaagtttttttgctaataaagaaagaagagaaaaattaataaaattaattgaaaatccagaatctttagatgaagaaaaatttaaactttcaatattgaccactatttctggtgcaaaaacagttgatatcttagaaatattgaaaaatataattttaaatagaaataaactagaagatattgaaaaatggatgaatttagaatttttattttctgagataaaaaagaaatttgatatagagataactagttttgagcaatttttaaaaattcttatggtaactcatttttactttgaattaggaaaaaaacctcatacaaatttagaaaattattttaaaggtagaaaaaatgaattatatatctttactgattcattgttacaaaataaacaaagttctgaaattataagggcagaattttacgaactggccaaagatttgaatataaaagatagaatagatgaattagagttagattattctataaaaggaacagcttttgaatattttgataaggttatcataaaagatattatagaggtttttaattcagaaattattgattatgataaatataaaaaatatatagagataagattggataattctttatggagagaggaatatcagcacttttataatgtattgttagctgttaatgatttttttagaataaaagattctttaataattgaggatagagaagaattaagagaaatttttaaagattatactaaaaattatttcttaatagataagttgtatagagatttttattattcctatgataaaataaaaaatagtgaattagcacctctttttgacactttaaaatctaaaatagataaattttatgagattgattatcttgaaaaattattggcactatggtcaagtaaggtatatgaaagagaaaaattatctcagcaaaaagatttttataaaaataatatagtgaaaactgatgttaggacagttgttataatttcagatgctttaagatatgaagttggatatgagattagtcaaaaattaagaaaagaggctaatattaaagaaataaaaatagaagctatgctaacagatttaccaagtagaacttttttaggaatggcgaatttattaccttgtaaaaaggaaagagatattgatttagtttctgctaaggtactcattgacggtattgatagtcaaggaacagaaaatagagaaaaaatattaaaaactagttgtgaagaatcttctgctatttcttttgataatttttataaaatgaatagggctaaacaggaagaatttataaaaggaaaaaaagttatatatatttatcatgatagcattgatgcaataggagataagggaaagactgaaaataacacttttaatgcctgtaaagatgctgttgaaaatattgtaagtctttctaaattactttcaagccttggagttgtaaatatttatataacaagtgaccatggttttctatatgaaaagaaagaggttgaagaatataataaacttgaattaaaaaatacaaaatataaatctattggaaaaagatatgctatatatgaaaaagaagttgaagaaaaaggctgtgtaacattaaaattagattctttatatggagtatttccagaaaaaaatcaaagaataaaggctagtggaagtggtttacaatttgtacatggaggagctagtccacaagaaatgataataccattaataaattataagagtggggctaattctaaaaaaatatctaaggttcaggttagaataagagaaagtgttgctaaaattacgtcaaatctaactaaattttctatatatcaaatagaagctgtaagtataaaagataagtttatagaaagagatgtttcagtagctttatatgatggagatgttagagttagtgatgaaaagaaattaaaattaaattcaatagaagaaaatactatacatgattttagattgactttaagtggtgaacataaaaaagttacattaaaagtaatagatattgaatcaggggatatattagattcaaaggaatatgatgtgagtattggaattgcttcagattttgatttttag

SEQ ID NO: 1450 - DNA, 2514 bp, Fusobacterium sp.
atggaaatagataaaattaaagaaatgcttgaatatagatttagtttaactactgaacttccacaaaaaagacatataattttttggtatgattcaaaaaaagaatttaaagatttaattgatgagttaaatttaactgatgtaaaaattatcaaactaactaaatctgttgataaaaaaggagaagctatctatacaaatatatttaaaacaaaatatactttggaagttattgatactaagtctaattatttaatttatagcgaatatcctagagctattgacagtgaaaattatcttttagatatagaaaaatactcagaattttttgaagcagataaatcagcaatgatagttgaagaattaaaattagataggacaaattacagatttggagaaattataagggaatattcaagtttttttgctaataaagaaagaagagaaaaattaataaaattaattgaaaatccagaatctttagatgatgaagaatttaaactttcaatattgagcactatttctggtgcaaaaacagttgatatcttagaaatattaaaaaatataattttaaatagaaataaactacaagatattgaaaaatggatgaatttagaatttttattttctgagataaaaaagaaatttgacattgaagtaactagttttgagcagtttttaaaaattcttatggtaactcatttttactgtgaattacaaaagaaagttcatacaaatttagaaaattattttaaaggcagaaaaaatgaattatatatctttactgattcattgttgcaaaataaacaaagttctgaaattataagagctgaattttatgaactagccaaagatttgaatataaaagatagaatagatgaattagagttagattactctataaaaggaacagcttttgaatattttgataagattattataaaggacatagtagagatttttaattcagaaattattgattatgataaatataagaaatatatagagataagattggataattctttgtggaaagaggaatatcagcacttttataatgcattattagctgttaatgatttttttagaataaaagattctttaataattgaggatagagaagaattaagagaaatttttaaagattacactaaaaattattttttaatagataagttgtatagagatttttattattcctatgataaaataaaaaatagtgaattagcacctctttttgacactttaaaatctaaaatagataaattttatgagattgattatcttgaaaaattattagcactatggtcaagtaaagtatatgaaagagaaaaattacctcagcaaagagatttttataaaaataatatagtgaaagctgatgttaggacagttgttataatttcagatgctttaagatatgaagttggatatgagattagtcaaaaattaagaaaagaggctaatgttaaagaaataaaaatagaggctatgttgactgatttgccaagtagaactttcttaggaatggcgaatttattaccttgtaaaaaggaaagagatattgatttagtttctgctaaggtactcattgacggtattgatagtcaaggaacagaaaatagagaaaaaatattaaaggctagttgtgaagaatcttctgctatttcttttgataacttttataaaatgaatagggttaaacaggaagaatttataaaaggaaaaaaagttatatacatttatcatgacagtattgatgcaataggagataagggaaagactgaaaataatacttttaatgcttgtaaagatgctgttgaaaatattgtaagtctttctaaattactttcaagccttggagttgtaaatatttatataacaagtgaccatggttttctatatgaaaagaaagaggttgaagaatataataaacttgaattaaaaaatacaaaatataaatctattggaaaaagatatgctatatatgaaaaagaagttgaagaaaaaggctgtgtaacattaaaattagattctttatatggagtatttccagaaaaaaatcaaagaataaaggctagtggaagtggtttacaatttgtacatggaggagctagtccacaagaaatgataataccattgataaactataagagtggggctaattctaaaaaaatatctaaggttcaggttagaataagagaaagtgttgctaaaattacatcaaatctaactaaattttctatatatcaaatagaagctgtaagtataaaagataagtttatagaaagagatgtttcagtggctttatatgatggagatgttagagttagtgatgaaaagaaattaaaattaaattcaatagaagaaaatactatacatgattttagattgactttaagtggtgaacataaaagagttacattaaaagtaatagatattgaatcaggagatatattagattcaaaagaatatgatgtgagaattggaattgcttcagattttgatttttag

SEQ ID NO: 1451 - DNA, 2625 bp, Acinetobacter lwoffii
atgaacttaagtcaactacagcaaggcctggaacaagccttttatattgaacagcatcgaatagtcttttggtacgatgcggaacagtcctttagcgaagaagtaaaggcgttaaaactgaaggatgtccagattctgaatatggcagaagaatccagccttgcgattaagcttaaactggaacttgaggatcagcagggtaaatacttgctgtattttccaagtcctgagcctgaaactgaaaaagactggttactggacatcaagctgtattcacgcagcttctatgccgatcgtttctcgattatttttaatgagctgggtttacagcagcagagtctaagagaacatctggccaaacgtgaagaattccttaaagccaaagcccgtctgagtacattgaaacgctatatccagcctgatgcagatgcacaggatctggatatggcgatgattgcggccgtggtcaaggctgacagtgccgagctgatgcatattgttctggcgctggcagatgaaatggtacagcagaatctggctctggaagtcaatccggaatcctttgctgaactggaaaaattccaactggtgccggctttggtcacggcattacaggcggaaataggttatccagcatcggttgaagagttgaatggggaagcaccattcaagctcggtacgttctttatccggttgatgagcacaggtttctgtgaaagcctgggcgatataccgctatgggctcaagaactggtgatgtcatctgtcagctcccgtgcaacagccagagcctttttgtcacgctggagagacagctccaaatactacccaaccttcgatacactctcccagaccgtggccaatgcactgcggatccaagaaaaggtcggggcttttgatctggagcagctgctcgatgtcatgacctttgaagtgattgaacaaaagatcattgttgatttggccagtcatatccctgcagcagccaaagctgaactggaacatttcagaacgattatttctacccgtctggatggctattgggcttccaaacataaggacgatgcaacccgccgtaaataccgtaccgtctatacagcgttgcaggcagcgattgagctgttcagcctgcgactgctgtttgatgccggtttctatttcgactctagcgaagccttgtataaagcctacgagcaagagttgtatcgctttgatatggcctatcgccactacagtgctgcttctcaacgcgctcatgtcgatatcctgaaaaaacttgatgaagaagtggaaaattgctattcctactggtttattgaccacttggcacgtaactggggagagcgggttgaagctgagcaacgcttgaatgtttggaaagtggcagatatcccaaatcagcagaacttctacgatacccacgtcagacccttactcaattctgcaacgaaacgccgtattgtggtaattatcagtgatgctttccgttatgaagctgcggtagagctgcgtgatcgtatcaatgaaaagcgttattctgaagcgaccttgtcttcacagctgggcgttgtcccaagttacaccacactgggcatggcctcgttattgccgcatcagactttggagtacaaagaggccgcaggggatgatgttttagtagatgggcagtccagcaaagggactgcagcacgatcaaaaattctggcagcctataacggattggcggttaccgctgaaacggtaaaaggctggtcgcgtgatgaaggccgtgaagcgctcaaagaccatgagctgatttacgtttatcacaacgtgattgatgcacgaggagatagtgcctcgacagaatcagaaacctttatggctgtggaacatgccattgaagagttgactgaactcagccgcaaaattttaatgcacttcaatatttccaccctgttgattacagccgaccatggctttctgttccagcaaagtaaactggaagccgcggatcgttcaagcttgactgaaaaaccagccaatacattgaagagcaaaaaacgctatgtgattgggcatggtttaccagagagcaaggaagcctggaaaggctcaacccaagctacggcaggcacattatctgcgactgatttctggattccaaaaggggcgaaccgtttccattttgtaggaggctcacgtttcgtgcatggcggcatcatgcctcaggaaatcgtagtgcctgtactaacggtaaaacagctacgtggtgaaaaggctggacagcgcaccaagcgtaaagttgaggtcatttctaccaaatccacgctgaagatggtcaataacatccagaagtttgatttgatgcaaactgaagctgtcagtgagctggtcatgccagtgactttatccattgccatttatgatggggatcttaaagtttccagtgaagaaactttgacttttgatagcagtaccgactctgttgccgatcgggtcaagcaggtcaggctgtcattgtctggcactgattttgaccgtaagaaagattacttcctggtactgaaggacaaagacctgaatatcgagatgcaacgctataaggtcaccattgatttggcatttaccgatgacttcttctaa

SEQ ID NO: 1452 - DNA, 2499 bp, Lactobacillus casei
atggcagaggtagaattgaaggatgtcgtcactggcattgagaagctgttcaaaggtcacacgcactttgtcttttggtatgacaaggaaggcgagtttgctgacaatattgacgaactaggtcatcagttgactgaaccgattgtaatcatgcagccacgaacccagctgaagacgaaaatcgaacttttggacattgaaaaggccgggggaaaggcgcttgtttatgctgcgttcagtgagccagacattcatcagaatcttttgaccgacatgattctttattctaaaaagtttacagccgatatgaatgtcatgttgcttcacgaacttggattgcctgagactgaattgacctttgtccaaggccagcgaaaattctttgccgctaagacgcgtattgccaagtttaagcagcgttatcaacgcggaaaaaatccagaacaagttgagcttgcggcaattgctaagacgaatgacttacaactatcaaacatattgatcgaagttatcaaggcaccaacacttttagatgaatttgccaaatatcaggttttagagacattttggagttttgttgatcgagcatatggctatcatggtaaacatgatttacaagagctgctggcaaccatgatggtgaattttgcgtattatcagatggagttggatttgccggtaatgcttcgccattatgaagtcagttacattaataatgttgtgtctttcatgttgaattggcggaatcgcaacgatactcgcgaagtatataaacaagcagctgctaaagtctggcgtcaacttgacggaacgcaaatcttcaagaacttgaagatagctgatttattgaaggcagacacgtttattgagttcgatcggcacgctgtgaagtggctgatttctgaattgttggcagggcatctgggagaggttattaaccacatgactttgccagcgattgctgaaaaacgtgggaaaatgtacttttctccggagtatcagctcgcttataatatgactgttgatgcccataacgttttgttgcctcgggaaaaccgaaatgttgatcagtttgacgacctaatccaggcctatatcaccgaggactatttagttgacacggcttatcgtcgatatatcaatgctctggatcagcttccagccacacaggtcgacttgtttgacaatttgtcccgaaatgttgaatcggcgtacaacaatgagcatcttgttccgatgatctctgattggtgccaagattatgtgccaaatatgatcgaaccgcaaagacgtgagcggaatttttactcctccacggtggggccaaataaggatcgtacagtagtgattatttcggatgcctttcggtttgaggcggctaaggaattgcagcaaagactggacaaacgggatgtttttggcacagaaatgcaatatgcagtcacgggattgccgtctgtcacttattttggtatgccatcgcttttgccgaatcatgaactcgcgtatcaaggcaacaaggaattattggtggatggtcaaaaggcgatcaatcttgagcaacgcatgcatatcctacaaacgattgagccgcaaagccaagccatgcggttgacggatttcttatcactttcgtcaacagagcagaaaaaatacgtcgtcgatcaaaaagtgatttatttttatcacaacaccgttgatgcgactggcgataagccagcttcggaagtcaatgtatttcgtgccgtagaggatgcgatagctgagttagagcggggcgttgatcgtttgcggactatttcaattcgaaatatttatgtgacagctgaccatggctttatctatcgccggcatctactggattcaacagataagattaatctaccgagtgatgtcgactttgagcaaaagaatctccgttacgcaattggatcaactgattttgatgaaattggggtagataacgtcaagctgggcgatatcttgggcaacgatgatcagcggttcgtcttttatccaagtaatgcgaacgtgttctcggtacctggagccggtcaaaattatgttcatggcgggtgttctcctcaagaaatgattattccggttttgcatgtcaccacagagagtcgcaagtcacaggccacgtatgctacattggcagtgacagattctagccggcgaattacgagccatgaggttattgtcaatatggttcaaaacgatccggtggatgaaactcatcgtgcagcaacttacgcgctttattttgttgatgggaatggccgacaaatttctggcgaacagcttgttcacgcggatattacctcaatcaatgtcaatgaccgattgattcgtcgacacataccgttgattgatcaggactttgaacgtgggggtcaatatcagttagtcatcaaaaacgttgaggctaatacgagcaccctgattgattatcaaatggatctcactgtggggggaggttttgactttgacatctga

SEQ ID NO: 1453 - DNA, 2598 bp, Escherichia coli; identical to SEQ ID NO: 1422

SEQ ID NO: 1454 - DNA, 2625 bp, Acinetobacter sp.; identical to SEQ ID NO: 1185

SEQ ID NO: 1455 - DNA, 2304 bp, Vibrio cholerae; identical to SEQ ID NO: 1292

SEQ ID NO: 1456 - DNA, 2604 bp, Holdemania filiformis
atggctttattggattcagagcaggtatcgcaagacctgaaccgtcggtttgcggcacccttgccggaattttactaccgccggattattttctggaaggacgatgaccgggagtttgaggataagttgccggaaatcacgctggaaaatgccacgctggtggcactgaacgggacaaacaattttgctgtgaaaaagctgctgacggtggacgataccacaggcaactaccttgtgtactgcccggagccgcttgccgatgaggagaactggttgcttccccttgagctgtacagcgaggaataccgtgccgaccttgtttctatgtggatggatgaaatgggcatggacaacacggcttctttgcgtaagcaggtcaaggcataccgtggctttttcaagatcaaaggacaccgcaccaaggttgccaatctgaaaaagcaggtgacgacacctgtccagttgcatctcgcagtgatggcggtgctgtgcggcttgaaggactttcagccaaacggtatcctccgggcagtgcttacagccggaatgaatcaggataccaacggcatctaccagaagttcgtggatgcaggtgccaaggatgcgttttgggcgatggcagcacaggtttccggctatcgggaggaagaatgcgacatcagcaggctggcaacccatatcctgttgaccgcagccaccagaaccatgcgcccagaccatttggcagggctggatggctttatctccagtccgcatcaggcatattgctatgactttgtttctgagtggatgcatagcgatgataatgggcatctgttcgagctggcacggtatgtggaagaagaactgcgtctgccatatcgctttagcaaacttccggtggaggaactggcagagacagaactgttcccatgcatcaatgaatgtattcttatcaacctgatgacggaaatcagcaaccagataatcaacgtggataccatcatagcaatggtggaaaagcgtcgtacctgtgcttggtttgaattggtgaaggattattacgagggcattttgcaggtggcaaatatgcaggcgttctttcttgaccactctgcagggttccacactgtggaggcacgaggcgtctggaaagaatataccgaagattattataagatggacacctattatcgtcagttccattgcagctttgcccggagcttaaagacctccaatcctctgttggacgacctgtttaagcacgtcgccgataaggtggaagggctttatgacaactggtacttagggcagctgggcagcaactggacgatggcggcagcagacgagctggctcagtatggtcgcattctggaagtgccgcagcaggtggatttttataaagataaaatcaaaaatgcagacacccgtatgtttgtcatcatctcggacgctttacgctacgaggtggcggcaacccttgccgagcagctgcgccgggagacgcaggcaaaggtggatttgaacagctgcagtgctatcttcccaacagtcacgaagtatggcatggcggcattgttgccccacaaggatttgaccgtggaagagaagacaaacggtctggcggtttatgcggacggcaccagcaccgatgccggataccgagacgccattttgaagaaagccaatcctgccagcattgctgtgaagtataaggacatcgtgttgatgaagcggcaggaacgcagtgagctgattaagggtaacgaggtcgtttatatctaccatgataaaatcgacgagaccagccatacagatgaagctctggtgttcccgtcctgcgaggatgccattgacgaaatcaagaatatggtgcgcatcatcgtgaacgacttcggtggcgtaaatattatcatcactgctgaccacgggttcctgtatacctatagccctctttccgaggacagcaaggtggataaaaccacggtgggagaagaagatgtggaagtggacagacgctaccttgtcacccgaaaaggtgcaaaaccgcagtatctgctgccagtgaagttcgtggcggatgatgccgggtatgatgccttttccccacgggagagcattcgcatcaagaaaaagggtggtggcttgaacttcgtgcatggtggcatcagcctgcaggagatagtcgtgccaatggtggagtaccattacctgcgtaaccagacgaaggagtaccagcgtaacaagaagaaatacgatacaaagcctgtgtcactgaatctgctttctgccaaccggaaaatcgggaatttgattttcttcctgaacttctatcaaaaagaagcggtgggcgataaccgtgaagcagcaacctatctgctgtatttcgtggattcggaaggaaaccaaatcagcgatacgcagaagattattgcagacaaacagacggaaaacaatcaggagcgcacgttccgctgcagctttaatttgaaatctctgaaattcagcaacaaggagacttactatctggtcatcgctgatgaatcgggattgcagttgctgcagcgtgaggagtttaccatcgatatcgcctttgcggtggatgagtttgacttcttcagctaa

SEQ ID NO: 1457 - DNA, 2523 bp, Enterococcus faecium
atgacagatataaatacgcaacaaattgaagaaaaattaaatcaacgttttcctaattatggacgtaggaaaatcattttttggtttgattcaaatcaggattttcttgaagaaattgactcattggtcattcaaaatgcaaaaatctatcgattagaaaaggacgcacaatttaaaaccaagcgtttattagaatatgaagatcccgaaactaactatttaatctatgcgccatttcctcgttgggatgataaagatgaagataatcatttgttgagtgtattgaactattcagaggaatttagtgcagaccgcttagcgattatcatgaatgaattggctattccacttagatttcatcagacagttaaacagtatcgtaatttctttaatgcaaaggatcgcatgagaagttttggtgaatttagtacgcatatgacaattaataaatcggaaacgattgaattaatgataatggctgttttgttgaaatcgaaaagtattcgattaaatgacttactgcgtgtagttctaaaaagctttacagaaagtagggagaatcctttaaaggaacttgataagtatcagttaacagctaaattttgggaatttattcaaataaaatttggctttacggatagccagcctacattggaaaagctgacgatgtgtctttatttgaactatttttattatcaaattgatcaagagatgccgaagaagttcaaaggatttgaaatactccatctgaaagcaaacattattactttcatggatcagtttatgaatgatacacgttacgtggaaagctttgaacagctatctaaaaaagtatatcagactattgatggtgatggattattagacagtatagaaattgatgatctaattgaagcagacgtattttctgagattcatgcaaaaatattaatgttttatgcagaacgattaaaggcttctgacactacaacgaaaattgcaggacaaacaatttttgatagtttaaagcagcgcgaaaaaatgcatttcgcatcggattatatttacgagtatcaattattgaaacatgcttattatcttgtggataaaaacagattatgcttgccgatgaacatggataatttgctaactcaatatgagaaggaaatgtattggattgatacgcattatcggaaatttatttggaatagtgatcatatagaagaaaagcaaaaatatgaccaattgtatcgattagttgaagcaaattattcgaagtttcttgatcaatcaggacaaatttggaatcaaacttttgaatttaagaatcgtccatccattcggaaattttataatcaagccgtaatgaaacgctctgttaaaactgtagttattatttcagatgcttttcgatatgagttagggatgaatttagaacgtaagttagttagagaaaagaagtattcaacaaatatggctagctttctttctgtattaccttcagttactgaattcggtaaagccgccttattaccaaacaatcaactaacttacaatgaaggaacagaagtactggttgatgggaaaaaaacgaatggtttatccaatcgaaatgcgattctccagcaacgagatgcaaatgctgtagctttaaattatgatgatgtggttaagatgaataaggctgaggtacgagaagtatttaatggcaaatcagtcatttatatttatcacgatcaagtggatagaacaggtgatcactcgaatgaaaatcgagtttttgatgcctgtgatttagcgataagcgaaatttcccgacttattaatcgcttgcataatgatggaagtatctatcgttttatagtcacggctgatcatggatttatttataaaagaagccacgttgaagaagtagataagattgaaaatccatctagaaatgaaaaagatcgtgtagaacgtcgttttattcttagtgaagaagaatacgaaataattggtacgaaaaattactctttgggagattctttaggaaatgatgacactagaaacatttgtgtcccggttacttcaagtatttttaagaaagctggcgggggacaaaactacgttcatggagggtcatctattcaagaaatgctagtccctgttctagaaattacggtagccaaaggtagcaatgcaaaggaaccagtagcaattgaattaatgactagcaaccgcagaattacaggattatcaaccacgttagaattctatcaaaaaaatgcaattagtgatgtttatgaccccgcatctttctggctttattttgaagatgaatatggtgaacgtatctcaaatgaagaaatctatgttgcggattcaaaagcagaagatgcaaatcagcggtttactaaatttgtttttgaatttgtaaatcgtcgatatacagttgaagatacttattatttagtgataaaaaatcaaaaaaatgatttgaccgagcgaataaaattcattatagataatccttttgcagaatcatttgattttgatatataa

SEQ ID NO: 1458 - DNA, 2514 bp, Fusobacterium sp.
atggaaatagataaaattaaagaaatgcttgaatatagatttagtttaaccactgaacttccacaaaaaaggcatataattttttggtatgattcaaaaaaagaatttaaagatttaatggatgacttaaatttaactgatgtaaaaataattaaattaactaagtctgttgataaaaaaggagaagctatctatacaaatatatttaaaacaaaatatactttggaagttattgatactgagtctaattatttaatttatagtgaatatcctagagttattgatagtgaaaattatcttttagatatagaaaaatactcagaattttttgaagcagataaatcagcaatgatagttgaagaattaaaattagatagaactaattatagatttggagaaattataagagaatattcaagtttttttgctaataaagaaagaagagaaaaactaataaaattaattgaaaatccagaatctttagatgatgaaaagtttaaactttcaatattgactgttatttctggagctaaaacagttgatatcttagaaatattaaaaaatataattttaaatagaaataaactacaagatattgaaaaatggatgaatttagaatttttattttctgagataaaaaagaaatttgatattgaggtaaccagttttgagcaatttttaaaaattcttatggtaactcatttttactttgaattaggaaaaaaacctcatacaaatttagaaaattattttaaaggcagaaaaaatgaattgtatatctttgctgattcattgttgcaaaataaacaaacttctgaaattataaggaaagaattttatgaactagccaaagatttgaatataaaagataaaatagatgaattagagctagattactctataaaaggaacagcttttgaatattttgataagattatcataaaagatattatagagatttttaattcagaaattattgattatgataaatataaaaaatatatagagataagattagataattctttatggagagaggaatatcagcacttttataatgcattgttagctgttaatgatttttttagaataaaagattctttaataattgaggatagagaagaattaagagaaatttttaaagactacactaaaaattattttttaatagataagttgtatagagatttttattattcctatgataaaataaaaaatagtgaattagcacctctttttgatactctaaaatctaaaataaataaattttatgaaattgattatcttgaaaaattattggcactatggtcaagtaaagtatatgaaagagaaaaattacctcagcaaaaagatttttataaaaataatatagtgaaagctgatgttagaacagttgttataatttcagatgctttaagatatgaagttggatatgagattagtcaaaaattaagaaaagaagctaatgttaaggaaataaaaatagaagctatgctaacagatttaccaagtagaactttcttaggaatggcgaatttattaccttgtaaaaaggaaagagatattgatttagtttctgctaaggtactcattgatggtattgatagtcaaggaacagaaaatagagaaaaaatattaaaagctagtcgtgaagaatcttctgctatttcttttgataatttttataaaatgaatagggctaaacaggaagaatttataaaaggaaaaaaagttatatacatttatcatgatagcattgatgcaataggagataagggaaagactgaaaataacacttttaatgcctgtaaagatgctgttgaaaatattgtaagtctttctaaattactttcaagccttggagttgtaaatatttatataacaagtgaccatggttttctatatgaaaagaaagaggttgaagaatataataaacttgaattaaaaaatacaaaatataaatctattggaaaaagatatgctatatatgaaaaagaagttgaagaaaaaggctgtgtaacattaaaattagattctttatatggagtatttccagaaaaaaatcaaagaataaaggctagtggaagtggtttacagtttgtacatggaggagctagtccacaagaaatgataataccattgataaattataagagtggagctaattctaaaaaaatatctaaagttcaagttagaataagagaaagtgttgctaaaattacatcaaatttaactaaattttctatatatcaaatagaagctgtaagtataaaagataagtttatagaaagagatgtttcagtagccttatatgatggagatgttagagttagtgatgaaaagaaattaaaattaaattcaatagaagaaaatactatacatgattttagattgactttaagtggtgaacataaaagagttacattaaaagtaatagatattgaatcaggggatatattagattcaaaagaatatgatgtgagtattggaattgcttcagattttgatttttag

SEQ ID NO: 1459 - DNA, 2547 bp, Clostridium butyricum
gtgaatttacaagaaataagaaattttctaaaagagttattttcaaagccattaggagatggaaaaactcgtcatattgtattttggtatgatgaaagtgaagattttattgaagatatagatacttttgatttagaaggaatcaaggtaattaaattaacagaaaacaatgccttttgggcaaagtatcatatagaaaaagaagatacaactagtaatatattagtttattctaatatgaaaaagccaattccacaggaggattggctatatgatgttttttgttatagcgaagagttctctacagatagagcaactgtaataatgagagagttaaaggttcaggattcatcattaaaagaagaatttaatatttataatactttctttaagaataaggaaagaattaataacttcaaaaatcttaatatccaatgctatacgaaagagaaggtgcatttaggagtcctttcagttttaactaaggttaagataatggatattgaagagattataaaggctatacttaaagattatttagatggaagtaataagatatacgaggatattaagaaatttggtagtgttgatgcattatggagtttacttcaaaaatattatggatataactttgaagagagaagtatagaaagattcatggcaatgttacttgtaactaatatgaatgaaacagttaagtttgaacttccaaaatcatatgcaccatttatatcaaagaaagatactaattgtattgtatttataaatcactttatgaataatgaaaaagatagtgaagcatatggaaagatgcaggacttagttgcagagaaattaaagatagcacaattattagaaaaacatgattctgaaacctttataaactgtgatgagttcgaagttatggatagattaattttatcaagaataactaatctattaaaagatggagtagaggaatatgataaatacttaaacttactatcatcacgtagaacattacattactacaaaaagtatgtaagtgaatataaggctataaaatgggctattaatcttttaaataagaagaaagaattagcatcaactattaaaacagaaaactcttataatatggttaaatcatatgctaaggactatttctatatagataaagcctacagaaaattctactatcactatgataattcagatttaaaggatgaattgaatgagttaaaggacactatagaaaatgtatataacaattggtatttacaagaactggcaattaaatggaatgatgctttattaaatcaaaatacttggagaattgatggattaaagtatcaagataaattctatagagaaaatattaagtataaaggtaaggacagagtattcgtaataatatctgatggtctaaggtatgagagtgcagaagagttaaacactttacttacaaatgagagaaaaggtaaagcacagttagattatatgcaaggggtgctaccttcgtatacaaaattaggaatggcatcattattaccaaataacaaaatagaaattaatgatagatatgatgtactggttaatggtgtaaatagcagtgggactgataatagaaatacaatattaaagatggaaaatgaaaagtctttagcaattacttatgatactgttatggatatgaaggatgctgaaattagaaaagcatttactggattagaagtagtttatatttatcataatacaatagatgctagaggagaccatgctagtacagaaagagaagttttcaaagcaacttctgatgcttttaaggaaatactgctattagtaaataaactagttaatagagtaagtgctgctaacattataattacagcagaccatggatacctttataagagaagtgctatggaagaaagcaataagttatcaggtataaaacttgaagatggagaagataacagaagattcttactaacttctagcaaagaagatattgaaggaactgttacatttagtatggattatttattaggagatgaatcaaataagtatgtaattacaccaaaaggaacttcaagattcaaagtacaaggagcaggtgctaactatgtacatggtggagcaatgccacaagaaatcatagtaccagtaataaagtttaaaaatgatagaagtacatcatctgttaatgacattagaaaagtcaaaatatcagtaacaagtattactagaaagataactaatataataacttacttagagttcttccaagatgaaaaaattcaagataaagtaatatctcaaagaattaaatgttattttgaagatgaagaaggaaatagaatatctaatgaaaatataattattggagattcaagatcggaaaatccagttgagagaacttacagagagaagtttgtattaaagagtatgccttatgataaaacaaagcaatacttcttagtaatgcaagatgaagaagatgcaaatggattctatgaaagaataccatttaatgttgatatagcaatagttgatgaatttgggttttaa

SEQ ID NO: 1460 - DNA, 2625 bp, Acinetobacter baumannii
atgaatctggatcaattacaaaaaggtctggaacaggctttctacactgaaaaacatcgaattgtcttctggtacgatgcggaacagtcatttactgaagaaatcaaagccctagagctaaatgatgtccagattctgaatatggcagaagagtcgagtctggcgatcaagctcaaactggaactgcaagatcagcagggcaaatacctgctgtatttcccaagtgctgagcctgaaaccgaaaaagactggttactggacatcaagctctattcacgcagcttctatgccgatcgtttctcgattattttcaatgagctgggtttacagcagcagagtctaagagaacatctggccaaacgtgaagaattcctcaaagccaaagctcgtctgagtacattgaaacgctatatccagcctgatgcagatgaacagaatctggatatggccatgattgcagctgtggtcaaggctgacagtgccgaactcatgcatatcgttctggcactggcagatgaaatggtacagcagaacctggctctggaagtcaatccagaatcctttgctgaactggaaaagttccaactagtgccggctttagttaccgcattacaggcggaaattggttatccagcatcggttgaggagctgaatggggaaacacagttcaagctcggtacattctttatccggttaatgaccacaggtttctgtgaaagcttgggcgatgtaccggtatgggcccaggaactggtgatgtcttctgtcagttcccgtgcaacagccagagcctttttgtcgcgctggagagacagttctaaatactacccaaccttcgatacactctcccagaccgtggccaatgcactgcggatccaggagaaggtcgggacttttgatctggagcagctgctcgatgtcatgacctttgaagtgattgaacaaaagatcattgttgatttggccagtcatatccccgcagtagccaaagctgaactggaacatttcagaacgattatttctacccgtctggatggctattgggcttccaaacataaggacgatgcaacccgccgtaaatatcgcactgtctatacagcgttgcagtcagcgattgagctcttcagcctgcgactgcagtttgattctgggttttatttcgactctagcgaagccttgtataaagcctacgagcaggagttgtatcgctttgatatggcctatcgccactacagtgcagcctcgcaacgagctcatgtcgatattctcaaaaaactcgatgaagaaatcgaaaattgttattcctactggtttatcgatcacctggcacgcaactggggtgagcggattgaagcagagcaacgtctgaatgtctggaaaatggcggatatcccaaatcagcagaacttctatgatacccatgtcagacctttgcttaattctccaactaaacgccgtattgtggtgatcatcagtgatgctttccgctatgaagctgcagtagagctgtgtgatcgtatcaatgaaaagcgttattcagaagcgactttgtcttcacagctgggagtggtgccaagttacaccacactcggcatggcctcattactgccacaccagactttggagtacaaagagagtgcaggggatgatgttttagtagatgggcagtccagcaaagggactgcagcacgatccaaaattctggctgcctataatggattggcagtaaccgctgaaatggtaaaaggctggtcgcgtgatgaaggccgtgaagcgctgaaagaccatgagctgatttacgtttatcacaacgtgattgatgcacgcggtgacagcgcctcgacagaatcagaaacctttatggcggtggaacatgccattgaagagctgaccgaactcagccgcaaaattttaatgcacttcaatatttccaccctgttgattacagccgaccatggcttcttgttccagcaaagtaaactggaatctgtggatcgttcaagcttgactgaaaaacctaccaatacattgaagagcaaaaaacgctatgtgattgggcatggtttaccagagagcaaggaagcctggaaaggctcaacccaagctacggcaggcacactatctgcgactgatttctggattccaaaaggggcgaaccgtttccattttgtaggaggctcacgttttgtgcatggcggcatcatgcctcaggaaattgtggtgccggtactgacggtaaaacagctacgtggtgaaaaggctggacagcggaccaagcgtaaagttgaggtcatttctaccaaatccacgctgaagatggtcaataacatccagaagtttgatttgatgcaaactgaagctgtcagtgagctggtcatgccagtgactttatccattgccatttatgatggggatctcaaagtttccagtgaagaaactttgacttttgatagcagtaccgactctgttgccgatcgggtcaaacaggtcagattgtcattgtctggcactgattttgaccgtaagaaagattacttcctagtactgaaggacaaagacctgaatatcgagatgcagcgctataaggtcaccattgatctggcatttaccgatgacttcttctga

SEQ ID NO: 1461 - DNA, 2625 bp, Cellvibrio sp.
atgaacttagaccaactcaaacaaggcttagaacaagctttcttcaaagaaaaccaccgtattgttttctggtatgaccctgaaaatgatttcgagggtgaattgccttcattggatttgccaaacgtaactgtccttaacatgaaaggtgagtcggtattgggtgtaaaactcaagctcgaacgtgaggacacaacaggcaaataccttttgtattttccgcaggcagaacctgaaccagaaaatgattggctgttagacataaaactctattcacgttcgttttatgccgaccgtttttcaattatttttaatgagttgggcttgcaccagcaaagcttgcgcgagcatttgtcgcaacgtgacaaattcctttcgagtaaagcgcgtcttaatgcgttaaagcgttacgtgcaacctacgttcaatgaagctgagttagatttggcgatgatcgcggcggtagtaaaagcagaagcctgcgatttaccgcatattctctttgcgcttgcagaggaaatggtaagcgcgcaatccggtttagaagaaattcctgccgccattactgagttagaaaagtttggccttattccggcatgggtaacggcgttgcagttagaagtcggctacccagcgacagcgggtgaattggctggcgaagaaccctttaattttggtcagtttttagttcgcctgctcgctacaggtttctgtgaaagcattggcgcggttcccgcatgggcgcagagcttagtgatggcctctggtagcgcgcgcgcgacttcacgcgccttattgtctcgctggtgcgatagctcgcgttattacaaggcatttgatgaagtatctacttgggtggccgcagcgctacgtgtaaatgaaaaattaaaagacctggagttgtcggctatatcgcaggcggcaaccttcgagcaaattgaacatcaaattattgtagagatagcacaggctattccagccgcagaccaagcgactcttggcgagtttgcggcggtcatcgccaatcgtctcgataactattgggcgtcgcgccataaagacgatgataaacgcaaaaaatatcgcgtcagctacaaggctttgtcggctgctatcgatttatttttattgcgccatagccatgcttcggggtttcattttaatagtgtgcaagctatttaccatgcttacgaaacagatctgtatcaatttgaccaagcttatcgacactattgcgaagcgtccaatcgtgcacaggtagacatcctcaaaaaattggatgtcgcggtcgaacaatgctacgccaattggtacatcgataaccttgctaaaaactggggcgacaatgtcgatgcagaaaataggctaaccaattggaaattagagggtgtagagaatcagcaacatttttaccgcaagcaagtagccccaatttttgctaaggcgaagcagtctcgggtcgtagtcattattagtgatgccttccgctatgaagcagccgtagagctgcgtgatcgcataaacgaaaagcgctactgcgaagcgaatttgacctctcaattaggcgttgtgcccagttacaccgcactgggtatggcgtcgctgctaccccatgaaaccattgagtaccgcgaaaacggcggggaagatgtatttgtcgatggtaaatccaccaagggattaaattcccgcaataaaatattaactaaacatggcggcatggcgattaccgcagaagacattaaaaattggtccagagacgacggccgggaaatattgaaggatctgcaactcgtttatgtgtaccacaatgtggtcgatgctcgcggtgatgtggctgcgacagaagcggaaacttttcttgcggtagagcaggccattgaagagctaaccgaattaacccgcaaaatcttaatgcacttcaatacctctactgttgtagtaacggcagatcatggctttattttccagcaaagcaaattgaatgaatctgataaaaccgcattaatggaaaagccagaaaatgccataaaaagtaaaaagcggtatgtggttggttttaatttaccaacgccaacaggtgcttggttcggttctactcaacacacggcaggaacaatgtccgacacccatttctgggtgccgaaaggcgcgaatcgttttcactttgtgggcggtgctcggtttgtgcacggagggattatgccgcaagaaattgtggttcctgtattggttgttaaacagcttcgcggccaaaaggcggagcaacgtaccaagcgcaaagtgggcgtaatatcgcccaagcctgcgttaaaaatggttaacaacatccagcgctttgagttaatgcaaaccgaggcagtcagtgaattggttcagccagtaactgtctctgctgcaatttacgatgcagaagtattggtatcgagtgaggaagtagtcaccttcgatagcgccacagattccatagcagatcgcgttaaacaagttcgtttgtcattaagcggaaaagaatttgatcgcaaaaaagattatttcctcatcttaaaagataaggacctcaatacggagattgaacgctatagggtgaccatagatttagcgtttaccgacgactttttttaa

SEQ ID NO: 1462 - DNA, 2523 bp, Faecalibacterium prausnitzii
atggcagaattgaacctgaaacaaattatagaccgcctgaatgcggaatttaccggggagacccggaaactggttttctggtacgatgacaaggcggaatttgccgaggatatggagacggtggagcttcagaatgcgaagatctaccatctccagccggataaccagttctatacaaagtattttcttgagcgtgtggataagaccacgaattatctgatctatgcaccgtttcctaaaccggatgtaagggacaaccatctggaagacacaatgctgtattccagacggttctttgctgaccgagcctccttgctgtcggttgacctgggtattgaggaaaagtacaagccggttattgagaagcacatcaagtttttcgccaacaaagagcgcactcagcggttctatgatttggaaatcgaaaacttcaatgaagaaaatatccttgtcggtctgctaagtgcagtctgcaaggcgcgtacctgctcttttgaggaagtcgtgcgcatcgtgttgacagatggcgagctggtggacaatgctttcttgcaggagtttgaaaaatacgacctgctgtctgcattctggcagctctgtgagcagcatttcggatacaccgatacaaaaccgagtttggaacggctgctggtaacattgttcgttacttatactgggcgatatgtgcaggcagagcttccggcagcatggaagagctttgtctcctacaagtccggcaatatcatcgcatttctcgatagcctgatgaacagcgtcctgtaccgggacaaatacgacgctctgtcgacgcacgttgccaaagggctgaatgttctttcggcatttgcaggaatgcgagtggacgatttggtggagtgcgacactttccttgccgtggatcaggtgctggtaaagtggctcattggcagacttgtttcggaagatatcggtgcaatcgtaaacggatttaccattccggaactctgtgaaaaacgggctaaaatgcactttggcagaaagaccgggaaaacctatcagatgctttccagtgcatacagcatggtgaaggaagcggattaccatgccgcagatggcttaaagccaatcatcgaccgatatcttgctgcggattacaatatggatcagcagtatcggaaattctactattattacgaccagctggagagcacggaaagctttgagtcgcttcgggagctggtggaaaatatctacacgaacgaatatctggcttgtctgctcccagcatggaatgctggaatccagcaggatgccgcattttcggcaattccgttgcagcgggagttttacaatgccaacctgcgctataccaaggaacgcaccgtggtcatcatttcggatgccatgcgttacgaggtcggacaggaattgtttgcccgaatgcaggatgacccgaaatgcacggcaaaactttccgtacaactaagtgtcctgccgtcttatacaaggctcggtatggcagcacttttaccgcataaaacactggagatgacggatgacttccaggtgctggtagatggtatcctttgcgataatctggcaggtcggcagcaggtgctgcaaagctataacccggatagtgtctgtgtacagttcgatgatatcaaaaatctgaaagtggcagagctgcgagatgtgctgacaaaacgtcagatcatctatgtataccataatcagatcgacgcgcgtggagacaaggcaaataccgaggatgaggtgtttcatgcgtgtgaggaagccgttcaggaaattgtggatttgattcatcgaatctccgtcagcggcaacacctatcattttatcgtcactgccgatcatggctttatttacaagcgtgataagctgacagaaagtgacaagatttccgggaaaagtgcggacaaagcatttgtcaatcgcagatttattgtgtccaaggcgacactggaagatgatggcatcgaccatatgagcatgggacgcattctggggaacgaggacagcaaggtggtgtcctatcctgtcagcagcaatgtctttaaggtggccggaggcggtgctaactatgtgcatggcggttcctcaccgcaggaaatgctggtgccggtgctggagtttaagatggagcgcggtcacatggaaacaaagaatgcagagattgctctggtcagcattgtccataagattacgaacctgatcacgtccatggactttattcagtcggatgccgttagcgatactgtaaaagctgcaaaataccgcattttcttcctctcggaagacaatgagaaaatctcgaacgaaaacagttatgtggcggacagtcgtgaggaaaatgcgcagaagcgtatcttccggatgcggttcacattcaagaataagaaatatgacaaggacaagcagtattaccttgtggtttacgacgaagaaagcggtctggagcagtggaggcagcctgtcatcatggacattgcctttgcagatgactttggattcggattctga

SEQ ID NO: 1463 - DNA, 2595 bp, Fulvimarina pelagi
atggatacggatcgcatccaaatcgcgcttggccgcttcctcgccgaaaatcgagtcgtcttctggtccgatcccgacaaggaattcgaagatattctcccgggtctcgatgtcggagatgcggccgtcatccggacatcgaaatcacctgctctggagacgaagctaacaatcgcttccggcggcgctggatcgtgcttcctggtttatgaagaccagccacgccccatgcctgcggacgactggctcctcgacatccgcctctatgcgaaatcgttcgctgcggaccggtcgacccacgttctcgaggatctcggtcttcattcgccggcactgcgagatcatatcgcgctgcgttccaagttcttcgccagccaggaacggctgacgcgtttcaaacgactcgtctcggctaaggacaacgaggtcgatatcgaccggaagatcatggcaagcctgctgcggctggataacgctgatttcttcgggatcgtcatcaagatcttcgacgagttccccgaccagtccgacatttcgcgcccgcccgacgtcttcggcgagttcgcgaggtacgatgtcgagcagtcattttggagccaagtggaggcggccttcgactttagtgacccgcgaccgacgctcggcaatcttctcattcgactcctggtcaccgatttcacccgtaagctcaacggcaagacgccgaaggcgctcgagcatcttaagctccgagggcaaggcgcgtcgaacacggccgtctgcctcgcacaatggcaggacagccacgcgcgccatgcgagcttcgacagattgtcggacgcagtcgcgacagccatcagacttggcgatcaagtcggtatcgtcgatccggagtacctcgaagacacgcgaacattcgcattgatcgaacggcgccttgcctcgggccttcgagatcggatcatcgatactgataccgccgtcgatgtcgaggaggtcgtttccctttgccgccggcggaaggatgggtactgggccaacgagagccttggtggcgccgctccgcgtaaggcctatgcgcgaacatacgacgccttggagcatgcggcgcggctcttcggccttcgcggggcctacgactcgggcttctctttccgaaccgtcgaggagttctggcaggcctacgagaccgacctctaccggttcgatcaactctaccgacatttctgcgaggcagccgaccatgtcgagagccagggttgggatgttctcaaggtactgcggcagaaggtcgaagacgtctacggaaacggatacgtcgcgaagcttgcgaccgcttgggggccatttgcggccaagatgatcggctcaaagtggcagatccctggtgttccaaaccagtcgcggttctacgagaagcggatcgccccgatcgttcaggaagacgataagcgggcgattgtcatcatcagcgacgcctttcgctacgaggcggccaaggaactggcggatcaactcaatagccgcgatcgtatggaagccaagctgactacgcagttgggcgtactaccgtccttcacggctctcggcatggcctctcttctcccacacgagaagctcgagtttgcggacggcaccatctatgtcgacggagcctcgtcgagcgggatgaaggggcgcggcaatatcctcgcgaagcatggtggtggtgtaatccgcgccgaggagcttcatgcgatgtccagggacgaggggcggcgcttcctcaagtcgcataaggtcgtgtatgtctaccacaaccatatcgacaagacggcggacggagcggacgaagaaaaggccttcgatgcggtgcgcaggaccattgatgacatcgcctcgttggcgatccgaattctcggcagcttgaacggcacgaaccttttcgtcactgccgaccacggattcctgtaccaggaaagctcgccgaccaacgtcgacaagaacgttgtcgaggaaaagccggccggcgtcgtgcttgcaaagaagcgctactatatcggcacggatctcggatcgcatgcgggcgcctggtcggcgccactgtcgcgtacgtccaaggtcacggacgataccgagttctgggtgcccaaaggaacgtcccgcttccacttcatggggggagcccgcttcctccatggaggggcaatgctgcaggagatctgcgtgccggttctgcgcatcgcttattcgaaggacaaggacgcgaacgacgtgaagtcccggccggtgcagatcaccgtccttggttcgaataaccgaataacgactgcgcatcgtagcttcaatctgatgcaggtggagccggtttcagaccgagtgcgtccgctgagcgtcacgatagcgatcgtcgatgccgatggtcgccccgtctctgatattcagaaggtcacgttcgacagcaggacggtggcgatttccgaggactggaaaaaggccgttaggttcaccctcgccgggacgactttcgataagtcgcaagaatattccttggtcgcccggaacgccgagacgaaggttcaggagttgatttaccatgtcgttatcgatctcgccttcgctcgcgacttcgactga

SEQ ID NO: 1464 - DNA, 2598 bp, Escherichia coli; identical to SEQ ID NO: 1225

SEQ ID NO: 1465 - DNA, 2598 bp, Delta proteobacterium
atgggtaaattgtccgacagagtccgaagcatgatcgcccgtcaggttaagaaccgtggcattgttgtctggtacgatcccgaaaaagcttacaccggattggtacagaacctgaaaatccctgaaaccaaggtattgcagtacacggactcctttttccgccttcgccacgaactggaaccgtcccttgagtttgtcacgcctgtgggaaaggccaaggacggatgcggtgtcgcgccgaatgtggtcgtctatgtccccatggatcggaacgaaacatcctttgcgttgatcgaagctgaaaccgccggcatagttgtcgaacccggtgcggaggccactgagaggaacagccggttgaaggttcagacggaatcattctttttggagatcgccccggaaaaggccgggcacctggcaaggcaggtagacgatggggttctcaccctcgaagatttggaccgcatctcagaggaagtgggcagcattacctcgggagcgctcaaactggttttcggtgcggcatctcccattgaatccattatcgagttcgcttccggctcaaccaaggacgcaaaaatttccgaaaaaaaggctctgggtgaactgcgaaatctggtgcgctccgaactgggacttgatttcggggacaccacctctccagcgaaagcacggcaagtcttgcgcagaatcgttcttctggccgagttcacggccgccattcctgaaaccggaagaccctcggctttaggcaccgtaaatctgcccggcaaacccatgcaactggatgcggtgagacacttgtgcgagacatggcgtaaccgtgtggactttcgcgacggctacatccaggcggcgcgtgagctggaacaagctgcgggcattgctcaaatgaaattgaatgtggatgacgtagcggcagtggagactttcccctgcatcgacgctctgctcatggcatcggtgcaacattcattgcttcaagggcgtttggaaggggcaatgggaatgtccgagtcacggaaaaaatctttctggagccgtgagcagcccgaactctttctgaaatggtcggcactggaattggccggacgcttcatgacggaagccgccaagattcgagatcagatcagaaagctggatgcttcggcaggcgagatggtcaaggcctacaccctttttacagagccctggatgatggcagatcgttttcatcgccattgggaaagccgtttgctcaacctcgatccggatggaacggaagaagacgatttcgaaaaattgagagccaaggttcgcaggaaatacaccgacctggtcgatgaaatgaaccggatctttatagcaaggtttcagaaagccgggtttgaagcgtgggaaatactgcctcagatgcggatttttcatgatcgggtttcgccctctcttgcgaaagagaaaaagacggtgttctttctggtggatgccttgcgttatgaaatggcggccgaacttctggaggggatggacaaagattttgatgttactcttgagcccgccatcggcaaccttccctccatcacgtccgttgggatggctgcccttttgcccggggcagaaacgggtttggaactgattcctacaaagggtggcatggccgttgttctggatagtcgccagctcagagatcgaaagagccgattggcttatgtgggtgaaaagacgtcctgcggatttatggcgttgagattagccgatgtgttgaagataggcgtcaagcgaaaaaaggagttgcaggcggcagggctgattgtggtgacctcccaggaaatagaccgattgggggaggatggcgaagattacgccgaaacccgtcgcttcatggacgacatgctggagcagttgcgccgttcgatccggattcttgcgaaactaggggtcgaacatttcatcatcaccgcagaccatggatacctttttgcagaccagatcgatccggggatgctcatggattctcccggcggaattaccgtggaacttcatcctcgcgtatggattggaaaaggcggcaaagacgccgatgggtatgtgcgggtggcggcaagtgagcttgaattcggcggcgatctcgaaatggcatttcctcgcggtctctcttgtttccgggtgaaagggggagttggcggatactttcacggcggtatatcgttgcaggagatggtgatacccgttgccgttcttaaaagcaaagtatcgacggcggttgacgccggggccgggatgaaaattcgcctggagttcggaaaacctgccattaccaaccggtttttttccatgttggccacgcttgaattgcatgggctttttcagacggaggatgtccggattcgggccatggttctttcaaatagaaaagaggtcggtttctgtgccatggcagcttatggctatgaggaggggtctcgcgaaatcaccatgcgaaaaaatgaacccaacgccctgaccttcatgttggccgatgatgtgggcgacggaaaagtcacggttcaaatcgtggactgccacacccagcttgagttggcttcactggccgatgttcctgttaaactggggatttga

SEQ ID NO: 1466 - DNA, 2523 bp, Enterococcus faecium
atgacagatataaatacgcaacaaattgaagaaaaattaaatcaacgttttcctaattatggatgtaggaaaatcattttttggtttgattcaaatcaggattttcttgaagaaattgactcattggtcattcaaaatgcaaaaatctatcgattagaaaaggacgcacaatttaaaactaagcgtttattggaatatgaagatcccgaaactaactatttaatctatgcgccatttcctcgttgggatgataaagatgaagataatcatttgttgagtgtattgaattattcagaggaatttagtgcagaccgcttagcgattatcatgaatgaattggctattccacttagatttcatcagacagttaaacagtatcgtaatttctttaatgcaaaggatcgcatgagaagttttggtgaatttagtacgcatatgacaattaataaatcagaaacgattgaattaatgataatggctgttttgttgaaatcgaaaagtattcgattaaatgatttactgcgtgtagttctaaaaagctttacagaaagtagggagaatcctttaagggaacttgataagtatcagttaacagctaaattttgggaatttattcaaatgaaatttggctttacggatagccagccaacattggaaaagctgacgatgtgtctttatttgaactatttttattatcaaattgatcaagagatgccgaagaagttcaaaggatttgaaatactacatttgaaagcaaacattattactttcatggatcagtttatgaatgatacacgttacatggaaagctttgaacagctatctaaaaaagtatatcaggctattgatggtgatggattattagacagtatagaaattgatgatctaattgaagcagacgtattttctgagattcatgcaaaaatattaatgttttatgcagaacgattaaaggcttctgacactacaacgaaaattgcaggacaaacaatttttgatagtttaaagcagcgcgaaaaaatgcatttcgcatcggattatatttatgagtatcaattattgaaacatgcttattatcttgtggataaaaacagattgtgcttgccgatgaacatggataatttgctaactcaatatgagaaggaaatgtattgggttgatacgcattatcggaaatttatttggaatagtgatcatatagaagaaaagcaaaaatatggccaattgtatcgattagttgaagcaaattattcgaagtttcttgatcaatcaggacaaatttggaatcaaacttttgaatttaagaatcgtccatccattcgaaaattttataatcaagctgtaatgaaacgctctgttaaaactgtagttattatttcagatgcttttcgatatgagttagggatgaatttagaacgtaagttagttagagaaaagaagtattcaacaaacatggctagctttctttctgtattaccttcagttactgaattcggtaaagccgccttattaccaaacaatcaactaacttacaatgaaggaacagaagtactgattgatgggaaaaaaacgaatggtttatccaatcgaaatgcgattctccagcaacgagatgcaaatgctgtagctttaaattatgatgatgtggttaagatgaataaggctgaggtacgagaagtatttaatggcaaatcagtcatttatatttatcacgatcaagtggatagaacaggtgatcactcgaatgaaaatcgagtttttgagtcctgtgatttagcgataagcgaaatttcccgacttattaatcgcttgcataatgatggcagtatctatcgttttatagttacggctgatcatggatttatttataaaagaagccacgttgaagaagtagataagattgaaaatccatctagaaatgaaaaagatcgtgtagaacgtcgttttattcttagtgaagaagaatacgaaataattggtacgaaaaattactctttgggagattctttaggaaatgatgacactagaaacatttgtgtcccgattacttcaagtatttttaagaaagctggcgggggacaaagctacgttcatggagggtcatctattcaagaaatgctagtccctgttctagaaattacggtagccaaaggtagcaatgcaaaggaaccagtagcaattgaattaatgactagcaaccgcagaattacaggattatcaaccacgttagaattctatcaaaaaaatgcaattagtgatgtttatgaccccgcatctttctggctttattttgaagatgaatatggtgaacgtatctcaaatgaagaaatctatgttgcggattcaaaaacagaagatgcaaatcagcggtttactaaatttgtttttgaatttgtaaatcgtcgatatacagttgaagatacttattatttagtgataaaaaatcaaaaaaatgatttgaccgagcgaataaaattcattatagataatccttttgcagaatcatttgattttgatatataa

SEQ ID NO: 1467 - DNA, 2493 bp, Lactobacillus johnsonii
atggcaacattaacgacagataaaattatttcagaacttaaaaactattttgaagataaatatcagtatgttttttggtatgacgataaggctcagtttaaagatatcattgatcaaattgcttctaatttaaatgaagttaaactatataaagctcaagctaatcaacaatttaaaacaaaaattaaccttttaagtgattctcaacataaatatttaatttatgcaccttatgaacgaccgagaatacaagaaaattatttaactgatctggaatactattcgaagctttttactgccgatgcaacacaaattatactagaagaattaaatttgtcagtagataaattatcttttgtaaaacaatatcatacattttttggtgctaaagatagacgcaagaactttattaagtattggaacgtagatttcgataccactcctgaaaaaggtattatcgcggcaattaccaaaactgaaaagctagatattaatgaattattgatgaaaattatttctgccggaaaagaaaacaatcaatatttatttctttttgctaaatataatgtactagattatttttggaaactagttgggaattatttcggctatgatactattgaaaatgctaacttagataatctaattaataatctttttttcacatatttagatacagaattagatattaaaaattctaataaatttcaaaatttattattaagtaataaagataatgtacaaatttttattgatcgctttgctgattctaataaatataataaatactatatctcagagtcaaatcgtgtttggaatgaattgaaattacatgatttattagtacaagaatccctcagtgacttaacaaaggtaactgtttttgaagaagtaaacagtatcgtattaacaaaaattagagataaatttattgataatcaagttactgattatgaacaagttctaaatattattgatcgaatgtctaaccacactcgcaataatttctctaataataaagaaaatgaatataaatttttacgttatagtgctgaattatttaatttgcgtatcccattatttgaaaattggcaaaaagaattggacggatatataaataatgaataccaaatagacactatttatcgaaaattattattagcttatacaagaattggcaataacgatttatatagtaaaatcaaaaaaaatattgatttgtattacggaaatattttattaaatagctcggttaaacaatggaataatacctttgatttatcagaagtaccaagtgatataaaacaagaaagattttatcataatcacgtagctcatgtgccagaaagagttgtagtaattttttcagatgccttacgctttgaagttggtaaagagctagaagatgagctagataataatgatcgattaactttaaatatgaaatatgcgcttactagcttgccgtcagtaacgtatatgggaatgaatgttatgctaccacacaatagtcttagatgggatgcagagaaacataaagttaaagtagatgataaaaacgctgaaaatacttctgctcgtaataaaattttaaaaacattcaatgaaagtaacacagctgctcaactaaaagatatcttggaaatgacttcaaaagaagtgaaaactttcattaatggtaagaatttaatttatttgtatcacaatcaaattgatgctaaaggacatgaactaaaaacaactaaagaactagtagatgctacagaaaaagcaattgaggaaattaaaaaaactattcaagctctacgaacaaacggtgtgtcgcacatcattgtaacagccgatcatggctttatttatcaagaacgtccaatttatgataccgacaaaattgatttagcaaatgaagactatttaggcaatgcgcatttaagatatttgattacccctgataaattaagcgtaaggggagttaaaagtactacaatgggtattagcttatctaatgatgataaaactaatatttattatccaacaagcccgaacgaatttattgcaagaagtggaagtaaaaattatgttcacggcggttcttctattcaagaaatgttaattccaatattagatatcaaagcaacttcacgaaaatccgctgcacaaccagcagaaatcaaattagcggctactacttttagaattaatagtttaaaaatgaatttgctttttaatcaaatagcttcagttagtgatagagtattaccaactgaatataatgtattctttgttgatgaggatgaaaagatgatttctaataaagtagtagttgaagcaaatcgtaagggatctgcggctgatcgtactcttcctgtaactattacaattcagaatacaaattataatcttaataaaaaatattatttagtaattgagaaccaagatactaattattcccaaaaaatagaatataccatggatatattttcaaataattaa

SEQ ID NO: 1468 - DNA, 2601 bp, Thiothrix nivea
ttgaatctcgaccagctcacccaaggcatcctcgccaagtttgccaaccaccgcatcgtgttctggcacgacccggaacaaagcttccaatccgacctgccagccctggcgctggatggaatagctctgctggacatgcagggccgctccctgttcgagaccaaaaaacgcatcgaactggatgagccggagcagcgtttcctgctgtattttccctacgccgaacctgagccggaaaaggattggctgctggatatgcgcctctacagcgagcagttctttgctgacgccagttccatgctgctgcatgagctgggcattcccaaaatggggctgcgcacccacatccgcgcacgttccggattcttcaacaagaaaaatacggctgccctgaaaaagctggtaacggaaaacgaagatgagttgtcactcgaccgcaagatgatggctgtgctgctcaaggcggattcggcggaactggcggatattcttctcagcctgttgaaagactatgcgcaggtattggaagccggtacagataccgccaggctacccagcatggccttgttgcataagcacgggctgccagattccttgtgggcactgttacaagccgaattcagctatcaggccaaggaaccctccctcactgatttcaccctcaagctgttctgtaccgagttgtggtcacagatggatagcctggatcgcgactggttgctgcaaaacgtcctcaagaccgccgcaggccgttcaaccgcgctggccttgctggttaactggcgggatagccggagttactcggagcattaccagaccatcgccagcgtgctggagcggcaactggaaatcagccgtcgtctggaaaattgcacgcctgactatctggtatcctgtaaaacctttgaggctgtcgagcagatcattatccgggggctggtttccgcgctgctggaagcagacaaggcgctggatcatgcttacttcgagtccgtgctgtcagaacggcgcaccagttactggcatcgggtcagggatggctactacgcccatatctacactgccctgcaacaggccgagcggctattcggtttacgtcactcgcacccggacggtttccactacgcttccgcccgcgatatgttcatcgcctatgcacaggaactgtttggttttgatcaggcataccgccagttcaaattcgcggtcaggcaagtagccaaccagggtggcgacatcctgcgccgcctggatgaggctgttgagaacctctacaccaactggtatctatacgaactgggtctggcatgggatcggcatctggccagcgaggagcgcatggctaattgggtattgtcgggcgtaccttcccagcaacaattctatgaacggcagatcagaagcctgctggctggcaaacaggtcaagcgggtcttcgtggtgatttccgacgcgctgcgttacgaggtcgcggaagaactggccagcctgatcaatgccgagaagcgcttcaaagccgagattgccagccaactgggcgtgttgccaagttatacccagcttggcatggcggcgctgctgccacacaagcaactgacctacgcgagtgggcaagcggtggtgcaagtcgatggacagtcatccgctgggctggaaaaccgcaaccggattctgacggcagttaacggcatggccgtcagcagcaaggatgtgatgggctggagcaagcaggaaggccgtgatcaggtgcgcgataaagcggtggtctacatttaccacaacaccattgacgacatctgtgacaagcaaggcggcgaagaccgtaccccagaagtatgccgtgacgccattgccgaactcaatcatctggttgggcgtatcgtcaacaacctcaacggtagccgcatcatcatcaccgcagatcatggtttcctgttccagcaacaggcgctggaacaaactggcaagacggaactgagcgttaaacccgtcaataccatcgagaccaagaaacgctatatcgtgggcagacagctccccacgtatgacgaatgctggaaaggccggattgccgacaccgctgacggtggcgatgacaccgggttcctgctgcccaaaggcgcacagcgcttccattttgtgggtggcgcacgctttgtgcatggcggcgcaatgcttcaggaaatctgtgtaccggtggtgcatatccgcgaactggaaaaggaatccattgcccagcatgaaaaacagccggtcggtgtggtggcggccagccagcccatccgtttggtcaacaacatcgacaaagtgcgtttcatccagactgatccattgggcgagcgttacaaagcccgtaaactggaagtctacgtgctggatgcgatggggaatgtggtttccagccgtgagccgctcagcttcgacagcacttccagcgtgatggaggagcgtatccgcgaagcccgcctgaaactggtgggttccgggtttgaccgccgcaaacagtacaagctggtgctggaggatatggacacccgcacccgctacagcgattatgccgtgaccattgacctggcgtttggtcaggacgactttttctaa

SEQ ID NO: 1469 - DNA, 2598 bp, Escherichia coli; identical to SEQ ID NO: 1222

SEQ ID NO: 1470 - DNA, 2496 bp, Brevibacterium mcbrellneri
atgagttcgctcagtgtcgtcctgcctcacctagagcagaggttcgagtcacagcgcctggtcttctggcacgacgccgacggcgagtacgccgccgagattgatgcgcttgatctcagcggcgtgaccactgtgcgggtggagaacaacgagtacgcggtgaagaaccgagtgctccacgacgagccggcgggcaagtttctcctgtaccgaggcgctcctgtgcctgcgggtacggggaactggttgcttgaccttgagcttgcctatgggatcttcaccgctgaccggaccgcgctcgtgcgccaggacctaggtctcagcggtagcgggatcgacgaggtggtgcgagagcacgagaagttcttccgagccgtcaagcgagtcgagagcctcaaatccctcctcgcgaccagcgatgacgccgacaggttgcgagcgaagatgtctgccgtggtgcttggtcagcacgagcacagcatgcttgagctcatgcgcgcgttgctgatcgagaacgcacgcggcgcgcacaccaagtacgacgcgctggccgaacagggtctggacagcttccactgggccggtgttgccaagatttacggctacgaagcaagtgagcctagcgtcgatgactttgtgctgtggatgttccgccaggcgatcaagcggtttgcatcggacacgcccggagccctgcgcaatatcgagctcgacttcgcgagcctgcgcaacgaccgacgcagcgccgatgctctcgccacgttggctcggcgcgcagctgaaagtcttgactacgccagcaccatcgaggatgccgaactggctgagcttgtgggcaacgatcttttcgaggacgtggagcgcaagatcatcagcgtgctgacacaggcaatcgtcgagcggacgatgggcacacgcgaggtgtccgagatcatccgttcccgacagagcagcatctgggtggacgggtaccgggaactctacgcggcgctcgccgctgcctctgaccttctgagcgagctcgcgactgcaagattcgagatcgcgtccttcgatgacggactcgaccgttactgcaagcgctggttccgcatcgaccagctctaccgacagttccactttgccgcccgcacaacggagtacaccggcgccctcgaagcgctccgggttgaggtggagaagcactacgcgaaccgattcctctacgagctcggcaacgcctggcagcagcaggttgatgccgtgactgattggcgatcggtggtgttgcgccatcagacaaggttcttcaccgatcacgtcgagcccatcatcaggaggggcaaccggaaggccgtcgtcatcatctctgatgcgctgcgctacgaggtagccgacgatctgggctcacgtatccgtcaggaagaccgctttgacgcggaactccacgcgatgctgggcgtgcttccgagctacacacaactcggcatggccgccctgcttccgcacacgacgctggctcactcgcacgatggcgacctggtgctcgttgacggccagcgttccgacggaacggcgaaccgcaacaaggtgctggctccggtagacgggttcgcaatccaggccgaggacgttctcgcgatgccgcgcggtgagctgcgcgaactctaccgtgcgcaccaggtgctgtacgtgtaccacgaccggattgacgccgctggcgacaaggcccgcaccgaacgacaggtgttcgaggccgccaacgacgcgctacgcgaactggtcgtcctcatcaagcaactgacgaatgcgaatgccacgaacatcctcgtgaccgccgaccacggcttcctctaccaggacaccgcgcttgccggtgcctcctacctctcgaccaagccgcagggggacgagctcgtggtgacgaaccgtcgatacgtgctcggccgggggctcaaggacgatcccgcgtttcgaaagttcgagcctgaacagctcgggctgagtagcgaccttgaggtgcagcttcccaagtcgatccatcgactcaagctgccgggcgcgggctccaggttcgtccacggcggcgccgcactccaggaaatcgtcgttccggtgctcaccgtcaacaagaagcgcaagagcgacactcgcctcgtcaacgtcgaggtgctgcccgagacggacaagatcaccaccggtcagctcgtcgtgaagctcttccagtccgagccggttagtgagaaggtccaggctcgcacgctacgcggcggcctctacgtcggcgagaccctgatctcgaatcagcccgagctgctcttcgaccagccctccgatgacacgcgtgaccgctaccagagtgcacggatgctccttagccaggacgccaacgagttcaacaaccgcacggtcgagttccggctcgaagagcagatacccaacaccacccagtggcgcgtctaccagcgggctcagtacctgctcaagcgctcgtttacatcggacttcgatttctag

SEQ ID NO: 1471 - DNA, 2598 bp, Escherichia coli
ttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgagtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacttggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacaccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctagaaaaaaatgtcctgctgacgccatccggcagagcatccgccctggcatttatggtgacctggcgtgccgatcgtcgctataaagaggcttatgactactgcgctcagcaaatgcagaccgccctgcacccggaagatcattaccggcttagctcgccatatgatttgcacgaatgcgaaaccaccctcagcatcgaacaaaccattattcatgcgctggtaacgcagctgctggaagagagcaccacgctcgatcgggaaacctttaaaaaattgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggagcgatgatcctcaagagcctggatgattatatcgaggcgctctacagcaactggtatctggcagagttaagccgtaactggaacgaagtgctggaggcggaaaatcgtatgcaggcgtggcaaatccctggcgtgccgcgtcagcagaactttttcaatgaggtggtgaagccgcagttccaaaatccgcaaatcaaacgcgtgttcgtgatagtttccgatgccctgcgttatgaagtggcggaggagctggggaatcaaatcaataccgagaaacgctttaccgcagaactgcgatcgcagctaggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaaaaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaagtaatcaaccgcctccacggcacacgcatttttgttacggcggatcacggtttcctgttccagcaacaggcgctttcggttcaggataaaacaactctgcaaattaagccggaaaacaccatcaagaaccacaaacgctttattatcggccatcagcttcccgccgatgatttttgctggaaaggtaaagtggcaaataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1472 - DNA, 2511 bp, Geobacillus thermoglucosidans
atggatattttagaggcgttgcgtgagcggattcgtgaagaaaaagaaaagaaaacaagagcgattgtgttttggtatgatgctgctgggcaggaatctgttgaatccttacaagaagcgttagccgatgagagagtaattgtacgtgaactgacagatacgaacttttttaaactcaaaatagaaattgaaattgacaagccgaacgaatcgtttgtactgtatgcaccgtttgcacgaccacgtgatgaagagaactatttattagatatcttgctatatagcaccgagtttaaagcagaccaaattgccgtctgggccgaacaattatctgtaaaagatattgtattgcgaccaattgttgagcgttataggcaattttttaacagcaaagaacggattcaaaaacttaaacggttattacctttaaatgcgaaagatatagatatagaatatgggattttagctgtattaaccggggcaccaatcgcgaatattgcagcaattacacgttatttgctaatggatgggctagatgaacagaataatgaggcgtataagcgggtcacgaaatatttctccattgaacgaatgtgggaattgcttgaacaacattttggccttgaaacgagacctgccaatcgcacattgcgacatttaatggaaacacttctttatgctcattttgcccgtgatgcagaggttaatattgaaaaactccaaacaaaatatccgtccattcgctcaaatatatgcgcattatttattgatgactggatgcgtggttcggcagaagagacagaaaggctagagtcatacatacgtgagattgaaagtcgatttgagttgcgttattacctacaaaatgtatcagtccaaaatattgaaaaagtaattacgttcccgcttattgatgcgttattgatcgaaaaagtaattgatgaattgcaacataaaacatcagatttggaagcatggcaagagcgaatttcttttcgtcttacgacatattggggcaagaaggagcgaatacaagcactctatcgcgtgttatatgaagcagtacggttaaccgaatacaaaacgtatcttaaacaatatgacagtaccatcgatttatacaatcaatatgtgcattgcctgcattatattgatcaagcgtatcgccgcttcatgcaagcatataccaaattggaacaacgtgaaatgattgaatcattagcaaaagctttaacaaattggtatgaaaatgtctatttaactaagcttgcgcaagaaacaaattattatttagaaaaagaagaacaaataacgaaaatacctttgcagcgttcattcttccagcaagtagttcaaccaattttagagaaggaaacaacaagagtgtttgttattatttctgatgctctgcgatacgaaattggttatgaattatgtgagcggcttaatcaacgtataaatggcgaagcaagtgtttctcctttgtatgcgagtctaccaacttatacacaacttggaatggcatcattactaccacatcgtacattaactattgatgagaaaaaaattgtctacgctgatggagaaccaacaaacggtttggcgaatcgaacaaagattttacagaaagcgcatcctgactctgttgcttaccgattagatgaatttatggattggtcgcgcacagaagcggaagaaaattttaaaggaaagcgtcttgtttatttgtaccatgatgttattgatgcgacaggggattcgcgtaagtccgaacgtgatacatatgaagcggtcgaaaaagctgtttattccttggaattagcagttgatcgtttatcacgattacaggcaaaacgtatctttattactgctgatcacgggttcttattccagcatttaaaagtggaggcagatgtaaaagtagagaccgttagaggaacagtttttgatggtaatcgtcgttttgcaattggccattcattaacagttccagatggagcggtaaaattaaagagttggcaaacacctcttcaaaatgtcgatgttgttattgcgaaagggttaaatcgatttatgactggcgggggattgcagtttatacacggtggggcaatgccacaagaattgattatcccgctcattgattatcgtcgtacagagcaagctaaacccgtggatgtaagtgtagcgatgttagataaagtgattataaactatcgtgtacctgttcaattttatcaagagcaaagcgtttcaagcgattatttaccacgccagctaaaaatggcattttaccaaggaaatgaacgaatttcgaacgaagtcattttaacatttaacctaacaggggaaaatcatgaacgcacagaacaagtggtcttcactcttgctgagcgatattatccaatgggagaaacgtgtaccttaaaaatggagacgattcaagataaaaaaattgatttgtataaagaagaaatttttactattcgtatgtacgaggcgttatattaa

SEQ ID NO: 1473 - DNA, 2304 bp, Vibrio cholerae; identical to SEQ ID NO: 1292

SEQ ID NO: 1474 - DNA, 2523 bp, Enterococcus faecium; identical to SEQ ID NO: 1373

SEQ ID NO: 1475 - DNA, 2523 bp, Enterococcus faecium; identical to SEQ ID NO: 1373

SEQ ID NO: 1476 - DNA, 2658 bp, Vibrio cholerae; identical to SEQ ID NO: 1291

SEQ ID NO: 1477 - DNA, 2559 bp, Sporosarcina newyorkensis
gtgaatatgaatcagatagtctccgcccttcaagacatttacaaagaaccgttaagtgatggagaacagcgtaagattgttttttgggtagacaaggatgaggaatttattgaggaaattggtcaattagcgttagatggagttagagtcctaaccttatccgaaaataatcaattttatatgaagtatttattagaggaagaggacccgacatcctcttatatgatctatacaaatttggaattgagttcagaagataactggttgacagatacagttttatattcgaaaacattttttgcggatcgcatttcccttattttaagtgaattgcaaatagatccaacgcttcgagctgtaataaagaaatatgagaagttttttaacaataaagaacgattccgtaagtttcaggcatttgggattgaggcgtatagtgaggaaacgattgagcttgccattatgagtgttctttgcaatgttaagacaactgaatttgaagcagtcttaaaagcgattctaatggatacgctggaagataatgataataagtatttatcgcaactggataagttctttgatattcatgtgttctggacttatgttgccaactattatggctatgagcgtaaaacgaagacgttaaagacactctttattcatcttgctgtgacagcatttagccattcagtaaacgagaagtatttaacagacgtaaaagatttcatcgctgtccgtaataaagcaaattcccttgttttcattgaccattggatgcaccacaagaccgattatgaagtgtttgacgattatgcagaaatggtggaacaagaaattcagctttcgaatatattgcagtctgttccgattgatgaatttaaacaagcggaaaccttttcttatattgaccgagctgtcattatttacattgcgaatagcttattggaaaagcttgaggactatgaagagtatacaaaattaattaagcttagacgggcaaaacacttttacgaaaaatatactcatatttatgatgctctttattacacagtgaaaatgcaggaatttcataaagaatataatcaaggaatcccttcaggacaagcaattgacatatatgaggcgtattacaaaaaatatcaggtcatggatacatactaccgcaaattttatgtggcttatgacgaagaaagcaatcatgaattactattgaagctgaaaggtcttgtagaatacctttatacaaattggtacatgggagaactaagtacaaattggtcacaagcagtaaaagcagaaatgacagagcaatggtcattacctggtgtgcttagtcaacaaagattttattcttctatcgtggctccacatattagtaaaggtgaacgagtatttgtcattatttcagatgcgatgcggtatgaagtaggattggaattagcagaacgtctgaatgctgaaacgatgggaacttgtgatgcacagacaatgcttagcgttattccatctgtgacaaagcttggtatggcttctcttcttccacataaaacgattgattttgatgcatctggtcgtgtgttagtaaatggcaaggattcatcaggcctcgataatcgaaaggcaattattgaaacagcggtagaagacagcattgctattcattatcaagatataagagacatgaacaaagcaggtagacgtgaaacattcaaagggaagaagctcatctatatctaccatgatacgattgatgcgatgggagataaagcttctacagaaatttatacatttactgcagtagaaacagccttgaatcaattgtatgatttggtgaaaatcattctggatgacttaagcgggacaaatgtatatattacggcagaccatggtttcctttatcaacgggaatctttagaagaaagcgataaaatcgaacaagaacaaatggataagcttgaagtgaaacgacgttacattctttcgaaggaaaaaagagatgttccaggtcaaatggcaattaatttatcctctgtcattaaaaatgaactggaattgacagcctatgtgccaaatggaacgattcgtaaccgtatgcaggggacaggagtaaactttgtccatggtggtgcgagtttacaagaaattgttgttccattactttcattcaagaataaacgtgcggggcagaagggtgtacaagctatttcgaaagtggatgttaaattgacaagcacgactcgaagaatcaccaatagcattttcaatttaaacttcttccaaacggagaaggtggaggaaaagatgaatcctcggacagtcgtcatttatatggctgatacagaaggaaatattctctcgaatgaagaaacgataattggggatcgtccatttgataatccagccgaacgcacattcaagttacagtttgtcatgaaaagtatcccttatgatcgcaataaaacatattacttaatgattaaggatacggaaacaggcgttataaccgaaaaggttccatttacgattaatttggggattgttagtgactttgatttttga

SEQ ID NO: 1478 - DNA, 2304 bp, Vibrio cholerae; identical to SEQ ID NO: 1292

SEQ ID NO: 1479 - DNA, 2304 bp, Vibrio cholerae; identical to SEQ ID NO: 1292

SEQ ID NO: 1480 - DNA, 2304 bp, Vibrio cholerae; identical to SEQ ID NO: 1292

SEQ ID NO: 1481 - DNA, 2304 bp, Vibrio cholerae; identical to SEQ ID NO: 1292

SEQ ID NO: 1482 - DNA, 2523 bp, Desulfotomaculum gibsoniae
atggccgaactaaacctaaaacaaattacggacaaactcaatgccgagttctccggtgatacccgtaagttggtcttttggtatgatgacaaagctgagtttgccgaagatattgatacattggaactggtgaatgcccaagtttatcacctggaaccggacaaccagttctacaccaaatactttctggaacgccaagatcggacaaccaattatctgatttatgctccattcccacggccaaacgtacgggataatcatttggaagatacgttgctttattccaggcagttctttgcagaccgggcctccttgctcactgttgaccttgggcttgatgaacaatacaaaccggtcatgcaaaaatatattaagttctttagagccaagaaccgcacgcaaagattctatgatttagagattgatcactttactaaagaaaccattgaagtgggtctgatgagcgttctatgcaagaccagaacgtcctctttcgaagaggttttgcgtgtcgttctcatggatgacggttttgaagacaataagttcctggcggagtttgaaaaatacgatcttctcccagccttctggtcttattgcgaagaacagtttggctataccgatgtgcaaccgaccctggaaaagctggcggtgaccatgtttgttacctatacggaacgatatctgcatgatgatttgccaccggcttggaaaagctttgtttcctataaatccggcaatatcattgctttcctggataacctgatgaacaatgtactgtaccgggataaatataatgaaatctcggcctatgtctccaagggacttaatgcaaccacggtttttgagacttatcagccggaggctctaattgattgtgatacctttgcggtgctggacaacttcattatacactgggtgaatgacaggctattaaatgaggatatcggtgccaggctggctgatctcactattcctgcagtatgtcaggaacgccgcaaaaagcatttcggagccggctatcagattcagtattggctattagagcatgcttattatctgatttcggcagccgattaccatagccaggatagcttcaaaggcattgtggagcagtatctggcccgtgattgcttgattgatacccactatcgaaaattctattactattatgatcagctaagcgaaaacatactttttgaaaaactgcgcgatttggttgagaatatctattctaatgaatatctgtccgaagttatttccaaatggaactcttatctggtaagggaagatatattgacagtaatatcattgcagaggaatttttataatcagcatgtcctttacagcaaggaccgggtggttgttattatttctgatgccctgcgctatgaagttgggcgttctctttggcttaaattacaggacgacgaaaaatgtaacgccaaattggcggccatgctgagcgtgttgccgtctaatacaagatttggcatggctgcactgcttcctcataaaacgttggccatgactgatgattaccaggtgctggttgatggtatgccttgcaatgatttgaagcagcgcgaagcgatcttgaaaagctattccccgaacagccggtgcgtgcagtttgatgatgtaaaaacgatgaaaaaggatgaacttagagagatatttaccggtatggaagtagtttatatttaccacaaccagattgacgcccgtggagataagtccaatacagaagacgaggtatttactgcctgtgaagaagccgtcgaagaaatttttgctttgattaagcggctgtctgtcagtgcaaataccaatcattttatagtgacggcggatcacggctttatctataaacgggataagctgcaggaaagcgataagattgcctatgttacgggtttagaagctcttatcaaccgtcgttttatcatctcgggacaagcagtggttggtgatggaattgcctctttaactgtgggcagcattcttaataacagtgacagcaaagttatatctttcccggtcagctcaaatgttttcaaggtagccgggggtggtcagaactatgtgcacggcggttcttcgccgcaggaaatgcttgtgcctgttattaatgtgaaaactaaaaagggtcatatggaaacacgtccggtgctaattatgctggtcagcgtggtgccaaagatcacaaatctgatttctactttagatttcatgcaagcggaaccagtcagtgatgtgattaaggcaaccagctacagggttttctttatttctgaagacaatgagaagatctccaatgaatgtatctatgtggcagataaaagggatgttgatccacaaaagagaatctttcgcctgagattcaactttaagaataaacagtatgataagaacaagaaatattatctggtggcttatgatgaaaagaatgatttggaagtcttccgtcatggcgtagtaatggatattgcttttgccaacgattttggatttaacgtatag

SEQ ID NO: 1483 - DNA, 2304 bp, Vibrio cholerae; identical to SEQ ID NO: 1292

SEQ ID NO: 1484 - DNA, 2523 bp, Enterococcus faecium; identical to SEQ ID NO: 1373

SEQ ID NO: 1485 - DNA, 2700 bp, Vibrio shilonii
atgaacatagaccaaatatctcagggccttttaaacaaatttgaacatagccgtttggtattttggcaagataccgacaaagagttcattgatcagcttgatgagctttctattgacggcattgagatcatccatttagatgataagtcccacttcgaagtaaagacacgtgtcgagttacttgaaccagccacccgatttgttctgtacagtaacactgagaccaacaaacctgaacgcgattggttatatgacattcgcctatactccgaggatttctatgctgactcaagctcaatgatcctaaatgagattggcatgagaatggagtttcgtcaggttatttcccattaccgcgccttttttacagctaaggttcgccgtgaacgcctgaagaagttgttgcctcacagtgcaaataaggaagagctggaactagcactactagcagcgacacttaaagttgagtctccaaccttccctgctatcttgaaccatctgttattaaagcttgcagatggcatcgatgttaatactattttcagtgatctagaaaaatacaacttggttgatactttctggcgctttgctttcgatgtgatgggatatcaagttgaaaaatttgatgatacagagcaaattcaacctcatctaaacgatttggtgaccaaacttctattcacagagtgctaccagtctttacttaatagtggaatcaacggcaatcacgaggtctttgcaaggttcaagcagcacctgctaccaatcaatttagatgaatcaggtaaacgcgattataccgagcgaagaacatttaactcctctaaacgagcgacagcgatcagttttattaagggtatgcgagaaaatcgaaatttatcaaatgcatataacacccttgcaaaacaagttgagcaagaattcgagataaaacacatcttgtcgctggttaagtcccctacgcaccttcatcgtgtcgatacttttgaatatgcagagcaacatttcattatcttactcgctcaacaattgagtgaccttgatcaagttgaggtcgattcattgatctctcatcgcttaacgacacattggactcatcatcagccaaattacgcagctatcttaaaagcaattcgagctgccaaacagttttatgcgttaaagcagcagtatattgatggctttagcttttcgtctgccaaagaaatgtaccgagcgtatgaaactgacttgtataagttcgattctgcataccgacgtttctgtgagcatgctttaaaagtcgctcataatggctctgatatattgaaaaaaacagggttggtttctgatatcgaaacactctatgtggactggtacttacacgacctagcgatcgcttggggtaaactcgtcgatgaagagtctttgttagataactggaagatttcaggcgtaccaaaccaaaatgagttttatagacgacaagtcgaaggcatttttaatacaacacaagtcaaaaaagtatttgtcattatctctgatgcacttcgttatgaggttgcccatgcaataagtgaccaaattaataatgaaaagcgctttcattccgagattaaatctcaacttggtgtcgtaccttcctatactcagcttggtatggcttctttgctaccacacaatgaaatctctacacacatcaactcaaccgtcgaatacaaagtcgatggtatcagtgctcgtggtacagacaatcgaaataagattttggctaagcgcaatgggatcgcgtttaaagcctcagaagtgctgaactggactaatgaggaaggcagagaaaaagttcacgatgctagagtgatctatatctaccacaatgaaattgacaaggttggagataaaggtgaatcagagcatcaaacgtttgaagcatgtgcgacagctatcagtgaaatcaagcagttaattgaacgtatcatcaatcgcttaaatggtagtcgtgtgttgattaccgctgatcatggttttatttttaaatccagcgatgttgtcgattcagatagaacggctttaaccgtcaaaccaaaaggcgctgttgaagctaaaaagcgctacatcattggcgaaagcctcccaaacgacagcttctattggcacggtaagatgaccaacacagcgagtttaactgtaaactcggaatgcagtgacggtgaatttattgttccccgcgggtcaaatagatttaatttcgttggtggggcaaagtttattcatggtggcattatgccacaagaaatttgtgttccagtcatccaagtcaaagaactaactacaaataaattgcagtcacgatacgccaaagagcgagtacctgttgttccgctttcaaaccctatccgtcttgtctctatggcagataaaatcgagcttttccaagcagcagctgttggcgaaaagtacacagctcgtgagctaaagatttggattgctgaccctaatggacaacccgtatcccacaaacagaaagtgatgtttgatgcgacctctgaaaagcaagatgatagaaagcgaaatatcgtgatcatgctcaacggtacgggatttgatcgcaccgtatcttataaattaatgatgaaagacatcagcgatccgactaagacacaagagctacaacctcactccgtcacgatcgatatcgcgatagaagatgacttcttttaa

SEQ ID NO: 1486 - DNA, 2493 bp, Brachybacterium paraconglomeratum
gtgactgatctgacctccgtccaggaggcactccagagccgactcgcctcccaacgaatcgtgttttggcacgaccccactggtgagtacgccgctgacctcgacgcgttcgatctcgggcccgtcaacgtcatccgtgtcgaggacaacgagttcggagtaaagaacacgatcctcgccgatcacatcactaagcacctcatctaccgatccggtgacatccctcgcgggacagcgaactggctgctcgatctcgaactcgcctgcggggtcttcacggccgccaagacctccatgctccagcatgagcttggcctcaacgacccgaccctgctgccggtgatcgagcagcaccagaagttcttttctgtgaacagccgcaagcaagcgctgaaaaagctcctgaacgacggagacgacgcagcccgactgcgcgccaagatgagccaggtgctcatcaaagcgtcaggtaacaagctgaccgacatcgtgcgggaactcctggtcgagaacgccgccgggaagaacgccaagttcgacgatctcgtcaccttcgggctcgatcagttcttttgggacgggctcacgagcatctacaagtaccagagcacgacgccgacgatcgacgacttcgtcctgtggatgttcagccgcgccattgaggacttcacgtcgaccgccccggacgaattccgcaatatccgtagcgacttcaacgcccttcgctacgacgttcgcacccgggacgcaatgatgaagctcgcttcccgcgcggcggaagcgctggacgtgcagtcgaagatcgagcatcgcggctaccgtgatctggcgaagatcacgatcttcgaggagatcgaccgcaaggtgatcgtggacctcgccgccgccgtcgtcacccagtcggtgacgcctcgcgaggtggcggacatcgttcggcaacgccagcacagcctgtggagcgctaagtacaccaagctctacgaagccatccagagcgcctccgagctgctcgcggcgaccgctgcgctaccccatgccatcgcaagtgctgctgtcggactcgagaaataccagtccgactggttccgcatcgaccagcactaccgctggttcacctacgcccaccagacggctgacttccagaagccgctcgaagcgctcaaggccgaggtcgataagcagtacgccaacaaatacctctacgacttcggcgggctctggcagcaagcgcttgaacccctgagcgagtggaagtcagcggtgctcgctccgcaggcgaagttcttcgaccggcacgtcgcacctgtcgtcaaggacgggcgcaccaaggtggtcgtgattatctccgacggcatgcgctacgagatcgccgaggaactcgcctcgaagatccgcagcgaggaccggttcgacgcctcgctctcggccgtgctcggctcgctgccgagctacacccagctcggtatggcgtcgctgctaccgcagtcgaacctggaactcgatcccgagggtctgccggtgctggcggatgggaagccgacgaacggcaccacaaaccgcgacaagatcctgcacgcggtcaagggccacgccatcaccgccgccgaggtcctcgctatgccggggagcgagctccgcgagctctacacgaagcaccagatcttctacgtctaccacgaccgtattgacgctgcgggtgacaaggccccgacggagcggaccgtcttcgaggccgccgaggagaccctccgcgaggtgctccaactcgtgaagaagtggaccaacgcgaacgcgacgaacatcctaatcactgccgaccacggttttctctatcaggacacccccttggagcaggcgtactacgtctcggagactccccagggtgacgcggtcaccaagaccaatcgtcgctacgtgctcggccggtcgctgaagccgtcgccgtccttcatgacgttcacttcggtccaggctgggcttgcgggagcaatcgacatccagattcccaagtcgatccaccgcatcccgcaaccaggcgccggcacccgctatgtccacggcggagcatctctccaggaggtcgtcgtcccggtgatctcggtcaacaagaagcgcaagagcgacgttcgcccggtcaacgtcgacctcatgcccgagaccgacaagatcaccaccggccagctcgctgtcaagctgctccagcgcgaggccgtcaccgacaagatccattcgcgccaggtccggctcggcctctacgtcggtgacacgctgatctccgaccaacctgtcctcaccttcgacagcgcatccgacgatcagcgcgctcgttaccaaaaggccgtgctgtacctgactcaggacgccgaccagtacaacaaccggcccgccgagctgcgcctcgaggagccgatcccgaacacgacacaatggaagccgttctcgaagggcaactacaccatcaagcgatcgttctcgacggacttcgacttctag

SEQ ID NO: 1487 - DNA, 2598 bp, Salmonella enterica; identical to SEQ ID NO: 1426

SEQ ID NO: 1488 - DNA, 2526 bp, Eubacterium cellulosolvens
atggatttacaagaaatacaagataaattgaatgtgctttttgaaggttcagatcgcaagattgtcttttggtatgacgatgatgctgcttatgaaggagacattgattcattgcagttatctgcaggaataaaggttttcaagcttacaggaagcaataattttgaagcaaagctattactggagcatagagatgtagacagtaattgtctggtatatgctccatatgctcgtcctgaggataaagagaactctttagtagatattttctattattcagaacatttttattctgacaagctgatacagctgatgggcgagttgaatattcctccggaatgtcaggatgaagtaaagctttataagaagttctgggcaggtaataaccttcagaagtttaagagtcttgagatagagacatataccaatgagtctattgatttaggtattctttgcgtacttgcaggagttaaaacacttaactttgaagagatgcttagaaagacaattcttgcaggacttactgataacagcattatgaaaaaactggagactcagaaaattgaccgtgttttctggagattctgtgagaagcagtatggatataaagattcaaatccgacgattcaaaagtttcttgtaacgatgcttgttacatatatggatgctcagatgaatggcaatgagcctaagacttggaaaacctttgtttcgggcaagaagaatgatgctgttgttttcattaagaaccttatgaacaatgaggaatccaaagagttttatgatggatttgcaagtaaagctgttgatgagcttaatgtcgcaggccttatcacacagattccacttgctgatgttgtttcttcagatgcgctgaaagaatttgatgacaatattattgactggattgcagctaaacttgaggatcagatgcttgatgaaaagatttccggaatgacgatcccagaaatttgtgagacccgttcgaagagcggatatcatttttcaagcgtttataaagaaaagtaccagatgctcattgcggcatatcatgtactgaaggaggtttcactgcgtagatatcagtccacgatcaaagatgctgtggaagattatgtaggcggaacttatttgattgatacatattatcgtaagttctattactacttggatcgtatcggaatggacacgaatatggaaaagattagagatcttgttgaaaacatgtatacgaacaagtatcttacagacttttctaacaagtggaatcagcttcttactgatgaagaatatgatgcgtatacagatacccggcaggaagagttttatagtcaatttgtaaaaaaattcatgagtgaagctggcggtggacgagttgttgtaatcatttccgatggtatgcgatatgaatgtgcacgggaattgcttgataatctggatttagatgaaaagtgtgaggcgaagatagatcatatgcttggcgttttaccttcagagacaactctcggtatggcatcacttcttccgaataattctattcaggtagatggaaatctcgacatatatgttgatgaacttcattgtggaaatagcacagctgagagacagaagattcttcagaatattgtgccgaaatcagcatgttatgagtttgatagcgtaatgcaggctaaacaggctgaactacgcgaaatgttccaggataaggatcttgtttatatttaccagaatcagattgatcagcgtggcgaaggaatgcgttcggataatgaagtcttcaatgcttgtcaggaggcaatcaaggagattcagatcatgattcataggttgacgggatatgtttcaaatacacgatacttgattacagctgatcatggtttcatctataaacgggataagttacatgaaagtgacaagataaaagtagagaagatctcggcaagttataagaataagagattcctgctgtcggaagaacctatctcaaacgacgcacttgtaagcagatgtatggcatatcttgggaaattgaacaaagggtttgccaccacgcctatcggtgcggatataatcaggatgcctggaggaggacaaaactatgttcatggaggatcatctcttcaggagatggtggtgccggtactcaaggtaataacatttaagggtaaacaggaaacggggcttgtaaatgtggaattatcgagtttccatcatcgagtaacgaacatcgaagtcaagcttgattttatgcagatggaagcggtgacggatactgttaaacctcgtagacttcaggcattctttgtagatgctgatggagcaaagataagctttccggtacctattacagcaaacataaaatcggatgatgcaagggatcgcttaattcaggagaagtttactttgaagagtggtcgctacagccgagatcaagagtacttcttggttattgcggatcaggatgatgaaaagaaggagttgcacagatacaaatttgagatagatatctcagatttggcgtattaa

SEQ ID NO: 1489 - DNA, 2727 bp, Pseudoalteromonas luteoviolacea
atgaatttagaacaaataaaacaaggcattctagccaaatttgataaatgccgactagtcttctggcaagatgaagagattgagtttcaagagcaattaccggtaattgaaactgaatttgaatcatcaggtgtcgagcttatcaagttggatgaatattcgcactttgaagtcaagcaacgtgttgagctaaaagagcctaacactcaattcttgttatatagcaacaaggcgctaaacgaaccaacgcgtgattggctttacgatattcgcctttatgctgagcatttttatgctgattcaagctcaatgatattaaatgaacttggtatgcgtatggagtttcgccaagacattagccgctataaaaagttttttggtaatcagcaacgttacagcaaacttaagaagttattacctgaaggcgcagataagcaagcactagaattagcaatggttgcggtagttgctaaggtagaatccgttagttttacaaccatactacatcaattaatttcactatttgttgagtctccaaataagtgtgatgaagccattgccgaattagaaaaatatgatctaaccaagatattttggcgtcatgcagtagaagagtttggttatattgcgctgggtaactggataaatgatgaagatgcagacatgccagttgcaaatgttaaagacttaattactaaactgttagtaaccgattgttaccatggtttacaggcatctggcgtttcaattagtaaaacggactttgctacaagtctttctgcacatgtattaccacttactattgattccgaaagcttggacaagcttcccaaggctattagagagctaataggcaatgcagctgcgaagcgagcagctgtggttagttttgtttcttcttggcgcgagagccgtactttgtctgcatcgtacaacgacatagttagagaagtcgcagatgaattagaaataaaacacaagttagctgagtttaaaaatccgagtaacttcataaatgttgagaccttcattgaagttgaacagcagttgatcaaattaattgcgacagacttacaggcttattctgctaatgaaatcagtgattgggtgtcgactaaattatacggccattggtgcagtgtcgacaaaaattatcaatacctgttcgcttctcttcgcgctgcaaaagagttctacgacttaagagataagtactttgatggtttttatttcgacagtgcgaaggttctctataaagcatacgaatcagagctttataagtttgatcatgcctatcggattttctttgaaaacttcattaatttacgtaagaacaatggcggtgacttattacaaagtttaggtttagttgatgatattgaaaatctttatgtgaattggtacttgaatgacttagccatagcatggggtaaattggttgatagcgagagtcttcttgataattggaagattgtaggcgttcataatcaacaacacttttatcaacaagaagtgcgtggcctattaagaaatactcaagccaaacgtatttttgtgattatttcagacgctttacgctatgaggttgctcacgatatttatcagcgtatcagtgatgaagggcgtttaaagcctgagttaaaatctcagctaggtgttgtcccatcttatacccaactaggaatgggaagcctacttccacaccaaaagttaactgcgcatttaggttcaaaagtagaatacaaagctgacggtatttctgtacatggtcatgacaaccgtcaaaaggtgttgtccaagcataacggcgttgcttttaaagccgatgaggttttcaagtggacaagacaagcggctaaacagcaaattggtgaagctgaagttgtctatatttatcacgatatgattgatgccataggcgataagcaaagtactgaaaatcagacttttgaagctgcacaagataccgttgttgaattgatcgagttgataaagcggatctttaaccgtttaaatggtagtcgagtgctattaacagctgatcatggctttttatttaaaatgaccgatttaacggattcagataaaaccgctcataagtcaaaacctaaaggcgcaattgaagataaaaaacgttatgtcatcggttcaaatttgccttcagatgatttttattggactgggaaaatagccaatacagctggaattgaccctgctttaggcgatgatgcagaatttattgtgcctagaggtagtaatcgattcaattttgtgggcggtgctaagtttatccatggtggcattatgccgcaggagatttgtgttcctgtgcttcaagttcgtgagcttgatactaaagcacagacaaaattagctaaacaaaaagttggtgctgttcctttacagaaccccattaaaattgtttcaaatatcgataggatttcatttttacaaactgacccagtcggcgacaagtttaaagctcgtaagttggagctttggattgaagacccttttggtaaacaggtgagttctaaagaggagtatacatttgattcagtttcagaaaagctcgatgaacgtaaacgtaatattcaaattaaattagaaggcagcggctttgatcgcacaataagttataaattgataatggaagatactgagagtaaaaccaaaacaacacactccgttattattgatttagccttcgaagatgactttttttag

SEQ ID NO: 1490 - DNA, 2547 bp, Clostridium perfringens
atgaacttaaaagaaattaagaatttccttaatgatattttttcaaaaccattaggtgatggaaaagtacgtcatattgttttctggtatgatgaaaatgaggattttactgaagagatagatgaatttgatttagagggtgttgagcttattaagttaaatgataacaatgctttttatactaaatatcatatagaaaaagaaaatgtagatggaaatattctagtttattctaatatgaaaaaacctaaaccacaggaagattggctttatgatattttatcttatagtgaggaattttctacagatagagctactgttattatgagagaattgaaagttaataatccttatcttaaggaagcatttactttttacaatactttctttaagaataaggatagacttgctgcttttagaaacttaggtattcaagattatactgaggaaaaggttcatattggagttttagctgttttaactaagactaagattatgaattttgaagagatagtaagagctttaattaaagaaaaactagagggaaatagcaagctttatgaggatattgataagtttggaagtctagatatactttggaacttaattagtaagaactatggttatagttttgaagagagaagtttagagaagtttatggctgttcttttaattacaaatatgaatgaaactattaagtttaatttgccaaagcaatatgaagattttgtatcaaagaaaagtacagattgtattgtgtttataaatcattttatgaatagtcttaaagatagtcattactatgataagatgcagcgattaataggggaaaagattaaaatttctaaacttttagagaaaactgattcagataaatttttgaaatgtgatgtttttgaagaaatggataagttaatattaggtagaataatcaatttacttaatgatgggattgaagagtatgataaatatttaaatttaatggcttcaagaagaactcttcattattataaaaaatatgaaagtgaatataaagctttaaaatgggccataagattattatctaagaagaaagaattaaattccattataaaaacagaaagttcttatgagatggttaaatcttatgctaggaattactttgagattgataaagcttacaggaagttctattatcattttgataattgtgaactaaaggaaattttaaataacttaaaagatactgtagaaaatttatataataactggtatttacaagaactatctataaaatggagtgaagcattagctaagcaaaaaacttggcgaattgaaggtataaatcagcaagagagtttttataatgacaatattaaatatggtcgtaaagagagagtttttgtaataatatctgatgcacttagatatgaaagtgcagaagagctttctacaagacttagaaatgaaagaaaagctaaagtggaattagattatatgcaaggggtacttccatcttatacaaagctaggtatggctgctttattaccaaataagaaaatagaaataaattctaattatgatgttttagttgatggaataaattcaaatgggacagaaaatagagataaaatactaaaagttgaaaatgataaatccttagcaattacttataataagcttatggatttaaaagaagctgaatttagaaaggtattttcaggtttagaggtagtttatatttatcacaatacaattgacgctataggagatcatgcaagtacagagagagaagttttctcagctactgatactgcattaaatgaattgataaatcttgttaataagcttgttcatagagtaagtgcatcaagtattattataacatctgaccatggatacctatataagagaagtcatatagaagaatatgacaaactatcaggtgtaaagcttgaagatggagaggataatagaagattctttttaacatataaagatatagatatagaaggaacaatgaagtttagtatggattacttattaggagagtattcaggaattagtgtaataactcctaaaggtatagctagatttaaagttcaaggagcaggtgctaattatgtacatggtggagcaatgccacaggaagtattagtgccaataattagatttaaaaacgatagaagttcatcttcagaaaatgatattagaaaggtaaaaatatcattaacaagcataacaagaaaaataactaatataataacttatttagaatttttccaagatgaaaagattcaagataaagtaataacacaaagaataaagtgttattttgaagatgaagaaggaaatagaatttctaatgagaatacaataataggtgattcaaaatcagaaaatccaattgaaagaagttatagagagaagtttgtattaaagagtattccatatgataagagaaaacgatattacttagttattgaagatgaagatgattcaagtttacaatgtgaaaagataccatttaatatagatatagcaatagttgatgactttgggttttag

SEQ ID NO: 1491 - DNA, 2523 bp, Enterococcus faecium; identical to SEQ ID NO: 1373

SEQ ID NO: 1492 - DNA, 2658 bp, Vibrio cholerae; identical to SEQ ID NO: 1291

SEQ ID NO: 1493 - DNA, 2598 bp, Escherichia coli; identical to SEQ ID NO: 1225

SEQ ID NO: 1494 - DNA, 2304 bp, Vibrio cholerae; identical to SEQ ID NO: 1292

SEQ ID NO: 1495 - DNA, 2304 bp, Vibrio cholerae; identical to SEQ ID NO: 1292

SEQ ID NO: 1496 - DNA, 2517 bp, Fusobacterium ulcerans
atggaaattgaaaagataaaagagatgcttgaatatagatttagtctaactccagtataccctaaaaaaagacatataattttttggtatgataatgatagagcatttaaagatgtaatggaagaattaaggttagaaaatataaaaatcattattttgacaaaagaaatgaataaaaaaggggaaatgattgatactaatatatttaaaacaaagtatacattagaaatagcagatattgaatcaaattatttaatatatagtgagtatccaaagccaaaagataatgaaaattatcttttggatatagaattttattcagaattttttgaagctgataaatctgcaatgataatagaggaattaaaattagatagaacagattataaattaagtaaaattattaaagaccatttagaattttttgctagcaaagaaagaaaagaaaaattaaaaaaagtgataaatgatatagataatatgaacgaaaataaattaaaaatgtctatattagctagtatttctggatctaaaagcatagagatactggagatattgaagaatttgattataaataagaataaattagaaatagtagaaaaatggatgggactaaaatatctatataatcaaataaagaaaaaatttgatatagatgtaaataattttaaacaatttttaaaaatacttttagtagtacacttctatagggggatacaacaaaaacctcatataaatttagaaaaatattatataggtaaaacaaatgaaatttatctttttgtggaatctttattacaaaataatcaaattaataaaatgataaaagaagagttttataatctaagtctagagataaatataaaagatagaatagatgagttagaattagaaagcagtgttcaagggataggaattgaatattttgatcaaattgttattaaagacattgtagaaagattaactcttggatttaaagaatttgatatatatcaaaagtatattgaaataaggttagataatagtttatggcgagaaaagtatttctatttttataaagcattatttgctgcaataaatattcttagactaaaagaaacagtaacggttaaagaaagaagtaatataaatgaagtatttattgactatacaagtgaatattatatgatagataaatattatagagaattttattattcttatgataatgggaaaaataatgaactatatgggattttagacgaacttgaagatagaatagcatatttttatgaaaaagaatatttggaaattttattagaaatttggtctaatcatattagtgaaagggaaaaattgccacaacaaaaaaacttctataaggaacatataacaaaggctgatacaagagttgcagttattatttctgatgcactaagatttgaagtgggaaatgaaatagctaaaaaattaatgaaagaagctaatacaaaagaaataattttaaattcaatgattacagaacttccaagtataacttcaataggaatggcaaatcttcttccatttgggtcacagaaaaaaattgatttaattgaaaagaaaattttcataaaaaatataaatactttaaatactgaaaatagagaaaaaatattaaagcttagttgtggagaatcagttgctattacatttgataggtttaaaaataagagcagaggagaacaagaagaatatattaaaggtaaaaaagtaatatatatatatcatgataacattgatgctattggagataaggggaaaactgaaaatagagcatttgaagcatgccatataaccatagaggacataacaggattgtctaaaacactttctagtcttggaattgtaaatatttatataacaagtgaccatggttttctttatgagagaaaagagatagcagaatatgataaaattgaattaagtaatcaggaatattttagtatagggaagagatacgcattatattccaattatgtagaagaaaaagggtgtattactttaaatgtaaatgatttatatggaatatttcccataaaaaatcaaagaataaagagtcttggaaatggattacagtttgttcatggtgggataagtccacaagaaatgatagttccattaattcactataaaagtggagtaaattctaaaaaatcttcaaaggttggggttagaataaaagaaagtgtgtggaaaataacttctaatttaacaaaatttactatatatcaattagaacctgtaagtataaagggaaaaatcattgaaagagatattgttgctgctttatatacagagcttgggattaaggtaagtgatgaattcaaagttagattaaatgcaacggaagaaaattttcaatataattttagattaactttgagcggagagcataaaaaagtatttttaaaaatatcagatattgaaagtggagatattttagactcaaaagaatataatgtaaatttaggtattgcatcagattttgatttttag

SEQ ID NO: 1497 - DNA, 2502 bp, Roseobacter sp.
atgacggatcggatcaccgccagcctggaacggctctttgacgagcatcgcatcgtcttctggtatgacgacgcgcgcgatatgcggggggagttcgatgcggttgatctggctggggtgaccaaagtggaggtcgccaacaaccagttcggcctaaagcaccggatgctgcggcaggagccgaccgcgaagttcttggtgttccatgacgggccagagcccgggaatgcggcaaactggctgctggacctgcaactggcaacggcggtgttcaaggcggatcaagctggcatatggctgggtgagctgggcctgccgccacagttcgaaagcgtcgtgcgtgatcacatggagttttatcgctccaaagcgcgtgtggctgagctgaaacggcttttgcatgcggcagatacccagtcgcaggttcgactgcgcatgctggccgtgtgtgctggcgccgagggtgggcttgatacagtggtcgaggcgctcctgagcgaattagcagagggccgcgacgatgcgatgcggctcatcgagcgatctggactgactgaggtgttctggaagcaggttggcaatgcctatgactatcagccggaccagcccgatcttgaagacttcgcgatcgcgctcttccagtcggcctacctgcgggcgctgggcgaagatggaaagttgaacgccgaggctctcttggtcttccggcgttggaagaacaaccgccattgggaagaggcgttcgagacgctggctgcgcgctatcagggcttgctgaagatcccagaagacttgtccaagcgcgacttccgtgcggtcatggccgtcgaccatttcgaggaaatcgaccgacacatcattcggcagttggtgcatgctatgtcgacgcagacggtcagcgcgtctgaggtcctgaaatgggtgcgcgagcgccggcagagccattggtatggctcctatacggacatctatcaggcgatcggcttcgccaccgaattccagcaggctctagcagaggccaatctcgggatgacgagccctgccgagggggtgaagcggtatgtcagcagctggtacaagctcgaccagctctatcgcaaattcatctaccacatgcagcgcagtggccatgcctcgctgctttcggaactctacgaggcggtggagaaccgatacaccaatagcttcctgttgaagctgaatgacgcctggcaggatcaggttgccggactgaccgattggacaatcccaggttacgcacgccagagcgccttctatatcgaacaggccgcagagttccgccgtcgcgatcagaaggtcgtggtcataatttcggacgcactgcgcttcgaggtggccgaggaatgcctacgccggatccgagcactgaaccgatttgatgcggaactgaagcccatgatcagcgcgctacccagctatacacagctcgggatggcggcacttttgccgaacagggagctgtctttcgcttctgatggcagcggcgcgatcttgacgtgcggcgaaagcacacaaggccttgccgcgcgcgagaagcacttggcaacaggacgtgtaggcgaccgcgccaaggctctatccgcacgcgatgtgctcgatatgcgggtcgatgagggcaaagagctcttccgcgacaatgacgtggtctacatctatcacaacctgatcgatgcgattggcgataagctgcaaaccgaggatcagctgcccaaggccgccgaggatgcgatcgaggaactgaccaagctcgttcggaagctgacatcggcaaacttctcgaacatcctgatcacggcagatcatggcttcctctatcagcaccgagcgctggatgagagcgacttcgcggttgctgatcctaagggcgatgaaatcctgctgcgcaatcgccgcttcgtcatcggtcgtggcctcgaagaagctgcgggcgtgaagaaattcacctcggccgagctcggtcttgcgggcgacctcgatgtcctgatcccgaactcgataaaccgcctgcgcgtcaaaggggcgggcagccgctttgtccatggcggtgcgtcgctgcaggaaatcgttatccctgtcatacgtgttggaaagcagcgcgaggcggatgtgaaccaggttgaggtgcagatcatcgtatctggccgcagccaaatcacttctgggcagacggcggtgatcttctaccaagcgcaaccggtttccgagaagatgcaggcgcgcgagctggtcgcgggtatctatgccgccgatgacacgctgatttcagacgagcatgtcctgcagtttgatttcacctctgagaacgcccgtgagcgcgaaatgccccggaagttcctgctgtcgcgtgaggcggacaaattcaataaccaagatgtattcctgaaactgcgcgagcgggttggtaagaccagtcactatcaggactacacaagccatcgcttccagttgaaacgtggcatcacaaccgattttgacttttga

SEQ ID NO: 1498 - DNA, 2598 bp, Escherichia coli; identical to SEQ ID NO: 1391

SEQ ID NO: 1499 - DNA, 2565 bp, Paenibacillus elgii
gtgaatatggatgaagttataaaagctcttcaagaagccttccaacaacctctgaatgagggggaacaacgaaagattatcttttggttcgataaagaccaggagtttgctgaatacatacatgaagtcgccatagagaatgtcaaagttcatacgttgtctgaagggaatagcttctatacgaagtatctgctcgaagaagaagaagatccaacctcaaactatctaatctactcgaatctggacatggataaggatgaagacaactggctcttggatacaatcctttattcgaagaagttttatgcggacaaaacgtcctttcttatgaatgagctgaatatagatcctcctctaaggagtatagtaaagaaatacgagaaattcttcggaagtaaagatcggatacggaaattcaaggggtttgaggtttcggcgtttactgagggaactattgagctagtaatgatgagcgcgttgtgcaatctcaagacacctgatttcgaggatgttctgaaagtcgtactcatggaatcgcttgatgatagccagaacaaatacttggagctgatcgctaagtatgttggagtagatgttttttggaatacggtagctgtacggtatggctatgagcaaaatcaaaagtcactcaaaacgctgtttatccatttgaccgtcacggcactaagtcatgtgatgaatgagggacaccttttactgattaagaattacattgcattccgaaataagcctaatgcgttggtgtttattgatcactggatgcaccataaaaccgattatcttgtgtatgatcaatgcgctgaaatcgtcgagaaagaaatcaagttatcggatattgtgaaccagctacctgttgaggaattcaaggcggcagatacgttcccgtattttgataaagccatcatcatttacatcgcaaacagcctggaagagcggctggaggattatgaagcgtatacgaagctgattaaccttcgtagggcgaagcattactatgagcggtttcaatccatctatgaagctctttactacacggttaagatgtttgaattccataaaaagtacagtaggggcattccgaaaacgcaagcagtggacatgtaccgagcgtatgtgaatgactatcaccaaatggacatgttctatcggaagttttatgttgcttacgacaatgaatcgaatagcgaaatcctaaaaaagctcaaagtgatggtcgagaacttatacaccaactggtatatgagcgaattaagttcgcattggtccgccgctgtgcatgatgagctaaaatcaagctgggtactaccaggtattcaaagccaaaaggatttctatagaagctttgttgcgccaaaaatctataacggtgatcgggtatttgtgatcatttcggatgctctccgttacgagatagcggcggagttgacagataagctgaattcagaaacgacaggagcctgcgatattcagccattgttaggcgtgctcccttcggttacgaagatggggatggcatctcttctaccgcataagaacttggagatcgatctgagcggtaatgtatcggtgaatgggaggtcttcaagtggcattgacaatcggattggcattctgcaatctgtattagccgacagcacagcagtccatttccaagagctgaaggatatgaataaggcagggcgtagagaaacattcaaaggaaaaaaattggtatacatctatcacgatagtattgatgcaacaggtgataaagccgctacggaagtcaatacattcacagcggctgagcgtgctatcgatgaactgtacgctatcgtcaagatcattcgagatgacctaagcggtacgaacattttcattactgctgatcatggatttgtttatcaacgtgaagcattacaggaaagcgacaagatcgaaaaagaaggaattcctgcgttcgaagtcaaacggagacatctgttcacacaagaaaaaggtgaacgaagcggtcttcttgacatcaacatggataacctgattacaaacgaacatcagatcacgacatatgtaccgaaagcaacgattcgcttcaaaattcaaggagctggatcgaattttgtgcatggtggagccagccttcaagagatcgttgtgccactcattcaattcaagaatatccgaagtggacagaagaacagtcttgagattgagaaggtggatgtgaagctcacaaacactacaaggaagattacgaacagcttgtttaaccttacctttttccaaaccgagagagtggaggacaaacgagttccacgtacggtgaaaatatatatggtggatgaaacagatgtggtgattagtaacgaagaaatgttaatttgtgatcgcacttccgacaaaccagaggaacgaacatttaaacttcgttttgcactgaagtcgatgccgtatgataagaatgctagctactatctcattacgaaagatgatgaaaccaatgtcatcgtggagaaaacaccgttttcgatcaacttgggcattgtaagtgattttgatttttag

SEQ ID NO: 1500 - DNA, 2598 bp, Escherichia coli; identical to SEQ ID NO: 1225

SEQ ID NO: 1501 - DNA, 2508 bp, Pseudomonas mandelii
atgagtaaccccaaaatcagccaggccctgagcaacctgttcgacaagcagcgcatagtgttctggtatgacacgcgcctggagtttcgcgctgatttcgagacgctggagttgccggatgttgagaaaatcgagctggctaacaatgagtttggcgtgaaataccgcctcctgcgtgagcaaccggaacagaagtttctgctctaccgtgaaggtgctgagcctccgcatttgcacaattggctgttggatgtgcagctcgccagtggcaattgcttccgtaccgatcaggttgccttgtggctggctgagctggagttgggaccggattgctatccgttgttggaagcgcatgtggcgtttttcgaatcagccaagcgccgcgaggcactcggtaagttactagaaccgggtgattcgcagagcctgctgcaacgcaaaatgcttgctgtatgcgccggcaacgagccgcgcctggatgtgattctggaaaacctgctgggtgatctggccgctagcaaagatgtgcggatcaagttaatcgaaagcagctgcttgaatgtctatctgtgggagcaggtgaagcgcgcctatggctatagctccgagcaaccagggttgcacgatttcgttatcgagctgtttaaggcttgtttcatgcttgggatcgacccggcgtataaggcgcgactgtccgctgaggcgctggtgttcctcaaacgctggaaggacagtcgttcacatgagcagagtttcgaggcactgtctgagcagtgcgcggcggtgctgcagatcgacgacaagctgcaaaccctggactggcgtagcctgctggagctggattatttcgagctgatcgaccgcaagatcctcagtgagctggtacgtgccgtggtggcccgtacagtgaccgctcaggaggtggagcagtgggtacgccagcgccgtcagagccactggtttgagcgcttcaaggatgtgtatctggcgctggagcatgcggcgcagttcattcaggtactggacatcacgcagctgcaaatggagtcgctgactgatggcgtgcaaaagtacgccagccagtggttcaggctggatcagcgttaccgcaaattcgtctatcacctgcgcgaatccggccaggcttcgttgttgggtgagttggctatgcaggttgagaatctgtacggcaacaactacctgagccgtcttaacgaccgctggcagcagcatgtggatgcagctcagcagtgggaggcagcgcccgtagtattgcagcgcaatttcttcagccgctacgtgcagccttttgtggagcgaaaaaccaaggtgtgcgtgctgatttccgatgcgttccgctatgaggtaggcgaggaactgcaaagtctgattcgtcaggaggatcgcttcgaggccgagctggagccgatgctgtcgatgctgccgagttatacccagctgggcatggcggcgctgctacccaacaacaacctgcaactggccgacaacgacagtggcgatgccatagtcgatggtcagagcgctcaaggctcggtcaaccggggcaagattctggcgaccagggtgccagcatcccaggtggtacgagccaaggatctcctggcgatgaaccaggccgactctcgtgccttgctgcgcgacaatgaggtggtttacgtttatcacaacctgatcgacaagaccggtgacacccgtgataccgaagagcgagtgttttcggcggccgaggaaacgctcagtgagctgatccgtctggtgaagaagctgaccaacgcgaatgccagtaatctgctgatcactgccgatcatggcttcatctatcagaatcatccgctgcaggagagcgatttcctcagcggtgagccggagggcgatgaggtcctataccgcgaccggcgttttgtactgggtcgtagcttgcgcgaaggcgccagctttaaaactttcaacccggtgcagctaggcctgacgggaacgcttatggtgcagattcccaaatcgatcaaccgtctgcggctgaaaggctctggcagccgctttgtgcatggcggcgccaccctgcaagaggttgtgatcccggtcatccgcattaacaagaagcgccagagcgatgtgggtcgggtggaggtggagttcatcggtggcggtggcaagaccatcaccaccgggcagttggccgtggtgctctatcaaaccgaggcagtgaccgagaaactgcagtcgcgccggttgcgtgcaggtttgttcacgctggacggtgagctagtatccgatcagcatgagctgttgttcgacttcagttctcctaatccgcgtgaacgggagctgccggtgcgcttcattctcagccgcaaggccgatgaggcgaataatcagcaggtggaactgctccttgaagagaccgtggacggcacttcacacttcacacggtacaaagccgcgcgttacgccattcgccgctcgttcagcagcgaatttgatttttaa

SEQ ID NO: 1502 - DNA, 2658 bp, Vibrio cholerae; identical to SEQ ID NO: 1368

SEQ ID NO: 1503 - DNA, 2304 bp, Vibrio cholerae; identical to SEQ ID NO: 1292

SEQ ID NO: 1504 - DNA, 2304 bp, Vibrio cholerae; identical to SEQ ID NO: 1292

SEQ ID NO: 1505 - DNA, 1917 bp, Geobacillus sp.
atgtgggagttatttgagcaacatttcggattgcatcatttgaaagaaaaagacaatttaaatgacttactggacaacttattgtttcaacatttttcaagggatgctctttttgaaatcgaacatttgtcaaataagtattcttccacacggtcgaatatttgtgctttattaatcgatgattggatgcggggaacgaatgaagaaaaagaaattttggagtcttatattcgtacgacagaaagcacttggcaattacaacattatttacaagaaaaaacggctgaagaaatagaaaaagtgactacattcccgattatcgatgcgatattaattgaaaaagtacggaatgaattgctatacaaaactaccgatttaacggcttggaaagagagaattacatttagacaaaagacatactgggggagtaaagaaaaattttccggcttatatacatgtctgtatcatgcagtcaaattaaccgaatataaaacgaatttaaagcaatatgacagtcgtgaagacttgtacggacagtatattcattccttgcattatatcgatcaagcataccgtcaattcatgtattcttattccaatttattacaacgggattttattgattcgcttgaagacaaattgacaaattggtatgaaaatatctatttacgaaaactagcggatgaaacaaactattatttggaaaatgaacaaaaaacgagaatcccacttcaaagaagatttttcagaacaaatgttcagcctattttggaaaaagagccgacgaaagtttttgttatcatatcggatgcgcttcgatacgaggccggttacgaattatgtcagcaactgaaccaactggagtatggggaagcaagtatttcgccattatttgcgagcttgccgtcctatacacaactcggtatggcatcgttattaccgtttaaacaattagcgatggatgaatcgaaaaccatttatgcagacggcatatcttccttaggaattgcaaatagaatcaaaattttacaaaatgcacataaagatgctattgcatatcgttgggatgaatttgatcaatggacacaaacagaagcagatgcacattttaaagggaaacgattgatttacatttaccatgatgttattgatgctgtcggtgattcaaggaagtccgaacgggatacatatggtgcggtaggaaaagcaattaaagagcttaaaatgactgtggaacgtttatcacgtctgcaagccaaacgaatcttcattactgcagaccatggatttttattccaatatccgaaaatcgaagctgatgtaaaaatagaacctgtcaaaggaaccatctatgctagtaaccggcgttttgcaattggtaaaaatttgagtgttccgtatggtgcaataaaactgcaggaaaaagatacccctttaaaagatgtagaagtagtcattgccaaggggttgaatcggttcaccggcggcggaggttctcaatttgtgcatggaggcgcaatgcctcaggaagtcattgttcctctaattgaataccgtcgtacagaaaaggcggaaccggtagaagtaagtgtcgccgtgcttgataaggttattacaaactatcgttttacagtaagcttttaccaagaacaaagtatatccagtgatgcactacctcgtcaaataaaggcagcattttaccaaggaaatgaacgaatttcaaatgaagtaacgatttcattcgatatggttggtgcaaatcatgaacgaaccaaacaagttatgtttactttgatggaaaaatattatgcaatgggtgaattttgtacattaagacttgaaaccgtcaatgacaaaaaaactgaaccttacaaagaagaaacgtttataattaaaatgtatgaagctttgtattaa

SEQ ID NO: 1506 - DNA, 2598 bp, Escherichia coli
atgcaatttaaagaactggaatcagggcttcgtcaaaagtttaccgacaaccgtatcgtcttctggcacgacccggaacaacgcttcactgattcacttaatgagctggatctcgacaatgtcacgttgctggatatgcgtggcgtttctgtgctcgcaacaaaaaaacgactcgaaatcgacgagcctgagcagaaatttttactctatttcacctgtgaggttcctgctcgcgagcaggactggttactggatatccgcctctatagtaccgaattccacgctgattatgcggcgatcaccctgaattctctgggtatcccgcaactcggtttacgcgaacatattcagcttcgcaaagccttctttaccgttaagcgaactcagatcctgaagggatgggtcaccgagcgcgaaacggaaaactctctcgataagaaaatgctggcggtggtggtcggggccagtaccttcgaaaccaaagaaatactatttgctttggttcagcagtttgtcgcagcacggcagcaagatgatagcgcactcgagaacactttcgccgtactgacgaagcttggcctggatgaggtactttgggaaattcttcgccttgagttgggataccagtctgaatctccttcaatggaaaatctgcttctgaaactgttctgtaccgatctctgggcgcagggtgatgaagcacatcgtgactggttgagtaaaaatgtgctggctaccgcggctggtcgggcctcgtcactggcctttatgggggcgtggcgcaacgatcgtcgctataaagcagaatacgattactgtgcagaggatttgcagcagacgctccagccaaaagagcactacaactacagctcaccatatacactggcaaaatgtgaaaccttcgaggctattgaacaaattattatccgtggtctggtgacacagttgcaggaagagagcaccactctggacagagatgcgtttaaagcgttggtttcagagcgcagtgcgaaatactggagccaaacccgccctgagtatctttctatctggaatgctattcgtcaggcagaacgcttgctgaatttgcgtaaccgttacaccgacgggtttaatttccccgatacaggtgcgttctggaaggcctattgtgacgaaatttatcgcttcgatcagacctatcgtttgttcaatgaatatgctgcaccagtgcacagcaaaggggcgatgatcctgcatgaactggataaattcatcgaagagttatacagcaattggtatctgactgaactaagtcgcggctggaacaaactgctggaagcggaaaaccgtatgcaggcctggcagtttagcggcatacccctgcagcgcaatttctataaagagaatgttaaacgtcagtttgacacctcgcaggtcaaacgtgtttttgtcgtgatctcggatgcattgcgctacgaagtggcggaagagctgggcaggcatatcaactatgagaagcacttcagtgcagagctgcgctcccagaccggagtgctcccaagctatacccaactgggcatggccgcactgttgcctcatgagtcgttgagctatcttcctgataattctggtgtagtatacgccgatgggatgtccacttccgggtttgaaaaaagagccgctattcttgcgaaggtgaatggtgtagcgctgaaagcaaaggacttgcagaacgccaataaccaggaagtgaacgagcaaatccgcaacgcttccgtagtttatatctggcacgacactatagatgccatgggtgataaggctgcaacggaagataaaacgtttgaggcctgccgaagtgcaatcactgagctaaaagatctggtttcacgccttcgtagccgatttaatgccagccgaatttttgttaccgccgatcacgggttcctgttccaacaacaagcgctggtggagcaggataaaacgaagctggaaagtaaagccaaagacacgattgaagcgaataagcgttttattgtcggtcatcaactgcctgaaagtgaattttgctggcacggcaaactggctgatactgcaggcgcaagcgatgaaagtgaattcctgttacccaaaggagtacagcgtttccacttcatagggggggctcgtttcgttcatggcggagccatgctgcaggaagtgtgtgttcctgtgttgaagattcgcgcgcttgaaaagaaagcggctgagaagcaaccccagcggcagcccgtgcccgtcgttgcgcgggatcaggtgatcaaactggttaacagcattgataaaattggttttattcagacttcggcagtgaatgatttaaatcagccgcgcacgctgaatatctttatcgtcgatgaaaacaaccaggtcgtctccggcacggaaacagtatgcttcgacagtgataacgaagatatgggtaaacgcacccgcgatgtaaccatgaaactcatggggacggcattcaatcgtaaaaacaagtatgttcttatcctggagaatgcggacagcgcaacagagtatggtcgctacccgatcacgatcgacctggcatttcaggatgacttcttttaa

SEQ ID NO: 1507 - DNA, 2598 bp, Salmonella enterica; identical to SEQ ID NO: 1426

SEQ ID NO: 1508 - DNA, 2595 bp, Collinsella stercoris
atgaagctatccgatatacagcaggagctaatcaggctctttgacgaacaagacgcatcggctggcaccgtcgtggtgtggcacgacccggatggcgcgtttgccgaatccctcgacgcgctcgatctgccgggcgtcgacgtgatgcgcgaggaggagcacgagctgttctcgctcaagcgcacgctgaacggcgacctcgcgggccatcgcatcctgctctaccgaccgcgcccccgccgcctggagggcgactggctcgccgacgttgaggctcgctccaccagcttcgccgccgactacacctccatgcagctgcgtgaactcaacgcagtcgacacccacgagatgcgcgaggtgctggccgcccacaaggcgcagctcgcaaaaaagaccgtgctgcgcaaactcacgcgcttaagcgcctcttttgagcagccgcagcagctcgcctgcggcctcatggccatcgcgctcgacgcgccctctcccgacgcgcaggccatcgtacgcgcatacctcatcgcggcgctggcatcggatggagccgaggcgctcgcccaggttgagcgcatgggctgcaccgacgagttccaggcggcaatctccgcatggattggctatacaggcgacgcgagcgacttcatcgcgctcgggcggcacgtgctcctgtgtgcactcgccggcgctttgcccaacgacgccgcctcggtgctgcccgcagacgtgacctcgggcagcaccgcgctctgtcaggatatcgtgcgtggctggtgtcagagcgccgagcgggactccctgttcgagctcgcgcagctcgtggaggaggtcgcgcccgtcgagcagatgctcgcccaggtgccactcgaaaacctaggcgatatcgatgtgttcccctgcatcgatgcgctcatcttgcgccacctgttccatgacgtcgcagcgtcgcccgaaaacgcacccgctgcgctcgcactcgcccaagcacgccacagcacggcctggtatcgggagttctccctttgctatgacgggcttgaggcggccgcgcgcatgcagcggttccgcaatgagcacccgggcggcatcgacgctctttctgcagagcgtgtctggggcctctacaccggcgagctataccgcctcgacacgtggtaccgccagatgcacctcgcactcgggcgcgccctcatcagtgcaccatacgggctcgacgaggacttccgcgcatgcagcgatcagatcgagaacctctacaagaactggtttttcgccggcatttcgcgccggtgggaggacgccgccgaggacgggctgtctcgaaacggctatgttgacggcatcccacgtcaaatcgatttcttcatgagctccgtcgagccgattgttcgtgcgggcaagcgcgcctgcgtcatcgtctctgatgccttgcgctacgaagtcgccgcggagctggcggaaacgctcgagcaaaacaccaaggggacatgcgagctcgcttccatgcaggccacattccccagcataacctcgtgcggcatggcgtcgctgctgccctgcggacacctcaccatggatgcgagcgagcccgggcggctgcgcgtgctgctcgacggctcggaggtggctacgaccgccgcgcgccaagagcaactgcgccgcagcgacccgcacgccgtcgccatcacctacgactcactcgtcaacgagatgagcgcgagccaacgcaaggacctcgtcaaggacgcgcaggtcgtctacgtctatcacaacatcatcgatgcgatgggcgacaaagcacccaccgagcgcaaggtgttctcagcctgcgacgatacggtgaaggagatcttcggcttggtgcagctcatctgtcgcgagcgaatcgcaagccaggtcgtcgtcaccgccgaccacggctttctctataccgacgagccgctcagcacctcggagcacaccgtcgcggccgagatcgacggagacacgatcgtcgtcgggcgccgctacgccatcgccgagggcagcgcgcgctccgacgtcctcatgcccatcgccctgccgcacgcggaaggcaagctcaagggcttcgcgcctcggcgctgcacgcgcatcgcccgggcaggcgcgggcgagaattacgtgcacggaggcatctccctgcaggagctctgcgtgcccgtgctcacgttcaccaacaagcgagcgggcagcaagggttatgtggaaagcgaacaggcaacgctctcgctcatcaccaccgtcgacacgatctcgaacagcatcttcaagctggacctgctgcaagacaagcccgtgggcggcaaggttctccccgcctcgtacgacgtgttcgtggggaacgcatcgcgcgaacccgtaaccgacatcgcgcatgtcgcagccgaccgcacgcaagactccgcagatgagcgcgtcatccccatcacgctcaatatcaaaccaggtgtaaccgtgagcgagcaggagccgtatttcctctacgcgcgcaactgcgacatcggcaccgtggacaccttgcgcgagctgcgcatgcgaattgccttcgccccttcgtttgattttggatggtaa

SEQ ID NO: 1509 - DNA, 2598 bp, Glaciecola punicea
atgacttcaagaatctcaacagccttagagcgattgtttgcgaaacatcgcgttgttttttggtatgacaacaaacaagaacttcgtgaagattttgatggcttagagcttgataatgtcaccaaggttgaacttaacaataacgaattcactttgaagcacaaattgctgcgtgaagagccaaaaactaattttcttgtttacaaacaaggtaagcagccagagccagtaaaaaattggttgtacgatgttgaactttctaatgccatatttaaaactgaccaagccgctatttggttaagtgagcttgaattaacaagtgaatttaacgaaatagttgagaaacatactgccttttttgaagttgatagcaataataaaggttcaaaatctcaagcaacatctgatagcgacaacagaaaagcaactttaaaaagtttactagaaccagatgatacccacagtcgcatccgcttaaaaatgttagccgtatctgctggtacaaaacaaaaaggcgatgctcgcttagatgtcattttagagttgctgatggcagagaatgcagaaggtaaagcgtataagctcattgaacgcagtaagctcaatcaatttttgtggcaacaagtaacaaaccattatggttatcgatgtgacagtccgtcattaatggattttgtgtatgagttatttaagtttagttatttagctgagttgccaacgagcttgcaagggacaagtcatgtttctggagctgctaacaaagaaaagatgaataacaacgctttagtgttctttaaacgttggaaagacagtagaaagcaccaaaaaatatttgaaaggttgtcagagcaatgtgcttcggtcttgaatattgagagtgacctacagcatagatcacttaatgacgtgttggagttagattattttagagtgatagacctcaaagttattcatgatctggttaatggtgttgctaaaagaaccttatcccaaggagaggtggcactatggtgtcgtcagcgacgacaaggacattggtatagcgaatttgagttactttacgatgccgtggatgttgcgagtcaattttttgcactgttagatactttacaatttgacatgtctagtgcccaacaagcagtcgaacgatataccaatcaatggtttaaactcgaccaactttatcgtaagtacgtttatgcacttaaggtatcatcacaacactcattgcttagcgcattaactgagcaaatagaaaacttatacattaacaattatgtgcagccattaacgaatgcttggcaacagtatgttgatgcgatgggtaaatggcaagtgccgagtgtagacccccaaaattgtttttttaaaaagtatgtagaagctaagtatctgtccaagaataaaaaagtctgcgtaattatttctgatgcattccgttatgaagcgggtgaggatatggtgagccgtattcggcaggaagaccgctatgatgcaaaactcaatcacgccctatcagcaatgcctagttatactcagttaggtatggcctcgttgttaccccagtctacagaatatcctttacagttatctgatgctaaaactggtacggtattaatgggaaatttatcaacccaagggactgagaatagagataaaattttaaaaactattcacggtgagcgagcgagtgcagttcaagcgaaaaatatattagaaatgacgcaggttaatagccgagagttacttaaagataatgatgtgctttatatttatcacaaccgcatagaccatactggcgataaaatgcagtctgagggcgaggcttttgaagctaccgagcacacctttgatgatttaattaaactggttaaaaaactagcaagcgcgaatgtaagcaatgtcttaataacagcagatcacggttttatttatcaaaatagtaagcttgatgaaagcgactatttagagaaagatgttagcggtgacatcctttataacgacagaaggtttgtcttaggaaaaaaactaaattgcggcaagtcactaaaacttttcagtagtgaagaacttggattagcgggcgacgtccatgcggtcattccaaagggaattcagcgtttaagactgagtgggtcgggtagccgttttgtgcatggtggcgcgtcactacaagaagttattattcctattatcagtattaataaaaaacgtgccagtgatactcgcttagttaccgtagagctactcagaagtggctctagtgtgattactagtgggcagatatcagtcaccttatatcaagctgaagcggtcactgataaaacacaaggtagaatattgcgattaggtatatacactgaatcaggcaaattaatttcagatagccacacagtagaaatggatctgacttctgacagcccacgagagcgagaaatgaaactgcgtttcttgttaaatcaggaggccgacgctgcaaacaatacagaagtgattttgaagctggaagagcctgttaccgggactaatcagttcaaagaatataaacaactacgttataccattaagcggtctttcacgtctgattttgatttttaa

SEQ ID NO: 1510 - DNA, 2538 bp, Enterococcus faecalis; identical to SEQ ID NO: 1400

SEQ ID NO: 1511 - DNA, 2583 bp, Pseudoalteromonas flavipulchra
atgacatcaagaatctcaaacgccttagcgcgactatttacaaaacacagaatcgtattttggtacgatgacaagcaagagttgcgtaatgacttcgaaacgcttgagcttgaagacgttaaaaaagttgaaatcgataataatgagttttcacttaagcacaccttgttgcgtgatgactacaaatcaagattcttagtatacaaagaaggcgatcagccagagcctgttaagaattggctatacgacatagagcttgcgaatacggtatttaaaacagatcaaaacgcaatttggttaaatgaattggagctgccgagtgaatttgctgaaattgttcagcaacatgctgctttttttgagcctgaaggcaaaacaaaagaggccgcttcacaagctgaagaacgaagagcaacattaaaaaacgtaattgaaagtgacgatactttaagtcgtattaggttaaaaatgttggcgatagcaacgggcacaaagcaaaaaggggatgtgcgcttagacgttgcccttgaacgtttgattgccgaaaaagctgaaggtaaaacgtataagtttattgagcgctgtaacttgcatcattttttatgggagcaggtgaataatcattatggttaccagagtgatagcccatcagtaatggactttgtatttgaactgtttaagtactgttattgtgctgagctaccaagtggtttgcaaggtgtcagtcaggactctgatgcagctaaattgcaaaacatgactaataacgctctagtattctttaaacgatggaaagacagtagaactcaccaagaaacatttgagtggttgtctgagcaatgctcaaactcaatgaaaattgaagatgaccttcagcatcgctctctaaaggatgtactggatctggattactttagagtcattgacaaaaaggtgatacatgaattggttaacggcgttgctaaaagaaccttatcacaaggcgaagtagcgctgtggtgtcgtcagcgacgacaaggtcactggtataaagattttgagttattgtacgacgcagttgatgtagcaagccagttctttgcattgttagacacgactcaacttgatatgtcatcggcttctgaagcggttcaaagttacacacggcaatggtttaagttagatcagttatatcgcaaatacatttatgcgctaaaagcgtcttcgcaacactcgcttcttaactcgcttacggagcaaattgaaaatttatatatcaataactatgtacagccactaactaatagttggcaacaacatgttaatgatatggataaatggcaggttagtggtgttgatccacaaagccgattctttaaaaaatatgttgagaccaattacctaaacaaaaataaaaaggtttgtgtgatcatatcagatgctttcaggtatgaagctggcgaagaaatggtaagtcgaattaggcaagaagatcgttatgaagcaaagctaaatcacgccttgtcgtctttaccaagttatacacaattagggatggcctcgttgttacctcagtcaaaagagtacccactacgattagcagatagcaaaggcaccgtatttatgggcgaattatcaactcaaggtactgataaccgggataaggtgctaaaggccattcatggtgaacgggcaagtgcgattcaggccaaagagttgttggagatgaatcagatcaacagcagagagctgttgaaggcaaatgacatcttatacatttaccataatcgaattgaccatgctggcgacaaaatgcaatcggaaggtgaagcgtttgaagcgactgaaagaaccttcgatgatttaattaagctaattaagaaattagccaatgccaatgctaacaacttagttattaccgccgatcacggctttatttatcaaaatagtgcgttggatgatagcgattattcagcgaaggatgttgaaggcgaaattgtttataacgatagacgttttgttttaggtaaaaatctcagcgcggggagatcatttaaaacgtttactgccgagcaattgggcttaactggtgatgttcatgctgttattccaaaaggaattcaacggatgaggctaagcggctctggcagtcgttttgttcatggtggagcctcacttcaagagaccattatccctatcatcagtattaataaaaagcgctctagcgatatcactatggttgaggttgaagtattgcgcagcggctatagcgtcataactagtgggcagatatcggttattctgtatcaagttgaagcagtgactgacaaaatccaacctagaaagttacgtttaggtatatataccgaatcaggcaagctgatttcagatagccatacggtggacgtagatttaacttctgaaaatgcgcgtgaacgtgagatgaagttacgattcttactcaaccaagaagcggattcggctaaccatcaagaagttatcttaaagttagaagagcctgttgctggaacaaaccaatgggaagaatacaaacagttacgctataccattaagcgctcttttacatctgatttcgatttttaa

SEQ ID NO: 1512 - DNA, 2598 bp, Escherichia coli
ttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaacctgattacccagtacgttaaccaacaaacagaagacgacagcgaactggaaaacacgcaggcgatgctgaaacgccacggtctggaatcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgctctgcacccggaagatcattaccggctcagctcgccgtatgatttgcacgaatgcgaaaccaccctcagcatcgaacaaaccattattcatgcactggtaacacagctgcaggaagagagcaccacgctcgatcgggaagcctttaaaaaactgctctctgagcgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagagttaagccgtaactggaacgaagtgctggaagcggaaaatcgtatgcaagcgtggcaaatccctggcgtgccgcgtcagcagaacttcttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgatcgcagctcggcgtgctccccagctacacccaactgggaatggcggcgttgctgcctcatgaacaactttgttatcaaccgggtaacggtgacattgtttatgctgatgggctgtcgacctcgggtattcctaaccgcgataccattctgaagaactataagggaatggcgataaaatcgaaggaccttctggagttaaaaaatcaggaagggcgaaaccttattcgcgattacgaagtggtgtatatctggcataacacgattgatgccactggcgacacggcatccacggaagataaaaccttcgaagcgtgccgcacggcggtgactgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaagggaaagtggcggataccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacagcaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1513 - DNA, 2523 bp, Johnsonella ignava
atggcagaattaaacctgaaacaaattatagaccgcctgaatgcggaatttaccggggagacccggaaactggttttttggtacgatgacaaggcggaatttgccgaggacatggagacggtggagcttcagaatgcgaagatttaccatctccagccggataaccagttctatacaaagtattttctggagcgtgttgataagaccacgaattatctgatctatgcaccgttccccaaaccggatgtaagggataaccatctggaagatacaatgctgtattccagacggttctttgctgaccgtgcatccctgctgtcggttgacctgggtattgaggaaaagtacaagccggttattgagaagcacatcaagtttttcgccaacaaggagcgtactcagcggttctatgatctggaaattgagaactttaatgaagaaaatatacttgtcggcctgctgagtgccgtctgcaaggcacgtacctgctcttttgaggaagtcgtgcgcatcgtgttaacggatggtgagctggcggacaatgctctcttgcaggagtttgaaaaatacgatctgctgtctgcgttctggcagctttgtgagcagcattttggttacaccgatacaaaaccgagtttggaacggcttctggtaacgttgttcgttacttataccgggcgatatgtgcatgcagagtttccggcagcatggaagagctttgtctcctacaagtccggtaatatcatcgcatttctcgatagccttatgaacagcgtcctgtaccgggacaaatacgatgctttgtcggagcacgttgccaaaggactgaatgtccttcctgcatttgcaggaatgcgagtggacgatttggtggagtgcgacactttccttgctgtggatcaggtgctggtaaagtggctcattggcagacttgtttcggaagacattggtgcaatcgcaaacggacttaccattccggaactttgtgaaaaacgggtcaaaatgcactttggcagaaagacagggaagacctatcagatgctttccagtgcgtgcagcatggtgaaggaagcggattaccatgccgcagatggcttaaagccaatcatcgaccgatatcttgctgcggattacaatatggatcagcagtatcggaaattctactattattatgaccagctggagagtacggaaagttttgagccgcttcgggaactggtggaaaatatctacacgaacgaatatctggcatgtctgctccctgcttggaatgccggaatccagcaggatgccgcattttctgcaattccgttgcagcgggagttttacaatgccaacctgcgatatacaaaagaacgcacggtggtcatcatttcggatgccatgcgttacgaagttggacaggaattgtttgcccgaatgcaggatgacccgaaatgcacggcaaaactttctgtacagctgagtgtcctgccgtcttatacaaggctcggcatggcagcagttttaccgcataagacactggagatgacggatgattttcaggtgctggcagatggtattctttgcgataacctggcaggtcggcagcaggtgctgcaaaactataacccggatagtgtctgtgtgcagtttgatgatatcaaaaacctgaaagtggcagagctgcgagatgtgctgacaagacgtcagattatctatgtatatcataatcagattgacgcgcgcggagacaaggcaaacaccgaggacgaggtgtttaatgcgtgcgaggaagccgttcaggaaatcatggatttgatccatcgagtctccgtcagcggcaacacctatcattttatcgtcactgccgatcatggctttatttacaatcgtgataaactgacagaaagtgacaaaatttccgggaaaagcgcagaaaaagcatttgtcaatcgcagatttattgtgtccaaggcggcactggaagatgacggcatcgaccatatgagcatgggacgtgttctgggaaacaaggacagtaaggtggtttcctacccggttagcagcaatgtatttaaggtggccggaggcggtgctaactatgtgcatggcggttcctcaccgcaggaaatgctggtgcctgtgctggagtttaagatggagcgcggtcacatggaaacaaagagtgcagagattgctctggtcagcatcgttcataagattacgaacctaattacttccatggactttattcagtcggatgcagtcagtgatactgtaaaaacggcaaaataccgcattttctttctctcggaggaaaatgagaaaatctcgaacgaaaacagttatgttgcggacagtcgtgaggaaaatgcgcagaatcgtatcttccggatgcggttcacattcaagaataagaaatacgacaaggacaagcagtattaccttgtggtttatgacgaagaaagcggtctggagcagtggaggcagcctgtcatcatggacattgcctttgcagatgactttggattcggattctga

SEQ ID NO: 1514 - DNA, 2304 bp, Vibrio cholerae; identical to SEQ ID NO: 1292

SEQ ID NO: 1515 - DNA, 2304 bp, Vibrio cholerae; identical to SEQ ID NO: 1292

SEQ ID NO: 1516 - DNA, 2598 bp, Enterobacter sp.
ttgcaaaatcaggaatttattgccggccttaaagcaaaattcgccgaacatcgcatcgttttctggcacgatcccgataagcgtttcctcgaagagctgggtaatctcaaactggagaacctcacgctgctcgacatgaccgatcagtcgcagctggcggttaaaaagcgcattgaaattgatgagcctgaacagcagtttttgctgtggttcccccacgacgtgcctccaaaagagttcgactggctgctggatattcgtctttatagtacggagttccatgccgatttcgccgccatcacgctgaatacgttaggcattccgcagcttggcctacgcgagcacatacaacgccggaaggcatttttcagtactaaacgtctttctgccctaaagggactggtcactgagcaggaaaacgaagcttctcttgataagaagatggttgcggtcatcgctggcgtaaaaaccgcaaaaacggaagagattctgttcagcctgattacccaatacgttaatcagaaaaaagatgactacagcgacctggaaaacacgctggcaatgctgaaacgccacgacctggaaggcgttctgtgggacactctgaatcaggaaatgggctaccaggccgaacagccttctctggagaacctaatcctcaagctgttctgtaccgatctctccgcgcaggctgatccgcagaaacgcgaatggctggaaaaaaacgtgctgaccacgccgtcaggcagagcatccgcgctggcctttatggtcacctggcgtgccgaccgtcgctacaaagaagcctatgattactgcgcacaacagatgcaagatgcgctgcgaccagaagaccagtaccgtctcagctcgccatatgatctgcacgagtgcgaaaccacgctgagcattgaacagaccatcattcatgcgctggtgacgcagcttctggaagagagcaccacgcttgatcgtgaagcctttaagaagcttctgtctgaacgccagagcaaatactggtgccagacgcgtcaggaatactacgctatttatgatgcgcttcgtcaggctgagcggctgctgaatctgcgtaatcgtcatattgatggtttccactatcaggacagcgcaacgttctggaaagcgtactgcgaagagctgttccgctttgaccaggcctaccgcctgtttaacgagtacgcgctgttggttcacagcaaaggcgcaatgatcctgaaaagcctggatgactatatcgaagcgctgtattccaactggtatctggcagaattaagccggagctggaataaggttctggaagccgaaaaccgtatgcaggagtggcgtattgcgggcgttccacgacagcagaacttctacaatgaggtggttaagccgcagtttaacaatccacaaatcaagcgcgtattcgtgattatctccgacgcgctgcgttatgaagtggcagaagagctgggcaaccagatcaataccgagaaacgctttactgcagaactgcgttcccagttgggcgtgttacccagctatacccagctgggaatggcggcattgctgccacatgacgagatatgctaccaaccgggtagtggtgacatcgtttatgcggacgggttatccacctcaggtacgcctaaccgcgataccatccttaagaaatataaagggatggcagtaaaatcggacgatctgctgaaatggaaaaatcagcaaggacgggatcttattcgcgattacgaagtcgtttatatctggcataacaccattgatgccatgggcgacagcgcatctacggaggagaagaccttcgaagcgtgtcgcaacgcggtggttgaactgaaagacctggtgacacgggtgataaaccgtctccacggtacacgtattatcgtaacagcggaccacggcttcctgttccagcagcagcccctttccggccaagataaaaccacgctgcagatcaagccagacaatacgattaaaaatcacaaacgctttattatcggtcatcagcttcctgccgatgatttttgctggaaaggaaaagtggcggatacctcaggcgtcagcgataacagcgagttcctgattccgaaagggatccagcgtttccatttctcgggcggcgcgcgatttgtgcatggtggtgccatgctacaggaagtctgcgttcccgtattacaggtgaaagcgctgcagaaaacggctgccgagaagcaacctcagcgtcgtccagtagacatcgtgaattaccatccgctgatcaaactcgtcaataacattgataaagtcagcctactgcaaacccatccggtaggtgagttatacgaaccgcgtactctgaacatcttcatagtcgacaacgccaataatgtggtatccggtaaagagcgaatctgctttgacagcgataacaacacaatggaaaaacgcgtgcgtgacgttacgctgaagctgatcggcgcgaatttcaatcgccgtaatgagtactggctgatactggaagatgcacaaacggaaacgggttaccagaagtaccctgtgattatcgatctggcatttcaggatgatttcttttaa

SEQ ID NO: 1517 - DNA, 2523 bp, Enterococcus faecium; identical to SEQ ID NO: 1373

SEQ ID NO: 1518 - DNA, 2304 bp, Vibrio cholerae; identical to SEQ ID NO: 1292

SEQ ID NO: 1519 - DNA, 2565 bp, Bacillus cereus
atgaatacaaaagaaatagatcaagtcttacaagagacgttcaataaagaattaatagaaggaaagaagcgtcatattgttttttggtatgatgaagcaggtgagtttatcgaagatattgatgagctgaatttagaaggtgttcgtatttggaaattaacttcgcataatatgtttgcgactaagttggaagtagaaaaaaatgatgtgaattcaaactttttaatttatgcaaatatggctaagccttcagcaagagaagattggttacttgatgtttataagtatagtcaagagttttcgacggataaaatgactgtcatgatacgagatttaggtataacaaatgatgcagctttgcgagatgtgtttaagaaatatacgaaattctttaatagtaaagaacgttacgcgttgtttaaagcattttcagttccagaatatacagaagagcaaattgatcttactgtattagcatctttatgtaagtgtagtattgtgaatttagacgaagtaatcaagggattatttagagaacaactaaaagaaacgaataagtattgggagaacattcaaaagtttggtgatgaagagacattttggagtcttgtagagaaggcatacggctataacttacaagataagtcaattgattcacttcttattttcttcttattaacaaacgtgagtgaaacattaggcggagatataccgaaaacatggcaaccatatatttcagctatgccaatgaatgctattgtatttatgaatcaatttatgaatcatagtgcggacgaaataatttacaatgagctagcaaatacggtcgaaaaacgagtgaaggtgacagaacatcttcaaagtaaagaaataaaagattacataacatcagatacgtttagttgttttgacacaaacattattacttatattacaaaacaattagtggatgcaattcatgattacacatcatatatagaaataattgctgcaagaagaacgttacattggtttagtgtattccttaatgagtatgaagcactatatcaagcgattcagttatttcaaaaaatatatgaaatagataatgtaattgctgaatcacagccctttgatttatttaaagcatatgaaagtaaatattacactatagacacagcatatcgaaaattttatgtggcattcgaccaaattgaagataaagatggctttagagatcttcgagataaggtagaaaacatatatactaatgtattcatgaatgaattagcgataaaatggtcaaatgcacttgagggtgagcaagaagaatattggccaattgccggtctagagtcacaacatacattttatcgttcatttgtacaaccattcgttaataaagaggaaagagtgtttgtaattatatcagatgcactccgctatgaagtcgcgaaggaattatccaatgtattgaatgtggaacgaaaagcatcgactgatattgttgcgatgcaaggtgttctaccttcatacacagacttaggtatggcgacattacttccatataagtcaatcacttttaatgaaaacgctgaagtatatgtaaatgattacaaagcatcaagtacagaaaatagagcaacgattctttcaaatcattataaagattctacagctattcaatataaggatttagccgcaatgaatcgtcaacaatttcgcgatgtcttttctggaaaaaaagtaagttatatttatcataatgtaattgatgcacggggcgatcatgcagcaacagaacatgaagtgtttcatgcggtggaacaaacattgaaagatattcgttctttagtaaatcagcttattaataccgttagcgcatctaatatcgttattacggcggatcacgggtttatttataatcgagatacattgcaagctagtgataaagtaaaaaaagatttgttgaatactgatattgaaaagcgacgatttattatatcgagcgaatctgattctttcgaaggtacaatgaatttttcaatggactatgtgttaggtgaaggttctggaaagtatgtaaaagtgccacgaggggcgaatcgtttcgctgttcaaggtacaggagcaaactatgtacacggtggtgcaatgttacaagaagttgtagtgccagtaattaagtttaaaaatgatcgtagtaagtctagtaagaatgatgtgaaaaaagttgaagtgaaattaacaagtttaacaagaaagattacaaatagcattacatacttagaattcttccaaacagaaaaaatagaagataagaagacgccattacgcttaaaggtgtatttcacagatgaagaaggtaatcgaatttctaatgaaaatattatcatcgcagatagtcagtcttctaaaccagaagatcgtacgtttaaagaaaagtttgtgctaaaaagcatgacgtatgataaaacgaagaaatattatttagtgttagaggatgaggaagagacagttgaaaatatttatgagatagtagcgtttacgattgatatagcgattacaaatgattttggtttctag

SEQ ID NO: 1520 - DNA, 2523 bp, Enterococcus faecium; identical to SEQ ID NO: 1373

SEQ ID NO: 1521 - DNA, 2604 bp, Salmonella enterica; identical to SEQ ID NO: 1180

SEQ ID NO: 1522 - DNA, 2304 bp, Vibrio cholerae; identical to SEQ ID NO: 1292

SEQ ID NO: 1523 - DNA, 2304 bp, Vibrio cholerae; identical to SEQ ID NO: 1292

SEQ ID NO: 1524 - DNA, 1830 bp, Escherichia coli
atggtgacctggcgtgccgatcgtcgctataaagacgcttatgactactgcgctcagcaaatgcaggccgccctgcacccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagcaaatactggtgccagacacaaccagagtattgcgccatctatgacgcgctgcgtcaggctgagcgtttgctaaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcaatgatcctcaagagcctggatgattatatcgaggcgctctacagcaactggtatctggcagaattaagccgtaactggaacgaagtgctggaagcggaaaatcgtatgcaggcgtggcaaatccccggtgtgccgcgtcagcagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctcccaagctacacccaactgggaatggcggcgttgctgccccatgaacaactttgctatcaaccggggaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcatgccgcacggcggtgactgaactgaaagatttagtcaccaaggtaatcaaccgtctccacggcactcgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtagatattgtcgcttaccatcccatgattaagctggtgaataatatcgataaagtgagcctgttgcagacgcatccggtgggcgaactttatgaaccgcgtatcctgaacatttacattgtcgacaacgccaacaatgtggtgtcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1525 - DNA, 2598 bp, Salmonella enterica; identical to SEQ ID NO: 1426

SEQ ID NO: 1526 - DNA, 2547 bp, Bacillus cereus
atgaatattatagaagagttacttcgactgtttcatcaacaacaggaagagcataatagcacgaatcgttcactggtgttttggtatgatgcacaaagtgaaggacgtgatgtgacagaaatagaagaagcactcaaacgtgaaaatattcaattgcattatttagacgaacataatgctttccgtacaaaggttttattggagaaagaggatacgaataattcgtatttaatttatgccccatttccaaaaccagaggatcgggagaattttttattagatattttgttatatagcggaagttacggtgagtttcaagctgatgaggttgcgattcgcatgaaggaattgcgtttggatcaccttgcaattcgaccatttttagaagagcatacgaagttttttgagaataagcaacgtatagcgaagttccaaaaattacttcctaataagtcgacagttgagcaagtaaagcaaacgatgctggctgtgttatgtaatgccaaaagtattacaccacaagatattttaaaaagtgttgtagctggtggaagtttatctgatacaaatgaattgcttgaacaagttgctaagtatttggatacagaagtattttatacgttcatagaagagtatttcgggatgtctaaagaagacaataatcgtctagctcaaattatagagacgatcgtgttccagcattatgctgcatatttagatgagaagttattagcatttaagtatgagtcaacagttccgaatatatgtaaagtgtttgttgaggattggttaaagtctgaagaaagaaatgtactagaaggaattttagatatattagaacaaaagtggaatgtaacacaatcagtggatcagtacacttatcaagcttttcttcgatgtgacacgtttgcagtagtagagcgcaaaattcttgatgttttacatgagcttcttctaaatgaaacgatagtggtaacagagtggaagagtattttaactgagcgaagtaagagttattggtataagactcgttttcataaggagtatgaactgttagaaaaggcactccgtttgtatgagtggaaagatgtatttgagcgtaatgacattccgaagaatgaagaagaatgggttacgatttatacagataaatattataatatcgatcaagcgtatcgtcattttcaagtacattatgtaaatgagcctaatttagacgaatatagtgagttattggagcgattaacgttttggtatgagaatcgatatttagtagagttaggtcgttatacagatgagatagtagaggctaaattaaaagagaactggccaattactgatgtaatgcagcagaaaaacttttatcgttatatgatccgtccgcttgtggaagggtctagggagcgtatttttgtaattatttctgatgcacttcgctacgagattggacaagagttaacaaatagctttagtcagcgattgaatacagaagtaaggttaattcctatgcaagcatcattgccgacgtatacacaactcggaatggctgcattgttacctggaaagatatctaatattgcaagtgatggtactgtatatgtagatgaagtttctacaaaagggttacaaaatcgaaataagattttacaatcgcgtgaaccagattccattgcattaaaaatggaagattttattggtttaagtaaggaagatggtttaggatttataaaaggaaaacgtgttgtctatttatatcatgataatatcgatgcgattggtgattctggcaaaacggaaggttatacgtatgaagctgttgaaagtacgatggaacgtgtaaagattgctgttcgaaagctgactggtacgtatgaagctggccgtatttttattacaagtgaccatggcttcttatatcaatcttcacaagtagaaaaacatcagaaaacagaaagtataaaaggtgatgttttcgatagtaatcgtcgatttgctattgggaaagatttaatagagcctgaaggaacagtgaaaatttctttaaaatatttaggattagaacaagaagcggttattgccaaaggattaaatcgctttactgctggtggtggactacgctttgttcacggaggagcaatgccgcaagaaagtattgtgcctttaattgagtaccgccagttaaaaggaaaagcacgtaagacagagaaagaacttgtagatgttcgagttacttctattcaaaaagtcattacaagttatcaatttatcgtgccatttttccaagaagaaaaagtatcaaatgagttatatccacgaacattgcgtgcagcattttatcgtaataatgaacggatttcaaatgaattaacaattttgtttgattctaaaggagaagtagtagagcgtcaaacagatgctgtattccatctgctagaagatcgttataaaacaggtgatgtttgtgtactacgtttagaggatgtttcgggacgtacgacagaagtgtacaaagaagaagagtttgaactaaagttatatagtatttaa

SEQ ID NO: 1527 - DNA, 2499 bp, Lactobacillus rhamnosus
atggcagaggtagagatgaaggatgtcgtcactggcatcgagaaattgtttaaaagcgggacgcattttgtcttttggtatgacaaaaatggtgagtttgctgaaaacattgatgatttggctcaaaaacttaatgagccagtcgtggtgatggcggcgcggacgcaactacagacgaaactcaagcttataaagattgaagaagctggtgaaaaggcgcttgtttatgccaactttgctgaacccgatattcaccaaaatctcttgactgatatgattttatattcgaagaagtttacagcagacatgaatgttatgttgttgcatgagcttggattaccggagactgagcttagttttgttgaagaccagcgtaagttctttggtgcaaagccccggattgcgcgattcaagcaacgttaccagcatggcaaaaatccagagcaagtggaattggccgcaattgctaagacgtctgatctgcagctttcaaacattttgattgaagttattaaaaatccttctttattgaacggtttcgacaagtatcaattattgtcaactttctggagctttgtcgatcgggcgtatggttaccacggcaagcatgaattacaagatctattggcgacaatgatgattaactttgcctattatcagatggagctcgacttgccagcaagccttcaaagttatgaggttagttatatcaacaatgtcgtatcctttatgcttaattggcgtaatcgaagggatacccgagcggtttacaaaaaaatagccacagacgtttggcagcaccttgatggctatcaattgttcaagagcttaaagatctctgaacgcttaaagacggatacctttattcagtttgatcaacaagttgtggagtggctggttgagcagcttctgcaaggccatcttggtgaagtgattgaccaaatgagcttgcctgagattgctggaaaacggtgcaggatgtattttgctgaagagaatcaacttgcttatagtatgattgttcaggcccaccgcattttgacgaaacgcgaacttcacgatactggcaagttagatgatcttattcatgcctatatcactgacggttatttgattgataccgcgtatcgcaaatatacgaatgcttcggaccaattgcctacatctcaagttgaagtgtttgagaaattgtcacagaaggtcgaagctgcgtataacaatgattatcttgctccagcgattcatgactggtgccaagattatgtgccaaatgtagttgagccaagaacccttgagcggaacttctattcttctgtcgtagcacctaataaagatcgggttgtagtaatcatctcagacgcctttcgatttgaggcggctaaagaacttcaagaacgccttgattcgcgcgatgttttcggaaccgacatgcattatgcgatcacgggggtgccttctgtcacttactttggcatgccatcactattgcctaaccagaaactgacatatcaaggcgacaaggaattattggtagatggtaagaaagctgtcaacctagaacaacgcttagagattctccaatctttagagcctcaaagtcgggccatgcatttgaaggattttatctcaatgagcttggcagatcagaaaaaatatatcgttaaccaaaaagtgatttatttttatcacgatactgttgacgcaaccggtgataagcccgcatctgaagcgaacgtttttcgtgcagttgatgatgcgattgaagaacttacacgcgcaattgaccggttacgtaatatttccattcgaaatatttatgtaacagctgatcacgggtttatttatcggcggcatttgcttgattcaacggataagatcagtttgccggctgaggtggatttcgagcagaagaacctgcgttatgctattggttcacaggattttgacgaaatcggtgttggtcgtgtcaagttaggggacatcttgaacaatgacgatgagcgaatggttttctatccaagcaacgcgaatgtcttttcggtccctggagccggtcaaaattatgtccacggtggctgttctccgcaagaaatgatcgttccagtgctacatgttttgacggaaagcagaaagtcgcaggcaacctatgttacgttatcggttacagattccacccgccgtatcacgagtcatgaggtgatcgttaacatgctgcaaaatgaccctgttgatgagacacatcgaccagctacttatgctctgtactttgtagatgggagtgggcggcacatttccggtgaacaagttgtccaagcagatagtacgtccgtcaatgttaatgatcggctgattcgtaaacatatcccgctcattgatcaagactttgatcgcgcaggtcactatcagctaatcattcaaaatgttgaggcgaatacaacaacttcaatcgactatcaaatggatctcactgtagagggagggtttgactttgacatctga

SEQ ID NO: 1528 - DNA, 2427 bp, Haloarcula japonica
atgggagatctcgcggacagcatcatcacggaacttcgacaaaaattcgaccgacacccggtctgggtgtggtacgacgcccaggagaagtacaagggcgtcctcaaccaggtcgaagctgaactcgacgatgtcacattggctcgctacgacggcagttacttcgagctaaagctccgtctccgaaacgaggatccggactacgagaagaattggttgttctatatccccgagtctcgaaacgacgccgagtggttccgcgatgtccacgcgcttggccgacagtaccgcgtcggccaggacatcgacgacacaccggtaacacagttcctcgtcgaacacgacgaagagatcccggacgcttacgaggactggggacagaaccgcgaataccaacgactggcgttcttttgcgtgctcttcgagactgtaggcccagcaatcgacgagtgggtccgtgactatctcactgatcctgaggaataccgcgaagacatcgaagataacgcgatggctgatgcctgggatgcacagctccgcgaggagtacggcatcgatgctggactggacccgaaagaactggcgacccaactcctcttcggtgaggtgacgagtcgtgctccagcggcacagtacgataatctcgccgcgaatgacgcccaagcagcggcgaagttctgcgacgattggcagcagtacgctcccgccgatttcactcgctattcacgggagatcgaagctgactacgatctcacagaggctgtgatcgaatccgatcaaacccgatggaacgctactgcgttcaagggtatcgacactggtctgattcggctcgtgatggatcgacttgctgaggaaacgtatgccgatcttccggagatcgcggcggaactcaatcggacagttacgaaacgtcgggacagcttctggagcaacgaggatctcgttgattggtcggtgcctgctttggcagtagagacgcttcgtcagatcggtaccgtcgatgtcgacgacgcgaaagcgatgggttcgatggaactcgcaggacagtacacgagtgacgatggctggtggcaggttgacgcagcctatcggcgttacatcaacgcgacccagaaagccacattcccgtacccaaaggaagccacggtgaaacgccaggtcactaaccactacatggccttccttcagggcgtcaaccggcctctggcagagattttgagcgacgatccgacactcggaacgccacagacctcgttctacgaggaattcgctgaggtcgaagacggaacggcgatcattatctgtgacgggctccgctacgaacttgctgaagccatccgtgaaaatcttggacgaagaaccgacttcgaacaggatctctccgcagtgagtgctgcacttccgtcgatcaccgaggttgggatggctgcacatctaccgggtgaactcggactctcgctcgacgacgacgaactcgtcgtcaccagcggtggtgaggaaatggctggaaaggccgagcgcgtcgaacgactcagtgctgcgggcttcgatgtcgtcgatatggacgaggtgggcgacatttcactggaagagctgaccgagtccgaccccgttccgcgtgtcgtctactccggtacgatagacaaactcggcgagagtcttgacgacgatgctgcattcagccaggttgcgtctcacgtcgacgatgttgaacggactgtccagcgtctcaaacaggccggctatactcgcttcgtgatcaccagcgatcacgggttcctgtatacggaccggctgaatgacgatcacaaagtcgaggcccctgaccttgctccggtcgtcaaacgccggttcgctgctaccgaccgtgaaacgccacttgtcgatactgatgagttcgtcgaaatcggtcacgaggcactgtcgaaactcggcattgatggctccgagatcaagttgctattcccccgtagtgtcgcgtgcttcaagtcacgaggtgggaatatgcgctacttccacggtgggatttcgcttcaagaactcctagtcccgtgtctcactgtaaccacgggcgaaatcgaagagagcgcgtcgatcagctacgatgtctcgatccctgatccgattacaaactccatactcaccgtggagattgaggccaagagtgggcaagtcgccttcgaccccgcaccaatattagaggttcgtgcaaccatcgatggtgagccagtcgcagatcctgttacgatggagatctcccctggcgacaatagcacccgtgttcggctcaaacagggagccatctcgggtgaagatatggtccaattcgaagtcgtcgatactgacaccagagagacgatcacgagacagactgtgagcctagatttactcttcggagatgacgatatgggatttgacgtgtga

SEQ ID NO: 1529 - DNA, 2499 bp, Lactobacillus rhamnosus; identical to SEQ ID NO: 1527

SEQ ID NO: 1530 - DNA, 2598 bp, Salmonella enterica; identical to SEQ ID NO: 1426

SEQ ID NO: 1531 - DNA, 2625 bp, Vibrio tubiashii
atgaatctgaaccagcttcgagagggccttgagcaggccttctacaaagagaaccatcgcctggtgttttggtatgacccggagcagtcatttgtggatgagctaccgtccctgtctctcgtggacgtgcagatcctcaacatggccaatgaatcagcattgggtaccaagctcaaactggagttggaagataaggccggtaagtatctcctgtacttcccatttgccgagccagatgtagaaaaggactggctgctcgacatcaagttgtactccagatgcttctacgccgaccgcttctcaatcatcttcaacgagcttggactacaccagcaaagcttgagagagcacctcgctaagcgagacaaattccttgccaacaaagcaaggctgacggcactgcaacgctatgttcagccggactttgatgagtctgatctggacatggccatgatagcttctgtggtgaaggcggaaagctgtgatctccctcatgtgatcctggcgcttgcggaagagacggtatcggatgaccttggcctggaggccaaccccgcttcaatcaatgaacttgaaaagtacgaccttattccggccttggtagctgcgcttcagtccgaaattggttacccggctacggtagaggagctgaagggagaagcacagttcaagctggggcatttcttcatccggctgctggttaccggcttctgcgagagcgtcggtgatgttcccggctgggctcaagaattggtaatgtcttcggccagctcccgtgcgacggccagagcactactttcacgctggcgagacagctctcggtattacaaggcattcgatgccgtgtctgggtgggtggcgatcgcgctgcggatcaaagacaagatgggtatattcgataccgaccaacttagcgatgttgttacctttgaggccgtggagcagaagattattgtcgatctggccgtggccatccctcatgctcccaagggggagttggaacgtttccgcgcaatgatcgcgtcgcgcctagacggctactgggcttccaagcataaagacgacacgacgcgccggaagtaccgcaccgtttataccgcattgcaggctgctatcgacctcttcagcttgcgtattcagcatgatagcggattccactttgagtcgagtgaagcgctatacaaggcttacgagcgagacctataccgcttcgatatggcctaccgtcattactgtgaagcgtcccagcgtgcgcatgtagagatcctgaagaagctcgatgacgaagtggagaattgctacgcctactggtacatcgacaacctggcgaagaactggggtgaccgcgttgaggtggagcagcgtctctctcagtggcgcttccctggaatacctaatcagcaggacttctttcagggactggtgaaaccgttgttttccaaggctacaaagcgccgggttgtggtcattatcagtgatgccttccgctatgaggcggcagttgagcttcgcgatcggatcaacgacaagcgctactctgaagctactctgtcttcccaacttggcgttgtcccaagttatacgacattggggatggcgtccctcttacctcataaaacgctggagtaccgtgaaacagcgtcagatgacgtgtttgtggatggccaatccagtaagggcacagcggcaagaaccaagatccttgcagcgcatggcggtctggccgtgacagcagaaaccgttaaagcctggtcgagggatgaaggccgggaagctctcaaagatcaggagctggtctatgtctaccacaatgtggtggatgcccgaggcgatagctcatcgacggaatctgaaaccttcatggccgttgaacacgccatcgaggagttgaccgagttgagccgcaagatcttgatgcacttcaacacgtcgacggtgctcatcacggcagatcacgggttcttatttcagcaaagtaagctggaggctgccgatcgctcctctctggctgaaaagccaaccaatgccctgaagaacaagaagcgctatgtggtgggctttggtctgccagacaccaaagaagcctggaagggttctaccaagtcaacagccggaacagcttcagatacggatttctgggtaccgaaaggggccaaccgattccatttcgtgggcggttcacgttttgtccacggtggggttatgccgcaagagattgtcgtgccggtattgaccgtcaaacagcttcgtggcgaaaaagccgagaagcgtaccaagcgaaaagtaggggtcatttccaccaagtccaccctgaaaatggtgaacaacatccagaagttcgacctgatgcagaccgaagtggtcagtgatttggttacaccggtcacggtgtcagtggccatctacgacggtgatagcaagatctccagcgaagagacggtgacctttgactgtgcaaccgattcggtcgcggagcgggtcaagcaagtacgactctcactgtctgggacggacttcgatcggaagaaggattacttcctggtgctcaaggacaaggacctgaataccgagatggagcgctataaggtcaccatcgacctggcgtttaccgatgacttcttttaa

SEQ ID NO: 1532 - DNA, 2304 bp, Vibrio cholerae; identical to SEQ ID NO: 1292

SEQ ID NO: 1533 - DNA, 2304 bp, Vibrio cholerae; identical to SEQ ID NO: 1292

SEQ ID NO: 1534 - DNA, 2598 bp, Salmonella enterica; identical to SEQ ID NO: 1426

SEQ ID NO: 1535 - DNA, 2598 bp, Escherichia coli; identical to SEQ ID NO: 1391

SEQ ID NO: 1536 - DNA, 2508 bp, Lactobacillus reuteri; identical to SEQ ID NO: 1242

SEQ ID NO: 1537 - DNA, 2304 bp, Vibrio cholerae; identical to SEQ ID NO: 1292

SEQ ID NO: 1538 - DNA, 2304 bp, Vibrio cholerae; identical to SEQ ID NO: 1292

SEQ ID NO: 1539 - DNA, 2598 bp, Escherichia coli; identical to SEQ ID NO: 1222

SEQ ID NO: 1540 - DNA, 2523 bp, Enterococcus faecium
atgacagatataaatacgcaacaaattgaagaaaaattaaatcaacgttttcctaattatggatgtaggaaaatcattttttggtttgattcaaatcaggattttcttgaagaaattgactcattggtcattcaaaatgcaaaaatctatcgattagaaaaggacgcacaatttaaaactaagcgtttattggaatatgaagatcccgaaactaactatttaatctatgcgccatttcctcgttgggatgataaagatgaagataatcatttgttgagtgtattgaattattcagaggaatttagtgcagaccgcttagcgattatcatgaatgaattggctattccacttagatttcatcagacagttaaacagtatcgtaatttctttaatgcaaaggatcgcatgagaagttttggtgaatttagtacgcatatgacaattaataaatcagaaacgattgaattaatgataatggctgttttgttgaaatcgaaaagtattcgattaaatgatttactgcgtgtagttctaaaaagctttacagaaagtagggagaatcctttaagggaacttgataagtatcagttaacagctaaattttgggaatttattcaaatgaaatttggctttacggatagccagccaacattggaaaagctgacgatgtgtctttatttgaactatttttattatcaaattgatcaagagatgccgaagaagttcaaaggatttgaaatactacatttgaaagcaaacattattactttcatggatcagtttatgaatgatacacgttacatggaaagctttgaacagctatctaaaaaagtatatcaggctattgatggtgatggattattagacagtatagaaattgatgatctaattgaagcagacgtattttctgagattcatgcaaaaatattaatgttttatgcagaacgattaaaggcttctgacactacaacgaaaattgcaggacaaacaatttttgatagtttaaagcagcgcgaaaaaatgcatttcgcatcggattatacttatgagtatcaattattgaaacatgcttattatcttgtggataaaaacagattgtgcttgccgatgaacatggataatttgctaactcaatatgagaaggaaatgtattgggttgatacgcattatcggaaatttatttggaatagtgatcatatagaagaaaagcaaaaatatggccaattgtatcgattagttgaagcaaattattcgaagtttcttgatcaatcaggacaaatttggaatcaaacttttgaatttaagaatcgtccatccattcgaaaattttataatcaagctgtaatgaaacgctctgttaaaactgtagttattatttcagatgcttttcgatatgagttagggatgaatttagaacgtaagttagttagagaaaagaagtattcaacaaacatggctagctttctttctgtattaccttcagttactgaattcggtaaagccgccttattaccaaacaatcaactaacttacaatgaaggaacagaagtactgattgatgggaaaaaaacgaatggtttatccaatcgaaatgcgattctccagcaacgagatgcaaatgctgtagctttaaattatgatgatgtggttaagatgaataaggctgaggtacgagaagtatttaatggcaaatcagtcatttatatttatcacgatcaagtggatagaacaggtgatcactcgaatgaaaatcgagtttttgaggcctgtgatttagcgataagcgaaatttcccgacttattaatcgcttgcataatgatggcagtatctatcgttttatagttacggctgatcatggatttatttataaaagaagccacgttgaagaagtagataagattgaaaatccatctagaaatgaaaaagatcgtgtagaacgtcgttttattcttagtgaagaagaatacgaaataattggtacgaaaaattactctttgggagattctttaggaaatgatgacactagaaacatttgtgtcccgattacttcaagtatttttaagaaagctggcgggggacaaagctacgttcatggagggtcatctattcaagaaatgctagtccctgttctagaaattacggtagccaaaggtagcaatgcaaaggaaccagtagcaattgaattaatgactagcaaccgcagaattacaggattatcaaccacgttagaattctatcaaaaaaatgcaattagtgatgtttatgaccccgcatctttctggctttattttgaagatgaatatggtgaacgtatctcaaatgaagaaatctatgttgcggattcaaaaacagaagatgcaaatcagcggtttactaaatttgtttttgaatttgtaaatcgtcgatatacagttgaagatacttattatttagtgataaaaaatcaaaaaaatgatttgaccgagcgaataaaattcattatagataatccttttgcagaatcatttgattttgatatataa

SEQ ID NO: 1541 - DNA, 2304 bp, Vibrio cholerae; identical to SEQ ID NO: 1292

SEQ ID NO: 1542 - DNA, 2604 bp, Escherichia coli
gtgaacttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgagtcacagctggcggtgaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaacttggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacaccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcagaccgccctgcacccggaagatcattaccggcttagctcgccatatgatttgcacgaatgcgaaaccaccctcagcatcgaacaaaccattattcatgcgctggtaacgcagctgctggaagagagcaccacgctcgatcgggaaacctttaaaaaattgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggagcgatgatcctcaagagcctggatgattatatcgaggcgctctacagcaactggtatctggcagagttaagccgtaactggaacgaagtgctggaggcggaaaatcgtatgcaggcgtggcaaatccctggcgtgccgcgtcagcagaactttttcaatgaggtggtgaagccgcagttccaaaatccgcaaatcaaacgcgtgttcgtgatagtttccgatgccctgcgttatgaagtggcggaggagctggggaatcaaatcaataccgagaaacgctttaccgcagaactgcgatcgcagctaggcgtgctcccaagctacacccaactgggaatggcggcgttgctgcctcatgaacaactttgttatcaaccgggtaacggtgacattgtttatgctgatgggctgtcgacctcgggtattcctaaccgcgataccattctgaaaaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaagtaatcaaccgcctccacggcacacgcatttttgttacggcggatcacggtttcctgttccagcaacaggcgctttcggttcaggataaaacaactctgcaaattaagccggaaaacaccatcaagaaccacaaacgctttattatcggccatcagcttcccgccgatgatttttgctggaaaggtaaagtggcaaataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaataatatcgataaagtgagcctgttgcagacgcatccggtgggcgaactttatgaaccgcgtatcctgaacatttacattgtcgacaacgccaacaatgtggtctcgggcaaagagcgcatcagctttgacagcgataacaacaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcattccaggatgatttcttctaa

SEQ ID NO: 1543 - DNA, 2502 bp, Sphingobium indicum
atgaatgatcgcatcgcaaaagggctggaagcggctttcgaccgtcaccgtatcgtgttctggaccgatgcggcgagggagttgcgggagacattcgagacactggagctgcccggtgtcgagaagatccagctcgccaacaacgagttcgcagtgaagcacaggatcctgcgcgaggtgccgcaggggcgcttcctgatctaccgcgaagggcctgagccggcgcagattcacaattggctactcgatgtgcagctggcccatggtacgttcaaggccgaccaggcagccctgtggctgtccgaactgggtcttgggctgggacttgaggatgtggtgcgcgcccatgcggagttcttccgctcggcccgcaggctcgaacagctaaagcgacttgcccgcaacgacgacacggccagcgcgttgcgcctgaagatgctaagcgtttgcgccggtggcgaaggcgggttcgattccgttgtcgagagactgctggccgacctcgcggtggacaccgacgaagccatccgcctgatcgagcgggccgggcttggcgccttcctgtgggaccagatggggcggcactatggctatacggccgttcagcccagcgttgaggatttcgcggtctctctgttcaaggcctgctatgccatggggctgggagaggcgggaggcctctcgcccgaggcactggtgttcttccgccgctggaagaacaaccgtcacgcggctcaggccttcgaggcgctgtcctcctcctatgccagtgtgctgggcgtgcggactgatctggaaacacgcgatttccgacacctcatcgaactcgactatttcgaggacatcgatcgggcgatcatcgttgcgctagttcgcggggtttctgcttgcacgcttgccgccggagatgtggcaagctggatccgccagcgccgccagagctactggtatgaccgtttccgagatctctatgaggcgatcggcttcgcggctgaattccacgcggcgatggcgcaagtgaaccttggcatgaccagcctcgctgaaggcgtcagccgctatgccggaaactggttccgcatcgaccagctctaccgcaagttcatctaccacatgcagaaatcgggtcaggccagcttgatggccgagctctatgagcaggtagagaaccattatgtgaacagctacctgcttcgcctcaacgacagctggcaggtacatgtcgatgcagcaccgacgtgggatgccgcccctgtgccggcccagcggactttttacgctacccaagtcgttccttatcgccagaaggaccagaagatctgcgtcatcatatcggacgccatgcggtatgaggtggcggaggagctattggctcgtgtccgtgggctcgatcgttatgacgcagagatcgagccgatgctgggatcactgccgacctatacccaactcggcatggcctcgctgcttcccaaccgcgacatacgtatcgctgacaacgataccagcgcggtgatcgtggatgggcagagctcccagggctccgaaaaccgtaggaaaatcctggcccaaggacgagagggcgaccggacgaccgcattgctggccgacgacctccttaagatgcagcgagatgactaccgggcgctgtttcgcgatcacgacgtgatctatgtttaccacaatctcatcgatgcgaccggcgacaaaccggccacggaggatcgagtattcgaggctgctgagaagacgctcgacgagctggttcagctggtcaaaaagctggcggccgccaatgccaacaatctgctgatcaccgcagaccatggcttcatttaccagcaccggcccatcgatgagagcgacttttcgggttctgaagtggtgggcgacaccatcttgttccgcaaccgccgctttgtgcttggacgtggcctgaaaccccaacaggggctcaggctctacaagtcgggagaggcgaggttgcagggtgatgttgaaatcctgatccccaagtcgatcaatcgcctgcggcttaagggctcaggtagccgcttcgtgcacggcggtgccacgctgcaggaggcggtagttccagtcgtccggatcaacaagaagcgtcagagtgacacgtccattgtcgatgtcgaaatcattggcagcacaaatcaggtcattacggccagccagatatcggtcagattctaccagtccgttccggcgactgagaagacgcaggcacgccgcttgcgcgccggaatattctcgcaatcgggtgaactgatttcagacagccacgaactcgttttcgattttcggtctgaaaatccgcgggagcgcgagcacccggtccgcttcctgctgtctcgcaaggctgacgactgcaacggccaggaggtggtcctgcgcttggaagagcagcacggggacacatcgcactacagcgaatatagaagtgcgcgctacatcctgcgtcgcagcttcaccaacgactttgatttctga

SEQ ID NO: 1544 - DNA, 2304 bp, Vibrio cholerae; identical to SEQ ID NO: 1292

SEQ ID NO: 1545 - DNA, 2304 bp, Vibrio cholerae; identical to SEQ ID NO: 1292

SEQ ID NO: 1546 - DNA, 2598 bp, Escherichia coli; identical to SEQ ID NO: 1380

SEQ ID NO: 1547 - DNA, 2565 bp, Sporolactobacillus vineae
atgaaactgaaagaagtacagcgtgtcctgaatgagacgtttcataaaccgcttcgctgggggcaaaaacgccacctggtgttctggtatgatccggcaggcgaattcaaagaggatatccatgatctgcagctggatcaggtacacatctgggaattaacccctgataatttctttgcgaccaagtatgaactggagaagaaggaccctgaatcttcatttctgatctatgcaccaatggcgaaaccggcaccgcaggaagactggctctatgatcagttgaaaatgggtgtggaattctccacggataaaacaacagccatcatgcgtgaactcggtgtctccgacgatggactccgtaaagtgttccatcgttatatgaaatttttcaataataagcagcgctttgcggcatttcaagcatttgggattcagaactacgatccggaaaaaatagatgttgcggtgctggctgtgctgacccataacgcgatcaataaactagatgaagtcgtagaagtgttgatgcgtgaaacggcagcgggcggaaaccggtcctgggaaatgatcggaaaattcggcgacattgatgctttttggcacctggtcgagaaagcgtacggctatacccggggagaaaaatccctgccggatttgatcacttttttcatgctgacatatctcgtctccacggcaccggatctgaacctgccggaggactggaaggcttatctggcggtgcggccgatgaatgtggtggtgctgatgagtcagttcatgaaccagccacaggatcgggcagcattccagaaattgtccgggatggtggccaaaacgattcatctggagagccatttgaaggcatgggaggtgcagaattacctcaaggccgatgcctttaaagagtttgatcagtcattgattcaatacatcattactcagctgacatccggtgtcggacagtttgacacctatcagagtatgttggatgcccgtcggacattgcactggtatccggattacgttgatgcatatgaggcagtgggacaagccatttgtctttttcagctggacgcggagcagcaacacttcatacctgagtcatctgccggtcagatgtttcaaaaatacacagatgattattaccgctttgaccaggcatatcggaaattttatatgacctacgatcgctggcagcaggatgacagcctgatcccgctgcgtcggcaggttgagcacgcgtacactagtggctatttgcgtgaactgtcagccaaatggacacagagtctgaacaggcgggcgccggatcaatgggcgatcaccggtgtgccgcaacaaacacgtttttatacggagtgtgtgcagccctatgtgacacgaggtgagcgggttttcgtgatcatttccgatgcgtttcgctatgaggcgggtcaggaactgaccgatcggctgaatcaggaaaaaaaaggtttggctgaactctcggccatgcagagcaccttgccctcctatacggcactgggtatgccggctctgctaccccatcattcgctcagctatcaagggaactcgcagaaggagcctgaaattttacttgatcagatgacaacaatcgggacatatgcccgaaatctgattttgcagaaacgagtgaaggagagcctggcgatccaggcacaggatctgcgcgacatgcggcagcaggagatgcggcagaagtttcagtcgttgaaggtcgtctatatttatcataaccggattgatgccagcggcgatcacccggcatcagaaacggaagtatttgcggctacggaacaggctatcgatgaacttattgccttagttaacaaactggtgaataacgtcagtgcatccgcggtgattgtcactgcggatcatgggtatctgtatcagcgcgatccggtcaagccaagtggaaagctgcctaaggctgacggaatggttctggcattgaaccgccgttttatgctcagtgaagagaaaacagatgcggagggaacactgcagttctcaacagaaggggaactggctaatgatccgcctctgatgattaccataccgaatggtgatgaacggtttatggttcagggcggcggtgccaattatgtgcatggcggtgcgatgcttcaggaaatcgccgtgccggtggtcgcatttcgcagccgccgcaatgacgttttacgtcaggtcaatgtgaaattgatgagcagtacacggaagatcacaaatataattacattcctcgaattttaccagacggagccaatggcggagaaggtgcatccgcgtcgcctgaacctcttcttcacggattcagacaaggaaaagatgtcgaacgaggttcacctgctggccgaccgatcttccgaaaagcctgccgatcgggtctttcgtgagaaatttgttttcaaaaatagatcttacgaccggcacgcaacctactatctggttctggaagatgaggatcagacggtcgagaaaatctatgaacggattccgtttacgatcgatattgcatttgctgatgacttcggattttga

SEQ ID NO: 1548 - DNA, 2304 bp, Vibrio cholerae; identical to SEQ ID NO: 1292

SEQ ID NO: 1549 - DNA, 2223 bp, Streptomyces sp.
gtgttcaccgcggaccgggcctcgctggtacagcaggagctcgggcttgccgccgacgatgtcggcgaggttgtgcaagcccacgagaagttcttccaggcggcgaagcgggtgcgggtccttaaggggctgcttcacgcggatgatgacacgctggtgttgcaggccaagatggtggctgtgctgctcgggcagcgtgagcacagtctcctggagatcacccgcgccctgctggccgagaacgccgacggcgcggatgacaagtacggcgtcctcgtcgagtacggtcttgacgacttccactggcagggcgtcgcctcgatctacggctacacgtcgcagagcccgagcatcgacgatttcgtgctgtggatgtttcggcaggccgccgcagggttcatgtccgaacggccaggcggactgcggaacatccagctcgacttcgccagcctgcgctacgacgtccgcagccagcaggcgatgaccacgctcgcaactcgtgtagctcgcgacctggactacgcgagcacgatcgaggacacgggcttccgggacctgctgggcaacgacctgttcgaggaagtcgaccagaagatcatcagcgatcttgcgagtgctgtcgccgaccgcaccgtcgcagcccgtgaggtcaccgaggtcatccgcagtcggcagaacagcttctggatcgacgggtaccgcaagctgtactccgcgatcggcagcgcctccgacctgctgaccgcgctcagcgcgctcgacctgtcgatgcagtcgttcgacgagggcctggaccgttaccggaatgactggttccgtatcgatcagctctaccggcagttcgcctatgcggcccgcaccgccgagcacgccggaccgctggagcgactgcgggagcaggtcgagtccttctacgcgaacaaattcctgtacaccctgggcgccgcatggcagcagcatgtcgatggcgtcgaccggtggcgttccgctgtgctccggccgcagacctcgttcttcgccgaccacgtcaagcccatcacgcgggatggccggcgtaaggccgtcgtcattatttccgacgccctgcgctacgaggttgccgacgagctcggttcacgtatccgccaggaagaccgtttcgacgcgactcttgatgccgttctgggcgtcctgccgagctatacccagctcgggatggccgcgctcttgccgcacaccacgatcggacattctggcaagggcgatcgagtcgccgtggacggccagcagtccgcagggaccgacaaccgcagcaagatcctcgccggtgtgcggggcacggcggttcctgccgaaaacctgctcggcatgacccgcgatgagattcgcgagctgtaccggcagcaccaggtgctgtacgtctaccacaaccgcattgacgcgaccggcgacaagcagggcaccgagcggcaggttttcgaggctgccgagaagacgctggaggagctcgtcgaccttgtcaagcgccttgcgagcgccgacgccaccaacatcttcgtgaccgccgaccacggcttcctcttccaggaatccgcgctcgacgaggcgggctacctgtccgttgcaccgcagggcgacagcatcgctgtgcaggcgcgccgctacgtgctgggaacagggctgaaacctgatccggcgttcaagacgtacacctccgcgcagctcgggctcgacagcgactacgaggtgcagattcccaagtcgatccaccggcttcggctcaagggctcgggtgcgaggttcgtgcacggcggcgcggccctccaggagatcgtcgtgccggtgctcgccatcaacaagaagcgcaagagcgacactcggctggtcaacgtcgaaatcctgcccgagtcagacaagatcaccactggtcagctggtcgtgaaactcttccagaccgagccggtcagcgaaaagatccagccacgcgccctgcgagccggcctgtacttcggcgagaccctcatctccaaccacgccccgctggtgttcgatcaggaatcggccgaccggcgcgaccggtatcagagcgccgtcatgctactcagccaagatgcgaacgactacaacaaccgtgcggtcgagttccgcctagaggaactgattcccaacacgacccagtggcgcgtctacggcaaggcgatgtacacgctgaagcgctcattcgcctcggacttcgacttctag

SEQ ID NO: 1550 - DNA, 2598 bp, Salmonella enterica; identical to SEQ ID NO: 1426

SEQ ID NO: 1551 - DNA, 2523 bp, Enterococcus faecium; identical to SEQ ID NO: 1373

SEQ ID NO: 1552 - DNA, 2598 bp, Escherichia coli; identical to SEQ ID NO: 1225

SEQ ID NO: 1553 - DNA, 2457 bp, Bacteroides xylanisolvens
atggatatacaaggatatatacttgatcattggcaagcaaagatgaagccagaaacacctgtcattatcatatatgataaagaaggggtttactatgacttattgccgatagccatagaaaaaggatttaaggtgattgatacaaccaaaggagcactccatgcccgattgtctgcatcacgattctggtgcaatgacttatccatagacaaaaacgttcagatgatcatatatcgtcagcgtccaatgccaaccaataacagaagttgggtagaagagcctttttcttgttttatgaaaagtgcctgtatatttccatatggtccacaagacacttatgaaaatatttgcagaacatttctaccctctaagcaacaagacttggacaaactttttgcaaatggctctacttcatttaatatgattaatgcgttgcttgatggtgccgcatatcctgagctagaacaattgacaggaggaaagagcatttctgaaataaccgtaggattattggcgcttgatgagtgcacaaatatgaactggcagaaagagtggagaattcttgcagaagtacaattcccacgacttgactgtactggtgtctcacttaatgaagtgcaaaataaactgtggacatatcttttgtttagcgaatttgtattcgaccttcctggagcattacctgaaaacctaaaaagtgtaccaatggctcctgttgagatgaaggaaaaagtttatatgatttgtgataaactcagaaatcaaatcaatctccgggagacatacgttagaattgctaataaagtgtctgaacagttgaagctgtcagaagtttttgtgaaagcaaaacatttaggtgaaagagttacctttaactttgaaaacagcgttgaatacaaccgctttattgactatataaaagcaggagatatacaagaagccacacgtttgattagcaagaacgaaagcggtgtatggtatcaagaagagcaagaggtttctaattattggaaattggcacagcatatagttgacctcatgcaatgtatcaataatggaattgagacagatggaacattagctgatcttatcgaatggtacacaaatgtaggttgtgttgccgataatgcatttcgtaaattccatacagacaaactcggaatgttgcatctccctaaacaagctgatgaacttaccaatcttatcaataaacattatcgtgaatttacagaaagaggagttaaagcatatcagcagctcattatagacataaaggattatccaaaattaagaaaccagggctacattcaattcgtcaagcctgcaataaaaaatggcaaacgagtggtttttgtgatggtcgatgcattccgatatgaaatgggtaaaacatttgcaaagagtattgaacgtaacttcatggaacgcgtagaatgtttgtcccgcatatcctatctaccatcaattactcgattcggaatggccagtcatatgggagatatatcagtaagaaacatccaagggaaattacaaccatttattggagagcaaatggtgtcaactcctgaggaccgtattacatggttaaaagcagatacaaacattgaagttcaagatttccgattagaagaatttaattcagctaaggtaaatgatagaacacgactgcttgttgttaggagtgttagcattgattcagcaggcgaaaatgacaaattgaatggacttgctaccatggagcgcgaacaaatacgtttggcaaaactattagacgattgcaaacgattgaagtttgatgaagccataattgttgccgaccatgggtttatgattcaaccatcattcaatgtgggtgatttgataaataaaccgaagggaagcgatatttccattgaagaatcgcgtgttattgctggtaatttgaatgattcaaacgatactttatctcttacaaccactcaattaggtaatgatatggaggtaatgaagttgagttatgctaaagattatacagtatttacacgtggtgaaatctattatcatgaagggctatcacttcaggagaatgtggtacctattataagagtaaaacttcaggaagaaaagaaacgacaatccttccaagtatcactatcatataagggtaaaaatggtggaacaattttcagcagaaggccactgattgatattaatacaacatttgcaaatttgtttgcagatgatgtaataatgaagttgaaagtcacaggagataatgattgtgaaattggagaggctgaagatcgtttctatgatagtgtcacaggacttatccgtattccttctggtgctacaagcgttcgtcagttaattaatatacgagatgaatatcatggaaatactgtgacaataacagctcttgacacagagacgaatgccaccctttctacattaaggttaaactttgaaaatgattaa

SEQ ID NO: 1554 - DNA, 2598 bp, Escherichia coli
ttgcaaaatcaggactttattgctggccttaaagctaaatttgccgaacatcgcatcgttttctggcacgatcccgataagcgttttattgaggaactggaacagctcaagcttgaaaacgtcacgctaatcaacatgaccctcgcgtcacagttggcggtgaaaaaacgcatcgagattgatgaaccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaaaaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggccgccctgcagccggaagatcattaccggctcagctcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagagttaagtcgtaactggaacgaagtgctggaagcggaaaatcgtatgcaggcgtggcaaatccctggcgtgccgcgtcagcagaacttcttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcgttgctgccccatgaacaactttgctatcaaccgggtaacggcgacatcgtttatgctgatgggctgtcgacctcgggtattcctaaccgcgataccattctgaagaactataagggaatggcgataaaatcgaaggaccttctggagttaaaaaaccaggaagggcgagaccttattcgcgattacgaagtggtgtatatctggcataacacgattgatgccactggcgacacggcatccacggaagataaaaccttcgaagcgtgccgcacggcggtgactgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgacttttgctggaaagggaaagtggcggataccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaacaatatcgataaagtgagcctattgcagacgcatccggtgggcgaactttatgaaccgcgtatcctgaacatttacattgtcgataacgctaataatgtggtgtcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1555 - DNA, 2598 bp, Salmonella enterica; identical to SEQ ID NO: 1426

SEQ ID NO: 1556 - DNA, 2457 bp, Bacteroides sp.; identical to SEQ ID NO: 1553

SEQ ID NO: 1557 - DNA, 2562 bp, Opitutaceae bacterium
atgctcgcctccgcctttttcgcccaaatccaacaacgattctcccacgagaagcgggcgcgggtctgtgtctggttcgatccgcaggaggagttccgccgtctactccctgtcttccatgcgcatctagccaagagtgcgccccagaccgttcacctgctcgcttataatcccaaggccaaacacggccaaatctggctcaagcatcaggtttggctcctcagccagaccgatcccgccgccaaattcgtgctctatctgccattgcccaaggagcgctggaacggccccgacgagcgtggcaaacaccacctcgaacttttaaccgaataccgcattaccggcaccgattggaaagtcggcggcaagcgcccctcactctttagttttctcaaagccgccggtgccgcattgccgaccgaccagaccgaacagcgcaaactcaccgatggcggcccggattcccccttggccaaatacgcagctaagttcgccaccaaggcgcctttattctgggaagagagcctcaccgccgaactggcccagagtcgcctcgtcggcgatgttgaccagcagctccttgatctcgcggtcgaacccgagaccgagtggacggcgttacaagagaagggcgtcctcgacgaattcctcgccgctctcaccgagcgcctcggctccgtcccgcagaccgacaacccggttctctgggttaaatccctggtagaacgtctggccctgaccgaggccttcgttggctacggtgagcctggcgatttccccttcgccgaccgtttgcccccgtctcgtgaccgcgaggcacacgtggcactccttcgccgttggcttcgcgacaccaactgccgccctgcttgggatcgctggattgccgagatcgaacaacacgtcaacctcaccgcctgggccaagggcaagaccggggcagcttacggcttttcccacctcgtcagcctgcgctggcaggatgcggtaaaatccgtcgtcactgccgcgaccaaggccgaaggctttggcgactacttggccgaagaagctccctcgctccgcagcgaggccgatttttcccgtgccagcactacttccgagtgtgactgggatcacctgctcggcgtgaccgaattcgtcgccagttgccgaaaactccaatctctcatccccgaggtgggttcagccgccgaatgcgtgcgcctctacaccgatttcgccgaacgcgtggacggccagcatctgcgcctcaaggccgaggccgccgaactcggcttggccgacatcggccagctcttggatcgcacttacggccaggcagccaattccctgaatcagcgtttctttggattttataccgccaccgattcgaatgacatccccggcctgcccttcgtcgccagccacctcgatgcccacctctggtccggccacggacgccgggccgtggtgatcgtggatgccctgcgcttcgacgtctcctatcagctcaaggcccagctcaccggcttcaacgtcagcatcgaccctctgcgcgccatgctccccacgcgcacgcctgtcggcatgagcgctctgctgccagccaagtttaccccgacctcgctaaaaactaccgggggcgaactccacccgatctacgccgccaagaacctctccatccgcgaaaaccggctcgctttgctgaaagagttcggggccgatacccgcgaaatcaccgaggtcgagaatgccaggaagccaggaaagttgcccactttgctcgttgtttacggccacgaagaggtggactcgatgggccatggtgacggcgagactctgatccgccacgtgcaaaaggagctggagcgcctcgcccgtgtggtgcgtaaactccaccaatggggctatgccgaagtccacgtcgtcaccgaccacggattcgtcctgctcgatgaagagcacctcccgccggaagttcctttcaacaaggactggggttccgttatcaaggagcgcttcgccattatcccggcgggcgtggacgtgccgatcaagagcaagcccttcgcttgggatttatccgtccgcgttgccctgccgcccggcctggcctatttcaaaaacgaaaaatccttcagccacggcggcgctgcacttcaggagatagtcatcccgcatttgatttctcgccagcaaactaagcagcagaaaatcggggtcgaagccctcatcggtggggcgggggtaaacctctccaccgcggcggtgaaaattgttatccgtcccgtaaacgtcggggagagtggtgagatgtcgtccttggtggcgctgccccgtaacctagagatcaatgtgctccgtgctgccgcaaccaccaccggctcggtgcttccgcgcggcgaagccaaaaaagcgacgctcaagcctgacgccgaagtgcccgtcacgttgttcttcgattccaaattcaccttcaagcagggcgacaccctccgcttggaaatccgcgacgccgacaccggcgagcaattccccggccccgagggtattgtcttccacgtcgcccgcgacctctaa

SEQ ID NO: 1558 - DNA, 2304 bp, Glaciecola polaris
atgattgatacctggtttaaagaggatttagcgcgcatcctggaaccgcaccctgtggccgtgtttattgatgaaagcggcgaggcggattttctattaaagagcttaaaaagtgattgtgatgtgtatcgcaccaatggcgagctggatgagctggaagcgaaatatcgcattgaaaaagccttacaagagcatcctgaatctgagcacaagtacgttatctatacgcaactcagcaaagaagacttaaccttcgtacgcgagtactgtgagaccaatggttgcatcgaaattcgttatttgcagaactacatcaaggataaggttcaccggaccttaaacttaaatattaacttgccgaaagacgagttgatcgctgctgcaaaagtgagtgtgggtaaagatcgtacctactggatggacttaagccacaaaggggcctctgaaatctttgatttagacaaggaactgctgccctttgttcatgatcccgaaaactatgtcactgaaaaatacgacgcacagttgcgtgaaaccttttaccgcaaggttaatgagctgctaggccaagaatatatcgataaacctgcatctaccctagcgtctgaagttgtatctgcgatgttaaagggcttggcggataatgactgtgataaaacgttgttatcagtttacaacagctggcttgattcggtgagttatcgcaattcatttggctcatacctcgccaaacataagttggattcagcgtttattaacagcagtgctatctggcagatcaatcccgaccacccatttaggcaggtggatgaagcttggttaaaggaattaggcaataaactggctaataaatctttgactaaaggagagtcagcacaactagttgcaaggctgaaacaacgccatcaaagcaaacaggcacaagcgctgggcattgtgttttggaacgacattattactttgctcgactttgatccgaaggatatggcctatttaagcagctttgctgaatgtgttgagttttacaaaaaacatttctgcccgcttgatactgccatacgtaatttgtacaccgaatttatgcaacaacgtgacagccttgagcctttccaagagctttacaaagagtacgttacgctgtttttagataagtggttccagtattttagtcagtaccgggaagatcaaactggcattttacaatccattattgaccgtgatatccaaattgatcgcccaggaaagaacagcaaaatagccgtgattgtaggcgatggcgtagcctatgaaattgcagagcaggttgctatcaaggttaagcaacttggtagccatagtacacttactcgccgtcatatcttagctgattgtccatccgaaactgaaaacaacatgagccatatttacatggcaaatggtgtgattgatgccgtgcaaaataagcgagaaaagtatcttgcagcccaaaattcacacattgatattgattacattcgtcttgatgaggtaagtgatcagccactatcgggtcaggtgctaatttgtacctataaagatattgatgacatgggtgataagctcaatcataaggcgctgaaatacttcccagaatctatcgatttttttgctgaaaagattaatcagttgctcaatatcggctatggaaaagtgtatttaatcaccgaccatggtttcgtgttgactggcttgctaagtgaagccgataagatagtggttaagccttcagggcaaaactacattgacgagcgctttatctggaccagtgacaagcaagaaagtttaatacctcagtttattgaagtagcaaaggcctacaaagattacaactacctttacttcgcccgcagcatgaacccgttcaaaacccctggcacttatggctttgcgcatggcggtttagcacctcaggagttggtgacgccttatttttgttgggagcaaaaaagtgatgttatgggagagctgcctgtaaccattgcgaacaagcatgacttggtcagtgtaactggagagctgtaccagctaaaactgcgggctgaatctggtgaaggaaatatgttcacgcttgaccgtaaagtgatgttgttgttctttgctaacaaaacccaagtgaataagagcgatgttattaccgtgcagagtaatggtcacgttactaaagagtacacctttgatggccatgaagagttagaagtgcaactggtagacgcgattacaaaacagcagcttgatcgtgttcttattaaaaagaataacgaccgcgaccttggcggattattttaa

SEQ ID NO: 1559 - DNA, 2481 bp, Bacteroides coprophilus
atggatatacaaggacatatcatagatgtttggattggtaaaaccagtaaggaacatcccattatcaccatttatgaccccgagggcaaatactattcacttttgcctttggtggcagaacgaggtgtacaggtaatcgacaccacccaagagttgattcatcatagagaaatggcttgcgactattggatgaacgaactggttcaaaacgaagatgcacgcctgctcatctatcgaaaatcagctgtacccaaggaaaaagaacgggtatatgacccttatatcggaatgactcaaattggtgcccgctttcccatcggccccaatgactcctatatcaacctgtgcaagcactttctacatggaaagacagaggccattgatgaactattcaagaatggcacagccagctttgcgaatatcaacgccttgcaagagggtgtgaattatccggagctggagacacttaccggcggtaagagcatggtggagattaccttgaatcttctggctttgaccgagatcggcagcactgcatggatgagtgagtggaaaagcttcggtgaaaatcatttgcctggactggataccaacggtaccacgttgaaggaggtcaagcaaaagctatggcaatatttgctcttcagcgaatttgtgcacgacctgcccgctgcattgcctgctgaactcaacacggtggctaaatgcccgaaagagaacatggagagcatcaacaacctctgccaaagcatccgcaaccgtaccgatttgcgtgacgactatgtagaacaggctcaggctatcaccagccgtttacacttggacagtttgtttgccgaagcaattgatttaggtaaaatagtaacattcgcctttgaaaacaaagtggagttcaatatctatttagaccatctgtacaaaggtgaatatgcggaagctacgttattggtaaacaaaaacaaaaagagcgtttggtatcaggccgatgccggagtggcattattctggaacttaaccgaccaatgtgaacggatgatgcagtgcattcgccagcctttgggcgatttgtatagtttgaaggatttggtcttgtggtacagtgaagaaggctataaagtagattatgctttccgccgttttcaagccattctgaccggttcggattttgatacaccccagataaatgaattagcgcagtttacttatcgtaactatcgaagctttaccgaacagatacagagtcgttatcagaagctcatccatgaagaaggctatccaatagctggtatcaatcggaatatacaagcttggaataaggagattgcaccactgctgactgcccgcaaacgagtagccatcatctttgccgatgctttccgctttgagatgggtaaggagttggctcaaagtcttgaaaatagttatactgtcagcttacagccctcagccgcttacgttcctactgttactcgattcggtatggcagctttgctcccggaagcagaatcaaagttggagttggcagtggaagatggcaagctgcagccttatcttgaagggaaaaaagtggagttaccgacagatagaatcaattatattgaaagtaaagtgcctgcgcatgtaaagctgatggatgtaaggtccgaggacttcctctcagctaacatcgccccggatgtgaatttactcatcattcgtagccaatcaatcgatgctgccggagagaatctaaccagtgtaggctatgctgagatggaaagtgaaatgcggctgtttaccaagtgtatccgtgcctgtaaaaatttaggtttcgatcaggtcgttattctggccgaccatgggtatatgatacagcccaaatatcaagccggagacaatatgagcaagccggtgggcaccagtgtcatgaacgaacgccgcagtcaagctggcgatttgaatggaaacgaaaattcatggctctttacttcggagcatatcggtgtgcgtagtccaatctatcgttttgcatttgccaagcaatatggcatctatgaaaagaataagatctatttccatgaaggtttgtcgttgcaggaaaacatcgttcccatcctgactgttcaattgactgaagaacgcacgaaagaagctttccgtctggaactgacttacaaaggaaagaacagtggcattatacgcgttaaccgtccgctcatcgaattaaactttagcggtgtggaatcactcttccgccctgaactttgtattgtcaagatggtcgtgacagatgccaccggaaaagaagcgggtcgtgtggttgaatcggcattctataacgagacgacagacttgattgcaattccaagtgaatgcgacaagtgtaagcaacccatagaaattaatgaaggcgttgaaggtgatatcattgtgatggctctcgaccctgataccaatgtgacattagcctctattcaattgcaaactgaatttgatttttaa

SEQ ID NO: 1560 - DNA, 2547 bp, Bacteroides sp.
atgatacaaaacaagatatacaattactttgaacgaaacgaaaagcttaaagtactttttatatttgacccgatggatgccattgcttcggaacttcatgccgtatcctggcgtgacggattccgtttcatcgaattcgacggcgcttggttcaaaacaaaatatgctttagaaaatgaatggaaagaagataaagtcattcttattttcaaacaggcaagcccatttacatcaacaatttccatgctaaagttcccactacttgatgtattatgtgctaatatggaatacaaaagcgatgattatgcagcctttatacagcaacatcacattcctcaaagctgtcacgactttatccgtaagcacattgatgaactgcaactggaaaagtttaatcgcattttaagtccttactataatactgaaaattttgataaaagccttgcatgcagaggattaatatccggatatttaggtgagaatcagttattagactgggattctatcattatcaggatgttcctcctgtcatcaccgggcgaagaaaagaaaaagataactttctaccgttcgatagagagaaacgtagatatctacgcaactttacaaaatgtacttgaatcctattttgggggatcttataatccaaacagcgaagaaaagataaaagaaatagcagaatcttttaaatacaatgctatcacacagacattagctgtcgatgcaaacgacaattataaacggtataaaataaacagttcattagttttagaccggataaataaattacttgagaaagccatccatcagtctaaagtaaaaagtgatttgttttttgcaacctttcatgcattagctgccggaataaaagttgaagaaatcatcaaaacctatggtattgatgctaattatttctatatccccaccgaactgtgttgggaaatcttaaagaaaatatttgcaaagcaactcacagagaccccggaagccgcatgtgacaaattacgtgatctgttcttaaaacaagagagcaatacagccattcaaaaaactattaactacggaatagaagtagccaattattacagcaaagccacttcattgggttcgttaaaactaaatactcccgacgagtatgtacgtaaatacatatcggaagcccacttgcttgatatgttctatcgtaaatcattagagaactatcatcagttatctgacagtactcctataatcagtgccatcgaaaaagtcaaaaaacaacttgatattgactatgcccaattgtgtaacatccttaatctagaatggcttacctgcctacaagagaaaggtagcagttttaacacaatcagcctgacaaaacaacaggacttttacgaacaagagaaaaataatcaaaccaaacaagtgattatcatcagcgatgcattacgttacgaagttgccgcagaactgatgcaatatctcggcagagaaaaacatattgcgacactggatgccgcgcttgccatgttacctaccgaaactaagttttgtaagcctgccctactccctcatcgttccatctggctatataagaatgatacggaaatggatttagctgtagatgataagattctaaatacgctggagaaacgctctgcacacgtagctctttatcgtgaaagtgcagtttgtacagattatgttactgtagtaaatggaaccaaagatgtaaatcgggaactattcaaaaagcctcttgtctatattttccataatacgattgatgaaataggtcattctaataatccaatggaagtagtttctgcctgtcgccgaacgatagaacagttggcaaagttaatccgaagccttcatgccagctacaatgtgactaatgtaacgcttacttcagatcatggtttcttatataacgacatggcttttgaagaaaaagataaaataacggtttccgaagaaacgatggaaaagaagtcgcgatattacattaccaaatctgatactcccatacaaggagttatcaaattccccttatccgaagtttccggcatgaatgataatgtatttgtggccgttcctgaagggacaaacagatttgccgctcaaggtggaggatacaacttcgctcatggaggggcatccttgcaagaacttatcattcctgtaatacatagtaaaaacaagaaaaacaatgtgaagcaaaaagtgaatgttgctttgataacccgtaatctctctattgtatcgagtcggttgaaatttaaaattatgcaatcggaaccagttgatatggataccctggagcgtaatatcgtatgcgccgtttatgcaaatgacacactcgtcactacagaaaaaaggctttgtctgaatagcagtgatatagataattacaacaatcgcatcttcgatgtggagttaacactgaaccaatcgacaagtacaagtatcatgcaactccgtatctttgatgtagaagacatgcttaaccctcttataaaagaaaccgttacgaacaatacattaatagaacaagatttctaa

SEQ ID NO: 1561 - DNA, 2598 bp, Escherichia coli; identical to SEQ ID NO: 1554

SEQ ID NO: 1562 - DNA, 2598 bp, Escherichia coli
ttgcaaaatcaggactttattgctggccttaaagctaaatttgccgaacatcgcatcgttttctggcacgatcccgataagcgttttattgaggaactggaacagctcaagcttgaaaacgtcacgctaatcaacatgaccctcgcgtcacagttggcggtgaaaaaacgcatcgagattgatgaaccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaaaaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggccgccctgcagccggaagatcattaccggctcagctcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaacctgagtattacgccatctatgacgcgctgcgccaggcagagcgtttgctgaacctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagagttaagtcgtaactggaacgaagtgctggaagcggaaaatcgtatgcaggcgtggcaaatccctggcgtgccgcgtcagcagaacttcttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcgttgctgccccatgaacaactttgctatcaaccgggtaacggcgacatcgtttatgctgatgggctgtcgacctcgggtattcctaaccgcgataccattctgaagaactataagggaatggcgataaaatcgaaggaccttctggagttaaaaaaccaggaagggcgagaccttattcgcgattacgaagtggtgtatatctggcataacacgattgatgccactggcgacacggcatccacggaagataaaaccttcgaagcgtgccgcacggcggtgactgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgacttttgctggaaagggaaagtggcggagaccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccgcagcgccgcccggtggatattgtcgcttaccatccgatgattaagctggtgaacaatatcgataaagtgagcctattgcagacgcatccggtgggcgaactttatgaaccgcgtatcctgaacatttacattgtcgataacgctaataatgtggtgtcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1563 - DNA, 2604 bp, Escherichia coli
gtgaacttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctggcggtgaaaaaacgcatcgagattgatgaaccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcgcccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagtaaatactggtgtcagacacaaccagagtattacgccatctatgacgcactgcgccaggcagagcggttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccagtgggcgaactttatgaaccgcgtatcctgaacatttacattgtcgataacgctaataatgtggtgtcgggcaaagagcgcatcagctttgacagcgataacagcaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1564 - DNA, 2541 bp, Thiorhodovibrio sp.
atgtccattactgaattcatcagccaggaagtcctgctcccccgactggccaagcaccaggtgctggctgtctatgaccctgagcgtcgctaccgggatctctgtctggccctggcaagcgaacagcgcgaagtggtggatgcctctgaatccagcatcgacagccgtcttgcggcgctgaacgcgctcggacggctcggcaaccaagagatccacgaactgctggtctatgtgcccactcccaagcccctgaacgaggaagaccagcaacacgacccctttgccctctacgctgcctgtggcgcggtctttccagaaggcgatggcgatgattaccaggcgctctgcctcaaggccaagccggatgatgccactcaggtgcgggcggtctttgccgagaatgccaacccgagcttcgcggtcattgatgccatcggcgccggtggcctgggctggcccaatctccgtgccctgctcaatcgggaatcgagccgcgacatcctgttcgacctgttggcgccgagtccaaaacagcaaacccggctcaaggacaatgaggcttgggtgaaggaggcgcgtgacctgctcaagagcagttttggcttgcgcctcaagaccaagggcaagacctggtcgagtatcgccgatgagttctggcgctttctgttgttcagcgaattcgcgttcgatctgccggagtccttgcccgccgcattggaaggcgtgcctcgggcaagcgatgcgtcgcgcctgctggtcgaggatctctgtgatcggctgcgcagcgacctgcgcacccaagcccgctacatcgaacaggccgagcgcgtcgagcaggaactcgacctggctcagctctgcgcccaactctgcgcccagccgaccgatcttggcacgcgcgacacctttgcctttgaagaacgcgcctttctgcgccaagccatggccgccttgctcgcggacgacagtgaccaggcgcgcgccattttggcccagcaccgggggtcggtctggacgggcaagggggaaagccaagcccagtgggatctcttgcaggcgaccgctaccctggtggacacctgcgccgatcttgatcgggtgctcggggatcacagcgcggggctggagacgctggtggatttttatgtgcgccagttgcgggagatggatcgtttacatcgggagtttgagcaagccgtcagcggctacgcctggcaagacgcggagggactgatgcagccggtgatcgatcaggggcgccaggtctatggccaactggcaagcctggtgcagcagcgctttacccagcatctgcaacacaccggctggcccttgaccggccgactcagcaacacggaggtcttcgataccctggtcgcgccgccgctccagcagagtggccagcgagtggcctatctcctgattgatgcgctgcgctacgaactcggcgtggcactggagcgccagttggcagaagacggccaggtggagttgcgcgccgccatggcaccactgcccagtatcaccccggtcggcatggcgagcctgttgcccgccgcgcaagccggcttgcggctggtgaagaccgatggcgagatcacgcccacgctccatgaccaggcggtgaccactgtgactcagcgcatggacgtgatccgcaagcgctatgggcaacgctttcaacaggggcggctcgatgatttcgtgctgaagaaactcaaacttgacccggatgccgatctgttggtgctgcgctcggtcgagatcgacagtcagttcgaaaaccatccggacagcgcgccgggcgaattgaccaatgcgctcaagcgcatccgcgttgccgtcaccatgctcaaggcacagggattccgcgaggtcatcatcgccacggaccatggctttttcatgaacacccatgccggccccggcgattcctgcaccaagccggtcggtgattggctctgcgtgcatgatcgttgcctgctcggtcagggcgcggaagaccgccaccattttaatctgccgaccgagaagctcggcgtgcgcggcgatttcgcccgcttggccggccccttgagcctggcggcgtatcgcagcgggctgacctactttcatggcggggcgtccctgcaagaattggtggttccggtcatccgcctgcaattgaccgccgccgatcaaccgaagttacagcaggccaaggtggccctcagttacaagcaggggatgagccggcacatcaccacacgggtgcccgtctttgaggtggcggtggaatcccaggatctgttctccgaagatggcgagtttgaaatcctgctcgaagcccaggacaaaaagggcaatgtggtgggtgaggccaaaccgggtggcctggtcgatcccgcttcgggcaccatcaccctgaaaccgggcgatcaggtgaaaatcaccctcaagatgagcatggagtacgagggtaagttcaaggtgctggcgttaaatcccaataccatgggcctcttcgcgcaattggatctggaaacggattacacggtttaa

SEQ ID NO: 1565 - DNA, 2523 bp, Cylindrospermopsis raciborskii
atgattaaccgaattaaccagtccctcaccaaactctttgaaaaacaccgcattgtgttctggtatgatgccaaaccggaacttgtccgggaatttttgggtggtgtagagaaaatagaacttaccaacaaccagttcgccgttaagtaccgtatcctgcaccaggaaccgaaaagtaagttcctactctatcaagaaacacctcaaccccctgacctagaaaactggttgctggatgttcaactagcccacacagagtttcgtgctgaccagactgctctatggctcgccgaactggaactaggtagggagtttacccatttggtgcaaggtcacattgcctttttcccatcctctgagcggagggagtcgcttaaacgattgattacatctcatgatactatcactcaaattcaattaaagatgttagctgtctgcaccggctgtgggtcggactcacgattggaagcgattctggaacaacttttaggggagctttctagtgaccttgcccagtataagaaaggtcaaattggggataaatatcgcctgatggtacggtgcgagctagagcagtatttttgggagcagatgaagaactgctatggttacagctgtgccaaaccaagtatgaaggattttgctctccaactcttcagctactgctattttgaaaactttgcctccacccccaaaggaactcaaaacctctcctccgacgctgtggtatttctcaaacgatggaaggatagcattaaatgtcaacattccttcgagactttatccagctggtgtgctaaagaccttggcattgaacatgacctaggagaaagagagattggggaactgctcgatgtggactacttccgcctaattgaccaaagaatattgagcgaactggtgcgcggtgtggagcagagaactttacttggtagtgatgttgctcagtggatatggcggcgcaagcaaagccattggtatgaagagtttcaacactactacgaatgtgttggggccgcagctaagtttatacaggagttagatagggcatgctttaccatagaatccctagctgaaggggtggaaaaatatgctaaatcatggtttcgcatcgaccagctttatcgcaaaactatctaccatctaggccgagtcccagactgttcatttatgggaggattagttgatttgatagaaaacctttacgctaacaattacctcttaaagctgaatgatcactggcaatcatgggttgatcagactacgagttggtctgcaccatatatctatctccaaaataaattttttcaccactgggtactgccctttctcaacacagataagaaaatatttgtaattatctccgatgctttgcgctttgaaattggtaatgaactgatcagcttaatccgccaagaagatcgttacgaggccaccctagaattagctatggccatgctccccagctatactcagcttggtatggctgccttactcccccatagcactctcgccatagctaatgatggttcggttttagtagattctcaaagttccatgggaaccgaaaatcgtaaaaaacaaatcaaacgcggacattctaaacgtgccaccgccataaccgcagaagatctaagagaactaagctcagacgatcgtcgcacactcttccgtgaccatgatttggtctatgtgtatcataaccacattgatgccataggtgataaacgagaatcagagtcccgagtttttgatgcggttgaagaaaccctagatgaactggtcaagctgattaagacactaaccagtgcaaatgctagtaatatattggtaacagcagaccacggatttatctaccagaaccgggcgatcgaagagagtgattttgccagtgatgaaccccagggggaacagatcctgtttaaaaaccgccgcttcgtcctgggtaagggactaaaagagacccccagcctacgtaaatttacttccaatcagcttggtctacaaggggaactagaagtgcagatccccaaatcaatcaaccgtctccgtcttaaaggttcgggaagtcgttacgtccatggtggcgcctccctgcaagaagtggtgattcctattgtgaagatccacaagaagcgaaccagtgatatcactatggtggaagtggaaattctccggggagctagttctattatcacagccacccaactgactgtagttatataccagacacaagcagttacagaaaaagtacacccccggtttctgcaagctggaatctatactcagacagaggaactgatctccgactcccatgacctcacctttgacctagaatcagaaaatcccagagatagggaaatttccgtcaccttcaccctaacacgcaaagcggatgaagccaatggaaaagaggtctacttgcgccttgacgaaaaactacctggcacattccaacataagaagtataaacacctttcttataccatgcgccgctctttcaccagtgactttgatttttaa

SEQ ID NO: 1566 - DNA, 2499 bp, Microcystis aeruginosa
ttgaatcagcagattaaacaagccttaactaaactttttgagcgtcaccggattgttttttggtatgacaccgaaaaagagttacgctcagatttcgagagattagaattagaaaacattgaaaaaatagagataaaaaataacgaatttggactaaaataccgaattttaaaagaacaacctcaacaaaaattcctcttataccatgaaggcaaagaaccagaatatttagataactggttactagatgtggagttagcacagggaaaattcagcagcgatcaagtttctctttggctaaatgaattagaactagggccagaatttgccgatgtgcttgctcctcatcgtgaattttttctgtctaataaacgccgagaatccctaaaacaattacttcaaccccatgacacaaaaaccaatattcgcctaaaaatgttggcggtttgtactgccgcacctccccgtttagattccattgtagaacaactcttaaaagaacacgccgaacaacaagacgaaaaatttaaactctgcgatcgcactggtttaactaaatttctttggcaacaaatggaacaagtttatggttatcgttcctcagagttaagtatcaaagactttgtcatacaactctttaaatcctgttataattacgccttagaaggacaggaaacactaacacaagatgccctgatttttttcaacagatggaaagatagccgtcaatttgaaaaatcttttgaaagcttatccgatcattgtgctgaaattctcaatattaaggaaaaactcaaccagcgacgttatcaagaacttatctcaatagattattttagcttaattgatctaaaaataattcatgatctcattcaagcggttagtaatcgaaccattgcgactcatgaagttattaatattgtgcgtcagcgtcaacaaggatactggtatcgaaaatttaaacatttgtacgaagttgttaactatgcctcacagtttattcaagtcttagatgaagctaacttatccatcgaatccctcaaagatggcttagaaaaatattgtcaatcttggtttaaaattgatcaactctaccgtaaatttatttatcatctggtggcggctgctcaacctactctgacagaaaaacttagtcaagaaattgaaaaccgttatgtaaattcctatcttttaaaccttaatagttcttggcaagtctttgttgatagtgtcacccaatggaacaagatagaattctcttcacaaaggtcattttttagcaaatgggtagaaccatttttgaaaaaagataaaaaagtttgtgtcattatttccgacgctctccgctatgaaatcggggatgagttagtcagtttaattcgtcaagaggatcgttatgaagccaccctagaagctgctatcactctcttacccagttatactgcactgggaatggctgcccttttgcctaatcagacactagaaataattgatgattctgtttatgtagatcaacaagactctcaaggaacagaaaatcggcgtaaaattatccaaaaagcctttcaaaagatacaaaaaaaagcaacagttattcaagccaaagaactattagaattaaaccaggatcgaagtcgttccctatttcgagatcacgatgtggtttatgtttatcacaatcaaattgatcagatcggagataaattagcaacagaaaaacaagtttttcaggtggttgaaaacaccttttctgaactcgataagctcattaaaaaactgacgggagccaatgccagtaacctattgattacggcagatcatgggttcatttaccaacatagtgatgtcgagaatagtgatttttccacggtggaagtactaggggataaaatcatcaaaaaaaataggcgttttctgatcggtaaagcactagaagactccgatagactcaaaaaatttaaagcacaacagatcggtttaacgggagaactagaaatccaaattcccaaatctattagtcgtttacgcatccaaggatcgggaagtcgttttgttcatggtggcgcaagtttacaggaaattattattcccattgttaaagttaataaaaaaagacgaggggatctttctaccgtggaagtggaaattattcgtaactctacctcaaccattacatcagggcaactagctgttactttttatcaacaaaaacccgtcaccgataaagttcaacctcgtaggctaaaagctggcatctatacacccatgggagagttaatttctgatctccacgaactgacttttgattctccatcggaaaatccaagagagcgagaatttccagtaagatttatcctaaccagtcaagggaataatatcaataatcaagaggtattattacgattagaagaaaaactgaccaatacttcccattttacagaatataaatctgtttcctatcccatccgtcgttcctttaccggtgattttgatttttaa

SEQ ID NO: 1567 - DNA, 2304 bp, Vibrio cholerae; identical to SEQ ID NO: 1292

SEQ ID NO: 1568 - DNA, 2304 bp, Vibrio cholerae; identical to SEQ ID NO: 1292

SEQ ID NO: 1569 - DNA, 2598 bp, Enterobacter hormaechei
atgcaatttaaagaactggaatccgggcttcgtcagaagtttaacgacaatcgcatcgtcttctggcacgacccggagcaacgcttcaccgattcgctcaatgagctggatctcgacaacgtcacactgctggatatgggcggcgtttctgtgctcgccacaaaaaaaagaatcgaaatcgacgagccaacacagaaatttttactctattttaccagtgaagttcctgcccatgagcaggactggctgctagacatccgcctttatagcaccgaattccacgctgactatgcagcgatcacactgaattcactgggcatcccacaattagggttgcgcgaacatattcaacttcgcaaagccttctttaccgtcaaacgtacccagttacttaaaggctgggtcaccgagcgcgaaacagaaaaatccctcgataagaagatgctggcagtggttgccggagccagcacctttgaaaccaaagaaatcctgtttgctctgatccagcaatttgttgctgcaagtcatcaggatgatagtgctttagaaaatacttttgccgtgctgaaaaagctggggctggataaggtcctctgggaaatccttaacctagaactgggttaccaggcagaagcaccaacgctggaaaacctactgctgaaactgttctgtaccgatctttgggcacaaggtgatgacgctcatcgcgagtggttgagtaaaaatgtgctgactactgccgcaggtcgtgcgtccgccctggcctttatgggggcgtggcggaacgatcgtcgttataaaacagaatacgattattgtgcagccgatctccagcagacactgcagccgaaagagcattacaactacagctcgccatatgcgctggcaaaatgtgacactttcgaagctatcgagcaattgattatccgtggcctggtgactcaactacaggaagaaagcacgaccctggacagggacgcgtttaaagcattggtgtcagaacgtagtgcgaaatactggagccagacccgcccggaatatctctctatttggaatgccttacgccaggctgagcgcctgcttaatctacgtaatcattatactgatggatttaatttccccgataccggcacgttctggaaagcctattgcggcgaaatttatcgcttcgatcagacctaccgcctgttcaatgaatatgccgcgccagtgcacagtaaaggggcgatgatcctccatgagctggataaattcattgaagagctttacagcaattggtatctggcagagctgagccgtggctggaacaaactgctggaagcggaaaatcgcatgcagacctggcaaattagcggcgtgccgttgcagcgtaatttctataaagagaatgtgaaacggcaatttgacacttcgcaggtgaaacgtgtttttgtcgtgatttcagatgcgttgcgctacgaggtagcagaagaactgggtagacacatcaatcatgagaagcacttcagtgccgaactgcgctcccagacgggagtgttgccgagctacacgcagttaggtatggcggcattgttacctcatgagtccttgagttatctgcctgacaattccggtgtggtgtatgccgatgggatgtctacctccgggtttgaaaaacgtgcctctattctggcgaaagttaacggtgtggcattaagcgcgaaggaattgcagagcgccaataaccaagatgtgaacgatcagattcgcaatgcctctgtggtttatatctggcacgacactattgatgctattggcgataaggcggcaacggaagacaaaacctttgaagcctgtagaagtgcaatcaccgagttgaaagatctggtatcacgcctgcgaaaccgctttaacgccagccgaattttcgtcaccgccgatcatggcttcctgttccaacaacaagcgctggtggagcaggataagactaagctggagagtaaagctgtaaatgccattgaagcgaaaaagcgctacatcgtcggccatcagttgcctgtgaacgaattttgctggcacggcaaactgtcggataccgctgggacaaatgatgagagtgaattcctgttgccaaaaggcgtacagcgtttccactttgcaggtggcgcacgtttcgttcatggcggagccatgttgcaggaagtatgtgtcccagtgctgaaaatccgggcgcttgagaaaaaggctgccgagaaacaaccacagcgccaacctgtatcagttgttgcacgggatcacgtgataaaactggtaaacagcattgataaagtcggctttatacagactacagcggtggacgacctcaatgaaccgcgcacgctgaatatctttatcgttgatgaaaataatcaggttgtctccggcatggaaacggtttgcttcgatagcgacaatgacgatatggggaaacgtacccgcgatgtgaccatgaaactcatgggcacagcattcaatcgtaaaaacaaatatgtgctgatcctggagaatgcggacagcgccacagagtatggccgctatccgattacaatcgacctggctttccaggatgacttcttttaa

SEQ ID NO: 1570 - DNA, 2499 bp, Marinobacter sp.
atgagcaatcgaatctcccaagctctgacaaaactgttcgaccgccaccgcattgtgttctggtacgacaccaagcacgagctgcgcagtgattttgagtcggtgtcacttccggatgtggagaagctggaaatcgccaacaatcagtacgggctgaaataccgtgttctgcgcgaagcgccgacgcagaagttcctgctgtataaagaagggccgcagccagcggaactggataattggttgctggacgtgcagttggctcatggtgagttccggaccgatcaggtggctatctggctgtctgagttggagttgggcctggagttttccgagattgcgcaggctcacgcagaattcttccaagccgagaaacgcaaagacgccctgaaaaagtggctgaaacccgatgataccgccggacagttgcggctgaaaatgctggccgtgtgtgcgggcagcgaaccccgtatggactcggtggtggagactttgcttcagcagttggctgatgacagggttgacgggatgcggctggttgaacgctgcgggttggacactttcctctgggagcaactcacgcgcttttatggctatgaattcactgagccaggcctgcgggatttcgttatcgcgttatttaaatcctgctatgccatgagtaccgatggcgagttcaaaatgaccggcgatgctctggtgtttcttaagcgctggaaggacagccgtcagttcgagtcagggttcgaagtcttatccgccgagtgtgccgatgtgcttggcattgagcaggatctgggaaagcgggatttccggaacctgattgaattggattactttcgcctgatcgaccagaagattatcagtgacctggtgcgagccgtggttgagcgtacggtaaccagtggtgatgtggccctctgggtccggcagcgtcgtcaagggcattggtacgaggagttccgggatctttatgaggccatcgagtttggtgcccgctttattcagatgctgggcgaggccaatctcaccatggacagcctggccgatggcgtgcagcgatacagccgcgcctggtttcagctcgaccagctctaccgcaagtttacctatcatgtgcgactgtctggccagccatcactgatgggggcgttgagtgagcaggtggagaatctgtactccaacagttatttgctgaagcttggggacgcattccagatacacgtggattcgagtgcccgctgggaagcgtatccggtcgttcagcaaaacaccttttttgagcattgggtgcgcccgttcctgcgcaaggacaaacgggtgtgtgtgattatttccgacgccatgcgttatgagatcggtgacgagctgctgagccttatccgccaggaagaccgctacagcgccgagcttgagcctgcgctctccatgttgcccagttacacccaactcggtatggccgctctgctgcccaataaaaccttggcgattgcggataacgataccggcacaacgctggtggatggccagagttctcagggcaccgcgaatcgcaccaaaatcctgcaggcagccctggaagggcgtggtaaggcgatacgagctgaggagtttatgcagcttaaccgtgacgacagccgggatgtgctgaaaggcaacgatgtgttgtacatctatcacaatcgtatcgaccacaccggcgataaaatgcactcagaagggcaggccttcgaggcggcggagcagaccctggacgacctgattcgcctgatcaaaaagctgacggcagccaatgccaacaacctgctggtaaccgccgaccacggctttatctatcagaatcgtgagttggacgagagcgatttcctcagtgtgcccgccaacggcgacactattctctaccgcgaccgccgctttgtattggggaagggcctggcaccgtctccggctttccatcacttctcgtctgagcagcttggtctggacggcgacatggaggtgcaggttcccaaatccatcaaccggttgcgcctgaagggctccggcagtcgctttgttcatggcggtgcttcgttacaggaggtggtgataccggtgctgaaggtgaataagaaacgccagagcgatgtcagcgccgttgaggtggatatcctgcgcggagccagctcggtgattacctctggccaacttgctgtcaccttgtatcagtccgggccggtaacggaaaaaattcaaccgcgcttgctgcgtgctggcatctacaccgaggctggcgagctgatttccgacagccacgagctggtgtttgatttgacatcagagaacccccgtgagcgtgagctgcaggtgcgctttttgctgtcccgcaaggcggatgaagcgaatggccaggaagtgtccttgcgacttgacgagcagcatgccggtacgtctcattacaaggagtacaagtcgctcaattatatgatgcggcggtcctttaccagcgattttgatttctga

SEQ ID NO: 1571 - DNA, 2598 bp, Escherichia coli
ttgcaaaatcaggactttattgctggccttaaagctaaatttgccgaacatcgcatcgttttctggcacgatcccgataaacgttttattgaggaactggaacagctcgagcttgaaaacgtcacgctaatcaacatgacccacgcgtcacagctgtcggtgaaaaaacgcatcgagattgatgagccagaacagcagttcctgctgtggtttcctcatgatgcgccgcctcatgaacaagactggctgctggatatccgcctttacagcagcgaattccatgccgattttgccgccatcaccctgaacacgctgggcattccgcagcttggcctgcgcgagcatattcagcgacgcaaggccttcttcagcactaaacgcacgcaggcgctgaaaaacctggtgacagaacaggaagatgaagcctcgctggataagaaaatgattgcggtgatcgctggcgcaaagaccgcgaaaaccgaagacattttgttcaatctgattacccagtacgttaaccaacaaacagaagacgacagcgaactggaaaacacgcaggcgatgctgaaacgccactgtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatccgccctggcatttatggtgacctggcgtgccgatcgtcgctataaagacgcttatgactactgcgctcagcaaatgcaggccgccctgcgcccggaagatcattaccggctcagctcgccgtatgatttgcacgaatgcgaaaccaccctcagcatcgaacaaaccattattcatgcgctggtaacgcagctgctggaagagagcaccacgctcgatcgggaagcctttaaaaaattgctctctgaacgccagagtaaatactggtgtcagacacaaccagagtattacgccatctatgacgcactgcgccaggcagagcggttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgatatcattctgaagaactataagggaatggcgataaaatcgaaggaccttctggagttaaaaaatcaggaaggacgagaccttattcgcgattacgaagtggtgtatatctggcataacacgattgatgccaccggcgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacactatcaagaaccacaaacgctttattatcggccatcagcttcccgccgatgatttttgctggaaaggtaaagtggcagataccgcaggtgtgagcgacaacagcgagttcctgattccgaaagggatccagcgcttccatttctctggcggcgcgcgctttgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccagtgggcgaactttatgaaccgcgtatcctgaacatttacattgtcgataacgctaataatgtggtgtcgggcaaagagcgcatcagctttgacagcgataacagcaccatggaaaaacgcgtgcgcgaagttaccctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1572 - DNA, 2598 bp, Salmonella enterica
ttgcaaaatcaggaatttattgccggccttaaagcaaaattcaccgaacatcgcatcgttttctggcacgatcccgataagcgtttcctcgaagagctggataacctcgaactcgaaaacgtcacgctgctcgatatgaccgaccagtcacaactggcggttaaaaagcgcattgaaatcgacgagccggaacagcagtttttgctgtggttcccccacgatgcccccccaaaagagttcgactggctattggatattcgtctttatagtacggagttccacgccgatttcgccgccatcacgctaaatacgttaggcattccgcagcttggcctgcgcgagcatatccaacgccggaaggcatttttcagcactaaacgtctttctgccttaaaaggcctggtgactgagcaggaaaacgaagccacccttgataagaagatggttgcagtcatcgctggcgtgaaaacagcaaaaacggaagagattctgttcagcctgattacccaatacgttaatcagcagaaagatgacgacagcgacctggaaaacacgctggcgatgctgaaacgccacgacctggaaggcgttctgtgggacattctgaatcaggaaatgggctatcaggccgaacatccgaccctggaaaacctgatcctcaagctgttctgtaccgatctttccgcgcaggctgatccgcaaaaacgcgaatggctggaaaaaaacgtgctgaccacgccgtcaggcagagcctccgcgctggcgttcatggtcacctggcgtgccgaccgtcgctacaaagaagcctatgattattgcgcacagcagatgcaggatgcgctgcgaccagaagaccagtaccgtctcagctcgccatatgatctgcacgagtgcgaaaccacactgagcattgaacagaccattattcatgcgctggtgacgcagcttctggaagagagcaccacgcttgaccgtgaagccttcaagaagcttctgtctgaacgccagagcaaatactggtgccagacgcgtcaggaatactacgctatttatgatgcgcttcgtcaggctgagcggctgctgaatctgcgcaatcgtcatattgatggtttccactatcaggacagcgcaacgttctggaaagcatactgcgaagagctgttccgctttgaccaagcctaccgcctgtttaacgaatacgcgctgttggttcacagcaaaggcgcaatgatcctgaaaagcctggatgactatatcgaagcgctgtattccaactggtacctggcagaattaagccgaagctggaataaggttctggaagccgaaaaccgtatgcaggagtggcgtattgcgggcgttccacggcagcagaacttctacaatgaggccgttaagccacagtttaacaatccacaaatcaagcgtgtgttcgtgattatctccgatgcgttgcgttatgaagtggcagaagagctgggcaaccagatcaataccgagaagcgctttactgccgaactgcgttcccagttgggcgtattacccagctatacccagctgggtatggctgcattattgcctcatgacgagatatgctaccaggcgggtaatggcgatatcgtttatgcggacgggttatccacctcaggcacgcctaaccgcgatactattctcaagaaatataaagggatggctgtaaaatccgacgatcttctgaaatggaaaaatcagcaaggacgagatcttattcgcgattatgaagtcgtctatatctggcataacaccattgatgccatgggtgacagcgcatctacggaggagaagaccttcgaagcgtgccgcaatgcggtggttgaactgaaggatttagtgacccgtgtgataaaccgtctccacggtacacgcattatcgtcaccgcggaccacggcttcctgttccagcagcagcccctttccgggcaggataaaaccacgctgcagatcaagccagacaatacgattaaaaaccacaaacgctttattatcggccatcaacttcctgccgatgatttttgctggaaaggaaaagtggcggataccgcaggcgtcagcgataacagcgagtttctaattccgaaagggatccagcgtttccatttctctggcggcgcgcggtttgtgcacggtggagccatgctacaggaagtctgcgttcccgtcttgcaggtgaaagcgctgcaaaaaaccgcagcggagaagcaaccgcagcgtcgtccagtagacatcgtcaagcatcatccgctgatcaaactcgtcaataacattgataaagtcagcctgctgcaaaccgatccggtaggcgaactgttcgaaccacgaaccctgaatatctttattgtcgataacgccaataacgtggtttctggtaaagagcgcatctgttttgatagtgacaacgatgccatggaaaaacgcatacgcgacgtgacgctgaagctgattggcgcgaatttcaatcgccgtaatgagtactggctgatactggaagatgcacaaacggaaacgggttaccagaagtaccctgtgattatcgatctggcatttcaggatgatttcttttaa

SEQ ID NO: 1573 - DNA, 2535 bp, Lactobacillus casei
atggcggagctagacaccaagaagatcgtggcgggtattgagaaactgtttgcggacaatgatcactttgtcttttggtatgacgcgcagggcgagtttgcggacaacattgcggatattacagagcagttgcgggaaccggtcgttatcatggggaaaaacgagcagtttaagaccaagctgacgctggtggcgatggagcagcaggggcagtcggccttggtttattcgccagcgccgaagccagatttgacggagaatttcatgacggacatgctttactattcgcgggaatacaccgctaatgcgctggtcatgctgcggcaggagttgcgagtgccggacgaggatgccgcgaccttccaggagcagaaacggttttttgccagcaaagaccgccaggccaaatttcagagactctatcagccgggcaaggatttgcagatggccatcatggctgcgctggccggggccagtgatcacaccatgacgatggtcttgcgggccgtgctgcaggccggcattggtgataccaatccagttctagcagagtttgaaaaatatggtctgctcacccggttctgggagaacgtgcggaacgcctatggcttcaatggtgccaccaattcgctgctggatttcacgacggccctgtatttgaactttgcctattaccaaatggagaaggatctgccgcggagtatcgataattacaagctgaccagcgccaacaatgccgtcacctttctgtccttagcgagaaatgaccagacatttgcggatacatatcgtcagttggccgaagcagtgtggcagcatcttgaaagcttcagtggtgtttcccggcagctccagcaactggatattgtggacttgctcaagacggatgtgtttgccaactttgaccggcaaatcctggcgtgggttgtcgagcgattgcaggctgatgatttccatgctgtggcggggacgacgccgttggcggatgtcttgacgcaacgagaaaagatgtacttcggtaaaacgtatcatgatgcgtatgccttactgcaggctgccttggtgattctcacgtaccgccggcgtgaggtgaaaaacttagcgaccgccaaagaacaatacatcactaccgattatgcggtggatacagcgtaccggcatttcgttcagcgctacgaccggattgccattgaccttacggatcttctggaaggtatcgctgacaaagtggacaacacgtacgtcaacgagtttctcacgccgacagtgacggcttggaccacggtgtatgatccgcgggacattgaacccaatagctggcagcgcagtttctatcggtcattcatcagttcggctaaagagcgcattgtcgtgattatttcggacgcctttcggtttgaggccgcggccgagctgaaacgcaagctggatgatcaggatgtctacagtacagaactcgatacggtatactctgagctgccttctgtgacgtatttcgggatgccagccttgctgccgcatcagacattaacctatcagccggacaagacggtcttagtggatggactcaaagcagacacgctggggaagcgccgtcagatcctgcaaaatcgggatccgcagagcaacgccgaccatgtgatgacttttctcaaagactgggatacgccgcaaagaaaacaactcttggcggggcaaaaggtggtttacttgtaccacaacgaagtggatgccactggtgatgacgcgaagaccgagaagcagatctttaacgccaccgaggaagccatcaacacaattgcgcggacaattggttttttgcgtaatttaagtgtagcgcacatcatcgtgaccgccgatcatggctatctgtacaaacggtctggtctggattcggcggacaagatcgacatcagcggccacgatctggacgtgttggggcagcgctatgcaatcagcagcgagaccatcgagcagcccggggtacggtcacagcgtctgggggcattgctagataatgatgatcagcggcgtgtctactatccggccacagatagtatcttcaagtccgccggagcgggacaaaactacgtgcatggtggcgcctcaccggaagaaatgattgtgccggtgctgcacgtgcggacacaaagtggtcgatccaaggccacaccggtgtcaatcaaggttacggaaggcgcccatcgcatcaccagccgcagcgtgatggtgcccatttctcaagaagaaccggtaaccgacaaaaccaccgccgccacctatgtactctactttgtcgatagccaggatcggcccatttctaacgaacaacgctatgtagccgatagtcgggaggatgatccgcagagcccgagccggcgccagagcttctacctgaccttacaggatcgggacttcgacaacagcggcgcatactacctgattattcagaatgcggaaaccaaggaagagattcagcggattcaatatcaaatggacttgacgattaaaggggatttcggctttgacatctga

SEQ ID NO: 1574 - DNA, 2523 bp, Enterococcus faecium; identical to SEQ ID NO: 1373

SEQ ID NO: 1575 - DNA, 2304 bp, Glaciecola lipolytica
atgattgatacctggtttaaagaggatttagcgcgcatcctggaaccgcaccctgtggccgtgtttattgatgaaagcggggaggcagaatttctaataaagggcctgaaaggtcaatgtgaggtgtacttcaccaatggagagctcgacgagctggaagcgaaatatcgcattgaaaaagccatacaagagcatcctgaatctgagcacaagtacgttatctatacgcaactcagcaaagaagacttaacctttgcacgcgagtactgtgagaccaatggttgcatcgaaattcgttatttgcagaactacatcaaggataaggttcaccggaccttaaacttaaatattaacttgccgaaagacgagttgatcgctgctgcaaaagtgagtgtgggtaaagatcgtacatactggatggacttaagccacaaaggagcctctgaaatctttgatttagacaaggaactgctgccctttgttcatgatcccgaaaactatgccactgaaaaatacgacgcacagttgcgtgaaaccttttaccgcaaggttaatgagctgctaggccaagaatatatcgataaacctgcatctaccctagcgactgaagttgtatctgcgatgttaaagggcttggcggataatgactgtgataaaacgttgttatcagtttacaacagctggcttgattcggtgagttatcgcaattcatttggctcatacctcgccaaacataagttggattcagcgtttattaacagcagtgctatctggcagatcaatcccgaccacccatttaggcaggtggatgaagcttggttaaaggaattaggcaataaactggctaataaatctttggctaaaggagagtcagcacaactagttgcaaggctgaaacaacgccatcaaagcaaacaggcacaagcgctgggcattgtgttttggaacgacattattactttgctcgactttgatccgaaggatatggcctatttaagcagctttgctgaatgtgttgagttttacaaaagacatttctgcccgcttgatactgccatacgtaatttgtacaccgaatttatgcaacaacgtgacagccttgagcctttccaagagctttacaaagagtacgttacgctgtttttagataagtggttccagtatttcagtcagtaccgggaagatcaaactggcattttacaagccattattgaccgcgatattcaaattgatcgcccaggaaagaacagcaaaatagccgtgattgtaggcgatggcgtagcctatgagattgcagagcaggttgctatcaaggttaagcagcttggtaaccatagtacacttactcgccgtcatattttggctgattgtccatccgaaactgaaaacaacatgagtcatatctacatggctaatggtgtggttgaggccgttcaaaacaagcgagaaaagtatctttcggaacaaaatacaagcattaatattgactacatccggttggatgaagtgagtgatcaggctctatcgggccaagtattaatttgtacctataaagacatcgatgacatgggtgacaagctcaatcataaggcgctcaaatacttcccagaatctatcgatttttttgctgaaaagattaatcagttgctcaatatcggctataccaaggtgtatttaatcaccgaccatggtttcgtgttgactggcttgctaagcgaagccgataagatagtggttaagccttcagggcaaaactacattgacgaacgcttcatctggaccagtgacaagcaagaaagtttaatccctcagtttattgaagtagcaaaggtctacaaagattataactatctttacttcgctcgcagcatgaacccgttcaaaacccctggtacttatggctttgcgcatggcggtttagcacctcaggagttggtgacgccttatttttgttgggagcaagaaagtgatgttatgggagagctgcctgtaaccattgcgaacaagcatgacttggtcagtgtaactggagagctataccagctaaaactgcgggctgaaccgggtgaaggaaatatgttcacgcttgaccgtaaagtgatgttgttgttctttgctaacaaaacccaagtgaataagagcgatgttattaccgtgcagagtaatggtcaggttactaaagagtacacctttgatggccatgaagagttagaagtgcaactggtagacgcgatttcaaaacagcagcttgatcgtgttcttattaaaaagaataacgaccgcgaccttggcggattattttaa

SEQ ID NO: 1576 - DNA, 2523 bp, Oribacterium sp.
atggcagaattgaatttaaaacagattattgatcgtctgaatgaagagcttaccggggatactagaaaacttgtgttttggtatgatgataaaggcgaatttgctgaggacatgcagaatgtagaacttgaaaatgccaaggtatactttctgcagccagacaatcagttttatacaaaatattttttagagcgagtagacctcacaacgaattacttgatctatgctccttttcctaaaccggatgtaaaggataaccatctggaagatacgatgctgtattccaagagattctttgcggatcgagcttcgttgctctcagtggatcttggtattgatgagaagtataaaccgatcatcgaaaagcatataaagtttttttccaataaagagcgtacacagagattctatgacttggaaatcgagaacttcaatgaggagaatatcctcattgggcttctcagcagtatttgcaagacgagaacctgctcatttgaagaggttattcgtgtgattcttacagatggagagcttcaggataataagttccttatcgagattcagaagtatgatctactggatgccttttggaaactgtgtgaacagcattttggatatatcgatgtgaagccaacattggagcgctttgtcgttacattatttgtgacatatacagcgaagtatatatcgtcagagctgccgaaggcatggaagtcgtttgtgtcgtataaatccggtaatgttattgctttcatggataatctgatgaacagcgtattgtatcgagagaaatatgatgagctttcagactttgttgcgactggattaggtgcggtaaatacattcaaggattatcttccggaagaattgctgaattgtgatacattcctgtgtatcgatcagattttggtaaagtggattgtagatcgtttgttggcagaagacacaggggcaaagttggatggttcattcattcctgagattgcagcaaaacgagagaagatgcattttggggcaagaatcggacgtacatacagattacttacaagtgcctattatcttgtggtaacaggaacgtttaactgtccagatggatttgcagctattcttgcccagtatcgggcggaagactataagattgaccaggaatatcgtaacttctattatgagtatgaccagcttgaagatactgcggcatttgaaagaattcgtgatcttgtggagaatatctataccaacgagtatttggataagctgcttccaaagtggaatgcaggattgcaggaagaggattctctgacaaagttgcctgtgcagattgatttctatgcccgtaatattcgtaatgtgagagaacgtacagtggttattatctctgatgcaatgcgttatgaagtaggacaggaattattccggctattgtctgatgatccgaagtgcacagctaaacttgaaacacagctcagtgtgcttccatcctatacaagacttggaatggcggctcttttgccacataagcaaatcacgatgacggattattatcaagtactggtggatgatgtactctgtgataacttggcaggaagacagaacgttctgcagaagtatttaccgaatagtatctgtgtgcagtttgatgatattaaaggattgaagaagaatgaacttcgtgacatctttactggaaagcaggcaatctatgtttatcacaatcagattgatgcaaggggagataaggccaatacagaagatgaagttttcgttgcttgcaaagaagccgtcgcagaaattattgatctgatacgccgtatatccacaaatgctaatacgtatcactttattgtaacagcggatcatggattcatctataagagagacaagcttactgagagtgataagattggtggcataaacgataagaaagcatttgtaaaccgcagattcattgttgcaccggaagctgttcaagaggacggcattgcacatatgagcatgggaattgtgctacgaaatcaagatatgaaaatggtatcgttccctattagtagcaacgtatttaaggttgcaggtggcggacagaacttcgtacatggaggctcttccccacaggaaatgcttgtaccgctagtagaagtgaagatggaacgtggacacatggagacaaagaatgcagagattgcccttgttagcatggttcagaagattacaaataaaattacaatgatggatttcattcagtcagaacctgtcagcgatacagttaaggttacaacatataagattttctttatctctgaggataatgaaaagatttccaatgaaaatagctatattgcagatagtagagagccaaatgcacagaagagaatctttagaatgaagttccagtttaaggataagaaatatgacaaggacaagcagtatttccttgtcgtttatgatgaaaataccggattagaaagcttccgtcatccaattattatggatttggcatttgctgatgatttcggattcgggttctaa

SEQ ID NO: 1577 - DNA, 2304 bp, Vibrio cholerae; identical to SEQ ID NO: 1292

SEQ ID NO: 1578 - DNA, 2598 bp, Escherichia coli; identical to SEQ ID NO: 1391

SEQ ID NO: 1579 - DNA, 2598 bp, Escherichia coli; identical to SEQ ID NO: 1385

SEQ ID NO: 1580 - DNA, 2316 bp, Vibrio cholerae
atgattgatacctggtttaaagaggatttagcgcgcatcttggaacagcaccctgtggccatatttattgatgaaagcggtgaggcggagtttctattaaagagcctaaaacgagattgtgatgtgtatcgcaccaatggagaactcgacgagttggaagcgaaatatcgcgttgaaaaggccttacaagagcatcctaaatctgagcacaagtacgttatctatacgcaactcagcaaagaagacttaaccttcgtacgcgagtactgtgagactaatggttgcatcgagattcgttatttgcagaactacatcaaagataaagttcaccggaccttaaacttaaatattaacttgccgaaagatgagttgatcgctgctgcaaaagtgagtgtgggtaaagatcgtacctactggatggacttaagccacaaaggggcctctgaaatctttgatttagacaaggaactgctgccctttgttcatgatcccgaaaactatgtcactgaaaaatacgacgcacagttacgtgaaaccttttaccgaaaggttaatgatctgctaggccaagaatatattgataaacctgcatctacccttgcgtctgaggttgtctctgcgatgttaaagggcttggcggataatgactgtgataagacgttgttatcagtttacaacagttggcttgattcggtgagttatcgcaattcatttggctcatacctcaccaaacataagttggattcagcgtttattagcagcagtgctatctggcaggtcaatcccgaccacccatttaggcaggtggatgaagcttggttaaaggaattaggcaataaactggctaataaatctttgtctaaagtagagtcagcacaactagttgctaggctgaaacaacgccatcaaagcaaacaggcacaagcgctgggcattgcgttttggaacgacattattgctttgctcgattttgatccgaaggatatgtcctatttaagcagctttgctgaatgtgttgagttttacaaaaagcatttctgcccgcttgatactgccatacgtaatttgtacaccgaatttttgcaacaacgtgacagccttgagcctttccaagaactttacaaagaatacgttacgttgtttttagataagtggttccagtatttcagtcagtaccgggaagatcaaacgggcattttacaagccattattgaccgcgatatccaaattgatcgcccaggaaagaacagcaaaatagccgtgattgtaggcgatggcgtagcctatgagattgcagagcaggttgctatcaaggttaagcaactgggtaaccatagtacacttactcgccgccatattttggctgattgtccatccgaaactgaaaacaacatgagtcatatttacatggcaaatggtgtggttgaggccgtgcaaaataagcgagaaaagtatctttcagcccaaaattcacacattgatatcgattacattcgtcttgatgaggtaagtgataagcctctatcgggtcaggtgctaatttgtacctataaagatattgatgacatgggtgataagctcaatcataaggcgctgaaatacttcccagaatctatcgatttttttgctgaaaagattaatcagttgctcaatatcggctataccaaagtgtatttaatcaccgaccatggtttcgtgttgactggcttgctaagcgaagccgataagatagtggttaagccttcagggcaaaactacattgacgaacgctttatctggaccagtgacaagcaagaaagtttaatccctcagtttattgaagtagcaaaggcctacaaagattacaactatctttactttgcccgcagcatgaacccgttcaaaacccctggcacttatggctttgcgcatggcggtttagcacctcaggagttggtgacgccttatttttgttgggagcaagaaagtgatgttatgggagagctgcctgtaaccattgcgaacaagcatgacttggtcagtgtaactggagagctgtaccagctaaaactgcgggctgaaaatatggcggaaagtggcgagggcaatttgtttacacaagaacgtaaggtaatgctgctgttctttgctaacaaaacccaagtgaacaagagcgatgttattacggtgcagagtaatggtcacgttacgaaagagtacacctttgatggccatgaagagttagaagtgcaattggtagatgcgatgacaaaacagcagcttgatcgtgttcttattaaaaagaataacgaccgcgaccttggcggattattttaa

SEQ ID NO: 1581 - DNA, 2622 bp, Methanoplanus limicola
atgccgatattcagcctggaaaagacaacagacgcaatacttgagaagttcagcagaccgtcagactacgggataagaagaatagtattctggtacgacagggacacaacagccggagaaaaagatcttgaatacataacagaggccctccggcagaagaagataaaactgcacatacttaagaacaacttctacgaaacaaaaaaactcctcgaacatgacgatctaaaatcagacttcctgatatactccccacaggcagaaagaccatacaaagagaactggcttctggatatacagctctactccggccggtttgaaaacagccggatctccgacctgaaaacagagatcggaatcgaaggatacaggcatgacagcttccttgaagagcagaaaaaattctttgcaaacaaaagaagagtcgcagccttcaaaaaattctaccggaatacatggaatgaagaggatttcatatccggaattttcgccgtactcacaggatcaaacgtcatagacgagaatgaaaacatcagaaccctcctgatgaattcactaaacgaagatgaaaacacagtctggcaggagatcctccgctacaacctctcagataaattctgggagagaacagggcggcattacggatattattcagaacacccaacactgaaaaaactcttcttaagcttcctgataacccacatagacctcaatacagaactgcccctaaaaacccttaaaaattacatcaaccacaacagacagagcaatgaatgcgagatcttcatctccggctggatgaacaattcaaaagactcatggcgctttgatgaatactgcacaaaccttctccgtgaagataacagcagacttgaagcggcactcacatcagaactgaaaaaatcaaagactgaaagctacatcagtgcagaatcacccgacattattgataaaaccatcatccgcaacatagtcggcacaatcacagaaggcggcagggactacagcagatacttaagctggatagaagaacggaagacaaaacactactatcagaaattccatgacatatactccgccttaaaatacggaataatgcttctcagcctctcagaagagacagaaaagaagggaatacaccaggaaaacctcaacggactcttcacagaatacagaaaaaactattaccttcatgatctttattaccggaaattctatctccactatgacagggatagtgacaaagagatactcagaaacggcatacgcgagataatagagagagaataccgccgcataaacgaaaaaatcctgatgaaatggagtgacctgacagagtcagagatgaacggaaaatggggcatagaactcattgacaaccagagcgacttcttcacagaccacgtatcaaagatcatcagcagaaacgagagagacaaagcagcagtcataatttcggatgcgctgagatacgaagtcgcagccgaactaaaagaggtcctaaacaccagcacaaacggcacaatagagatgagtgcaatggccggatgcctcccgtcatatacaaaactcggaatggcatcactgcttccccacagcaatctggagtacagagacgagctgatattcgcagacggaataaacacagacggcctctcaaaccgggaaaaaattctgctcgcagaagagagagaatccatcgccttcagcttcagggacctctggaaactgaagaccgatgaagcaagggaacagctcagaggaaagagaattatttacatctatcacaacagcatagacgaaaccggagataaacactcatcacaggacgatgtcttcactgccgcagaatcggcaataaatgatattgacgctatggtaaaccgcctcagccggaacttaaacataaacaacattatcataacagcagatcacggcttcatctacagcagggattcgcttgagagtgccgacattgtcaatacagacacctttgacagggacaaatggatcacatccaataagagattcataatcagcagcgagaagacagacctgccaaacacccacagattcagtctgaccataaattccgggcatgaaaaaccgctgtacatctacacaccctatgccgatctgcgtttcagactgtcaggaggcggcagaaacttcgttcacggcggtgctgcactccaggagattgtaattccggtcctgctgtacaaccacaataaatcgttatcagaccttgacagaaaaggaattgaatacggaacagtcggaattacagttatcgaacaaaacagaaagatcacaggcaaccctttcaggatcagactcttccagaccgaaaatgtgactgataagcgtgaaccattaacatgcagaatagggctgtacgataattccggaaacagagtcagtgacgaaaaaacagtgatagcagataaaagctcagatgaaccaaacgagagaatatcagaggtgatactgacaatgagcagctcaactgaaaacggaatatatcatttaaaggcattcaaagaggataaaaatgaattatacggcgatgtctttgacatccctgtagaggtagatcttctgataacagacgacttttaa

SEQ ID NO: 1582 - DNA, 2358 bp, Methanoplanus limicola
atgccggggaaatttattgaggaagtgaagaaggctattttgagtgcagcgtctgactatgacagggagaggttatccgctccggttgcactgatatggacagatcataaccgggaatgggagccggttgttgaaaaacttgtaaaagatcacgggatgccgattgcaacatttggcagttatgatcctgaggaatttaaaggccctgcaatttatatccggtgcttaatttcgcataatctgaacggtggcagttttggggttgctgatgtttccccggattccggagtgtctgatgaatcaggcgtaccggaatttccaaaagaaggaactccggtcatataccttcccggatattcaaaagatgttttaagaaacccggaaaactgcccggaagaactgcttcagctctttgaacttcagtacagagggatagtatggtcacagaaaaataacagggactggacaatacccgcctttatcaaaaatatccttgatattgacataataatggataaagagacaagacaggccgctataaatgcagtcggtgctctctgtgacgaagatgtaacattaatcaaaaacagagcacccttaaacgcctcttactttaactccctcattcaccccgacacaaaaaaacagctcctcctctggatgaactctccaaaagaagaaaaagagagaatggggccggaacagtggcggccattctgctcaatctgtaaatccgaatatgaatttgacccggaaaaagatactcctgtaacagccgcagaaaaacttggctcacttaagaacaactggtcaaatgtctgggagagatactgcgaaaatccggacaaatacgtaaacattcctacccttcttagaaattcaaaaatgccgcctctggttgtatatcaggactcatggcctcagaataatgataaactggagaaaaaagtcaaagaagagcttcttcacttgcaggaactaaaccggaatgatgcagtcaaaaaagtcctaaccctggagaagaaccataaaatcagaagagactgggtctgggcaaaaattggagaaagcccttacgcatgcacattaaaataccttgcaaaactcgcagaaatagtccgggagaacagattttccggaacaatacaggagcaggcagaaagatacacagaggaatacttcacagccgatgatgcgatattaaaggcaataagggaagcaggaaaggacaaagaatgcctccggataacatcagcagcaattgcagcaatatcaaaatcatggttctcttcacttgcagaaagttttcagaaagaatggaccaacaacccgccggaaatttccaaatcgggttataaaccggaaaaaggaacggtttacctcttcgttgacggtcttagatttgacctggcaaatgaacttaaagaaataatcagcaaggaccatcctgaaacagaccttaatttcagctatgcagcacttccgacattaacctcaactgcaaaaccggcagtaatgccaatagccggagaactaattgcaggcagtgaattcactccgtttacaaaaacagaggcagcagcaaacatcacggcccttagaagaataatggaagagcatagtattcaggttcttgatgataatcgaacaggagatcctgacggttcagcatggacggactgcggaaatatcgaccatgaagggcatgacaaacagattgaactcccgctgataattccggcagaacttgaaagaataagcaaaagagtacaggaactgataaatgcaggctggagtgagataaaaattgtaacagatcatggctgggttttcatgcccggagaaatggataagactgaactcctcccggccctcacagaagttaaaaagagcaggtgtgccagacttcgcccggatgcgaaaaccatcttcccgacttcaaagtggcattgggacagaaatgcaaccgtggttttctcacccggaattacctgttttgactccggaaaggtatatgaacacggcggactaagcccacaggaagtaataatcccacagatgacagtaaagggcagggaaaaagccaaaaccggattagtaaaaataacagaaatgacatggagaggactgagactaaaaggaaagaccgaaggctgtgaaggtctgtctgctgatataaggactcagccgggagatgagaattcctcccttattgattccgttaaggaaatatcagatgaaaaactctcccttttggttttagatgacagtcttgaaggttctgaggcatttctggttctcatagactcagataaaactgtatgctatcaaaaggaaatcacaataggagaagaataa

SEQ ID NO: 1583 - DNA, 2304 bp, Vibrio cholerae; identical to SEQ ID NO: 1292

SEQ ID NO: 1584 - DNA, 2598 bp, Escherichia coli; identical to SEQ ID NO: 1225

SEQ ID NO: 1585 - DNA, 2304 bp, Vibrio cholerae
atgattgatacctggtttaaagaggatttagcgcgcatcttggaacagcaccctgtggccatatttattgatgaaagcggtgaggcggagtttctattgaagagcttaaaacgagattgtgatgtgtatcgcaccaatggagaactcgaagagttggaagcgaaatatcgcgttgaaaaggccttacaagagcatcctaaatctgagcacaagtacgttatctatacgcaactcagcaaagaagacttaaccttcgtacgcgagtactgtgagaccaatggttgcatcgaaattcgttatttgcagaactacatcaaagataaagttcaccggaccttaaacttaaatattaacttgccgaaagacgagttgatcgctgctgcaaaagtgagtgtgggtaaggatcgtacctactggatggacttaagccacaaaggggcctctgaaatctttgatttagacaaggaactgctgccctttgttcatgatcccgaaaactatgtcactgaaaaatacgacgcacagttgcgtgaaaccttttaccgcaaggttaatgagctgctaggccaagaatatatcgataaacctgcatctaccctggcgtctgaagttgtatctgcgatgttaaagggcttggcggataatgactgtgataaaacgttgttatcagtttacaacagttggcttgattcggtgagttatcgcaattcatttggctcatacctcaccaaacataagttggattcagcgtttattaacagcagtgctatctggcaggtcaatcccgaccacccatttaggcaggtggatgaagcttggttaaaggaattaggcaataaactggctaataaatctttgtctaaagtagagtcagcacaactagttgctaggctgaaacaacgccatcaaagcaaacaggcacaagcgctgggcattgtgttttggaacgacattattgctttgctcgaatttgatccgaaggatatgtcctatttaagcagctttgctgaatgtgttgaattttacaaaaagcatttctgcccgcttgatactgccatacgtaatttgtacaccgaatttatgcaacaacgtgacagccttgagcctttccaagagctttacaaagagtacgttacgctgtttttagataagtggttccagtatttcagtcagtaccgggaagatcaaactggcattttacaagccattattgaccgcgatatccaaattgatcgcccaggaaagaacagcaaaatagccgtgattgtaggcgatggcgtagcctatgagattgcagagcaggttgctatcaaggttaagcagcttagtaaccatagtacacttactcgccgtcatattttggctgattgtccatccgaaactgaaaacaacatgagtcatatctacatggcaaatggtgtggttgagcccgttcaaaacaagcgagaaaagtatctttcagccccaaattcacacattgatatcgattacattcgtcttgatgaggtaagtgatcagcctctttcgggtcaggtgctaatttgtacctataaagatattgatgacatgggtgataagctcaatcacaaggcgctgaaatatttcccagaatctatcgatttttttgctgaaaagattaatcagttgctcaatatcggctatggaaaagtgtatttaatcaccgaccatggtttcgtgttgactggcttgctaagcgaagctgataaaatagtggttaagccttcagggcaaaactacattgacgaacgctttatctggaccagtgacaagcaagaaagtttaatccctcagtttattgaggtggcaaagtcctacaaagattacaactatctttacttcgcccgcagcatgaacccgttcaaaacccctggcacttatggctttgcgcatggcggtttagcacctcaggagttggtgacgccttatttttgttgggagcaagaaagtgatgttatgggagagctgcctgtaactattgcgaacaagcatgacttggtcagtgtaactggagagctgtaccagctaaaactgcgggctgaatcgggtgaaggaaatatgttcacgctagaccgtaaagtgatgttgttgttctttgctaacaaagcccaagtgaacaagagcgatgttattaccgtgcagagtaatggtcaggttactaaagagtacacctttgatggtcataatgagatagaggtgcaactggtagacgcgatgacaaagcagcagcttgaccgtgttcttattaaaaagaataacgaccgcgaccttggcggattattttaa

SEQ ID NO: 1586 - DNA, 2304 bp, Vibrio cholerae; identical to SEQ ID NO: 1292

SEQ ID NO: 1587 - DNA, 2565 bp, Bacillus cereus
atgaatacaaaagaaataaatcgtgtcctacaagatacgttcaataaagagttaacagaaggaaagaagcgtcatattgttttttggtatgatgaagctggcgagtttatcgaagatatagatgagctgaatttagaaggtgttcgtatttggaaattaaccccgcataatatgtttgctactaagttagaagtagaaaaaaatgatgtgaattctaactttttaatttatgcaaatatggctaagccttcagcaagagaagattggttacttgatgtgtataaatatagtcaagagtttgcaacagataaaatgactgtcatgatgcgagagctaggcataacaaatgatgctgctttgcgagatgtatttaagaaatatacaaagttctttaagagcaaagaacgtgaagcgttgtttaaatcgttttcagttcctgaatatacagaagagcaaattgatcttgttgtattagcatctttatgtaaatgtaatattgtgaatttagatgaagtaataaaggcgttatttagagaacaactaaaagaaacgaataagtattgggagaacattcgaaagtttggtaatgaagagacattttggaaccttgtagagaaaacatacggctacaatttacaagataagtcaattaattcactccttattttcttcttattaacaaatgttagtgaaacattgagcggagatatacccaaaacatggcaaccatacatttcagctataccaatgaatgctattgtatttatgaatcaatttatgaatcatagtgcggatgaagtaatttacaatgagctcgcaaatacggtggaaaaacaagtgaaagtgacggaacatctacaaagtaaagaaataaaagattatataacgtcagatacgttctgttgttttgatacaaacattattacttatattacaaaacaattaatgaatgcaattcatgattacacgtcatatatagaaataattgcggcaagaagaaagttgcattggtttagtgtattccgtaatgagtacgaagcactgtatcaagcgattcagttatttcaacaaatatatgaaatgggtaatgcaattactgaatcacagccatttgatttatttaaagcatacgagagtaaatatcacaatatagacacagcatatagaaaattttatgtagcattcgatcagattgaagataaagatggttttagggcacttcgagataaagtagaaaacatatatacaaatgtatatataaatgatttagcaataaaatggtcagatgcgcttgagggtgaacaagaagaatattggccaattgcaggtctagagtcacaacatacattttatcgctcatttgtacaaccatttgttaataaagaagagagagtgtttgtaattatatcagatgcactccgctatgaagttgcgaaggaattatctaatatgttgaatgtggaacgaaaagcatcgactgatattgtcgcgatgcaaggtgttctgccttcatatacggacttagggatggcgacactacttccgtataagtcaatcacttttaatgaaaatgctgaagtatatgtaaatgattacaaagcatcaagtacagaaaatagagcaacgattctttcaaagcattataaagactctacagctattcaatataaggatttagccgcaatgaatcgtcaacaatttcgcgatgtcttttctggaaaaaaagtaagttatatttatcataatgtaattgatgcacggggcgatcatgcagcaacagaacatgaagtgtttcatgcggtggaacaaacattaaaagatattcgttctttagtagatcagcttattaatactgttagcgcatctaatatcgttattacggcggatcacggatttatttataatcgagatacattgcaagctagtgataaagtgaaaaaagattttctgaatacagatattgaaaaacgacgatttattatctctagtgaatccaattctatagaaggtacaatgaatttttcaatggactatgtgttaggtgaaggttctggaaagtatgtaaaagtgccacgaggggcgaatcgtttcgctgttcaaggtacaggagcaaactatgtacacggtggtgcaatgctacaagaaatagtagtgccagtaattaagtttaaaaatgatcgtagtaagtctagtaagaatgatgtgagaaaggttgaagtgaaattaacaagtttaacaagaaagattacaaacagtattacatatctggagttcttccaaacggaaaaaattgaaggtaagaaaacaccattgcgcttaaaggtttatttcactgatgaagagggaaatcgaatttctaatgaaaatattattatcgcagatagtcagtcttctaagccagaggatcgtacgtttaaagaaaagtttgtgctaaagagcatgacttatgataaaacgaagaaatattatttagtgttagaggatgaagaagaggctgttgaaaatatttatgagaaagtagcatttccgattgatatagccattacaaatgattttggtttctaa

SEQ ID NO: 1588 - DNA, 2304 bp, Vibrio cholerae; identical to SEQ ID NO: 1292

SEQ ID NO: 1589 - DNA, 2604 bp, Salmonella enterica
atggatatcactcagcttcaaaccgggctaaacaacaaattcaccgcagatcggattgttttctggcacgacccagaacagagctttactgcacagcttacagagctcgccatactgtggaacgggttgccagtaacagtgctcaatatggcagagcagtcacagcttcaaactcgcaaacgcattgaaatcgatgaacccatgcagggattccttctctactggcccagttcagaaccatcaccagctaaagactggttgctcgatatacgtcgttatagcaccacgttttatgctgatgcagcctcaattctgcttaatgacctcggcctcgccaatatggcgctgcgcgaccacatcgcgtcacgtaaaagctttttcgccaacaaggagcgtactgcagcctttaaacgtcgcctggacggccgtggcggcatagaagatccgctatcacttgatatgaaaatgataagtgtcgtgctgacctgtcatgctcagattgccgaaataatgaaaagcattggcgatcggttacttgaaaatgctgaaaccgctcttgttccgctagaacagcatggattactgcctgcattttggcatttaatgaaccgtgaatatggataccatatagctgaagggacagaaccatcactacgcgaactgattcgtaagttactggtgagcgaatgctacgaacagcttgattccaaagaacgtcctgtctggctacagtcacaactattagccacccctaccgggcgcgcgaatgccatggctctgctatctggctggcgtgattctaatcagtacagtagccattttgccgaaatctctgcacaggtagcagagcagctcgaacttgcttcacgcctgacaacgcaagatatctggctctggggagaggtcgaaggttttgaagcggtcgagcaaggtttgatccgtgagctgatatctggattaaacaacggcgatctgagcctgaatagagtagagtttacccaactgatatctcgccgtcgacatgggttctgggccagaactgtacctaaatatgcttatatttatcacgcgctgcaacaagccgaattgctgctggaactacgtcgttccaaaccggatggttttcattactcctcggcgcaagaaatgtatctggcctatgaagctgaattgttccagtttgatgcagcctatcgcctgtttaatgaagcactattgcacctacagggacaatcggtcgaagtgctggctgtactggccagtaaaatcgaagatctgtatgtaaactggtatctctatcagcttgggctaacatgggatggtttgttagctaaagagcagctacttgataactggcagttgggtctcccttcgcagcatcgcttctatgatactgtcatcaaacaacgctttacccagagcggggtcaagcgccagtttgtgattatcagtgatgccttacgctatgaagtggctcatgagctccagggacagataaatgaagccaaacgcttctctgcacagctcaagagccaacttggggtactacctagctatacgcaacttggcatggccgccctactcccacatcagcaactagactatgccgctaccagctcaacagtattagttgatggacagagcagctcgggtttagaaaatcgcagcactattctcagtaaggtgggtggtatagcgatttcggccaaaagtctgctgagctggacccgggcagaagctaacgaggcggttggtgacgcaaaggtaatctacgtctatcacgatgtcatcgatgctcagagtgaatctcagaaaagtgagctcaagacattcattcatgcccgccaggctatagacgaactgaatggactcatcaacaaaattatcaatgggtttggcgttactcgcgtagttatcacagccgatcatggattcttattccaacaggcctcagttgaaaacggggtaaaatcgcctctgaaacacgaaccatctggaactctggaagcttcaaaacgctatctccttgctcgcaatttaccaacaaacgaagatgtctggcatgggcaattacgtaatattgttggtggtaactctgatgtggaattctggcttccgaaaggagtgagccgtttccattttgttggtggagcccgcttcgtccatggtggtgcaatgttgcaagaggtctgtgttccaatacttgaagtacaagagctgcgtggcaagaaacaaactctacatgaaaaaaccaaagtcgacatagttccggcataccaacccattaagctggtaaatgtgatcgataaaatccgcttcctgcagaccgatgccgtcgatgaacgtcataaatcaagaatggttcgtttctcggtggtagatagttcagaacaaaccgtgtcagctattgagaagctactctttgacgcgacttcaagtaatctcgatcagcgccagcaagacgtgcgtttaaaactgaccggtgctcaatttgaccgcaaggcgcagtatcaattgctgctcgttgatgatgaggatggtattgaaatggcacgctatccagtcactattgatttggcaatccaggatgaattcggtttttaa

SEQ ID NO: 1590 - DNA, 2316 bp, Vibrio cholerae; identical to SEQ ID NO: 1580

SEQ ID NO: 1591 - DNA, 2709 bp, Collinsella aerofaciens
atgcccaagatcgatgtagaagaacagctcaagctgcgatttttgcagccgttgtcctcatgcgcgccgcgccgtgttgtggtttggcacgatgcggacggcgagtttgctcctgagtttgagcgattggctgccgagggtttcgacggcgtgggggccgatgccggcgtaatgtctgctcacggtgactttgagcgcccggtgcgctttgttgaggcctgcgagggccgtatgtttgccgtcaagaagctcatcaaccgcgatgaccttgcgagcgatatcttgctgtatcgccgttgcccgcgcggcaggcttgagggtgattggcttgccgatgttgagctgtatgccgatcagttccaggctgactatctttcgcttttggccgatcagctgggcatcgagaatatcgacgccgtgcgcgagagcctgcgcgagcacaagacgttctttgatgccaagacccgctgcgctaagtttgccgcgtgtgttccgcatgcctcgggcgcatccgatatcgaactcggcatccttacggtgatttttggcggtaaagagcctggtgacgcgcgccccgcgtttgtgctgcgtggctgtatgaccatgttgctgcacgagggtcccgaggcgctggctgagttggcggacaagtactgcgtgcgcgatgccctctctgccttcattgtgcgttgctatgggtttgatgggccgctttacgagcgtgactcattgcttatgcttgcatcccatgtgctccttacggcggcatcaaccgcgcttcccgagggagcgctcaaggggctcgaaagctatgtggctcccgcctacggcccctattgccttgaggcggtgcgcacgtgggaccaggccgccgatacccaggcatcgagcgaggacctatttgagatctgtcgtttggtggaggatgcccgtgggctctttgcgcggttcgagactctgccaatcgatgcgctggcctcgcttgacgtgttcccgtgcgtcaacgaggccgtgctctcgcagctgttcagttcgtttgcccagggcgcggaccgcgttgaggacgcacgtgcctttgtggcgcgccgttgcgacctgagctggtaccgtcgtgtcgagagctattttgacctgcttgccgctgtggccgatatgtgtgcgtttaggcaggcgcacgcgggcgggttccatctggcgcaaccccagcaggtgtgggatgcctacacgtccgattggtatgccatggacgctgcttatcgccatatgtgcaccgcgtatctgcgggcgcgctccgtcgagtgtgatgcgctcgaggagcctgcccgctctgtggcggactgggcggagaatctctacagcaactggttcttggccgacgccaatgcctgttgggcggccgctgcgcagggggagtgggccgattgcggctacatcgaaggtccctcacggcaggatgagttctactggcatatgctgcccacctttgtgggctctgccaaaacgacggtcgttattgtgagcgacgcgctgcgctatgaggtggctcgtgacgttgcggcgttgctcgagcgcgagcgcggcggcaacgtcaaggtctctagcatgcaggcggtctttccctccattaccgaggtgggtatgcccgcgctgctgccgcaccaagcgcttgagcttgcagcagatggcccatttgtgttggctgacggcatgcccactgcgacgactccgcagcgcgaggccgtgctcgcccacgttgagcccacggcccgcgctttacgctcgagcgcatacctcaacatggcgggaaccgagcgcaaggtactgctcaaggactcaagactcgtctacctctaccacaacaagatcgatgccacgggcgagaaggccgctacgcaggatgacgtcttcgatgcctgcgcggacactgtggaggaacttgccacgttggcgcgccgtgtgtgcaccgacgccccgggcgcacgtgttgttataacggcggaccacggctttatctacacgcgtcgggagctcaacgagtgccagatgctcggcaagccagaccttcccgtccttgatgctcccgtcatgcacggcaaacgtcatctggtggtgcccaacgaggccgtactcaaactttcggatgaggcgtgtggggtgtttgttaatgttgacatgggacgtttgggagccggatttgaggggtttgccccgcgcgagaacgtgcacttcaagcgtcccggcggcactaacaactacgtccacggcggcatgagcctgcaggagctctgcgtgcccgttatcggattttggcgtgcacgctcgggttccaaggactttgtcgacacgcgcgcagcgacactgcgcgtactaagtgagggacgccgagtgaccaactcgcttttctcggtcaacttaatccaggaagaacctgtccaaggcaaggtcttgccgtgcgagtacgagctggtgtttaccgatgcaagcggcaacgaggtgagcgatacggtcaaggcgcatgccaacaagacttctgttaactcgcaggagcgcgtggtgcatgccaagtttgcgttgcatgcggcggatggattctcggccaagggcccgtactatctggtctgccgcgagcgcgagacgggcaagatcgtttggcgcgagacgtataccatcgctgtttcgtttgcccctgttgctgactttggtttttag

SEQ ID NO: 1592 - DNA, 2523 bp, Enterococcus faecium; identical to SEQ ID NO: 1373

SEQ ID NO: 1593 - DNA, 2304 bp, Vibrio cholerae; identical to SEQ ID NO: 1292

SEQ ID NO: 1594 - DNA, 2541 bp, Bacteroides sp.; identical to SEQ ID NO: 1414

SEQ ID NO: 1595 - DNA, 2670 bp, Vibrio cholerae
atgcagattagcgaactggcacaaggtgtcgctgccaagctcgaacaaagccgcattgtgttttggtacgacccagagcaaagctttactgaagagcttgagcatttagctaattctttatcgcttgcaaaagaatcaggtgataaagcggcagatataactgctaggggacttccagatgatttgaccatcctcaatatgggcaatgagtctgtattggcagtgaaaaaacgcattgaagtagatgagcgtgaagctaaattccttatctattttccaagcgctgagccagagcctgatcgtgattggttgctagacgtgcgtttgtatagcgagcagttttttgctgatcacagctcaatgctgcttaatgaattaggtatcccgaaaatggcgcttcgcacgcacattcgtaagcgccaaagcttttttgctaataaacagcgcatagccggtttaaagaagtgggtgactgagaacgaagacgaactgtcgttagacaggaagatgatggcagtggttgtaaaagctgattctgcgtctttgtcggacattttgcttgggttactacgcgaatatgcggcttatatcgaagatgaaagccttggtcaacctttatggagccagctaggaaagtttgatcttgagacctctctctgggcatatctgagtgagggttttggctatacagtcgaagagccaaccttctcagacttcgtgttgaaattgttctgtactgaattctggagccaaattgaaggtgttgaacgcgattggttgcttaacaatgttctaaaaagcgcatcaggccgggcgacagccttggcgtttatggtgagctggcgcgacagccgctctttcgccgcttactacgaaagcatctctaaggtgcttagccaacagttggaaatttcgactcgtgcaggccagtaccatccggttgagcttatcgaatgcgaaacgttcgaagctgtggaacaggccataatccgtggtttagttcgtgatttgctcgatagcagtaaagcgctagaccgggttcagtttgatacggtcttatcaagacgtcttgctagccactggacattgtcacgcaaagaatacttcgcaatttatgaagctatccgcaacgctgaagagttaatgcacttgcgaaatcgctatgtggacgggttccactttgataacgcgaaagcaatgtacgacgcctataccacagacatttatcgctttgaccaggcttaccgtttgttcaatgaacatgtgcactctgtattgagtaaaggtgcagacatactgcgtcagctcgacgacgaagtcgaaagcatttataccaactggtacttatatgagcttggccttgcctgggatcgtcacttggctaatgagaaattacttgaaaagtggcagatttctggcgtaccgcaccagtatgacttctatgaaaaagaagttcgtacacgactgagtctgaaacagacaaaacgagtgtttgtgatcatctctgatgcccagcgttttgaaattgcgaatgagcttggcgctatcattaacaacgagaagcgatttaaagctgaggtgtctactcagttgggtgttttgccgagttatacccaacttgggatggcggcattattgcctcataaggcgctcagttatcagccagagcaaggcacggctgtttatgtggatggtatttcttcacagggtttagacaatcgtaactccatcctacagaaggttggtggtatggcggtgagttctaaagaactgatgagctggagtaaccaggaggggcgtgacaaggttcgagacgtagaagtagtttatatctatcacgataccattgatgcgattggtgataaggcagcaactgaagagaaaacgtttgaagcctgtcgtagtgccattgaagagctaaaagacctcgttgggcgggtcatcaaccgtctaaacggcagccgagttgtgatcaccgctgaccatggcttcctcttccaacaaaaagcacttgtagcggctgacaaaacctcgttgaaaaccaaacctgctggcgcgatagaagccaagaagcgttacatcgttggtaataacttgccttcagatgaagcctgttggaaaggttcaattaacgatacggctcatggttctagtggttcttcatatcaagcagagttcctgcttccaaaagcggctcaacgcttccacttcgttggtggtgccaagtttgtgcacggcggagcgatgctacaggaagtctgcgtaccggtactacatgtgcgagagctacaaaaagaacaagcagcaaaacatgagaaacaaccggtaggtgttgttgcagccactcagcccataaaattagtaaacaatatcgacaaggtcagatttattcagacagaccctgtaggcgatcgttttgttgcacggttgttggatgtctatatcgtcgatgcacaaggtaatgaagtatccagtcgtgaaacgattaactttgatagcgtgagtaaagtgatggatgaacgtactcgcgaagctaggttaaagcttattggctctcagttcgacaggaacgctcaatacacattagttcttgagaatgcggaaatgagaacccgttatagccaatacgcggtaaccatagatttggcattccaagatgattttttctaa

SEQ ID NO: 1596 - DNA, 2658 bp, Vibrio cholerae; identical to SEQ ID NO: 1368

SEQ ID NO: 1597 - DNA, 2304 bp, Vibrio cholerae; identical to SEQ ID NO: 1292

SEQ ID NO: 1598 - DNA, 2523 bp, Enterococcus faecium; identical to SEQ ID NO: 1373

SEQ ID NO: 1599 - DNA, 2514 bp, Fusobacterium sp.
atggaaatagataaaatcaaagaactacttgaatatagatttagtttaaccactgaacttccacaaaaaagacatataattttttggtatgattcaaaaaaagaatttaaagatttaattgatgagttaaatttaactgatgtaaaaattatcaaactaactaaatctcttgataaaaagggagaatctatatatacgaatatatttaaaacaaaatatactttagaagttatagatactgaatcaaattatttaatttatagtgaacatcctagatctattgacagtgaaaattatcttttagatatagaaaaatactcagagttctttgaagcagataagtctgcaatgatagttgaagaactaaaattagatagaactaactataaattaggagaaattatcaaagactatcctagcttctttgctaataaagaaagaagagaaaaactagcaaaattgattgaacagcctgaatcaattgatgaagaagaatttaaactttcaatattgactgttatttctggagcaaaaacagttgatatcttagaaataataaaaaatataattttaaataaatctaaactacaagatatagaaaaatggctaaatttagattttttattttttgaaataaagaaaaaatttgatgttgaagttactagttttgaacaatttttaaaaattcttatggtaactcatttttattttcaattacaaaagaaagctcatacaaatttagaaaagtattttacaggtagaaaaaatgaattatacatttttgctgaatctctattacaaaataaacaaatttctgaaattataagagaagaattttatgacttagctaaagatttgaatataaaagatagaatagatgagttagaactagattattctatctcaggaacagcttttgaatactttgataaggttattattaaagatattatagatatctttaattcagaagttatagattatgaaaaatataagaaatacattgaaataagactagataattctttatggatagaaaagtatcaatacttctataaggcattgttagctcttaatgatttctttagattaaaagattcattgataattgaagatagaaaagtattaaaggatatttttaaagattatactgagcattatttcttaatagataaattatatagagatttctatttttatcatgataaaataaaaaatgatgaattagcccctctatttgatatattaaaggctaaaatagataaattttatgaagttgattatcttgaaaagttattagctttatggtcaagtaaagtctatgaaagagaaaatttagctcaacaaagagatttctataaaaataatatagcaaatgctgatgttagaactgttgtcataatttcagatgctttaagatatgaagttggatatgagattagtcaacaattaagaaaagaagcaaatgttaaagagataaaattagatgctatgttgactgacttaccaagtagaactttcttaggaatggcaaacttattaccatgtaaaatagaaagaaatattgatttagtatcagctaaagtaattgttgatggtatagacagtcaaggaacagaaaatagagaaaaaatattaaaacttagttgtgaagaatcttctgctatttcttatgataattttaataagatgaatagaggaaaacaagaagaatatataaaaggaaagaaagttatatatatctaccatgatagtatcgatgcaataggagataaggcaaagactgaaagcaatacttttaacgcatgtaaagatgctgttgaagatattgtaggcttatctaaattactttcaagccttggagttgtaaatgtctatataacaagtgatcatggcttcctatatgaaaagaaagaagttgaagaatataataagcttgaactaaagaatacgaaatatgaggctataggaaagagatatgctatatataaaaaagaagctgaggaaaaagcttgtattactttaaaattagattctttgtatggagtatttccagaaaaaaatcaaagaataaaagctagtggaagtggcctacaatttgtacatggtggagctagtccacaagaaatgataattccattgataaactataaaagtggagctaattctaaaaaaatatctaaggttgaccttagaataagagaaagtgttggaaagataacatctaatttaacaaaattctctatatatcaaatagaagctgtaagcatcaaagataaatttatagaaagagatgtttcagtagcactatatgatgaaaatgttagagttagtgatgaaaagaaattgaaattaaattcaacagaagaaaatactatacatgattttagattgactttaagtggtgaacataaaaaagttacattaaaagttatagatattgaatcaggagatatattggattcaaaggaatatattgtaagtattggaattgcttcagattttgatttttag

SEQ ID NO: 1600 - DNA, 2316 bp, Vibrio cholerae; identical to SEQ ID NO: 1580

SEQ ID NO: 1601 - DNA, 2595 bp, Aurantimonas manganoxydans
atggataccgatcgcatccaggtcgcgctcagccggttcctcgctgagaacaaggtcgtcttctggtccgatccagaaagagaattcgaggatgtgctgtcgtcgctcgacgtgggtggcgcgacggtcattagggtgtcgagatcgccggctctcgaagcgaaactggcgatcgccgccggcgccgccgattctcggttcctggtctatgaggatcagtctcggccggaaccggccgacgattggcttctcgacatccgcctctacgcgaagggcttcgctgcggatcgctcgacccatatccttgaggatctcggcctacatacgccggccctgcgggatcatatcgcgcagcgagccaagtttttcgcgagccgcgagcgcctgacaaggttcaagcgtttcgtctcgccgaaggacaacgaggtcgatatcgatcggaagatcatggcgaacctgctccggctggacaacgccgacttcttcggcatcgtcatcgcgattttcgatgccttcccggaccagtccgacatttcccgcccaccggaggtcttcagcgaattcgcgaagtacgatgtcgaggagtccttctggagacaggtcgatgcggtgttcggatttgctgatccacgtccctcgctcggaaacctcctgatccgtcttctcgtcaccgacttcacgcgaaagctgaatggcaaaacgcctaaggcgctcgagcacctgaagcttcgtgggcaaggtacgtcgaacaccgccgtctgcgtggcacagtggcaggacagtcacgcccggcattcgagcttcgataggctttccgatgcggtctctaacgcgatcaagctaggggatcatgtcggttcggtcgatcccgaatatctcgaagacacacgcacgttctctctgatcgagcggcggctcgcctccggcctccggaatcggatcatcgacaccgataccgcggtcgacgtcgaggaagtcgcttccctgtgccgtcggcggaaggacgggtactgggccaacgaaagcctgggtgacacagcacctcgcaaggcctatgcgcggacatacgacgcgttggagtacgcggcgcgcctcttcagtctgcgcggcgcctacgcctcaggcttttcgttcgagacggtcgaggagttctggcaggcctacgaaaccgacctgtatcggttcgatcagctctaccgccatttctgcgaagctgcggatcaggtcgagaggcagggatgggatatcctcaagacgcttcgccagaaggtcgaggacgtctatgggaacggatacgtcgcgaagctggcgaccgcctggggcccattcgcggcagagatgatcagctcgaagtggcagatctccggcgtgccaagacagtcgcgcttctacgagaagcggattgctcccatcgtgcaagaagacgacaagcgggccatcgttatcatcagcgatgccttccgctttgaggccgcaaaggaactcgcggaccagataaacagccgcgatcgcatggaagcgaagctgacgacgcagctgggtgttcttccatcctttaccgcgctcggcatggcctcgcttcttccccacaaggatctcgcattttcaggcggggtcgtcaccgtggacgggaagtcttcgagtggaatgaagaaccgtggcgaaatcctcgcgaagcacggcggtggcgtgatcggcgcggaggaacttcatgcgatgtccgtcgacgaggggcgtcgcttcctcaggtcgaacaaggtcgtctacgtctaccataaccacatcgacaagacggccgacggcggcgatgaggaaaaagcattcgacgccgtccgcaggacgatcaacgacatcacgtcgctggcgatccgtattctcggcagcctgaacggaacgaacctcttcgtcaccgcagaccacggatttctctaccaggagagccctccgaccagcgtcgacaagaacgcggtcgaggacaagcctgaaggcgtcgtcttggcgaagaagcgctattacgtgggcgcgaagctcggatcgcatccaggtgcttggtccgctcctctctcgcgcacttcggacgtccgcgacgacactgagttctgggttccgaagggcacgtcccgcttccacttcatggggggtgcccgcttccttcacggcggcgccatgctccaggaaatttgtgtgccggtcctgcggatcgcctactcgaaagacaaggatgcgaacgacgtaaagtcccggccggtgcagatcaccgtcctcggcgcgaataaccggatcacgacgccgcgtcgcagcttcgaccttatgcagaccgagcccgtctccgaccgcgttcgtccgatgagtgttactgtcgcgatcgtcggctccgacgggcgtccggtctcggatatccagaaggtcacgttcgacagcaagacgccgacgatgtcggaagactggaagcagaccgttcggctgactctggccgggacggcgttcgataagtcgcagcgatttttcctcgtcgtccggaacgccgagaccaaggttcaggagttgagtcagcatgtcattatcgatctcgccatcgcccgcgacttcgactga

SEQ ID NO: 1602 - DNA, 2502 bp, Sinorhizobium meliloti
atgcaggataggatcgccaagggacttgaagcccaatttgacaaccatcggatcgttttctggtacgatccggcgcatgaattccggcaggcgttcgatgcactaacgctcgacggtgtcgaaaagattgaagtagcgaacaccgagttcgccgtgaagcatcgcatccttcgcgaggaaccgaagcggtgctttcttctctatagggatgggccgcgtccggctgacatcgacaactggctgctcgacatcgagctggcgcacggtgtgttcaagagcgatcaggttgcgatctggttggcggacctggggttgccaatcagtttcgaagacgttgtgcgggagcatcaggaattcttccgcgctgggcgccggatggagaagctcaaagctgcactccgtggggacgacacgaaggcaaagctgcgtctgaggatgctcggcgtgtgcgccggggccgacggtgacttcgataccgtcatcgaggcgctattgggagagcaggcagcagggaaggaagactgcttgcggttgatcgaccgcgtcggcctgagcggcttcctctgggatcagatggagcgtatcttcggctatcgtgccaacaagcccagcatcggcgacttcgccatcgctcttttcaagtcctgttaccagagcgcggtcggcggcgaagcgaagctggctccagaagccctagtgttcttccgccgctggaagaataaccggaatgctgaggaggccttcgctactctctcgaccgaatatgccgaggcgttaagcgttacccaggatctcaccaaacgcgacttccgcaccttgatcgaagtagatttcttcgaggaagtcgaccgagcgatcatccgcgctttggtccacgaggttggcaaccagactgtggcgcagggtgaggtcttgaactggatccgtcagcgtcggcagagccattggtacggcgcttatcgcgacctctacgaagcgatcgggttcgccgccgagttccagcaagcgattgcgcaggtcacgctcggcatgaccagcctcgcggaaggcgtggagcgctacgcaaagagttggttcagaattgaccagctctatcggaaattcatctggcgtatgcagaagtccggccaggcaacgctgatgcgcgaattgttcgaacaggtagagaatcactacgttaacagctatctcctgcgcctgaacgaggcttggcagacgcatgtcgatggggctcaaacctggtcagcgtccccgatccccgcgcagcgtactttttacagggagcaggtaagtgaatttcgccggcgcgatcagaaggtgtgcgtcatcatttccgacgcacttcgctatgaggtggcggaggagctgcgggggcgcatccttagccttgaccgctacgaggccggcattgatccgatgtttggctgccttccgagctacacccagctagggatggcggcgcttctgccaaatggtgagttgcagattgcggataacgacagcggcaccgtgttagtgaatggtcagagttcacagggaatagagaaccgcaagaaaatcctggcgaccggaaggaagggcgacagaacaacggccgtaaaggcggaagatctcatggcacttgacaaggatgaggcacgagcgctcgtccgcgatcatgatgtcgtttatgtttatcacaatttgatcgacgcgatcggcgacaagcgggattcagaagagcgcgttttcgaggccgccgaggacacgatcgaggagatcgtgcgggtcgtaaaaaagctcaatggcgcgaacgctaacaacatgatcgtgacgtccgatcatggcttcatctaccagcaccggccgattgaagagagcgacttctcctctgcgcaggttgaaggggacgtgatcctgttccgggaccggcgtttcatcctcggacacagtctgaagggcaatcatggcctgcgacgcttcgcgccggagcaggctggtctcgaaggttcggtggaatttctcatccccaaatccatcaaccggcttcgtcggcagggatcgggaagccggttcgtgcatggcggcgcgacccttcaggagattgtcgttcccgtcgtcaagattaacaagaagcggcagagcgacaccaccgcggtcgaggtagagatcatcggaagctccaaccagttgatcacgtccagtcagatttcggtccgcttctaccaagtggaggccgtcacggagaaaacccaggcgcgcacgctcaaagcagggatttatgcacaatcgggtgaattgatctcggacagccacgagcttgtgttcgatttcagatctgaaaatgcgcgcgagcgcgaagttccggtccggttcctcctgctccgccaagccgacgaattcaacggtcaggaggtaatcctgaagctggaagagcggcatggtgatacgtctcacttcagggagtaccgcacggctcgctacacgctgcgccgcagtttctcgagtgatttcgatttttga

SEQ ID NO: 1603 - DNA, 2508 bp, Sphingobium yanoikuyae
atgactgaccgcatcaccgccggcctgatgcggctctatgaggatcaggggcaccgcatcgtcttctggtatgacgccgcccgcgatttgcgcacggcgttcgacgcggtggacctgcctggcgtgaccaaactggagatcgccaacaacgagttcggcctgaaataccgcatgctgcggcaggagccgacggcgcggttcctgctctataaggacggccctgagccgccgatgcctgagaactggctgctggatgtgcaactggccagcgccgtgttccgcgccgatcaggcggcgatctgggtagctgatctcggcattccggcgaagtatgaagccgccgtccgcgatcacgccgaattttatcgttcaagcaaaaggctggaagcgctgcgcgccatcgagcgcgagcggccctcgcaaagcgccaacgatgtccgccgcaagatgctggcggtctgcgctggtgcggatggcgatctcgatacggtgatcgaggcgttgctggccgagctggctgaaggccgtgatgaggcgctgaagctggtggatcgggccgggctggcagagttcttctggaaggacgtggccgcgcgttatggctatgcggcggatgcgccggattttcaggatttcgccatcacgctgttttccagcgcctgggcgcgagccatgggagaagctgcccccctgaacaccgatgccgcgctgatgttccgccgctggagcgcctcgcgccggtggggtgaggcgttcgagaagctgtcgggcgattatcaggacgtgctgaagatcagggacgatctggcctcccgcgattttcgcaccctcatgccgcatgatcatttcgaggaagtggaccggaggatcgttgtcgccatcgttgaggggcttgcccggcagagcctgcccgcgactgatgtgctgaaatgggtgcgcgatcgccgccagagccattggtatagccgctacgcggatgtctatcaggccattggctatgcgaccgagtttcagcaggcgctggccgaggccgatctgacgatgaccagcctgtccgatggcgtgaagcgctattccgcaagctggttccggctggatcagctctatcgcaagttcatctatcacatgcagaaaagcgggcagtcggggctgctatccgcgctctatgaagcggtcgagaaccgctacaccacgaatttcgtgctgaagctgaacgatgcctggcaggatcaggtggctcgcctcacggactgggcggtcccgggctttccacgtcaggtggacttctaccgggggcaggctgctgaataccggcgcaaggatcagaaggtcgttgtcattatctcggatgcgctgcgctatgaggtggccgaagaggcactgcgcgagatacgcaagctcaatcggttcgatgctgaactgaagccgatgatcggggttttgccgagctacacgcagcttggcatggcggcgctgttgccgcaccgacaactggcgatccgcgacgacaatgatctggtgctgctggacggtgaaagcaccatgggggccgctgcgcgtgaaaaggcgcttgctgcgggccgggctggagaccgggtaaaggttctcgcggctaaggatttcatgaatctgggatcatcggagggcaaagacctcttccgggatcatgatgtcctctatctgtatcacaaccagatcgacgcgattggcgacaagctcaccaccgaggaaaatgtcccagctgcggcagaggctgccatcgaggatctggtgaagctggtgcggaaactgacttcggccaatttctcgaacatcctgatcaccgccgatcacggcttcttgtggcagcacaaggctctggaagagagcggcttcgcgctgagcgagccggagggcgagatcgttacacgaaaccggcgcttcgtgatcggccggggccttaacagcagtggcggcatgaagaagttctctgctgcacagcttgggctggaaggtgagcaggacattctgatcccgaactcgatcaaccgcctgcgcgtcaaaggatcgggcagccgctttgtccatggcggggcgagcctgcaggagatcgtcctgcccgtcctgcgtgtcggcaagcagcgcaaggaggatgtcggacaggtttcggtgcagatcattccgccaccccgtgctcagatcaccacgggccagatccaggtcaccttctatcaggcggagccagttaccgacaagcagcagccccggcaggtgcatgcagccatctttgccgacgataaaacactcatctcagatgaagccgagttggaattcgatttcacgtctgagaacccgcgcgagcgcgagttgtcgcggagcttcctgctgtccaaggcggcagacgcctataacaatcagacagtcttcctgaagctgcgaacgcgcatcggaaagaccagccatttcgaagatcacgcttcgcagccgctgctgctgaaacgcgggatcagtacagatttcgatttctga

SEQ ID NO: 1604 - DNA, 2625 bp, Pseudomonas fragi
atggatacacaacaacttaaccaaggcctgcggcaggcttttttcaaagagagccaccgcatcgttttttggtacgaccctgaacagggcttcacggatgaactcggccagctcgatctgcccggtgtacaggtgctgaatatgcaagggcattctaccttcggtactaagctcaagctggagcttgaggacactgaaggtaagtacttgctctatttcccgtgcgccgaacctgacgcgaatgatgactggctgttggacatcaagctttattcgcgcagcttctatgctgacaaggtgtcactgatcttccatgacctgggcctgcaccagcagctgctccgtgagcatctagccaaccgtgagcgcttccttagcagcaagactcgcctagccagcctgaagcgcttgatccagccaactgacaccgagcatgagttggatctggcgatgattgccgttgtgctgtgtgcaagtggcagtgacgtcatgacgctgctttgcaccctggctgatgttgtcgtacgtgacgatctgggtcttgagcagaatcctgcggtcatcgatgagctgtacaagttcggcctaatgccggcgttgctgcaggccctgcgtaaagaggtaggctatcaggcctccatcgaggaaatcagtggcgataaaccgttcaactttgggcatttccttattcgactgctagcgactgggttctgcgaaagcatcggcgatatacccagctgggcatcagcgatcgctattccctcagccagcgcacgcgcgacttcacgcgcactgctttcccgctggcgtgacagctcacggttttaccaagcctacgatgagatttccggctgggtcggtgatgccctgcatatcacacagaagattggtgaaatctcgttggaggttttggccaatgttgcaaccttccaagccgtcgagcggcagatcattatcgacctgaccaaggctattccggaagcagatccccgtgacctcggtttgttttcgaagatcatctccgagcgactggataactactgggcgactcgccataaggacgatgagacacgccacaagtaccggctgctatacacggcgctgtcggctgcaatcgacctgtttacgcagcgtcaccagtacgctgcaggcttccacttcgccagtaccgaggcgttgtacaaggcctatgagagcgagctgtaccgttttgacacggcttaccgccattattttgccgcctctcaccgcgcccacgttgagctgctgaagaagctcgatgaggccgtcgagcagtgctatgcgtattggtatctcgatcagctcggacgctcctggggcgaccgtgttgaggccgaacagcgcttggagcactggaaaatacctggtgttcctaaccagcataatttctatgagcgttgggtagcgcccttgttggaggggcatcgtagcaagcgcgttgtagtgatcatcagcgatgccttccgctatgaagccgctgtcgagttgtgccagcgcatcaatgaaaagcgttacagcaaggccagcttgaatagccagttgggcgtactgccgagttacaccacgttgggcatggcgtccctgctgccacaccagacgctggagtatcgcgagggcagtgatggtgtttttgtaaacggactcaacactggcaacaccatcgctcgcgacaaggttcttgcccagcatggcggcatggccgtgaccgcacttcaagtcaaagagtggtcccgtgacgctgggcgtgaagcgctaaaggatcagcagctggtttacgtctatcacaacgtgatcgatgaccgcagtgacaaaggcggcggctcagaggtggatactttccatcacgtcgagttcgccattgaggagctgaccgagctgacccgcaagatcctcatgcacttcaacaccagcacggtattgatcacggccgatcatgggttcctcttccagcagagtaagcttgaggcggcggatcgcacctcactcgcagagatgccggatagtgcgatcaagagtaagaagcgctatgtcattggccatactctgcctgttgccaaggatgtctggcagggatcgaccaagcagaccgcgggcacaacatcggacactcagttctggatacccaaaggcgcgaatcgtttccactttgttggcggtgcacgctttgttcatggcggggccatgcctcaggaaatcgttgtgcctgtgctgacggtaaaccagttgcgcggtgagaaagcggagaaacgcaccaagcgcaaagtcggggtgatctcgccgaagtcagcgctgaaaatggtcaccaatatccagcgctttgacctgattcagaccgagtcggtcagcgagcaggtgttgccggttacggttgctgtgtcgatctacgaaggggagcagccggtctccagtgaggaggtcgtgacgtttgactgtgcgacggactccatgagcgagcgccttaaacaggtacgcttgtcactatcaggcagcgatttcgaccggcagaaagattacttcctagtgatccgcgataaagatttgaacactgagcttgagcgctaccgtgtgacgattgacctggccttcaccgatgactttttttga

SEQ ID NO: 1605 - DNA, 2487 bp, Lactobacillus helveticus
atgcctacattaactactgataagattattgctaaacttaatagctattttacagataaccaatatgttttttggtacgatgataagcaagaattcaaggatattattgattcaattgcacagcatttaagcccggttaagctttataaagctcaagcaaatcaacaattcaagagtaagattgatttgctaaacgattcagagcataaatatttaatctatgcaccatacaagagacctgcaattcaagagaattacctaactgatatggaacattattctaagctcttcactgcagatgctacacaaattatcttggaagaactccaacttccagagaatcaactgctttttgttaagaagtataatagttactttggtgccaaaactagaagagcagattttgttaagtattggtctgatacttttgataagacaccagaaaagggtattattgctgcaattactaaaacagaaaagctcgatatgaatgagttgttaatgaaagtaattgctgcaggctatgttaataatcattatatttttacatttagtaaatatgatgtgcttgatattttttggaagctggtcatgaattacttcggtggtgaggctgatagtgaagttgatctgaagtatctagttgagcgcatttttatcacatatttagctaatgaattaaacgataagcttcccgatagatttaagaattattattttaaacaacaagataatgttcaaatctttattgatcgttttgctgactcaaataagtatcagcaatactatgacaactgctcatctacagtttggcgcgatttgaatttgaataccgtgttgaagcatgaaccagccatgattttgactaagattagcatattcgaagaaattaaccatttaattttggctaagttagtcgctaaatttgacggcaagagaattaccgattatgagcaactgcttgagatcatcgatcagatgcttgatcatacacgtaataatttcaatggcggaactgaacccgaatataaattcttacgatatgctgcagaattattgaatttaaaagtgccaatggttgatgattggcaagatgaattgaatgattacttatataatagctataaaattgacacgatttatcgtaagagtttgctagcttacactaatatcattgatactgataattatattgatattaaaaaaactattgatcgttattatggcaatatgttgcttgatagctctgttaagcagtggaatgaaacttttgatctaaaggaggttcctgtcaagctgaagcaagaacgcttttatcataattatgtcagggatgtacgagagagagtagttgtaattttctctgatgccttgcgttatgaagtagctaaagaattagaagaagagctaaatagcgatgatcgtctgacaatgaagatgaatcatgcaattacggttttaccatccgtcacttatatggggatgaatgtgatgctacctcatgaaactttagaatgggataataagacttctaaggttaaagtaaatggtgaaaatgcagagaatactgacagtcgggacaagttacttaagtcatatgatgaaaacaatcttgcttttcaattaaagaatgtcctggaaatgtcttctaaagagattaagcaaatgattacggggaaaaatgtaatttacctctatcataatcaaatcgatgccaaaggacatgaattaaagacaactaaagaattagttgaagctactgaaaaggcaattgatgaaattaagcaagctgttcaagtcctaagaactaatggtatagctcatatcatcattactgctgatcatggatttatttatcaagaaaagccaattgaagataaagataaaatcgatcttcaagggcaaaattatgaaggaaatactcatttaagatatttaatcactccaagtcaaattaatgtaatgggtgttaaaaatacaacaatgggtgtcagtttaaataatgatgatcctaccaatgtctattatccagtaagtccgaatgaattcgtagctagaagtggaagcaagaattatgttcatggtggttcttctattcaagaaatgttaattcctgttttagatattaaagcaacttctagaagatctattgctcaaccagcagaaattaagttagcggcaacaacatttagaattaataatttgaagatgaatctattgttcaaccagactgcgccgattagtgataccgtcttaccagcagaatatcatgcttactttactgatgaagatggtaatttgatttctaataatgtaactattgaagcaaatcgaactggttctgcagctgatcgtacaattgctattacgattacaatgcaagacatgcagtatgatcttgataagaaatactatttagtaatagatcgtgaaggtagtacagaagagccaaaacgatttgaatatagtatggatttgattaattaa

SEQ ID NO: 1606 - DNA, 2304 bp, Vibrio cholerae; identical to SEQ ID NO: 1292

SEQ ID NO: 1607 - DNA, 2598 bp, Faecalibacterium prausnitzii
gtggaaacagataaaatcgtattagacctcaaccgtcggtttgcggtaccgctgccggaattttatgagcgccggatcatcttctggcacgatgaagaaaaggagtatgcggacaagttggatgagatccggcttgaaaatgctaagctggttgcactgaccggcagcaatacctttgcggtcaaaaaaatgctgtcggtggatgacctgacgagcaactatgtcgtctactgccccatttcctacgagcggcaggaggatgattggctgttggatattgaactatacagcgaaagctaccggacggatgctgtttccaactggatgcaggaactggatatcttggacaatccctctatgcgcaagctggtgaagcactaccggaagttttttggtgcacaggctcgtcgtgccaaaatcatggcacaggataagatacctgccactccggcacagttgcacatggcagtgatggcggcactctgcggtataaaaaaagcacagcccaatgaaattttgctgaacgtgcttcgtggtgggttggataaagcgcagaatccaatctatcagagttttgtggattatagtgcagaagaagctttctgggcaatggttcggcagggctgtggctatgcagaggaagagccggatcttgggcagctggcaattcatcttctgttgacagcttctacgcgcacactgcgcccggaatttctggcagggcttgagaagttcctttccattccgcatcaggcgtactgctacgagctggtgtcggagtggctgcacagtgatgatctgcagcagctttatgacgtggcccgctatgtggaagatgaagcacatctgccgcagaggctggaaaaactgacggttgataatctggcgacaacggagtgtttcccgtgcatcaacgagatcatcctgagcaagctgatgacggagatcagtgaccatatcattgatgtggatgtgatcacaaagacggtggaaaaacgccgcacctgtgtctggtacgagtacttccgcaatttctacgagggtctgttgcaagtagccaacatgcaggagttcttcaaagagcactccgcagggttccataccccggatgcaaagcaggtctggaaagaatatgcggaggactattacaggatggacacctattatcgactgttccatctgagcttccagagaagtctggaaacctccaatatcaaactggacgacctgttcaagcatgttgtagataaggtagaggggctgtactcctactggtttctgggaggcctcggcaaaaactggtcggatgtatgtgctgatgagatggcagagcatggccgcgtattggaaattccgcagcagtcggatttctacaatgagtacatccgtccggcagatagccgcgtgttcgtgatcatctcggatgctatgcgctacgaggtggcggcatcactggcagatgaactgcgcagagaaacgcagagcaatgtgaaactcggcagtatgcagggcatcttcccgtctatcacgaaatttggcatggcggcactgctcccacataaggcgttgacggctgaactgaaaaatgaggtactgaatgttctggccgatgggcagtctaccgcaagcacgaaccgggataaggtcctgaaaggtgtaaatccggccagcgtggcgttgcagtataagaacatcatcgggatgaaacgtgcagagcgtgcggcactggtcaaggggatggatgtagtctatatctaccatgataccattgacgaagcaagccatacttcggacacctctgtgttcccggcatgcgacagggctatcagtgaactgaagaatatggtgcgcattatcgtcaatgacttcggcggggcgaacattctgattacggcagatcatggcttcctgtacacttacagtccgctgaccgaggatgacaaagtggataaaaccagcttccatgatatggaagtggaatatggcagacgctatgcaatcatgcagaaggaggcgaatccgcagtatttgcttcctgtaaaattcctggacggaaaaacggaatacactggatttgctccacgggaaggtattcgcatcaagatgaatggtggcgggctgaattttgtgcatggcggtatcagcctgcaggaaatgacggttccggtgatcgaatatcattatctgcgcaacggctctatggaatatcggcgcaataagcagaagtatgatacgctccccgtaacagtgagtttgctttcttccagtcggaagatcagcaatatgatcttttcactggatttctaccagaaagatgcggtaagtgcaaaccgtgaggctgctacttatctggtgtggtttacggatgaatacggaaagcctgtcagcgatacccagaagattattgcggacaaaaccagtgagaacggcgcagatcgtacgttccattgcaacttcaacctcaaatcgatgaagttcagcaatacagcaacctattatctggtgattgcggatgagcagggtcagcagatgcagcagcgggaacagttccagattgatattgcatttgcgattgatgagttcgatttttttaattga

SEQ ID NO: 1608 - DNA, 2625 bp, Acinetobacter sp.; identical to SEQ ID NO: 1409

SEQ ID NO: 1609 - DNA, 2541 bp, Bacteroides sp.
atgactcaagaaagaatatacagttattttcagcgtaacccgcagttgcatgtgcttttcatcttcgacaaggcgaatatcattatgaatgatttggcagactgttcgtgggaaactgaatatatctataaagtatttgatggagcttggttcaacactaaatataacattgaatacgcatggaaagagaaacgtgtggtattactcttcccattaggcacctatcccatgagtgaggaacaacagctcagattccctcttatggacatgctgaaagctaacatggaatataaagaggaagattatgccgcgttcatgcaacaatataaacttccagagaaatatcgcgcctttatcagccgccatatcggtgaattgatgtcgaataagataaatgcaatgctgaaagatcggtttatgccggaagcattcagtgaggatgtagtagtccgcggttttatttcttcttatctgggtgaaaagaggctcttggaatgggaaaacatcatcataagaatgttcatactcggattggattcagaaaataagaaacggttggatttctatcataagttggaacgaaacaaggatgccaagacagcggtcgatgagcgtttgactaagatatttggattcagttacaaacccaaccaagaggcgaaggtgaaagagttggtggagagtttgaagtataatagcatcacccaacttcttgatgtgattgccgatgattcctacaaggcttacaaaataaagagcagtatagcacttgaacaaatgaatcgtatctatgaactgggcacacgtgaccgggagtttgcagataaattcacgaaagtgatgaaagaactaggtgctgatattcgggaaaaggaactgacaaccatttatggcatggatgcttccttctattacttgacggaagaattaggttggcctattttgcaagaaattgccggtagcaaattcgtgacagaacctgcagaaatgcaagaacgtttgcgtttgctttcccaaaaacttcctgccgatagtgtgcttcaacaagctataagcttcttgatgcaaatggccttttattatgaaatggtaagaggactgggtagcctgaagttgaatactccggaagcttatgtgcaactctatacgaacgacttgtataggcttgacaccttctatcgttgtgcattggaggaatatcatgaattgttgtcaaaggatgttcctatacttacttgtttgaatggactgaaacaacagtttgatggagagtatgcacgtatggttaatgtcttcaatctggaatggatgatctgtgtgatagaaaaagggaactactttaacgacctgtcgttgaaaaaacaagaggatttttatgctaatgaatgtgtcagtaacagcaagcaggtagtaatcatctctgatgcgctacgctatgaagtggcggcagaactgatgcaggaactggctaaagagaaacatatagcaaaactatctgcatatcgtgccatgctgcctactgaaaccaaatactgcaagccggctcttctgcctcatacttcattgatatggaagaacaaagaaatgctggtagatggtgaagtattagacacattagagagccgttcggcacaggtggccaaatacaaagaaagtgcttgttgtgtagactatgaaactgtaatcaaagcagatgtaaaaacagcacgcgcactatttaaaagtccgttggtttatatcttccatgatacaattgacgctgctagtcacggggctggagccggagatgtaattgcggcttgtcgcaaggctattgaacagctcgctgtgctggttcgtcgccttcatgcctcttggaatgtgacgaatgttgtgctgacagccgaccatggttttctctacaatgacgtggaatttgcagagaaggataaacatgcggtgacagttgcgggtattatcgagaagaaaacgcgttactacgtgagtgatcaagttagcgcgcaagaaggggtggtgacaatgccattggacaaagtatcgggtatgaaagccgagactcctatatatataggagtacctatgggtaccaaccgtttggctgcttctggtggatacagctttgcccatggcggagcgaccttgcaggaaatgcttattcccgtgattcatagttcgcagaaacgctctgataagactaataaagtgggtgtggcattggttgatcacaatctcgtgatggtaagcagtagattgaaatttcaattgatacaaagtgaagcggtttccatgacggtagttgaacgtaaggtcgtttgtcaagtgtatcaaggcgatacacccgtaaccggaaagcaaaccattacgcttgacagtgctgatacgatcaatttgaataacagagtatacgaggttgtgctgatcttgaatcattcagtacattcaggtatgctacaactacgtgtgtatgatgaagaagactgtttgaatccacttattcgtgaagtggtgaagaataatacaatgatagaacaagacttttaa

SEQ ID NO: 1610 - DNA, 2670 bp, Proteus mirabilis
atgcagattagcgaactggcacaaggtgtcgctgccaagctcgaacaaagccgcattgtgttttggtacgacccagagcaaagctttactgaagagcttgagcatttagctaattctttatcgcttgcaaaagaatcaggtgataaagcggcagatataactgccagagttctgccaaatgatttgactatcctcaatatgggcaatgagtccgtattggcagtgaaaaaacgtattgaagtggatgagcgtgaagctaaattccttatctattttccaagcgctgagccagagcctgaccgcgattggttgctggacgtgcgtttgtatagcgagcagttttttgctgatcacagctcaatgttgcttaatgagctgggtattccgaaaatggcgcttcgcacgtacattcgtaagcgccagagtttttttgccaataaacagcgcatagccggtttaaaaaagtgggtgactgagaacgaagacgaactgtcgttagacaggaagatgatggcagtggttgtaaaagctgattctgcgtctttgtcggacattctgcttgggttactacgcgagtatgcggcttatatcgaagatgaaagccttggccaacctttatggagccagctaagtaagtttgatcttgagacctcactctgggcctatctgagtgagggttttggttatacagtcgaagagccaaccttctcagacttcgtgttgaaattattctgtactgaattctggagccaaattgaaggtgttgaacgcgattggttgcttaacaatgttctaaaaagcgcttcaggccgggcaacagccttggcgtttatggtgagctggcgcgacagccgctctttcgccgcttactacgaaagcatctctaaggtgctaagccaacagttggaaatttcggctcgtgctggccagtaccatccggttgagcttatcgaatgcgaaacgttcgaagctgtggagcaggccataatccgtggtttagttcgtgatttgctcgatagcagtaaagcgctagaccgagttcagtttgatacggtcttatcaagacgtcttgctagccattggacattatcacgcaaagaatatttcgcaatttatgaagctatccgcaacgctgaagagttaatgcacttgcgaaatcgctatgtggatgggttccactttgataacgcgaaagcaatgtacgacgcctataccacagacatttatcgctttgaccaggcttaccgtttgttcaatgaacatgtgcactctgtattgagtaaaggtgcggacatactgcgtcagctcgacgacgaagtcgaaagcatttataccaactggtacttatatgagcttggccttgcctgggatcgtcacttggccaatgagaaattacttgaaaagtggcagatttctggcgtaccgcaccagtataacttctatgaaaaagaagttcgcacacgactgagtctgaaacagacaaaacgcgtgtttgtgatcatctctgatgccctgcgttttgaaattgcgaatgagcttggcgctatcattaacaacgagaagcgatttaaggctgaggtgtctacgcagttgggcgttttgccgagttatacccaacttgggatggcggcattattgcctcataaggcgctcagttaccagccagagcaaggcacggctgtttatgtggatggtatttcttcacagggtttagacaaccgcaacgccatcctacagaaggtaggtggtatggcagtgagttctaaggaactgatgagctggagtaaccaggaggggcgtgacaaggttcgagacgtagaagtcgtttatatctatcacgataccattgatgcgattggtgataaggctgcaactgaagaaaaaacgtttgaagcctgtcgtagtgccattgaagagctaaaagacctcgttgggcgggtcatcaaccgtctaaacggcagccgagttgtgatcaccgctgaccatggcttcctcttccaacaaaaagcacttgcagcggctgacaaaacctcgttgaaaaccaaacctgctggcgcgatagaagccaagaaacgttatatcgttggtaataacttgccttcagatgaagcctgttggaaaggctcaataaacgatacggctcatggctctagtggctcttcatatcaggcagagttcctacttccaaaagcggctcaacgcttccacttcgttggtggtgccaagtttgtgcacggcggagcgatgctacaggaagtctgtgtaccggtactgcatgtgcgcgagctacaaaaagaacaagcagcaaaacatgagaaacaaccggtaggtgttgtagcagccactcagcccattaaattagtaaacaatatcgacaaggtcagatttattcagacagaccctgtaggcgagcgttttgtcgcacggttgttggatgtctatatcgtcgatgcacaaggtaatgaagtctccagtcgtgaaacgattaactttgatagcgtgagtaaagtgatggatgagcgtactcgcgaagctaggttaaagcttattggctctcagttcgacaggaacgctcaatacacgttagttcttgagaatgcggaaatgagaacgcgttatagccaatacgcggtaaccattgatttggcattccaagatgattttttctaa

SEQ ID NO: 1611 - DNA, 2196 bp, Bacteroides sp.
atgattgataaatggtttcaaaacgatataaataaagtattggctgtacatgaccgtgtggtggtgacagatgctttaggagaaggtcgactcctgttggattatttgccttctgatgttgtggtgatcaatataggcaatgaagaaatagacgagatagaagcaagataccaggctgaaaaagactgtatcggcaagaaggtggtattctataagcggaatgcgcctgattctttatgttttctgttagagtatgcggaaacatacggttgtattgtactggatgatatggaggcttatatcagaaaacatctgtttgaaggtataaaggaaaatacagaattaggaaagcaggaacttctgatggctgccaaattaagcaaaggaaaggacttgaattggtggcatggggtaagtaagggaataatcaaaccactggatacggatggactggtaatagacttactgcaccatcctaaaaagactaaaaagagtatcgatagggatgtatggaagatttttgaatcggaagtctatagccttatctcaaaaccacagacagaacagccggtggaaatattggcacagtcggtagctgatacgatatttgacggactgattcataataatatatcagacagacttttgaaaatctattataagtgtgtggacagtaattcaatgagggagcctttactgaattacatcgagaaatataaaatacctcaaggtatgtctgtattggatactcatccggaccattgtcttatggaattggacagacagtatttcaagcaactcagtgttgcattggagaacaatgaatatattatcggattccagcaatatgtccacaatcgaactaagagtaagaaagtagaagcatataaggctgaatggttgaaggatgtaaaggtgttgcttgacttcaagaatgagaagctttatgaaatcaataccgtttctcaactggcgaactattatcaatcgcactttgctcctttggattcagccataagacatctgtatgtggcatggcttcaggaagaaaaactattgcgcccttatcaatacagatacgaacaatataataaagaattgcttgactgttggtttgggcttacagaggaatataaaccaactcaaagaaactttatagctgataaactttccggaaccggacggatagcggtaatagtttgtgacgggttgaggcttgaaatagcagaatccatagctgataagattaaggttaagggaaagaaggatgtggcttttgctgaattgccatctgtaacagaaaatggcatgagttcgcttttcggttgtgcggaagtagaagatgttgcccaaacaagatataacaatctgaagaccttaatccacgatgttgaggttatccaactggaaaaactcaatagtggagtaacggccaataagttagtattgatgttcggtgatatagaccaggttggcgaaaagaaacagctggcaggattgaaagatataaatgcatacgagtcttttgtctctgaaaaaataaatgagcttttcagtatgggttatagtaaagtgtatcttacagccgatcatggatttgtcataaccggtatattagatgaagcggataaaattccggttccagatggtgatataatcaaatcggaggaaaggttctgtctggcaaatgatactttggacaatgaaaatataatcgtacggagccagaagtataaagaaagtcaataccagtattatgcaaagtcggacaaaccgtttgtttcaaaaggtgcatatggttacgcacatggtggatttactcctcaggaatgtattattccggcttatgagtttgcaaatgaaaatcaggagtctttaggggtttccattgctaacaaacaagctttgcagaatgttacaggaacttatttcacggttaagctgaaggctgaaagtgtagagaattctttgtttaaggccgaaagaaaagtggtgatacagatttatggaaatggaactttgttgagtacgtcttcggtatatagaatgactccttcatctgtgcaggaagctgaatttgcattggcagaaacgggaaatgtaaaagtggtggtcgtggatattcagacgcagcaacaagtggacttctgtgatgtgaaaaaatcagtgtctcgagatttggatgacttattttaa

SEQ ID NO: 1612 - DNA, 2598 bp, Salmonella enterica; identical to SEQ ID NO: 1426

SEQ ID NO: 1613 - DNA, 2628 bp, Pseudomonas fuscovaginae
atggatacgcaacaactgacccaaggcttgcggcaggctttttttgcagaaaaccaccgcatcgtcttctggtacgaccctgagcagagttttgtgagcgagctggagcagctcgatcttcccgatgttcaggtgctgaacatgcagggcgagtccacctttggcatcaagctcaagctggagcttgaggacgccaaggggaagtacctactatacttcccctgtgccgagccgaatgccaatgatgactggctgctggatatcaagctgtattcgcgcagcttttatgcggacaaggtctcactgatattcaacgatctggggctgcaacaacagagcttgcgcgagcatctagctgcccgcgagcgctttctcagtaataagagtcgcttggtcggcctgaaacgattgattcagcccagcgacactgagcaggcactggatctggcgatgatagccgtggtgttgggggctaacgccagtgacatcatggtgctgctctgtaccatggctgtgactgtggtaaatgatgacctgggcctggagcataatcccccggttatcgacgagctgtacaaatttggcctgatgcctgcattgctccaggcgctccgggatgaagttggctatccggccagtgtcgaggaaaccaatggcgaaaagccgttcagctttggacatttcctgattcgtctgctggctaccggcttctgcgaaagtgtcggtgacatcccagactgggcttctgcgattaccatcccgtctgccaatgcccgggcaacttctcgggcgctgctttcgcgctggcgggatagttcgcgttactacaaggcctacgacgaaatctccagctgggtcgccgaggctctgcatattgggcaaaagatcggtgagactccactggagacgctggccaacgtcgccaccttcgaggcggtcgagcggcagatcatcgtcgatctgagcaaggccattccggagtcggatccgcgcgatctgggcctgttctcgaagatcatttccgaacgcttggataactactgggcctcgcgtcataaggacgacgaggtccgccgcaagtaccgcctgctctactccgcactgtcagcggcgattgatctattcaacctacgtcagcagtatgccgccggattccatttcgccagtaccgaagcaatctacaaggcctatgaaaacggactgtatcgctttgatagggcctatcgccaatattttgcggcctcccagcgcgctcatgtagagctgctgaagaagctcgatgaagccgtcgagcaatgttacgcctactggtacctcgaccaactgggccgaagctggggcgacaaggtagaggccgagcaacggctggagcactggaagatcgccggagtacccagccagcagagcttcttcaatcattgggtgcagccacaatttgtgaagaaccgcagtaagcgcctggttgtaatcatcagcgacgccttccgctatgaggctgcggttgaactgcgtgaccgaatcaatgaaaaacgctacagcgaggcaatcctcgccagtcagcttggcgttctacccagctacaccacattgggtatggcctcgctgctgccacacaacactttggagtaccgggaaggtgccggcgatacggtgttcgcaaatgggcaatccaccgccggcacagtgcagcgcgacaagatccttgcccagcataatggcatggcagtgacggccgaccaggtcaaagcttggtcacgagatgaaggtcgagaagcactgaaagatcagcaactaatctacgtctatcacaacgtcatcgacgaccgtagcgacagtggtggcccatccgagtcggacacgttccaccatgtggaggtcgccattgaggagctgaccgagctgactcgtaaggtcctcatgcacttcaacaccagtacggtgctgattactgccgatcatggctttctgttccagcagagcaagctggaagtcgctgatcgcaccgcgcttgcggagaagcccgagaacgctatcaagagcaagaagcgctacgtcatcgggcacactctgcccgcagccaaagacgtatggcagggctccaccaagcagacagcaggtacaacctcggatacccaattctggattccaaaaggcgcgaaccgcttccacttcgttggcggggcgcgttttgtacatggtggtgctatgccccaggaaattgttgtaccggtgctgacagtgaaccagttgcggggcgaaaaggccgagaagcgcaccaagcgtaaggtgggagtgatttcaccgaagtcagtgctgaagatggtgaccagtatccagcgcttcgatctgatccagaccgagtcggtaagcgaacaagtattgccaatcactgtggcggtcgccattttcgagggcgagcagccgatatctagtgaggaggtcgtgaccttcgattgttccactgactcgatgagcgagcgcatgaagcaggtgcggctatctctgctcggtagtgacttcgaccgcaagaaggactacttcctgatcatccgtgacaaagacctccatacagagttggagcgctatagggtcaccatcgatttggccttcaccgacgactttttttga

SEQ ID NO: 1614 - DNA, 201 bp, Lachnospiraceae bacterium
atggcggaattaaacctaaaacagataaacgctcgtttgaatgaggagtttagaggagagaagagaaagcttgtattttggtatgatgacaaggccgagtttgcagaggatataaaggatatagaacttgacaatgcaaaggtgtattttttgcaacctgacaatcagttttacaaagtactttttggagcgaaaggataa

SEQ ID NO: 1615 - DNA, 2319 bp, Lachnospiraceae bacterium
ttggagcgaaaggataatgagaacaattatcttatatatgcaccttttccgaagcccgatgtaagagaaaatcatcttgaagatacattgttgtattcaaagagattttttgcagacagagcgtcactgcttatggcagacctcggagtggatgagaagtataagaatatcattgaaaaacatatcaagttctttgcaaacaaggaaagaacacagaggttttatgaccttgagattgaacagtttaatggagagaacataattgtcggaatgctttgcagtatctgtcgtacacagacctgctcttttgaagaagtgttacgtgcggttttaagtgacggagaatatgaagataacaaatttattgatacattcaaaaagtatgatttgcttgttgagttttggaagctgtgtgaaagagatttcggatatattgacaatataccgtctttaacaaactttgttttgactctttttgtcacatatgccgccaaaagtgtcatgggagaacttcctgagagcttaaaaagtatggtttctcataagagcggaaatatcattacatttatggacaatcttaaaaacagtgtgttgtataaggacagatataatgaattatcggaatttgtttcaaatgagttgaatatagtcaaaatgtttgagaatcttttgcctgaagaattattgtattgtgacacctttgtatgcattgataagattataataaggtggataaaagagcgcctgcttgcagaggatacaggtgcaatgcttgataatcattcaataaaagaggtcgtttcgatcagatcaaagatgcactttagtgagagtatgggaaagatttatcatatgcttggcagtgcatatgatattgtggtgagcgcaaagtatgtctgtccggacagctttagcgatattttggaaaagtataagacaagcgactataagatagatcaaaactacagatatttttattatgattatgacagccttgatgacagtgaggattttgagagactgcgtgagcttgtggagaatatctataccaatgaatatcttgacaagcttttacaaaagtggaacagcggtattttagagcaggatgcattcggtaagctgcctttgcaaatagacttttatgacagcaatataggcggtcttaaggacagaactgttgtcataatttcagatgcgcttcgttatgaggtgggatatgagctatatactacattagcagacgatccgaagagcaatataaggattgatacaagtttgagtgtattgccttcttatacaaggcttggaatgacggcattattgccacataagagcattacaatgagtgatgattatactgtgcttgtagacggtatgagctgtgacaatctgcttacaaggcagaatatattgcaaagatattgtgataacagtatttgcgtacagtttgatgatattaaaaatatgaaaaagtcggagcttcgagatatatttaccggaaagcagcttatctatgtctatcacaaccagattgatgcaagaggagacaaggcaaatacggaggatgaggtgttcgtagcctgtaaggaggcggtaaatgagatagcggatttgattcgccgtatatcttcaaatgccaacactcaccattttattgttacggccgaccacggatttatctataaaagagataagcttaatgagagcgacaagataaatgtaagagataagaacgcttttgtaaaccgcagatttatagtatcgactgaggcgatatatgaagacggtatagagaatatttccatgggtaagattttaagaaatgatgacggcaaggtggtatcatttcctataagcagtaatgtttttaaggtatctggaggaggacaaaactttgtacatggcggctcgtctcctcaggaaatgcttattcccgtgctgaatattaagatggagcgcggtcatattgatacggggaatgcgcagatagcgcttgtcagtatggtgcaaaagattacaagtaacgttaccgtacttgaatttatccagtcggaagctgtaagcgatacgatcaaggcaactacatataagctttattttatctctgatgataatgagaagatatcaaatgaagcgactctttttgcagacagcagagagcttgatgcaagaaagcgaattttccgtatgaatttcagattcaaagataaaaagtatgacaagaacagaaattattatcttgcggcatatgatgaaggcagcggtgaagagatttggcgccaccatgtggttatggacttggtaggagagagtttttag

SEQ ID NO: 1616 - DNA, 2304 bp, Vibrio cholerae; identical to SEQ ID NO: 1292

SEQ ID NO: 1617 - DNA, 2523 bp, Roseburia inulinivorans; identical to SEQ ID NO: 1462

SEQ ID NO: 1618 - DNA, 2598 bp, Salmonella enterica
ttgcaaaatcaggaatttattgccggccttaaagcaaaattcgccgaacatcgcatcgttttctggcacgatcccgataagcgtttcctcgaagagctgggtaatctcgaactagagaacgtcacgctgctcgatatgaccgaccagtcacagctggcggtgaaaaagcgcattgaaattgatgagcctgaacagcagtttttgctgtggtttccccacgatgtgcccccaaaagaatcagactggctgttggatattcgtctttacagtacggagttccacgccgatttcgccgccatcacattgaatacgttaggtattcctcagcttggcctacgcgagcatattcaacgccggaaggcatttttcagcactaaacgtcttgctgccttaaaaggcctggtcactgaacaggaaaacgaagcttctcttgataagaagatggttgcggtcatcgctggcgtaaaaaccgcaaaaacggaagagattctgttcagcctgattacccaatacgttaatcagcaaaaagatgacgacagcgacctggaaaacacgctggcaatgctgaaacgccacgatctggaaggcgtgctttgggacattctgaatcaggaaatgggttatcaggccgaacatccgaccctagaaaacctgatcctcaagctgttctgtaccgatctctctgcgcaggcagatccgcagaaacgcgaatggctggaaaaaaacgtactgaccacgccctcaggcagagcctccgcgctggcctttatggtcacctggcgcgccgaccgtcgctacaaagaagcctatgattattgcgcacagcagatgcaggatgcgctgcgaccagaagaccagtaccgtctcagctcgccgtatgatctgcacgagtgcgaaaccacgctgagcattgaacagaccgttattcatgcgctagtgacgcaacttctggaagagagcaccacgcttgaccgtgaagccttcaaaaagcttctgtccgaacgccagagcaaatactggtgccagacgcgtcaggaatactacgccatctatgacgcgcttcgtcaggctgagcggctgctgaatctgcgtaatcgtcatattgacggtttccactatcaggacagcgcagcgttctggaaagcgtactgcgaagagctgttccgctttgaccaagcctaccgcttatttaacgaatacgcgctgttggttcacagcaaaggcgcaatgatcctgaaaagcctggatgactatatcgaagcgctgtattccaactggtacctggcagaattaagccggagctggaataaggttctggaagccgaaaaccgtatgcaggagtggcgtattgcgggcgttccacggcagcagaacttctataatgaggtggttaagccacagtttaacaatccacaaatcaagcgcgtattcgtgattatttccgatgcgctgcgttatgaagtggctgaagagctgggcaaccagatcaataccgaaaaacgctttactgccgaactgcgatcccagttgggcgtgttacccagctatacccagctgggtatggctgcattattacctcatgacgagatatgctaccaaccgggtaatggcgatatcgtttatgcggacgggctgtctacctccggtacgcttaatcgcgatacaattctgaagaaatataaagggatggcagtaaaatccgacgatcttctgaaatggaaaaatcagcaaggacgggatcttattcgcgactacgaagtcgtctatatctggcataacaccattgatgccatgggtgacagcgcatctacggaagagaagaccttcgaagcgtgccgcaacgcggtggttgaactgaaggatttagtgacccgtgtaataaaccgtcttcatggtacacgcattatcgtcacggcggaccatggtttcctgttccagcagcagcccctttccgggcaggataaaaccacgctgcagatcaagccagacaatacgattaaaaaccacaaacgctttattatcggtcatcagctccctgccgatgatttttgctggaaaggaaaagtggcggataccgcaggcgtcagcgatagcagcgagtttctgattccgaaagggatccagcgtttccatttctctggcggcgcacggtttgtgcacggtggagccatgctacaggaagtctgcgttcccgtcttgcaggtgaaagcgctgcaaaaaaccgcagcggagaagcaaccgcagcgtcgtccggtagacatcgtgaactaccatccgctgatcaaactcgtcaataacattgataaagtcagcctgctgcaaactcatccggtaggtgagttatacgaaccacgtactctgaacatctttatcgtcgacaacgccaataatgtggtatccggtaaagagcgaatctgctttgacagcgataacaacacaatggaaaaacgcgtgcgtgacgtgacgctgaagctgattggcgcgaatttcaatcgccgtaatgaatactggctgatactggaagatgcacaaacggaaacgggttaccagaagtaccctgtgattatcgatctggcatttcaggatgatttcttttaa

SEQ ID NO: 1619 - DNA, 2607 bp, Acidovorax sp.
atgagcagtcaacgcatctccgacagcctgtcaactttgttcgcgtcttaccccgtggtcttctggcacgacgtggaggccgagttctcatcgacagtaggcagcctgccccccgagggcgtgcaactggtgcgcctggacgaaacgccctcgctgcgcgtgaagattgatatcgagcgcgcgccgggtcagcgctggctgatctacagcacccagcccgagccggagcccgcgcaagactggctgctggacgtgcgcctgcgcagcaagtcgtttcgggccgacaccacgtccatcttgctggaagacttgggtctgaccacccaggcgcttcgccaccatctgaaagagcgggccaagtttctgcgcgccaaggaccgggtggagcgcctcaagcgcctggtgctgccgggcgacggtgcgccagatctggaccgcaagatgctggccgtgctgacccgtgccgaccagccagagctgtttgccatgctgcagcgcttgtttgctgcgctggtggtggatggcgaggccgacctggctgcgcagcccaaggcttggcaagacattgcggccaacgatttagcgcctgcgttctgggcactggtgcgctcgcaactgggctatgccgacgcagagcctaacctgcgtgacctgctggtgcgtgtgttggtgacggacctgtgccggagcctggacggtgcaccgccgcgccagttggcgcactttgtgttgcccgaccgcgccctggcagccaatgcctcggtgtttgcggcgcgttggcgctcagacctggcgtttttcagcagctacaacgtgctggcccgcgccctggcgcaagagctgaatctggcgcaattgctggccagctacacggcagagcaactggccgagtgcatggctttcgaggaggtggagttgcgggtggtgcaagacctcaagcaacgcatcgtggcgggggcaggtgccaacatggacgtggtgcatgggttgattgcacggcggcgtgatgggcattgggccaatcctttgctggccagtgccagcgagcgcacccgtgcgctggcggcttgctacgacgcgctcacggcagcggcagactttttcagcctcaaggccagccacgcggcgggcttcagcttcgccggtgcggccacggcttttggccagtaccgcgagtacctgtaccgctttgaccagctgtaccgccactttcacacggcagccgatgccgtggagccttcaggctgggcggtgctgcatgagctgcgcacgtctatcgagaatgtgtattccggttggtttgtgccgcagctgggtgccgcctgggccaaggtggtggaaggcgatcaaggcttgctgcaacgctgggccatcccggatgtgacgccgcagcaggcgttttatgagcgcgaggtgcagccgttgtacagcgggggcgcaaaacgggtgtttgtggtgatttcagacgctttgcgctacgaagtggcgcaggagctggtgcagttcaccaacggcaaaaaccgcttcaaggcatcgctgggcgccatgctgggtgtgctgcccagctacaccgcgctgggcatggcggcgctgctgccgcaccagacgctggcgtacaaggaaagcgccaacctcgatgtgctggctgatggtcaccttgttgctacgttggagcagcgcaatgagcacctaaagggcgtcggcggcatggcgatcaaggccgaagacctgatggccctgggcaaggaaaaaggccgcgatctggttcgtgaccgccagctcatctatatctaccacgaccgcatcgacatgacgggtgacaagcaggcgtcagagtccaagacctttgaggcggcggcgcagacggtgcaggagttgtcgcagttgctgggcttcatcatcaactcgctcaacggctcgaccgtgctggtaacgtccgaccatggtttcatttaccaggagtcacccctggatggggccgacaaatcgacactggaagacaagcccgtaggcacgctcaaggccaagaagcgctatctgatcggccgtaaccttggcacgaccgccaaagcctgggcaggcaatacggcggtgacggcgggcaccacgcttgagggcagcctggatttctgggtgcccaaaggggccagccgctttcactttgccgggggcgctcgctttgttcacggcagtgctatgccgcaagaggtggtggtgccagtcattacagtgcgtgagagcgaggccgaccacgccaagacccggccagtgaatatcagcgtgctgggcaacgtgggcaagatggtgaccagctcgcagcgtttcgagttcatacagaccgatgcggtgtccgagcgggtgctggcgcgcacggtggtggtttcgctgcgcgagggcgacgcgccgatcagcgacgagcagacactgacgttcgacagcacctcccagttgctggatgagcgcaagcgttcggtatttttgacggtgctcgccggtgcgcatgacccccaccgccgatatgacctggtgatgcgcgatgccatcaccaaggtggaagtgctacgactgcccataaaggtggacttagcctttggcagcgacttttaa

SEQ ID NO: 1620 - DNA, 2373 bp, Desulfonatronospira thiodismutans
atgcgagtaatagaccacatcttgcgctccattcgggatgcagccctgtataaccccgaagttcaggctgctccgtcctgcatattatggccggattgggacagacaatgggaaccggctgtgaacaggcttctgcaggaaatgcccgagcttttcgttcttggaaaatacagccctgaacagcgtaccggcccagccatctggcttagatgcgtaattcttttttccagcgcgaatgtagagcaggtttgtgatgcccctgtatctgaatccctgaactcacaatttcctgttgttcacagcggtgctacacctgtcatttatctgccgggagtaagccggcaggatttgagggcagtagagagctgtccggattccttaaagcccctggctgagctgcagtaccggggggtcatctggtcccaggtcaatgccaaagactggaccattctggctttcctcaaatcggaccagggaggtctcggcctggatgtagcccgggacagtgagaccaaaagagccatccgtacagcgcttatgcccttgcttgacgaagatgtggacctgcttgagtgcaagcggctggataaagactatttccacaatcttctttccggtggtgaccctgttcgcgatcttttgcaatggatcagcgccccggacgattttagaaacaggctggataaaaaccattgggaagcattcgtccaggtctgcaagtcccagtttggatttgaccctcaaaaacagggcgtgcttacagcagcccacaacctggcccaacagaaaaaccagtggcgttccgtctggtccagatacagggaagcaccgcacagatatccgggtatccccgggcagataagaaaatgcaggccgccggcagggtctcttatgtggtatgtaggcggcgaatttccaggttggccgcaatggaacgaacaacaggagaaaaacctgagagaaaatctctctggtctgaaggaactgccagcccataatgccagacaggaaataatcgagctggaaaagattcatgcctcgcggcgcaattacgtctgggctgaactgggcttgtctcccctggccatgtctttgaagcacctggctgtaatggccgaagtcaccaggaataccctggctgctgggacattatctgatctggctgctggatattctgactggggctgggaagcagacgatgctcttttaagagccctggcctgtgtccacagacaggaggattttgaagccctcagttctgctctgagaacggtctacctgccctggtctcaggaaagttcccgacatttacagcggttgtggctgaaagaacattccgtaagccatgtgcaggaagaacaggaagtatattttgaatgctgtctgtttgtggatggactgcgtttcgactgcgccaggcgtttgcagacgctgctggaagaaaaaggtatcagtgtatccaggcagcttggctgggcggctctgccaagcgtcacagccacaggaaagccggcagcctccccggtagccggacacatttctgctgcccaggcttcgcaggaaaacttcgaaccgtgcacagcgcatcactttaaaaaactccttcaggaaaaccagtggaccgtttgcaggcagaatgaccctttgccccggatttcagaactggaggtcaaaaaattgtgggttgaatttggagacattgaccatgaaggccacgaatggggatggaaactgtccgctcatgtggatcgcctgctcagggaagtcagggatcgcatcgaggaccttattcaagccggctggacagccatcagggtggtgaccgatcacggctggcttttgctccccggtggactgcccaagattgaactgcccagggccttgacccagaccaaatggagccggtgcgcggtcatcaagtccggggcggacacagatgaaaatctgtacccctggtactggaatccagacagacattttgccctggctgatggcataagctgttttcgcaggaatgatgagtattctcacggaggcttgagcctgcaggaatgccttctgttgaagctaaccgtctttgccggacctgctgcccgggcggaagaatcactgcagttgatggatgtggtatggaagggtttgcgttgcacagtcgtcgttgaggggtggacccaggatttatggctggacgtgcgtaccagccctggagaggcttcatccagcctggtgctcaagctcaaacttttgaaaaaggatggctctgcttcggtcgtggtggaggatgaacagtttgagggccaggaggctcatatcgtactgatcaatgctgaaggccagctgatttctcagacttcgaccatcatcggcggctga

SEQ ID NO: 1621 - DNA, 2523 bp, Oribacterium sp.; identical to SEQ ID NO: 1384

SEQ ID NO: 1622 - DNA, 2586 bp, Magnetospirillum sp.
atgaatgaggttcagatcagcgaggcggtgtcgcagctttttgccgatggcaaccgcatcgttttttggaacgaccccgaccgagagttcgaggaaacgctggcaacacttgccctcgatagcgtgaccctgctgcgtgctgatcaggtgcctgggcttgaagccaagattcggattgaaagggaacagcccgatagccgcttcctggtctattcgaccgccgaggtgccgctgccgtccgaggattggcttctggatatccgcctctacagccggacgttcagggctgatcgtgcctccatcatccatggtgaacttgggctgaatgagcagtcgctgcgaacccaccttggcacccgtgccaagttcctcggcagcaaggatcgtttggcgaggctgaagaaattcgtccagccgaccgataccgcccgtgatctcgaccgcaagatgctggcggtgctgaccaaggtcgatcagtccgaattcttcggcatcctcaccgctctatatcacggcattcccgacgcacatctcgaagcggtgccagccgcatgggacgacatcgaaaagttcgatttggcggcggcgttttggtcactggtgcaagagaatttcggctatgccgaggacgctcccacgctcaagaatttgctgatccgcctgatggtcagcgatcttgcccattcgaccacggcgaacctgcctgcggctttgacgcacctgatgctgccaaagctgtttttgtccagtgcgtcggtctgccttgcccagtggcgtgacagcaattcacgcagcgacagctatgattggctgtcggatgcggtcgcagtcgccttgaagatcgagagccaactccctggcttggacatcgagccgctgctcgacaacaagaccttcctgatcatcgaaaaatatatcgccgccaaactgcgggatcgggtggttgcaaccgcatccacgatcaatgccgccgccatcaagggcatcgccaagcaccgtcagaatggctactgggcggacaggaatcgtggtgccatcggtgcgacccgtgaagcccttcacgccgtctatgacgccctgatcgccgccgccgatctgttcgggctacggggagaattctcgaccgggtttgaatacaattcggcacaggcgatgttcgagggctatgcgaccgccctccaccagttcgaccgcctctaccgccatttcatcgaagccgccgacgccgcgaccgctcaggggtgggatatcctcaaggcactgcgggacagcgtggaggattgctacaccaactggttcctcaccaacctcagcctgaaatggggcaagttcgttgaggacgaactgctggcaaattggcgggttgatggcgtcatgaaccagccttggttcttccagaaagttgccgccgccttgatggaatcggatcgtcgggtgttcgtcatcatcagcgatgccctgcgatacgaagcagcgaaggaactggtcgatgacctgaacggcacctaccgggtccaggcggaaatccagcccatgctgagcgtgctgccgtcctacacggcgttgggcatggcggcactgctgccgcattccaagctcagctattccgacaagggcgatgtcctagtggatggtcagtcctcggcggcgggcaatcgctcgaacattctcgccgcgaaaaagggcgttgcggttaaagccgacgagcttcgcgacatgaagaaggatgccggtcgagaattcgtgaagccctacgaggtcatctacgtctaccacaacaccatcgacgccatcggggacagcggctcgaccgaaggcaagacgttcgaggcggttcgcacggcgttgaccgagatcgcggacctgatccgcatgatcatgaataacctcaacggcacctacatctacgtgaccgccgaccacgggtttttgttccaagaaaccgcgttggacgccaccgacaagagtgccttggtggacaagcctgccggggcgttgacggcgaagaaacgctttctgatcggtcgaaacctgcccgacagcgacaaggcatatcacgggtctaccgcagtcactgccggtgccgatggcgacatggaattctgggtgccgaagggcaacaaccggttccacttcgtcggcggctcccgcttcgttcatggcggagccatgctgcaagagatcatggtgccgctgatccgcgtcaggcagatcaagggtgacgccaaatccaagacctcggtgaagaaagtcggcgtgatggtcgtgacccaaagtccgaagatcaccacgaaccgctatcgattcgaattgatgcagaccgagaaggtgaccgacagggttaagccagcgacactggatatcgccgtctacgaggatggtcagcccatcaccaacgtagaacgggtcaccttcgacagcacccaggacaacctggacagttggaagaagtcggtctggctgtcgcttcaaaagcggagctatgacaagaagggctgctaccatctcattctgcgtgataccgatgatttggagcagggacgggtcgaggtgagcatcagcatcgcctttatggacgacttttag

SEQ ID NO: 1623 - DNA, 2598 bp, Escherichia coli; identical to SEQ ID NO: 1391

SEQ ID NO: 1624 - DNA, 2304 bp, Vibrio cholerae; identical to SEQ ID NO: 1292

SEQ ID NO: 1625 - DNA, 2625 bp, Acinetobacter baumannii
atgaatctaggtcaactacaacaaggtctggaacaagccttttatactgaacaacaccgaatcgtcttttggtacgatgcggaacagtcctttagcgaagaagtaaaagctttaaatctgggggatgtccagattctgaatatggcagaagagtcgagtctggcgatcaagctcaaactggaactacaagatcagcagggcaaatacttgctgtatttcccaagccctgaacctgaaaccgaaaaagactggttactggacatcaagctgtattcacgcagcttctatgccgatcgtttctcgattattttcaatgagctgggtttacagcagcagagtctaagagaacatctggccaaacgtgaagaattccttaaagccaaagcccgtctgagtacattgaaacgctatatccagcctgatgcagatgcacaggatctggatatggccatgattgcggctgtggttaaagctgacagtgctgagctgatgcatatcgttttggcgttggcagatgaaatggtacagcacaatctagagctggaggtgaatccggattcctttgctgaactggaaaaattccaactggtgccggctttagttaccgcattacaggcggaaattggttatccagcatcagttgaggagctgaatggggaaacacagttcaagctcggtacattctttatccggttaatgaccacaggtttctgtgaaagcttgggcgatgtaccggtatgggcccaggaactggtgatgtcttctgtcagttcacgtgcgacggctagagccttcttgtcgcgctggagagacagctccaaatactacccaacctttgataagctttcccagagcgtggccaatgcactgcggatccaagaaaaggtcggggcttttgatctggagcagctgctcgatgtcatgacttttgaagtgattgaacaaaagatcattgttgatttggccagtcatatccctgcagcaaccaaagctgaactggaacatttcagaacgattatttctacacgtctggatggctattgggcttccaaacataaggacgatgcaacccgccgtaaataccgtaccgtctatacagcgttgcaggctgcgattgagctgttcagtttacgactacagtttgattccggtttctattttgactccagcgaagccttgtataaagcctatgaacaggagctgtatcgctttgatatggcctatcgtcattacagtgcagcctctcagcgagctcatgttgatatcctgaaaaaactcgatgaagaaatcgaaaattgctatgcctactggtttattgaccacttggcacgaaactggggagagcggattgaagctgaacaacgcttgaatgtctggaaaatggcagatatcccaaatcagcagaacttctatgatacccatgtcagacccttactgggttctgcaacgaaacgccgtattgtagtgatcatcagtgatgctttccgctatgaagctgcagtagagctgcgtgatcgtatcaatgaaaagcgttattctgaagcgaccttgtcttcacagctgggcgttgtgccaagttacaccacactcggcatggcctcgttattgccgcaccagactttggagtacaaagaggccgcaggggatgatgttttagtagatgggcagtccagcaaagggactgcagcacgatccaaaattctggcggcctataatggattggcagtaaccgctgaaatggtaaaaggctggtcgcgtgaagaaggccgtgaagcacttaaagaccatgagctgatttacgtttatcacaacgtgattgatgcacgcggtgacagcgcctcgacagaatcagaaacctttatggcggtagaacatgccattgaagagctgaccgaactcagccgcaaaatcttaatgcacttcaatatttctaccttattgattaccgccgaccatggcttcctgttccagcaaagtaaactggaatctgcggatcgttcaagcttgactgaaaaaccgaccaatacattgaagagcaaaaaacgctatgtgattgggcatggtttaccagagagcaaggaagcctggaaaggctcaacccaagctacggcaggcacattatctgcgactgatttttggattccaaaaggggcgaaccgtttccattttgtaggaggctcacgttttgtgcatggcggcatcatgcctcaggaaatcgtagtgcctgtactaacggtaaaacagctacgtggtgaaaaggccggacagcggaccaagcgtaaagttgaggtcatttctaccaaatccacgctgaagatggtcaataacatccagaagtttgatttgatgcaaactgaagctgtcagtgagctggtcatgccagtgactttatccattgccatttatgatggggatcttaaagtttccagtgaagaaactttgacttttgatagcagtaccgactctgttgccgatcgggtcaagcaggtcaggctgtcattgtctggcactgattttgaccgtaagaaagattacttcctggtactgaaggacaaagacctgaatatcgagatgcaacgctataaggtcaccattgatttggcatttaccgatgacttcttctaa

SEQ ID NO: 1626 - DNA, 2625 bp, Acinetobacter baumannii; identical to SEQ ID NO: 1185

SEQ ID NO: 1627 - DNA, 2589 bp, Magnetospirillum sp.
atgaatgaggatcagatcagcgaagcgttgctgtcgctgtacggtgacggcaatcgcatcgtgttttggaacgaccctgaccgggagttcgaggaatcactcgcatctctcgatctcgacggggtgaccctcctgcgtgccgatcagatgccagggcttgaagccaagattcggatggaacgggaacaggcccataaccgattcctggtctattcggcgacccatgtaccgctgccgtccgaagattggctcctggatatccgcctctatagccggaccttccgggctgaccgggcttcgatcatccttggtgaactgggcctgcaagaacaatccctgcattcacacatccaggcccgtgccaaatttctcggcagcaaggaccgcctgacccggttgaagaagctggttcagccgacagattcgattcgtgatctggaccgcaagatgctggcggtggtgaccaaggtcgatcagccggaatttctcggcattctcaccgccctttaccacgccattcccgactcggaccttgatgccttgccccctgcctgggacgagattgaaaagtacgacctattggaatccttctggtccatggtgcaggggcaatttggatattccgagaattctccgacactgaagaatctgctgatccgcctaatggtcagcgattttgcccattcaatcacggcggaacttccggctgccttggcacacctgatgctgcccaggttgttcctatccagtgcatcggtctgcctttcccagtggcgggacagcaattcacgcagtgacagttatgaccggctgtccaagatggtcggcgatgccctgaagatcgacagccttcttccgggaatgcagatcgagccgttgctcgacaacaagaccttcctggtcatcgagaagttcatcgctgtttccctgcgggacagggtgactgcgaccacggccacgatcaatgccgaagctgtgaaggccatcgcgaaacaccgccagaatggctactgggcggatagaaaccgtggagctatcggtgccacccgtgaagcccttcatgccgtctatgacgccctaatcgccgccgctgacctgttcgggctgcggggggagttctcgaccgggttcgactacaattctgcacaggcgatgtttgacggctatgccaccaccctccaccagttcgaccgcctgtatcgccatttcatcgaagcagccgacgcggccactgcacagggatgggaaatcctaaaatccctgcgtgacggggttgaagattgctataccaactggttcctgaccaatgtcagcctgaaatggggcaagttcgtcgaggatgagcttctgaaggaatggcgggttgaaggcgtcaccccccaaccatggttcttccacaaggtcgaagccgctttgatggaatcggatcgtcgggttttcgtcatcataagcgatgctctgcgatacgaagccgccaaggaactggtcgatgtcctgaacggcacctatcgtattcaggccgaaattcagcccatgcttggggtattgccgtcctataccgcattggggatggccgccctgctgccccattccaaaatcagctattccgacaagggtgatgtgctggtggatggtcagtcctcggcagcggggaatcgttcgaacatcctcgccccgaagaagggcgttgcggtcaaagccgatgacctgaaggacatgaagaaggatgccggtcgagaattcgtgaagccctatgaggtcgtctacgtctaccacaacaccatcgatgccatcggcgacagcggttcaaccgagggcaagaccttcgaagcggtgcggcaggctctgaccgaactttccgatctgatccgcatgatcatgaataatctcaacggcacctacatctacgtgaccgccgaccacgggttcctgttccaggaaacggcactcgatgcatcggacaagaatgcccttaccgacaaaccagcgggggcattgaccgcgaagaaacgctatctccttggccggaacttgcccgattcaaccaaggcatatcatggttcaaccgcgatcactgccggtgccgatggcgacatggaattctgggtgccgaagggcaacaaccggttccactttgtcggcggctctcgcttcgtacatggcggtgccatgctgcaagagatcacggttcccctcatccgagttcggcagatcaagggagatgccaaatccaaaacctcggtgaagaacgtcggcgtgatggtcatgacccagagtccgaagatcaccaccaaccgctatcggttcgaactgatgcagaccgagaaggcaaccgacagggttaagcccgcgacactggacatcgccgtctatgaggatgggcaggccatcaccaacatcgaacgggtcaccttcgacagcacccaggacaacctggatagctggaagaagtctgtctggctgtcgctccagaaacgcggctatgacaagaagggctgctaccatctcattctgcgaaatgccgaagatggcattgaagtacagcgggttgaagtgagcatcagcatcgccttcatggatgatttctaa

SEQ ID NO: 1628 - DNA, 2604 bp, Escherichia coli; identical to SEQ ID NO: 1542

SEQ ID NO: 1629 - DNA, 2304 bp, Vibrio cholerae; identical to SEQ ID NO: 1292

SEQ ID NO: 1630 - DNA, 2457 bp, Bacteroides sp.; identical to SEQ ID NO: 1553

SEQ ID NO: 1631 - DNA, 2304 bp, Vibrio cholerae; identical to SEQ ID NO: 1292

SEQ ID NO: 1632 - DNA, 2598 bp, Escherichia coli; identical to SEQ ID NO: 1391

SEQ ID NO: 1633 - DNA, 2316 bp, Vibrio cholerae; identical to SEQ ID NO: 1580

SEQ ID NO: 1634 - DNA, 2502 bp, Methylophaga aminisulfidivorans
atgagcaatcgcatctctcaagctcttaccaacctttttgataagcacaggattgtcttttggtatgacgccaagcatgaacttcgtgatgactttgaggctttagaattatctggcatagaaaagctggagattgccaataacgaatttacgttaaagcatcatatcctgcgtgaagaacctaaaaagaaatttttgctgtttcatgatggccctcaacctgatgacctgaataattggctcctagacgtacaattggctcatggtgagtttcggaccgatcagattgccatctggctttcagagctgagtctgggtttggagtttgccgacttggttcagagtcatgctgaatttttccaagcggctaagcgtaaggacggtcttaaaaagctattaaacgctgatgatacgcctggtgtaattcaactgaagatgttggctgtttgtgctggtactgatgagccacgtatagaggtggttgttcagtctcttctgcaagaacttgcagagggtgatgatgagaaagttaagcttattcgacgttgtgagctggagtcttttttatgggagcagatggcaagacattacggctatcaatctgcaacgccaagtattagagatttcgtcattgaacttttcaagtcttgttttgcaatgggtactgatggtgaattcactctaagaggcgatgcgttggtctttctaaaacgctggaaggatagtcgtcagtatgaacagtgttttgaaaagttatcagaggaatgtgctgaggtcttagcaattgagcaggatctttccagtagggatttccgagatttgatcgagttggattatttccagctaatcgacagaaaaattatcagtgatctggttcgtgagttgagtgagcgaactatttcatcgggtgatgtggcactctgggtgcggcagcgtcgtcaggggcactggtatcaagaatatcaacatctctatgaagccatagactatgccgcgctatttattcaaaccattggtgaggttaagcttcagatagaaagtctggcggatggtgtgcagcgttattgccaaacttggtatctgttggatcagtactatcgtaagtttatctaccatactcgtcgcgctgcacatccatcaatgacagcagctttatcagaacaaattgagaacctctactccaataattacctattgaagcttggagatgctttccaagctcttgtggatggcgtggaaaaatgggatgcgtctccggtgccattacagaaaaacttctttgagctctgggtaaggccattcttgaatagagataatagggtttgcgtcatcatctctgatgcaatgcgttatgaaatcggcgatgagttattaagcttgattcgacaagaagatagatatagcgctgaacttgagccagctttatcgatgctgcctagctatactcaattgggaatggcagccctgctgcctaatcaagagctagccattgctgacaatgatactgggacagtgcacgtggatagtcagagctcgatgggcaccgccaatcgtgacaaaattctgaaagctgccattgatggtagaggtaaggcaatcacggcagaagactttatgtcactgagtcgagatgacagtcgtgaaatgctgaaagccagtgatgtggtttacatttaccataatagaatcgaccatactggtgacaaaattcactcagaaggtagagcatttgaggccgctgaagaagcattggatgatttaatcaggttgatcaaaaagctcactgctgcgaatgcctcgaatatactcgtgacagccgatcatggctttatttatcagcatagagcgattgatgagagtgatttttcaagcgtagatgttagtggagattctattctttactcagacaggcggtttgtcttgggtaaaggcttaagtgattcaaacagcctccattctttcacatcttcacagcttgggttgtctggtgatgttgaaattcgtgtaccgaagtcaatcaacagactgcgtaaaagtggttcgggtagtcgctttgttcacggtggggcaacgcttcaagagactgtaattccgatcattaaaatcaataaaaagcgcaaaagtgatgtcagtgcagtggaggttgagatcctgcgcggtggaagcactgtgattacctcaggacaggttgcagtggcgttctatcaagttgcacctgtcactgacaagcttcagccacgtcaattgaaagctgggatatacactcaatcaggtaagttgatctctgatacgcatgagctgacttttgatttgagctctgataatccccgagaccgtgagttaccgatgcggtttgtattgacgcgtgaagctgatgatgccaacggagaagaagtgatactcaagctcgaggagcggcatgcggggacctcacacttcaaagaatataaatctcttcgttatacaatgcgacgctcctttacgagtgatttcgacttttag

SEQ ID NO: 1635 - DNA, 2598 bp, Escherichia coli; identical to SEQ ID NO: 1225

SEQ ID NO: 1636 - DNA, 2304 bp, Vibrio cholerae; identical to SEQ ID NO: 1292

SEQ ID NO: 1637 - DNA, 2586 bp, Photobacterium sp.
atgacatcaagaatttctgttgcgctaaagcgcttgtttgctaagcacagaattgttttttggtatgatgataagcaagagcttcgtgccgattatgaagccttagagctagaaaatattgaaaaaattgaaattgataataatgaattttctataaaacatagactgttacgtggtgcgccgaaaacaaactttttgttgtacaaagaggggaaacaacctgagccgctcaataactggctatatgacgtagagcttgcaaatgtcacttttagaactgatcaagtggctatttggctaagtgagcttgagttgccgagtgagttttccgagttgatagagaaccatacggcatttttcgaacctcaagggaaagagcaagacgcgctttcagaagccgaatcaagaaagcaaacattgaagggcttacttgaacccgatgacacccttagccgtgctaggctcaaaatgttggcgatttcagtcggtttgaagcaaaaaggtgatactagattagatgtcattttagagttattgatggctgatatggccgttggcaaactatattcgtttattgaacgttgtaatcttcaacaatttttatggcaacaggtaactaatagttatggttatcaaactgatagtccatcagttaaggattttgttcttgagttatttaagttttgctatttagctgaactttcaacagggctacaaggaacgagaatagattcagacgcttctcaaaagcataatatgacaaataacgctttggtgttttttaagcgttggaaggatagccgggcccatcaacggacatttgaatggctttctgagcaatgttccaactttatggatatcgagagagatttacaacatagatcgatcagggaagtgctagatttagattatttcagtgttatagatagaaaagttattcacgaccttgttcatggtgtagctgatagaactctatctcaaggtgaggttgccctttggtgtcgtcagcggcgacatggccattggtatagtgaatatagactgctatacagtgcggttgatgttgcctgccagttttttgcactgttagatgtagttaagcttgatatgccaagcgcgactcaagccgtacacaggtatacaagccagtggtttaagcttgatcagctctatcgtcagtatgtatatgcgcttaaggtttcctctcagcacaccttgcttagtatattaaccgagcagatagaaaacttatatgttaatagcttcgtacagccacttacaaatgcatggcagcatcatgttgatggtatgggctcttggcaagtgccggatgtaatctctcaaaataagtttttcgaaaattatgttgtaggtcaatatttagcaaagaagaaaaaagtatgcgtgattatatctgatgccttccgttatgaagctggtgaagagatggttagtaggataaggcaggaagatcgttatgaagcgagccttaaccatgctttatccgcaatgccaagctatacacaattaggaatggcatcattattgccacaatctaaagattacccgctacagttagctgacaataaaacgggtactgtgttgatgggggggctttctacacaaggtaaagatagtagagataaaatattaaaaactattcacggtgaaagagcgagtgcagttctagctaaagacctcattgaaatgaatcaggctaatacaagagaattagtgaaagctaatgatgttttgtatgtttatcataatcgcattgaccataccggtgataaaatgcagtctgaaggtgaagcgtttgaagctgccgaaaagacttttgatgatttaactaagcttgttaaaaagcttactaatggtaatgccagtaatattttgatcactgcggatcatggatttatctatcaaaatagtactctagatgagagtgactatttggccaaagatattgaaggtgacattttatataacgacagacgatttgtactaggtaagggtttgtcatgcgggaagtcactaaaagcatttagtagcatagaacttggtataagcggtgatgttcatgcagtggtaccaaaaggtatccagcgtttgcgattaagtggttcaggaagtagatttgtgcatggtggcgcttcactccaggaagtaatcgttccagttattagcatcaataagaaacgttcgagtgatactaaaatggtggatgttgatgtgcttagaagtggctctagtgttattactagtggtcagatatcagttacgctatatcaagcagaagcggttactgataagacccatgcgagaacattacgtttaggcatctataccgaatcaggcacattgatctcagatagccatactgttgagctagacctgacctctgagcatccacgtgaacgtgagatgaagttacgcttcttacttaatcaagaagcagaatctgcaaataacgaagaagtcctcttaaagttagaagagcccgtgattggaactaatcagttccaagattacaaacaattgcgctataccattcgtcggtctttcacatctgattttgatttttaa

SEQ ID NO: 1638 - DNA, 2304 bp, Vibrio cholerae; identical to SEQ ID NO: 1292

SEQ ID NO: 1639 - DNA, 2514 bp, Fusobacterium sp.
atggaaatagataaaattaaagaaatgcttgaatatagatttagtttaactaccgaacttccacaaaaaagacatataattttttggtatgattcaaaaaaagaatttaaagatttaatggatgacttaaatttaactgatgtaaaaataattaaattaactaagtctgttgataaaaaaggagaagctatctatacaaatatatttaaaacaaaatatactttggaagttattgatactgagtctaattatttaatttatagtgaatatcctagagttattgatagtgaaaattatcttttagatatagaaaaatactcagaattttttgaagcagataaatcagcaatgatagttgaagaattaaaattagatagaactaattatagatttggagaaattataagagaatattcaagtttttttgctaataaagaaagaagagaaaaactaataaaattaattgaaaatccagaatctttagatgatgaaaagtttaaactttcaatattgactgttatttctggagctaaaacagttgatatcttagaaatattaaaaaatataattttaaatagaaataaactacaagatattgaaaaatggatgaatttagaatttttattttctgagataaaaaagaaatttgatattgaggtaaccagttttgagcaatttttaaaaattcttatggtaactcatttttactttgaattaggaaaaaaacctcatacaaatttagaaaattattttaaaggcagaaaaaatgaattgtatatctttgctgattcattgttgcaaaataaacaaacttctgaaattataaggaaagaattttatgaactagccaaagatttgaatataaaagataaaatagatgaattagagctagattactctataaaaggaacagcttttgaatattttgataagattatcataaaagatattatagagatttttaattcagaaattattgattatgataaatataaaaaatatatagagataagattagataattctttatggagagaggaatatcagcacttttataatgcattgttagctgttaatgatttttttagaataaaagattctttaataattgaggatagagaagaattaagagaaatttttaaagactacactaaaaattattttttaatagataagttgtatagagatttttattattcctatgataaaataaaaaatagtgaattagcacctctttttgatactctaaaatctaaaataaataaattttatgaaattgattatcttgaaaaattattggcactatggtcaagtaaagtatatgaaagagaaaaattacctcagcaaaaagatttttataaaaataatatagtgaaagctgatgttagaacagttgttataatttcagatgctttaagatatgaagttggatatgagattagtcaaaaattaagaaaagaagctaatgttaaggaaataaaaatagaagctatgctaacagatttaccaagtagaactttcttaggaatggcgaatttattaccttgtaaaaaggaaagagatattgatttagtttctgctaaggtactcattgatggtattgatagtcaaggaacagaaaatagagaaaaaatattaaaagctagtcgtgaagaatcttctgctatttcttttgataatttttataaaatgaatagggctaaacaggaagaatttataaaaggaaaaaaagttatatacatttatcatgatagcattgatgcaataggagataagggaaagactgaaaataacacttttaatgcctgtaaagatgctgttgaaaatattgtaagtctttctaaattactttcaagccttggagttgtaaatatttatataacaagtgaccatggttttctatatgaaaagaaagaggttgaagaatataataaacttgaattaaaaaatacaaaatataaatctattggaaaaagatatgctatatatgaaaaagaagttgaagaaaaaggctgtgtaacattaaaattagattctttatatggagtatttccagaaaaaaatcaaagaataaaggctagtggaagtggtttacagtttgtacatggaggagctagtccacaagaaatgataataccattgataaattataagagtggagctaattctaaaaaaatatctaaagttcaagttagaataagagaaagtgttgctaaaattacatcaaatttaactaaattttctatatatcaaatagaagctgtaagtataaaagataagtttatagaaagagatgtttcagtagccttatatgatggagatgttagagttagtgatgaaaagaaattaaaattaaattcaatagaagaaaatactatacatgattttagattgactttaagtggtgaacataaaagagttacattaaaagtaatagatattgaatcaggggatatattagattcaaaagaatatgatgtgagtattggaattgcttcagattttgatttttag

SEQ ID NO: 1640 - DNA, 2547 bp, Clostridium perfringens
atgaacttaaaagaaattaagaatttccttaatgatattttttcaaagccattaagtgatggaaaagtacgtcatattgttttttggtatgatgagaatgaggattttactgaagagatagatgaatttgatttagatggtgttgagcttattaagttaaatgagaacaatgctttttatactaaatatcatatagaaaaagaaaatgtagatggaaatattctagtttattctaatatgaaaaaacctaaaccacaggaagattggctttatgatattttatcttatagtgaggaattttctacagatagggctactgttattatgagagaattgaaagttaataacccttatcttaaggaagcatttactttttacaatactttctttaaaaataaggatagacttgctgcttttagaaacttaggtattcaagattatactgaggaaaaggttcatattggagttttagctgttttaactaagacaaagattatgaattttgaagagataacaagagctttaattaaagaaaaactagatggaaatagcaagctttatgaggatattgataagtttggaagtctagatatactttggaacttaattagtaagaactatggttatagttttgaagagagaagtttagagaagtttatggctgttcttttaattacaaatatgaatgaaactattaagtttaatttgccaaagcaatatgaagattttgtatcaaagaaaagtacagattgtattgtgtttataaatcattttatgaatagtcttaaagatagtcattactatgataagatgcagcgattaataggggaaaagattaaaatttctaaacttttagagaaaactgattcagataaatttttgaaatgtgatgtttttgaagaaatggataagttaatattaggtagaatagtcaatttacttaatgatggaattgaagagtatgataaatatttaaatataatggcttcaagaagaactcttcattattataaaaaatatgaaagtgagtataaagctttaaaatggggcataagattattagctaagaagaaagaactagattcaattataaaaacagaaagttcttatgatatggttaaatcttatgctaggaattactttgagattgataaagcttacaggaagttctattatcattttgataattgtgaactaaaggaaattttaaataacttaaaggatactgtagaaaatttatataataactggtatttacaagaactatctataaaatggaatgaagcattagctaagcaaaaaacttggagaattgaaggggtaaatcagcaagagagtttttataatgacaatatcaaatatggtcgtaaagagagagtttttgtaataatatctgatgcccttagatatgaaagtgcagaagagctttctataagacttagaaatgaaagaaaagctaaagtggaattagattatatgcaaggggtacttccatcatatacaaagctaggtatggctgctttattaccaaataagaaaatagaaataaattctaattatgatgttttagttgatggaataaattcaaatgggacagaaaatagagataagatactaaaagttgaaaatgagaaatccttagcaattacttataataagcttatggatttaaaagaatctgaatttagaaaagtattttcaggtttagaggtagtttatatttatcacaacacaattgatgctgtaggagatcatgcaagtacagaaagagaagttttctcagctactgatactgcattaaatgaattgataaatcttgttaataagcttgttcatagagtaagtgcatcaagtattattataacatctgaccatggatacctatataagagaagcaatatagaagaatatgataaattatcaggtataaagcttgaagatggagaggataatagaagattcttattaacatcacaaaataaagatatagaaggaacaatgaggtttagtatggattacttattaggagcggattctggaatgaatgtaataactcctaaaggtatagcaaggtttaaagttcaaggagcaggagctaattatgtacatggaggagcaatgcctcaagaagtattaataccaataattagatttaaaaatgatagaagttcttcttcagaaaatgatattagaaaggtaaaaatatcattaacaagcataacaagaaaaataactaatataataacttatttagaatttttccaagatgaaaagattcaagataaagtaataactcaaagaataaagtgttattttgaagatgaagaaggaaatagaatttctaatgaaaatgcaataataggtgattcaaaatcagaaaatccaattgaaagaagttatagagagaagtttgtattaaagagtattccatatgataagagaaaaaaatattacttagttattgaagatgaagatgactcaagtttacaatgtgaaaagataccatttaatatagatatagcaatagttgatgactttgggttttag

SEQ ID NO: 1641 - DNA, 2538 bp, Actinomyces neuii
atgagtggaacaaacctagaccaactagcaggcgccctgcgggacaaactcatctactcgcgcatcgtgtcctggctagacctggccggcgaatacgccgaaatcatcgagcagatggaaaccctactgggcgtgcccatcatcgtagtggacggcaacgaattctcggtcaaaatccgcgtcctagccgaccatccaaaagagaagtttgtgctgtaccggaaaggcgaactacccccggtagaagacgactggctagcagacatccggctggggtacgccacgttccgcgccgactccatcacgctacaggcaaccgagctggggctgaccgcggacgaactggtggccaccatgcgcgctcacgcgggcttcttcaactcgcgcgaccgcgtaaccaagctgcgctcgcgcctgcgcgacagcgtcgattcaaagaccctgctggcaatgatgacctccaccctgttgggcactgccgaccactcgttctcgcacctattcgccgagctggcatccagcgcagccccacccgccggcgaagaaccggccgaaggaaaattcccgctgctcaaatacggcctcgacgacttcttctgggatggggccgccaaaatctggaactacgacggccagaaggacctgcccgccctggtgctgtggctgttcctgcaagaacaaaacaactggcccgaaagtgcaaacgcgaacgcgcgcgcggactttaggagctggtttaacgccctgcccaaccagcaggcggtccaggcgtgggcggcgtacgcggccgaaaagctcagttcgttacaacagctgtcggcccggccggcaggtgagctcctgcaaaacaagacggttccgggggtagacgagctgctggtgcgccagctggcagacgagctggttgctggctccaccaatgcggaagcggtccgcaaggttgccgccgaaaggcaaaacaccatctggtatgagcgctcgcgaaatacctggaaagctctgctgagcggggccgaatgcttgacgctgatccgcactatgggcaagcccctgttcgccgacgcggcagacgggttcttccagtacacggataggtggtggaagatcgaccaggcctaccggcagttcctgtactttgctgccggcaccggcggggacagccccatagcagtgctgaaacagcaggtagagaccgcttacatctacgactaccagcagccgctagcccacgaatgggacggggcaatccggcagctgggcgggtggaagatcccggctcggggaagcgagtcagccccgtccaggcaggatcggtttgtggcgctcaatgctcgctcgggcaggcgcaccatcgtgatcatttcggacgcgctgcgcttcgaagtgggcaaagaactagaagaaaaactgaaccggcagggccgattcacggcccaaaccgaaccctggtacaccctgctgccctcagttaccaagttgggaatggcggcgctgctaccgcacgggcaactggaatttaccgaaaagtcggaggtgcgcctagacggcgcctcggccgagggcactgagcgacgcgaccagatcctggctgacgcttttgcggggcgggccggggcgctcaccttcgaggatgccaggtcaatgaaccgggaccagattcgcgactatgtgcgcgagcgggacgtggtgtacatctaccacaacgaaattgatgccattggggattcgggcagttccgaaatggacacgcccggggcctgccagcgcaccctggaggcgctttgccggctctgcacgcagtgggcaaactacgccaacactgcccgcatcattattactgccgaccacggcttcctgtaccaggagcgggcgctcgaagacaacgacactgtgctgcaggggcaggtgcccgccggcaagcagatggtgggcaagatgaaaaggcgctacgccctcggcaagaacctgcagaccgacgacaactggacggccttcaccgcggagcaaatcggcttggcgggcggcttggacgtggccgtaccgagagggctgcgccgacaccgcgtgagtgggaagggacgccagttcgtgcacgggggtgcttccctgcaagaaatcacgatcccagttatcacggtgaccgtgggccggcagaataagacagaagacgcgcggatcgaactgcactactcgcaaactgcgatcaccaccccggctatctccgctcgcctggtgcaaaaggacccggtaggtggaaagaccgcgccctttaccgcccagattggcctgtacgcccaagacggggcgctgctatctgacctggtgactgtagaggtgaattcgccctcgcaaagccaagagcaacgcaaccgaaacgtgcagttggccctaacggccgaggcgaacgcacacaacaaccaagacgtttacatcagagcgcataagctggtaaacggaaaccaggtagcggcggtggccgaacacaaggtgcgcttgttgcgcagtggatttaatgcctttggaggattcgacatatga

SEQ ID NO: 1642 - DNA, 2523 bp, Enterococcus faecium; identical to SEQ ID NO: 1373

SEQ ID NO: 1643 - DNA, 2604 bp, Escherichia coli
gtgaacttgcaaaatcaggactttattgctggccttaaagctaaatttgccgaacatcgcatcgttttctggcacgatcccgataaacgttttattgaggaactggaacagctcaagcttgaaagcgtcacgctaatcaacatgacccacgagtcacagctggcggtaaaaaaacgcatcgagattgatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgcacgcaggcgctgaaaaatctggcgacagaacaggaagatgaagcctcgctggataagaaaatgattgcggtgatcgctggcgcaaagaccgcgaaaaccgaagacattttgttcaacctgattacccagtacgttaaccaacaaatagaagacgacagcgaactggaaaacacgcaggcgatgctgaaacgccacggtctggactcggtattgtgggaaatgctcaaccacgaaatgggctaccaggcagaggagccatcgctggaaaacctgctcctgaaactgttttgtaccgatctctctgcccaggccgacccacagcagcgcgcctggctggaaaaaaatgtcctgctgacgccatccggcagagcatctgccctggcatttatggtgacctggcgtgccgatcgtcgctataaagaggcttatgactactgcgctcagcaaatgcaggccgccctgcacccggaagatcattaccgactcagctcgccgtatgatttgcacgaatgcgaaaccaccctcagcatcgaacaaaccattattcatgcgctggtaacacagctgctggaagagagcaccacgctcgatcgggaagcctttaaaaaactgctctctgagcgccagagcaaatactggtgtcagacacaaccagagtattacgccatctatgacgcattgcgccaggctgagcggttgctgaacctgcgcaatcgccacatcgatggtttccactaccaggacagcgccaccttctggaaagcctactgcgaagaactgttccgcttcgaccaggcttatcgcctgtttaatgaatatgccttgctggttcacagcaaaggagcgatgatcctcaagagcctggatgattatatcgaggcgctctacagcaactggtatctggcagagttaagccgtaactggaacgaagtgctggaagcggaaaatcgtatgcaggcgtggcaaatccctggcgtgccgcgtcagcagaacttcttcaatgaggtggtgaagccacagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaacccggtaacggcgacatcgtttatgctgatgggctgtcgacctcgggtattcctaaccgcgataccattctgaagaactataagggaatggcgataaaatcgaaggaccttctggagttaaaaaatcaggaagggcgagaccttattcgcgattacgaagtggtgtatatctggcataacacgattgatgccactggcgacacggcatccacggaagataaaaccttcgaagcgtgccgcacggcggtggctgaactgaaagatttagtcaccaaggtgatcaaccgcctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaagggaaagtggcggataccgcaggcgtgagcgacaacagcgagttcctgattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccacagcgccgcccggtggatattgtcgcttaccatccgatgattaagctagtgaacaatatcgataaagtgagcctgttgcagacgcatccggtgggcgaactttatgaaccgcgtatcctgaacatttacattgtcgacaacgccaacaatgtggtctcgggcaaagagcgcatcagctttgacagtgataacaacaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaa

SEQ ID NO: 1644 - DNA, 2304 bp, Vibrio cholerae; identical to SEQ ID NO: 1292

SEQ ID NO: 1645 - DNA, 2304 bp, Vibrio cholerae; identical to SEQ ID NO: 1292

SEQ ID NO: 1646 - DNA, 2511 bp, Fusobacterium necrophorum
atggaaaaagaaaaaatcaaggaaatgttggaagaacgctttcaagtaattcctgcataccctagaaaacgacatattcttttttggtatgatggacagaaagcatttcaagatattatagaggaattacagcttgataaagtaaaaatccttcgtttgcaaaaaggagtcaatcgaaatggagaagaaattgataccaatctttttaaaataaaatatactttggagattttggatacggattctcattatttaatttatagtgctaatccaagaccctctaagcatgaaaattatctcttagatatagaaagctattctgatttttttgaagcggataagtctgctatcttagtagatgattttggatttgatagaaaaaatcatggtattcatgatacaattcgagaatattcggagttttttgcaagtaaagagagaagagaaaaactaagaaaattattagaaaatcctttacatacaagcgaagaaaaattaaagctttccgtacttgctgtgattgtaggagctaaaacagcggaattacaggagattttaaaaaatatcatatttgattccagtaaattggaacaaattaagaagtggatgggactttcttttttatatgaacaaattttaaggaaatttcatctttccatagaaagttgggaagaatttttaaaaatcttagtggtagttcatttttatcgagaagtacaacaaaaaccttctattcatttggaatcctactatcttggaaaaaccaatgaactttttatttttacttcttctttgtttcaaaatcaaaacgattctaaacatattcaagaaattttctatgaagtaggaaaggaattgaatatgaaagatagaattgaagaattggaatttgaaaaaatgttattaggaaattcttttgaatatttcgaaaaaagaattttacaggagttggtggaccggttacagcttggagttgtggattattcccaatatatatcatggattcaagaacgttctcattacagtttctggaaagaaaagtatttctatttctatgaaactcttctttccgttgcccatttattgaaagaaaaagaacagttagaaatccaagatagaaaaacactttctaaaattttggaagattatacagctcattactacaaaattgatcaggcgtacagaaacttttactattcttatgaccagattaaaagttcggaacttgcttctattttcgattcctttcatagtaaaatttctcatttttatgaagtggaatatttagaagttttgttagctctttggaatgaacatttggaagaaagaaattctttagcacaacagaaggatttttatgagagatatattaaaaattcgaatactcgtgttgctgtaatcatttctgatgctcttcgatatgaagtgggagaggaaattacaagacaattagaaaaagaaggaaatgccaaagaaattcgaatttttcctttattaaccaacttgccaagcattacttctgtgggcatgacacaattattgcctcccggaaaagatcgaagcatagatctttttcataacaagatgacagtcaatggaatttctacattttctacagaaaatcgtgaaaaaattctaaaagaaagttgtttggaatcttctgctatttcttatgatacttttaaaaataagagcagaggggaacaggaagcttatgtcaaaggaaaaaaagtactatacttttatcatgacagtattgatgctataggagacaaagcgaaaacagagcatagaacttttgatgcttgtaaaatggcaatgcaagatattctttctttgacaaaaattttatccagtcttggaatcgtcaatatttttattagcagtgatcatggatttttatatgaaagaaaagaaattgaagagtataataaattagaattgcaagaagaatattttcttttaggaaaacgatatgctttttctacaaaaaaagtggaagagaaaggttgtattactattcccattgaagatttttttggagtttttccgcaaaaaaatcaaagaatcaaagtgggaggaagcggtttgcaatttgtacatggaggaagtagccctcaggaaatgattattccatgcattcattatcgtggaggggctaaggtcaaaaaggcaaaaaaagtaggagttcgcattaaagaaatgggagagaagattacttctcatttcagaaaatttgcaatatatcagttagagcctgttaatccgcaagaaaaattattagaaagaactgttgttgcagctctgtatgatgggaatatttgtattagtaatgaatttaaaattctattatgtgcagagactgaaaacacggaatattctttttccttgactttgagtggagaacatgagaaggtaatattacgagttaccgatgcagagtcaaaagatattttagatcaaaaagaatatcaagtcaaaattggaattgcatctgaatttgacttttaa

SEQ ID NO: 1647 - DNA, 2304 bp, Vibrio cholerae; identical to SEQ ID NO: 1292

SEQ ID NO: 1648 - DNA, 2346 bp, Xanthomonas vesicatoria
atgcgcgtgatcgaacatctggtcaagaccctgcgcgactcggcgatcttcaaccccgaggttcaagtcgcgccctcgtgcatcttgtggcccgacaaggaccgccagtgggaggctgtgatcccgcgcctgcagagtgagctggcggaactgctggtgctaggcgactacacgcctgagaaccgcacggggccggccatttggctgcgctgcgtgattgccggcaaggcgcccgatgtcactttgccagccgaccgcgtgccggtgttctacctgcctggcgtcagccgccaggacctacgagcgatcgaagactgcccggacctcttgaagcccttggccgagctgcagtacaggggcgtgatctggtcacaggcgaacgccaaggactggaccatcatggctttcctgaagtccgaccaaggcggcatgggtctggatatggcccaggacaacgatgccaagaacgccatgcaactggcgctgtaccggctgctggatgaagaacgcgagctgctgaagggcaagcggctggataaggactacttcaacaccctgctgaccggtggcgacccggtacgcgacctgctgcagtggctggatctgggcgaagcgttccaaaccacgcgcggcgcaaacgagtgggcggcctttgtggaggtctgcaagtcacagcttgcgttcaaccctcaggccgagggggtattagcgggggccagcaagcttgcgatgcgtgaagggccctggcattcggtgtgggagcggtacagcgaagcgccccagcgctacccccacatcccgaaccgaatacgccagtgcaagccgccacagctggggatcttcgacgcgccgggagagaagctgagcggttggccacaatggaacgaagagcaggaaaagtcgctccagcatgatctgctggcgctaaatcaccttcctgcgcacgaagcaagaaagcgggtgctggagatcgagaaggctcacggaccgcgccgcgagttggtctgggctgagcttggggaatcgccgctcgcgttggcggttaagcacctggccttagtggctgaagttactaaaactagtttggctgccggctcggtttcagacatgcaattaggctacgcctcccagggctggcgggctgacgacgcgatgctgttggctctggcctgtgttgacaaggcagtagacgttgaagctgtgacgtcggcgatacgcgcgatctatctaccgtggctggaagagtccgccagatacctgcagcaggtgatttctggatcggtgtatccgggcggaaggatcgctgaggcacctgcgttctatagggtcgatggagaatgcgttctgtttgtggatggccttcgctttgatgccgcgcgtcggctctcggcaaccctggaggcgagtggctaccaggttgcggaagcgatgacctgggccgccttgcccagcgtcactgcaaccggcaaagccgccgtgtccccagtgcgcagcaaaatcagcggcagtgatcactgtgacgattttgaacccggtgtcgccgctacgggtcaatcgctcaaaggcggctatcacctgaagaagttgctgagcgccgacaactggaaggttctggacagaacagacaacggtgacgggcacggcaacgcttggtgcgaattcggcgatatcgacagtgagggccatgttcgcggctggaaattggccaaacacatcgacccacttcttggcgaaatcgcagaacgtattgctgcgttgttggccgcaggctggactcgcatcaaggtggtgaccgatcacggttggctacttatgccgggcaagttgccaaccatccagatgtcaaaggacctcacggacaacaagtgggggcgctgcgcctcgatcaagtcaggcgcttccaccaatgagcgcttgtacccctggttctggaacccgaatcagcagttcgctcttgctgacggcgtggggtgttatggaaaatcggtggattacaaccatggtggattgagtcttcaagaatgtctcaccttagagctgatcgtgacccgaggcgcgaacgcatcagtcaggcaagccgcccaggtgacggacatcgcctggaggggcttgcgctgcacggtggcagcggacggccagtacgcgagcctgttgctcgacattcgtacgcgcgcgggcgaccccacaaccagtgtggtcgtaagcatcaagccacttaaggacaacggcgccgcatcggtggttgttgagaacgaagaactgcaggggttcgaggcatttttggtcctgctcagcgcgtctggcgaactggtggccgaagcgaacaccgtgatcggcggagcgtga

SEQ ID NO: 1649 - DNA, 2520 bp, Lactobacillus zeae
atggctgaagttggtttgcaagatgttgtggctggtattgagaaactgttcaatgacatgacgcattttgtgttctggtacgacgcaaatggggactttaccgacaacttggacgaacttagggaaaagattcgtgaaccaattgtcgtgttaaatcatcgtgaacaggtgaagacaaaactgcacttgattgaccttgagaaagctgggaagcgcgcattggtttattcaccgtattcgaaacccgagatttcgttagatttcttaaccgacatggaactgtataaccaggagtttacggcagatgctgctgcgatgttgcaaaaggaacttggcttaccagatagtcagcgtgaatttgttcgtgatcaggctaagttctttaacaataaagagcgagttgcacggtttaaacaattgaatcagcccggtaagaatccttatcaagttgcaatggcggcattagcaaagacaacagatattcagttgacttccattcttctggcagttattgccgcgcaaactgataaccagaatgtcttactggatgagtttgataagtacgacttgcaagaggagttctggcagtttattagtgccgcctacgggtatactggtaaacatcagttaaatcagctcttggcggctatgttcttgaactttgcctattttcagctggataccgatttgccaaagaattttgcaaattataaattagcgaacctcactaatgtcagttcatttatgcttaattggcgacaacgagctgacttgcaggaaaagtatgcttgggcggctgagatggtttggcaaaagttgaacggtgatcgaatctttggacaaattgacccgactcgtttaattaaagtggacgcttttccgcaaattgataaacggattttgcagtggcttaacaaagagctagttgctggcaatactggtgaaatgcttgggcagctgtccttgaacgatatcgctcagaagcggacgaccatgcattttggcaaacagtatcaggtcgcggatgacatgataggggatgcttgcttaattctcagcgagcagtttacacctgataccgaaccagcaagtgtgctcgaacagttgagccagtatacggagaatggttataaaatcgatatggcatatcgacgctacaacaaggcgagaaatgatttgccagtggatctccaaccgatgtttgacaagttgtcagatcaagttgagcgcgtttataacaataatcgacttgtaccaatcatttctaactggacaaaagtgtacgaaccacgactggttccaccgcagtatcagcagagggacttctactcgaattttgtttcaaaccaaaaggatcgcattgtggttatcatttcggatgcatttaggtttgaggctgcgaaagaacttcaacgtcgacttgatcaacaagatttgtacaccccctcaatgcagagtgcgattactgggttgccttcagtgacctattttggtatgccccagttattgcccaatcatcaattgagatataccactggccaggaactactagtcgatgagaaaccagctaccaatcttaagctccgcagggctattcttcagcaagctgaaccagcaagtgacgcggagggattggatacattcttgtcatggtcgtccgaggcacaaaaacagtttattgccggtaaaaaggtcatttatttctatcacaacacaattgatgcagttggtgacaagccagcatcagaggcgaaagtgttccgagcggttagcgatgcgatttcggaactgcagcgcggtattgatcggctacggaacatttcggttgcccacattatcgtgacggctgatcacgggtttatttatcgacggaagccgcttgattctacggacaagattaatcttccaaccgatatggtttttgaagtgaagaatctccgatatgcaatcgggcaaggtgaactaaatgagattggtgttgggcaggccaagctaggagacattcttgacaccgatgatactcgatccgtcttttaccctgaaaacggcaacgtgttcacagtgccaggagcaggacaaaactatgtacatggcggttgttctccgcaagagatgattattcctgtgcttgatgtccgtgccagacgcggtcgttcccaggctagttatgctgaattaacgctggttacaccggtgcgtcgaattacaacgcgtgaagttatcgtcaattttgttcaaaaagatgcgatcagtgatttagtaaaaccggcaacctttaaaatgttctttgaagatgataaaggcaatcatatttcgggcgaaatacaggttgttgccgattacaaggaaaaaaatattgaggaacgtagaatcacaggccgaatcccgttgatggacaaggaatttgatcgttcacaagagtacttcttggtggttgaaaacgttgattctggagaaatagaccgtattcaatatcaaatggatttgacggtcggaggagggtttgattttgacatctga

SEQ ID NO: 1650 - DNA, 2415 bp, Bacteroides ovatus
atgaagccagaaacacctgtcattatcatatatgataaagaaggggtttactatgacttattgccgatagccatagaaaaaggatttaaggtgattgatacaaccaaaggagcactccatgcccgattgtctgcatcacgattctggtgcaatgacttatccatagacaaaaacgttcagatgatcatatatcgtcagcgtccaatgccaaccaataacagaagttgggtagaagagcctttttcttgttttatgaaaagtgcctgtatatttccatatggtccacaagacacttatgaaaatatttgcagaacatttctaccctctaagcaacaagacttggacaaactttttgcaaatggctctacttcatttaatatgattaatgcgttgcttgatggtgccgcatatcctgagctagaacaattgacaggaggaaagagcatttctgaaataaccgtaggattattggcgcttgatgagtgcacaaatatgaactggcagaaagagtggagaattcttgcagaagtacaattcccacgacttgactgtactggtgtctcacttaatgaagtgcaaaataaactgtggacatatcttttgtttagcgaatttgtattcgaccttcctggagcattacctgaaaacctaaaaagtgtaccaatggctcctgttgagatgaaggaaaaagtttatatgatttgtgataaactcagaaatcaaatcaatctccgggagacatacgttagaattgctaataaagtgtctgaacagttgaagctgtcagaagtttttgtgaaagcaaaacatttaggtgaaagagttacctttaactttgaaaacagcgttgaatacaaccgctttattgactatataaaagcaggagatatacaagaagccacacgtttgattagcaagaacgaaagcggtgtatggtatcaagaagagcaagaggtttctaattattggaaattggcacagcatatagttgacctcatgcaatgtatcaataatggaattgagacagatggaacattagctgatcttatcgaatggtacacaaatgtaggttgtgttgccgataatgcatttcgtaaattccatacagacaaactcggaatgttgcatctccctaaacaagctgatgaacttaccaatcttatcaataaacattatcgtgaatttacagaaagaggagttaaagcatatcagcagctcattatagacataaaggattatccaaaattaagaaaccagggctacattcaattcgtcaagcctgcaataaaaaatggcaaacgagtggtttttgtgatggtcgatgcattccgatatgaaatgggtaaaacatttgcaaagagtattgaacgtaacttcatggaacgcgtagaatgtttgtcccgcatatcctatctaccatcaattactcgattcggaatggccagtcatatgggagatatatcagtaagaaacatccaagggaaattacaaccatttattggagagcaaatggtgtcaactcctgaggaccgtattacatggttaaaagcagatacaaacattgaagttcaagatttccgattagaagaatttaattcagctaaggtaaatgatagaacacgactgcttgttgttaggagtgttagcattgattcagcaggcgaaaatgacaaattgaatggacttgctaccatggagcgcgaacaaatacgtttggcaaaactattagacgattgcaaacgattgaagtttgatgaagccataattgttgccgaccatgggtttatgattcaaccatcattcaatgtgggtgatttgataaataaaccgaagggaagcgatatttccattgaagaatcgcgtgttattgctggtaatttgaatgattcaaacgatactttatctcttacaaccactcaattaggtaatgatatggaggtaatgaagttgagttatgctaaagattatacagtatttacacgtggtgaaatctattatcatgaagggctatcacttcaggagaatgtggtacctattataagagtaaaacttcaggaagaaaagaaacgacaatccttccaagtatcactatcatataagggtaaaaatggtggaacaattttcagcagaaggccactgattgatattaatacaacatttgcaaatttgtttgcagatgatgtaataatgaagttgaaagtcacaggagataatgattgtgaaattggagaggctgaagatcgtttctatgatagtgtcacaggacttatccgtattccttctggtgctacaagcgttcgtcagttaattaatatacgagatgaatatcatggaaatactgtgacaataacagctcttgacacagagacgaatgccaccctttctacattaaggttaaactttgaaaatgattaa

SEQ ID NO: 1651 - DNA, 2598 bp, Escherichia coli; identical to SEQ ID NO: 1554

SEQ ID NO: 1652 - DNA, 2598 bp, Escherichia coli; identical to SEQ ID NO: 1562

SEQ ID NO: 1653 - DNA, 2592 bp, Coprobacillus sp.
gtggcattagaagatataaaaaagaacttagataaaaggttttctgaacctttacctgagttttatgatagaaaaattatattttggaatgatgaagaaaaagaatttatagatgaaatagaacaattagaattagataatgctaaagtgttagtattaaaagataataataactttgaaattaagaaaatattatcttatgatgatttgagcagcaattatctagtatataatccatttgatatcaatatggaagatgattggttattagatattaaactatacagtgaagaatttagagcagatcaagtatctatgtggatgcaagagatgaatatagctccaattcctgctgtacgtaataaaattaagctgtataaaggttttctaaatgctagtagtagaagaaaacttgtatcacagtttggaagtgaaatagacacaccatctaagcttcatttggctgtattagcttctattagcaaagtacgaagtatgagccctaaagatatcattaaagctgtcatggctaatggtgatgatttaagcaatgatttaaagatgagtatgttatcttataatgcgagtgatacctattggcatttagtaaacaaaacgacaggatatgtgtctgatgatgtaggtaatattgatgatatgaatattcatattgttttaagtgcgatgactaaaacaatgcaagaaagatgtctaactggattagaaaatagatataattctttttatagtggcttttgttatgaacttatttatgaatggttacatagtgatagaaaagaagaattagttgatgtattaagatatattgaaagaaaattaaaactaatcgatcgttttagtcaattagaaattagtgatattgttgatactgaaatattaccatgtatagatgaaattattttaaataaattaatggaaaaagtagtacaacatacaattaatgctgatgaagttattgcgattatagaaaaaagaagaacaatggtatggtataaagaaaatgaattctattatactggattaatgcaagtagctaatatgcaaaaattccatgataatcatatcaatggttttcatcatactgttgctaaagatatgtggaatagttatgtaagtgattattatttaatggatacttattatcgtaactttcatgtggcatttggacaaagtttaaatttatctcatccattattagatgataattttagatttgtagtagatgaagtagaaaaattatataaaaactggtatttagatcaattagctacaaattggactaatgtaatagaagaagatttaaaagatgttggtcaaattaatggtattaaccaacaaacgagtttttatcaaagagatataagttcatttgataataaagtatttgtgattatatcggatgctttacgttatgaagtagctagtagtatttctgaaactttaaaaatagaaacgaaatcaaatgttgaattagaaagccaacaatctatcttcccatcggttactaaatttggaatggctgcattattaccacatcgaaaactttctttaatcaaacaaagtgacactataaaagtattggtagatggaaataatagtgattctagtaatagagaagcaattttaaaaaatgctaatgaaaatagtgtagttgttaaatataaagattttatattgatgaaaaaagatgaacaaagagaactgattaaaggacaagaagtcatttatatttatcatgatacaattgatagtacgagtcaccatgatgagatgggagtatttagtgcttgtgaaaaagcaagtactgaaattgtgaatctagtaaagatgattactggcggtttaaatggattgaatgttgttattacttctgatcatggttttttatatacatatcaaccattaaatgaagatgataagatgaatcgaacatcatttaaagatagtattatcgaacagggtagaagatatgtcattactgatttaggtagtgaacctgactttttaatgcctgttaaaggattctatgaagaagatggatataatgcatttgcaccaagagaaaatataagaattaaaggtgctggtggagttaactttgttcatggtggcattagtcttcaagaactagttgtaccagtaattaaatataaatatctacgttctggatataaaggatatgagaagaataaagataaatatgattctaaaccagttacaatatctttgttatcttctaatagaaagattagtaatatgatttttaatataagtttttatcaaaaagaaccagttaaagataattatgttgcttgtacatatcatgtgtttttaacagatacacaaggtaatatcgttagtgatgttcaaaagattattgctgatagagcaagtgtatctaatgttgatagagaatatcgttgtacctttaatttaaagcaacaaaaatatgataataaggagatttattatttagtaattcaagatgaagcaggtgtacaagtaccaattaaagaagaaatgcaaattgatatatcaatgacttttgaagaatttgatttcttcaattag

SEQ ID NO: 1654 - DNA, 2127 bp, Natronorubrum tibetense
atgaaatcgcaaccgacgacgacactcgaagaccaggcgaaagctcatctagaagatgaatttactgacgactacgcgacagctgttcgagtcgtctggtgggacgacggaggacatctccgagaggtcgtccgtgctgctgcagaccggatcggcgtagggttctcggaggcagaacagttccctctcgaattgagaagaaacgcaatcgacgaaccggagactccccacgtctggtacatcccgcaagcgaaggagaatcgtgactggttcagagacatccgtgaaactggcggtgaaatcgaactcacgatcgaacagctaactgccgagctgtatgaggtcaatccctgggatatctatgatgttgagcgagggacggagtctgaccgcgaaactgcggcgaatgtaatcaaaactcagttcgcaagcggtggaattccacgctacggggacctgatcggtgagataatcacaaagggagagggccagattttagaacacctcctcgagggtggatggccagaaatcgacaaggatgatgaaacgattgcccgagtgcaaaagtcgctaaaagacaggcacgtcgctcccgcagacaatgctgaaacaccagaggagatcgaggacgtcgtctggaagtgggccgttgcccgttggctcgtcgccgagggaaaggatgtcgacgctttccccgagggatatggaaacgtgggtagcaccctcggcgatatcaacccactcaaacgaattgtcgattcccgacagagcaagcggttggcagagcgctatctgagcgagagctactggggagacgtaatcgaatcatccgacgatgcgtgggagttcgcggcctgtccggttgatggagcgcttgatgcagctctgtgggatgcgtggctcgaatcgttagaagaggggaggtatacggaatgtatcgaaagggcgaacgaacgccaagaagctcttggagtgtatccggacgatattccctggacgacgctctgggaacaagccgaacaagtagccgagttggaattgcggtttgcagcctgggaagagcggtcccagtcattcgaccccttcgaccagtatgccgatcaagaagacggaacttggaagatcgactatggggtgttggaactcgagatcacaggtgaacccgagcaagagagactcctcaactctcacccggcgacggagtcgctccctgagattcgcgccgagctcttagagacgcggtatatgaactatcttgaggagatgagcgaggcagtagtcagttcgttcaggactggatcgcctctggcggggaaagacgctgcctacgagtggtggactgacaacgagcaggatctcgcaacaggggaaacagtcgccctgtttttgattgatgcgctgcgattagacctcgctcgggagctggccaaccgccttcgagaggactattcgatcgccgaagaaaccagagttagcacacttccatcggagaccaagttcgggatggctgcactcacaccggggcgagcccacaggttccgtgtcaaactccggaacgggaagctctctgtcgaacgaggtggccagcgtctcgacaacaaaggaaaccgagtaaaagtccttgaacgagagggatgggacgtaccggacgatcgcgattccgggtggcaacaccaccaaatcgcctactacgacaaggacatcgacgacatcggtgagaatgaactcgacaatccagagagtcacttcaccagttacatcgacgaactttacgatctgattacagaaaagctagagaacgaaaactgggatcgaatctacgtcgtgacggatcacggattcgtcctgctcccgaaggggactacaatggaatcgatttctagctacgacggagatggagaggtcaaatatcggcgaatcgctggagacgacatcgaggatgccggaacaggcgtccgagtcacgggtcagacacccgggacagaatatctgaaaacgtcagttcgattgctcgccaaacctcgacagtacaacagcaaaagtgggcttaccgacgcccgctattaccacggtgggatccttccgcaggaatgcatgctgaacttcctccgagtcgagaaagaatag

SEQ ID NO: 1655 - DNA, 2193 bp, Haloarcula argentinensis
atgcaagcaacacaaaccctccctgaagccgcgaaagacaccatccgaagcgagttcgaccgggccgaatcagcagacccgatcgtcctctggtgggacgacgggaactatctcgaggacatcatcaagcaggcctgcgacgaactcggcgtgcatctgaaagtcgccgaggggacgccgctggaactccgtgctgctccagtcgacggcgaacaggtctggtacgtcccacacgtcaaggagcccgaagacaccgagggtgacttcgactggttccgcgacgtcgagcacacgggcggcgaggtggagatgagcatcgaagacctcactatccacgcgttcgaacgcgggcaactcgacgcgtgggagctgaaaaccacgacgcggtcggacgaccccgcaaagcgccgcgagatcgcgcggattctccacgaccagctcaccggcggccagctcccgacgctcgaacagctccgcacgcgaatcgtcaccggcggctacaccgatccggtcgcgttcgtgctggagaacggctggggcgacatcgacgacagccccgacacgatcgagcagatgcaggacttgctcaccagcgagggtgtcgacgcggtcgccagcgaggacgaacccgcggggatcgtcgcggcgacgcgtcggtggggcgtcgccgagtggctgatccacgccggtgtcgatgccgaacggttcccgacggcgttccgcgccgaaacggccggcgatcacgatctccccgaactcaagtcgctgttgaacaacaccacctcggccggtctcattgccgaccgctatctcggcgaagcgacctggcccgacatcgtcgcggacgtcgacgagccgtgggaactcgcggattgtctcgtcgacgccgctctcgaacggcgtctctgggaggcgtggcacgcatccttcgacgccggcgactacgaggcgtgtctcacgcgcgcggaggagcgctacgacgccctccttggcagcgaggacttccgtggcacttaccgcggtgcctacggtccagacagtccgtggacgcagacgtgggagcaggccgcggaggtcgcccgcctcgcacaccagctcgagacgtgggacgagagagccaccgacgacgttgtctcactgtacgctgacccggacgacggaacgtggcagatcgacaacgcggtgctcaacctcgtcgtcgccggcgcgcccgagtccgacctcccttccgaccatcctgccgtcgataccctcgacgacctccggacgcacctccagtcggaatacgtcgagtacctcgaagccctcggagaccgcgtcaccgaaactgtcgaggccggcgctccgttcgtcgacgaggaccactcctatcagttcttcaccaaggaatccgacggcctcgaaagcggccagacggtcgcactgtttgttatcgacgccctccgactcgacctcgcacgccggctcgcggacgagttacgcgactacgtggcgacgctcccggccgacgcccccgagttcgccgtcgacgaagacgtctggctcgggacgctgccctcggagactgaattcgggaaagccgcactcacgccgggagagatccagatgttcgacgtctcgctggtcgacggcgagttacaaccccttcgaaacaaccgaaaggtgaacacgaatcgacggaactcgctgttgcacggcgacggctggacggtcactcgcgacacggaggacggctggcagtcgacgcgtgtcgcctacttcaaaaacgacctcgacgacatcggcgagaaggaactcagcgatctcgaggcgatgctggcccgacgcgtcgactcgctcgcagagttcatcggtacgaagctcgaacagggagagtgggaccaggcatacgtgctgaccgatcacgggttcgtcctgctcccggacagcgcgtcaccggagaagatctcacggccgatggaggcgtcagactccggtcggcgatggattgccggcgaggacgtagacgcggattcacccggcgtgctactcgactccagctcccgactggggtatcttgacgctaacgtcagcgtccttgcgagcccgctcaagcggttcaaaaagcagggcctcggggacgcacggttctaccacggtggcctgctcccacaggagttcgtgctcgatttcatcagcatcacgcaggggtag

SEQ ID NO: 1656 - DNA, 2151 bp, Halosimplex carlsbadense
atgccagcgacgaagacactcccacagtgcgctcacgacgctatcgagagcgccatcgacgaagccgcagacgaggaccctgtcgtcctctggtgggacgacggtggctacctacgcgacatcgtccgagacaccagcagtcagctcggctgtgagttcagagccgcggaacagacgccgctggaactccgcacagaggcaccacgggaccgaaccgtctggtacgtcccacaggccagcagcgacgacgtcgactggttcaaagacgtcgagcacaccggcgacgtgatcgaacagcacatcgggaagctcgcagcccgctgcttcgagaacgaccgactgcaggcggcgacgattcggacagcctacgaggacgccgacgaccgggagaacgtcgccaagacgctctacgaagaactcaatgacgaaggcggccttccatcgctccagggcctccagacgaagatcgtcctcgacgggcacgacgaccccgtccagttcgtcctcgaacacggcgccgagaatttacccagcgacgaggacctgatcgagattcgcgatctcctggtcgacaacggcgtggacgccgtcgacggcgtaagcgacgcccagactatcgtcgaacgaacgcgccgctgggccgtcgcggagtggctcgtcgacgagggactggacaaatccctgctccctcaggagtaccagcccgagtccagcagcgggttcggcgtctccagaccggaactccgctccgtcctgagcaagaccgaacgcaagcaggaactggctcgcgtctatctcgacccaaaccagcggttctggcacgacgtccttcgcacccacgacgacccgtgggagctcgtcgactgtcccgtcgacgcctcgctcgaacaccgcctctgggacgagtggacgcagtcgttccacgccggcgactacgaggagtgtgcaacccaggcggaacaacgccacgaacgcctcgacgcgacctacggcgacgttccgtggacgcagctctgggaccaggccattgacatcgcgacgctcgcgaacgaactcgaaacgtgggaggaaagcggcgataccggagatgtcgtagagctgtacggcgacgtagaggatggaacgtggcagatcgacaacgccgtgttcaaccttatcgtctccggcgagccggaaaccgccctccctgaagagcatccagcaaccgcgaaactcgaagatctccgctcgtcgctggtcgaatccagatacctggagtacctcaccgatctgggcgacctcgtcggggaccagatcgaagcgggctcgccgttcgtcggcgagaaccacgctcaccagttcttcgccgaagaacaggaacacctccagagcggtcagagcgtcgcgctgttcatcgtcgacgccctgcgcttcgacctggcccacgaacttgccgagtccattcgaagtgagctcccccagctcgaagttgacgagagcaagtgggtggggaccctcccctctgacaccgagttcgggaaggccgcgctcacccccggcagcaagttcagtttcaacatcgaactgcaagacggtgagctcgttcctgaacgaaacggacgcgagatcacgaatcaccgccgacagacgctcctcgaaaacgacggctggagctacatcatgcaggatgccgaggacgaggtcggctggagtaacacgcgcgtcgcctactactggaacgacatcgacgagaccggcgagaaggagctcacggacttcgaggagctgttcagcgaccgcatcgatgccatctcccggatcatctgcgagaagctccggaaaggcgagtgggatcgtgcgtacatcctctcagatcacggcttcgtctcactcccacagcacgtcgatatcgacgacctgcatccgccgagcaacgccgagaaggtgacccgccggtggatcgccggcgcggacctagacgacgacacgcctggtgtcttgctggacgaagacacgcacctagggtacctcgacgacgataccaaaatcagtatcctcaccgacccgatccagcgcttcaggaaccaggggctcccagacgcccgtttctatcacggtggcgtcctcccacaggagttcgtcctgaacttcgtcacgatcacgcaagagtaa

SEQ ID NO: 1657 - DNA, 2973 bp, Rhodopirellula sp.
atgacggacacgatcactcccgcccgacgtcacggtcccgtctccaaagcactggagtctgaactacgcgctttaataggccagcatgacattgtcatttggttggacgccggcagcatctacaccgacttcgtcgactcgctcgctcggatgcaggccgacggcaagttgccgtatgcggtgcatgcttttcgcggcagccatctgcaattgctgtttgacctgcgaatggtcagcagctcgcccagccgccatccgatggtgattcacatgccgggcttcaaccgtgactcggtgaagcaaacgccaatcttggaactgtacctggccggccgcagtttcgagaaacgcttttcaactctggtgacggatgcagcgactggaaacgtgacgccagaacagatcaaggcgttcttgtccgatggagagacgtcgattgccgctgccgacgagtggctgacggacatgctgcgatcgggtggcaactcgatcgcagcccaactgcattctttgtcggcggaatcactgctcgatgatctgctcagttcgtctccaatgccggactccgttgcagaccgcgtcgacgacggcgcagatttgaaacccttgtggaatcgtttaggggcgacgttgggtttgcccggcgactggcgtactgatctgcttcgcgaaagccagcgagacgagtcccaaatcgggccaaaggacatcgcgttcgttgccgctgcgtgggcgatggccgttgagtacgttgatgacttggatcgagatccggtggatccaagattgaatgacgcgtctacgttagccacgccattgaaacaggcgtgccgttcgctagcctgctacttacgcaccaatcatgtgaagttttatctgcgaacgtcaaacgatgcggaaaatttcttagaagtcgagaagattgctgcccgcgccgaggacttgggaaaagtcgatacgtttgagtttgaagagcaaaagatctttgagggcacgctggaagcaatcaaggaagagaaatgggatgtagcacgaacttgggcggatcggcggctgagcggcgattcgttctggctgcaggaggatccgcagcgggaaagctcgtggcgtttgctgttgtcggccgcagttcttggggagtcgatcgagaaggcgggggcgacgcttggcgagttccatagcctgaccgaggcgatcgacatttacattgccaagggcgcagccgttgatcgcgcccaccgacaaatggaacaacagcgtcgcagcctattgttccccagcttgccgcgctactacgacgtgcgtcagccgctcgacgcaatgcgtttgctgtggcgtgactgggcggacgcgtgggcgattgagttcaaccagttctgccaaacccacggtttcttgccaaaacccgagtatcgtcaacgcgatttctttgacgatgtggtagtgccgctgtgcaaggacggtgatgccgtcgcggtctttgcggttgatgcgttccgctttgaaatggcgacggaattgatggacgagtttgagtcggccaaggcaacgacggttcatttgaacggtcgattggcggagttacccacggtaacgtcagtaggcatgaatgcgctagcgccggtgaatcaaaagggaaagatgaaaccggacgtgaagaacggctcggtgcgtagtttccattccggtcagtttcaggtgaaggatccggccagtcgaaaacgggcgatgcacgaaaaggtcggcgggcggacgtgcccgatgctgacattgcaggagatcagtggattggatggcaagcagcttcgtcggaagatcgcgggtgcgaagctgatctatgtgcacagccaagagatcgacgatgccggcgaaaaagatttggggcctgttgtctttgactatgcaatgcaaagtatccgtgcggcttggcagttgttacgtgaggcgggcgttaaacaattcgtcttgaccgccgatcacggctttctgctgcgcgacggtttgtcggaagttcaatcgcacgggcgaaaggtcgatccaagacgccggcacgtgctgcgtcccccgtcggcggatcacgaaggcgaggctcgcgtcccgctttctgatcttggttacgaaggttgcgaccaacatttgttctttccaatgggtaccgcagcgtttgatattggaaataagtcgctgaactatttgcatggcgggaactcgctgcaagaacggctaatcccggttatcacgatcagccaccgtgcggccgtcggcggacaaaacgaacgttacgagttcacggatgtgaagcgagaagaggctgtcgccgagatgcactgtgtcacggcgacgctgacccacgtgagcgagcaagcgtcgttgggtttctcggagggtttgaaactggccgccgcgctgcgaccgcttggtgcggatgacgtttcactggaattggtccaagtgcgtggcggcggtgcaaaacttaaaagcggcacgatcgtggccacggcggggacgcccttcgaggtgttcttccgactgaaaggcaaatcggatgggcgagtgcgtgtcgagctttaccacccagccgcggatgcggatgtcacaccgctgctgttacccgatcgttttacggtgacagtcgttggtggtgtcgaggcgaaatccgaacctgagatcgagaaaactccggctaagcctattgtcgacgagatcgaggcaagttcgtggcttcatgagctggagaacgacgaggttcgccagttcttcaaccatctcgaaaagcacggtactgtgacggcggatgaagcggagacattgctgggcggcccgcgacaggcacgccgattctcatcgaagtttgaggcgttcgctgcaaaggctccgttcgccgctcgcattgacgtgatcggcggcgtcaagcgatacgttcgcgaacacgagacggagtacaagatcatcaaggattcagaatcatcatga

SEQ ID NO: 1658 - DNA, 2643 bp, Pseudanabaena biceps
atgtccgcgatcgccagttatcttgaaaacgacattaaagaaaccatccgccgtcagggaattgtcctttggctcgatgccgatagtcgctataccgaatttgtcgatcgcctgatcactcgtcatcaaacaggtgattttgattttcctgtggtgggttttcggggtagctatctggaaattttgctgcaactagaaaactatggcaatggactcgatcctgaaccgttattaattcatttgccaaaccacaacactaatacggttaagcaaacaccactattagaactatatcgggctggtaaacgctacgaaaaagccctgaatactcttgtgcgtgaggcggtcacgggtaaagtcgcccccgatgcgatcgctgatttgctcaaaactcccgacctcactctagcaggggcggaaacttggctagatcaggaattaaatcgacataattctcataattctaaaactggtaatatccgtagttatttggcaggattagaccatcaatggattctcgatggtttgctcgatcacaatagcaatctccgcaccaaaatccatagcgcatctgagctaaatattctcatcgaacatctctatattcatacagggatggatattacctttttgcagttcttccttaaagatgatcctgtagatatagatcgtctagaacttgcctttgtcgcttggttgatgtgtgtggaatataccaacgacctcacccgatcgccctatttaccacaattacagccattgcgatcgctcccaaaacctttacaagcgcaatgtcaaaatctaattaatcatctacgcgatcgctatcccatccgctacatggcgatctctgaagaagtagaagcaaaaatcaagcctgaatttgaccagatctctcccaatgacctcggtaagattgacaccttcgccactgaagatcgggtgatgctcaatgcatctattcaagccttgctcactcaaaattggcaacaggcgagcatctgggggcgatcgcggattaatgctccttccctatggatacagcaggattcacaaaaacgccgcctttggggttgggtgttaatagcagcacagtttggacagataattgctcaacaaaatcatgtcttaaacggagtggaaaccctacgagaagcacttgatatctatacccaaaaagcttggattgtggattattaccatcgtcgctttgagcaactacggttgcaaatgtcaaatagtaacttgccacaatttgcgtcaatggtgacggtgactaattttttgcggcagctttatcgtgactgggctgatgatttggcgaggggttttgccaaactttgcgatcaggttgggttcctacctgaagaagaattacaacagcgctatatctttgagcgttactgtctgccattaattactactccagagaaggatggcgcgaagcgccatccttctctaggacaagttgagcaaggtgatcgcgttgctattttcttagttgatgcctttcgctatgaaatggcaatggaactgatgaacaaattaaataaagaggatttccagactaacctgattggttgctatgccgaactaccaacgattacggcgatgggcatgaatgcgatcgcccctgtgtcgagtgatggcaaaatccgcttacccgatggtaaagattttagtaaagggattaaggcgggagaatatactgtcaaagatcctgatagtcgggcgcgggtgatcggcgatcgcacatttagttctagtcgtgatcgacattcgttatctagtctctcgctgcaacaggtcgcgcaatcaacgagtgagactttaggaagtctatctaaaaatgccgccttgctcgtaatccatagtcgagaaatcgatgatgcgggtgaagcaaatatggggctgattgccttcaccacttggattcaacaactgaaagcagcgattaataatctccaaaagattgggattcatacctgcatcctcaccgccgatcatggcttcatgctccttgatcacaccgtcaaagaagtggaatatgccaccgccacccgccgctatgtgcgtcttgatgattaccgccgcgaggctgattgtgtatccgtgcctttgcgatcgctaaattatgaaggtcaagagggctatctactatttcggaatgatactgccatttttaagggtagaactaaactgagtaatgcttcttttgctcatggaggtaatagtttacaggagcgagtaattcctgtcctgaccgtcactaagcaatcagtcactaagcgatcatctgttaaaactaagcgtgttaaatcgcaaacacagattcaagattctcttcaagatccgagtactattacggaagcgatcgctatagatatggttattattgagcctgtagcaagtttatctacaagcgatcgctggcaagataattttgatgatcctgcgatcatcaaggtatttgaacatctagaaaaacatggcgcgatcgtggaaactgaacttgtgcaaatgcttggctcatcacgcaaagcgcggagcttttccctcaagtttgaggaatttgtcaagcagatcccctttggggttcaagttgaaaatgtcgcttctggcaagcggtatattaagagataa

SEQ ID NO: 1659 - DNA, 2082 bp, Planctomycete KSU-1
atggatagctggcgtgattatgttttaaaagaatttactcctcaggttgtacggttgacactggttgcagatcctgatggattattgacggaggaaggtattgtcatggctttacgagaacggggatttgagattttagaattcgatgattctattgcattccgcttttcgtacgaatcaaagtaccgttcgctttgggacaagggagaattgacagaccttgtggttattctaagatcacctacagatgatttaagttttcttccctacgatcttttacgtgtagggcgaaaactttcctttaatttgggtgacctgtttcccaatttaagttatcctgtaatcgaaggtctcgaccgcagtaatcttgataccttataccaggcacaaatacggtataaacctgaaaagcttggagataatacgacaaaagacttcgtcctcaggcatgtatttgaaattgtcccggaactgattaagcaaccacatgatttacttcgtgtcctccttcgactccattataaagagctgcatatccctccaattcttaatgagcggtttatttatatcttacgtcaaaacaaatgttttgatgcctggcctcttgagaagattgtatcggatagagaggctttttttgaatttttgcaagagcgctggccaatatttcttgaaggcatgacatctggtaaagcggaaatagtcagtgaaaaggggttaaccgatgatttgaaatattcaggaccacctaacattccttttgatcaccacgatatccgtatttacatagataatctctttttggaaggtatgctacaccctgttcaacacccaaaatctgatatactttccaaaacatgggttgtttcagggattaaggtagacccggaactcgatacattacgccggttacaaaagttgatgaagagtattgaaggctcaattcctgatgcagaaggcaggcatcaggattggttgatctttgcgcatcggtgggcagaggttatcgttcttttccatcaaacgggaaaacacgtggagcttgcttccagccagcttgacttcaataaaaactggcaagatgccggctctaccgatcatctcaaaagtgcttcaatatctgaactacacgctaatcaatttcaaatgcttcaggaaaggatcgacaaagcatttctactctggatacagaaacgatatggaggtttatacaatcaacctcctgtacctcctgttatggtacaccatattccgagggcaatggagcgttacatgaggtctatgggtaaagaaaaggtcgcattaattctgatagatggtatggcttttgattcctggttggtggtcaaggaagaatttatgaaacaacgaccacatttatctatccgggaaagggcaatttttggttggataccaaccatcactccggtatcccgacaggcagcattcgcaggaaaaccaccaatgtgctttcccaacagtatcaatactctcgaaagagaacctgtattatggtcacagttctggatagaccacggttttacacagtcagaaataagctacgtaaaaggtgtgaatgaaacaaaaacacatgtgatcgatgaaataaccttagatcagagaattcgtatattgggtttagtagtggatacagtagacaaaataatgcacggtatggaacttggcttggcagggatgcataatcaagtacgccaatgggcaaaagagggttttctgggaaagctcattgaccttttacttgaaaggaattataagatcttcttaacatctgaccatggtagtattgaggccaaaggatgtggccgtcctgcggagggttctatagccgatgtacgaggagaaagggtaaggatatatcccaaccaagtcttacgaaaaacgataaagacaagatttcctgaagcaatggaatggccacaaattggccttccacaggattatttaccactattggcccctggcaggtctgcatttattcatacagatgaacaaattattgcacatggtgggatatcgttagaggaatctgtagttccatttgttcagattgaaagaagttaa

SEQ ID NO: 1660 - DNA, 1935 bp, Bacillus cereus
atggggagttggcgtgatggaatactgaaaaaatttcaatatcaaaatagcaaaatgatattagtccatgatcaagatttccttttaaatgatgaattactattaaatcatttaaaagaggaaggttatgaggttattcgttttgaagatagtatttcttttaggtatttgtacgagctgcaatatcgtgagtcagtaaagtctgataaattattggtatacacaaatgatgatattatgtttccgtacgagtatataaggggaaactttagtatgaagattgatattagtacaatctttccaaagttttctgcgccaatacttcgaagtatgaaccgtgaagatttagatgccttgtttactgtgcatgcacagtatcaaggctcttcttctaataaagatactttggagtatatcgtaaaacatttatataaaatatcgtatgaaattattgatagtgaagtggaattgtacaagctccttctttttcttcattacaggaagaaagaaataccacaggttgtacaagaatttcttatagaaaagttgaatcagtgtaaagggtttcataagttaccgatggaaaaattgatttcttcagctggatttttctatgtttttttagaggaccaatgggcctattttgtatctgaatatacaaagtgtgagagtgagaaaatcttggaaccttcgtcgttatatagaacacatccatttacaaatgatgatgtatggagactaatggtcaacttatttatggaagggactatttcaaaagtaaagaaaggaccaaatttacagatgccaaagtggatgaagataggaattgaggaagaatccaaattggagactcttcacgaaaagctaaatcatattagtaaaatagtgaatgagaaacttacaaggattaagttgtataaagactggattgagttaattgatctagttgctgaatataagtacactgcattggaaagtaatgatacagtatatgtggaagaagcaaatacattaatgatgaaagtaaaccaggattttcaggattggatgttaaagcagtatcatactttaataagcttgcctccgattccaaagccaaagatggttcatcatgtgccgcatgtattacatgcacaaagaagagaaaatgaaaaggtagctctgctagtgctggatggcatgagttttattcaatggaaacaagtgaaaaaacatttgaaagaaaatggtttttcttttgaggaaaatggtatatttgcatgggtaccaactcttacttctgtatctcgtcaagctattttttcagggagcattccatttacatttagcaaaacaataaaaacaactgcagcggaggagaggtattggaaaactttctgggaaaaacaaggtatgttaaagcaatatgtagcatatcaaaaaggattaggaaaagaggattacagtagggagaatattcttgcgttaaaaagaaattctgtgaaaatatatggagcagtaattgatgtaattgataagttcacacatcacgcagtgttaggtgaaaaaagtttagtttctaatttagaaatatggttacagaccaattatctcgtaaatttattagctgatttaataaaagagaagtatactatttatcttactgctgaccacggtaacacaatagctaaaggaattggacggatttcagaaggtgttttagtggatcaaaaaggagaaagagtacgaatatatagtgatacaatactttatgaagattcggcatctaaaattgatacagtgggttggaataatgctggtcttcctgaaaattacaatgttcttttatctcagtatggtcaagcgtttgtgcaaaaaggtgaagaaattgtgacacatggcggaatcagtatcgaagaagtagttgtaccttttataaaagtacaacaaaattaa

SEQ ID NO: 1661 - DNA, 1446 bp, Clostridium thermocellum
atgattgaaaaacgagtagcagagcttttttcaattgaatatgaaaaacggttgctgatatttgataccgacaggttttgtgatgcttttgattatatcggctttcttatttcgcgagactttgaagtaatacggtatgaagatattgaagcatttcggctcagatatgaactggacataaggaattctgaacataaatatgcggttgtcgttttttctgatatatacgtgccgtatgatataaggaagcagttttttgaggttcatatttcttttaaaaacatttttccgaaacttcatgaggatacggtgcagcggtatgtgaaagatattgacctgattagctttgcctacgaacaactttatttttcctgtgacactagggaaaaaactgaagaatttatttcaaatacggttttttcaaaagagaatgtaaaaaactattgtgagttaatgacgaaaaaacttctaccttccggagataaatctggaattactgcaaaggaatggattgaaattgctcgtaaaaaggcattaattgattactatgctgcaagggcaaatatttctgttgataccagctttgttgacgtgtattttgaaaaatttatattcaacggttaccaaaagctttcaggtgaaacaaagaaagatgcgccggctatattgcctaaggtaattgattttatagcacatggtaaaactgctcttgttgtcgtcgatggaatgtcgctgtttgattttgaagttatctcacggtattttgaagggattgaatatgaatattattgtacttttgccttaataccgacgacaacggcaatttccaggcaaagtttacttactggaaagtatcctcgtgagttgaaacatccttttactttaagtgatgaggaaaaaggctttatagaaactgctcagaatgcaggatatacgaaacaacaaattttatatgcaaaaggcttcaatcctcccgtcaaccattttaccaagtttatggctgttattatcaatgacatagatgacttggtacatggccagaagcaaggccgtgtaggaatgtataatgatatttctttatgggccaaaagtggtaaattacaaatgttgattaaagatttgtatgcacagggttttgatgtttatataacttcagaccatggtaacactccatgcattggagcaggaactattcgtggtgttggcgttgaagttgaaaccaaatccaagaggatgtttgtattgaaagattttgcagaattaagaaacttctttggagataaagttgtggcttatccgggatattacttggataatgactataaatactacgtttgcaaatcaggtgtttcttttgataatatgaatgaggaagtaatgacacacgggggcatctcaattgacgaggtaattgtaccattcattaaagtaaggacggtaatttag

SEQ ID NO: 1662 - DNA, 1455 bp, Lachnospiraceae bacterium
atgtttggagactatgtgttaaaacaagcagccgcagaatacaacaatcgaatactccttatagacgacgagggattggaagaattaactcattacagtgcggactttcaggcacatggcttcgaagtggtgcattatacggatgatttgaccttccgaattgagtacgaggataagctgaaaaatacagcgaacaagctgttggtgcttgcacattcgggtagctatattccctatgacctccaacgaagacttagagtttaccttctttcaatggacaggctgtttccgaaactgaatatggaggcccttaaggctcgacgtaatttggatttagagcttctctgtttggcgtataagaagaattttgatgacctgcgacagcgtaagcagacggaggaatttctccatcagaaggtagattgctcagagaatgtcgctgcgtatctaaaacagcgttattctgagctgttgcaaagtcttactaccgccaagagctatcgagattggtttgcccttgcagaaacaaaagcaaagattgacacgctgtcaacggagtatcgtttgaattttgatacttcggaagtcaatcgggctttccgggattatgtattgaaggaattcggtaagctctccactgaaatgaataaagaaactccggtgctggttagccgtgcaatggagtatatgaacgaccatagcaacaaatttgtgattatcgttatggatggtatgtctaaatttgactggagcattattgcaaagtcgtttcatgaccttcaatatgaacaatcagccgcttttgcgatgattccaagtaccacctccatctcccgacagtgtcttctgtcaaataagacaccgggccagctaatggaaccttggaagcagagcaaggaaaagcaggagtttgtggcctgcgcaaggtcaatgggatacacagataaccagataggatatgagcgagggtatgatgcacagtttggctcctttgtgaagtgcggtgcggttatcattaacgatgtggatgatatggtgcacgcccaacaccaaggccgtctgggaatgctgaatgacatcggtgttctttcagaccaacataagctggctgacatgacgaagcgttttctttcagagggctttgatgtttatatcaccgcagaccacgggaatacgccttgcacagggcttggaaagttaatgggaacaggtgtagaaaccgaaacaaagagccgaaggatgattgttctacagaactttgctgacaaagacgggcttatgcaaaagtatggcttgatagagtatccaaagtattatatgaataaggcttttgattaccttatttgcgatgtgggagactccttcgatgcaaagggtgaagaagtaatgacgcatggcggcataacaattgatgaggtcatagtaccttttattaagataaaggcggtaaattaa

SEQ ID NO: 1663 - DNA, 1536 bp, Enterococcus faecium
gtgatgaaaatgaactggataaacgaggttacagacaagttcccgcagaaaaagatttatcttgtaagagatgacgatggattactgatgatagataatgttaaggtcgaattgtctgagttagatgtttctgtaataacttatggagatccagttcattttcgttatacatacgaaactaaattcggtataaaatttgatggaacactacttattcgcttagtagatactggttttcaagagattccttgggacgtgtatcaaaaggcatttcgggaatctattggaattgctgatatatttcccttcctggatagtaaagctgtgaaagagctagatattgaaaaatgggagcaattatacaatgcccagcaaagtttaacagcaagacaaaattatgtttcttcaatgaaatttatagaacgtgtgatttaccatgaagctgaggaacacatttcaatgatacttgatccttatgtcgaagatcttacgctatttaataaaaaagctccggtcttgcgtgaatggggcgagattgctagattgattggtgaacatcgcttatatcgtagaatggatgaggagtttgaactattagtcgatgatgccaataaaaaatttcaagagtatttaaaaaaagagtatgatagaaatctttccctccctccggcaaaacagccaaattatgttaatcaaattttgaattatttatacagaatgcaaggtatttcaaatagaaaattagctttgattgttatggatggaatgagctttactcaatggagtgttatcgaaaaatggctagttaataaaagttttgttttccgaaccagggcaactatggcgatgattcccaccattacccctgtttcaagacaagcaattttttccggaaaaagacctaatgagtttccagaaacaattatcagaacttcctcggagccaattcaatggcgtaaattttggaaaggaaaaggattcctcgaaaattcaatcaagtatcagaaggggttaggtcataccaattatgaagataccgttcttgagtttagatatgctggtacagatatctatgggtgtgtcatcgatgtggtggatgaatttatgcacggtgccaagcaaggtctagagacagttcaatcagaattgagaatttggcttaagaagggattcctagaatctatgttaagtgatttgatgaatttagattatgatgtgtatattacgtctgaccatggaaatgtggaggcaactggaattggacgaatccaagaaggtattcttgctacagggaaaggtcaacgtgctcggatatatgactcagaagtacttaggtctaatacacatgatttatatactgaatcaaccatagaatgggagagtgtaacgttaccgaataagggttatttttcggtaattgctaaggaaaaatttgcatttgtacctgaaggtgaaataattatgacccatggtggaatgcatgtggaagaagtaattgtgcctttcgtaaaagttttaaaaagggatgatcgatag

SEQ ID NO: 1664 - DNA, 1866 bp, Caloramator australicus
atgaatattaatgatattctgttgagaaaaattccattaaacttatatgaacatattttaatttttgattttgacaatttaatttcaaacgaacttataatagaaaaaatactaaaggaaggttatgagatttttgaatttaaagacatcgaatattatagaatttattttgaagcggaatgtaggaattcctccaagaagcttatattaatagtaaatgataatgtctatattccatatgatattaaagaggattattttttggttgatataagtttaaatgatatatttaaaaatattgatgttagggttttaaaatatattgcaagagaaaattatggtattatttatgaaaaagcaaaaaatattaaaagaatattatcttatgaggaaacttgtgactttttattaaaaaatgtttattatattgatatccaacttattaacacttttaatgacttaattaaaatcatattaaggttatattacaaaggaattgagctgcctagcattttagtagagcatttatatgagagattgaatttagattatgatttacttaatgaaatattaatggggaaagataaattctttaattttttacaaaatcagtgggaaatgtttgtgaatagttttattaatccgtctataaaaagcattgttgattttaatgatacagatataaaagtgtatattgataatttattctcggaaggatacttgcattctgttgatattcaaataaatgataatatacccgaatttgctaaaatagggattatactagatagaaattctgttttaaataacgaatatggaatgatgattaataaattaaagaagaaaactgatagcatcagtgattataaagattggatagaattagccaagatttttggggaaatagttagaataagttgcattttaaataaagaagaatataaatcgctaagtttaagtttaaacgataaatttaaaaactggctttatatgaattatggtaaactgccatatttgtcttattttaatggacctgtaatgattcatcaaattcaacattatataataaataccattaaaaaagaaaagaagaaaaaagtaattttaatagtatttgattgcatgtcacaatttaattggagtattattaagcattatcttaataagaaggggtatttgattgaagataaagcttgttttgcatggattccaactataacttctgtttcaagacaggcattgttttccggagaaattcctattaattttaaagagactctatttacgtcaaattacgatgaaaaacattttaaaaatttttttataaatcatggctataatgagaagaatattatgttttttagaaatgtaaaaacttttgaggaagaaggcttgcaaaatgcattggaaaagaatgtagatgtaattggcattgtagttgatttaatagatagatttgttcataatcaaatgtttgattataaggggctatataataatattgaattttatttgaatgaaggatatttagataagttttttactaatattttagaatatggatatgaaatatttattacttcagatcatgggaatatatcagcgataggacaaggtaacgttaaagagggtgttttgcttgaaacattatcaagtagaattgctgtttatgaaaacgatttaaaaaatatttatctaaatgataagaaaataatagaatggattggaacaggattacctaatgagtataattatattatatgtgacaataattattccttttataaggatggtgaatcaatattaagccatggaggtatatcttttgaagaggttatagttccatttgctagaataaaacactaa

SEQ ID NO: 1665 - DNA, 1968 bp, Pseudoalteromonas marina
atggcttggcaaagtgaactactcagtaaattagatttcaccgcaaaacagtgttttattatttcagatcctgaaaacctttgttttgaaccatttattgacgcacagtttgaagaatcaaaaatagagcttatagattatagcgaccctgtgtcgttaaggttggtatatgagaattggcttgaagagcaaaacagcaaggcattaatcattagatgtgctgaaattgatgaaaactatattccttttgatatctcgttaaacgcacaaagcgtaaattttcatatcaatgaaataataccagagctagagaacgaaacacttcgaagcctttctcctatttacttccagccaattaaggaagccatttcaaactatcgaccaggcaagctgggaagaattgctagtttagattttttgttaaggcatatctataagattgcccctgagataatacaatctgaagtagatttagttcgattactcatccaaaagcattaccttagtggtgatatgccagaagtaattgagcaaaggttaattgctttattagagctaaatagtgctttcaacggttgggattttgataggttattgccaaataaggctgagttttttgagtttctgcaagctcaatgggggctatatcttcaaacactagtacctgtgcaagaaattaaagagccttcatggcctcaaggtaaactaattgtgccgtttgaagatcaggatattcaagtttatgttgataatttattcagtgatggtttgctaaaacctatagatttaaaaggagtaccacaagaacactgggcctctataggtgttgctagtgatgaaggtttctctgaattaaagcgtttttctcatttgctctctcgtttaaataaagtgttttcaaatgtagaggttaatgagcaaaacgcggacttttggggagagcatgcatttgagcttggtatgctgaatgcgttaagccacaaaatagaaaagttactcccttcagatcttacatcattaaagcgcctaaacgataaagtagataatacgtttgagcagtggttactagataagtttggtagtttgatttcgttaccctcgattcgccaccctaatatgttgcataaaatccctgactggttaaatcgtaaggtacaggatgaacaaaaagtttgcttgctcgttatggatggaatgggctttcagcagtgggcattgtttagagagtctttgaactcatgttcaagagtgacaatggaagaacattatagttttgcttgggtccccactattacctcaatttctcgacagtcgatgttttcgggtaaaaaaccttatttttatgctgattcgcttttaacaacatcaaaagaaggtaagctgtggcaagcatattgggaagaccatggtttaactagcaaagaagtgttgtatgcaaaaaaagttgaagatagagctactaatgaatcgtttaatgacttgatatctgatcgccatattatggctgctggcttagtcatcaatttcgttgatgagcaaatgcatggtatgaaaaacggaatgtctggtttaaatgctgtagtgtcaaattggattaaaacttggaggtttgcagaaaaaattaacattttactagatgcaggttatgaagtgattgttactgctgatcacggtaatcaagaggctataggctgtggtgcattacgggaaggtgtaaaggctgaaaccaaaggtgagcgagttagaatctatgattcagaaaatgcagctactagttctaatgaccttttagacgggaaagtgctaaaatggcccggcaagaaatatggcttacctgaaggacgatttccattagtaagtaaaggaactcatgcgtttgtaaaagaagggaacaaaattgttgggcatggtggtatcagcttacacgaagtagttgtaccgttagccgttataaaaagaaagttgtaa

SEQ ID NO: 1666 - DNA, 1977 bp, Desulfotomaculum nigrificans
gtgacccctttgagtacatggcgtgatgtggtgctgctggactttcaagaaccagtgccggccctttccctggcagcagatccggatcatttactgctggatgaagttcttttgtcttccttaaaggatagacaggtggaattcatccagtacaatgacccggtgtcctttcgttacctttttgaatccaggtatcgccaggccatagcagagaaaaatataaaactactggtgcaggtaagggatgttcccttggagcaattgccttatgatctgctgcaaatggggcgccagttaacctatcgactgcaaacgattttccctaaattgtcaccccaggtagtaaaacaacttacggcccaagatttagatgccttgtatgctgtctatggacagtatcaaggctctacttctactgccgaaacctgtgctttcatcctgcaccgggtttataaagtggcctatgaattgattgatgatgagacagagctgattaaattcctgctttccaaacattatcgccaaatacagtacccggagatcattgaatcttaccttattgaacagttacagaaacaaaagaatttgaccaagctaccgctggcagagatggttaaatccgccacctttttttatcaaaccttacaaagccagtgggttgcgtatctcaaaaccctgcaagaacagcctgctggatggaaggaaaatggccagcccaggggcttttacagccaggaaaaggtgcatccctttgaccatgaggatgtctatcgtctactggataacctgtttattgaaggatacctaaaaccggtggcgggatttaacagccaaaagttacctggttggacccacgtgggactggtgattgatcctgccagtgatgataaacatcggctgtcaagtttagtggccaacctcaaggaaaaattaccaggcatcggcaattaccgggattggttacaggtgatgccgctatatgcggaagtaaaggatttaatcttgtccattggttttaaccagaaggatgctatcctgatggaagcacaggccgtggagtcagagatggatgcaatatttgagacctggctcatgaggaactacagtagtttgcaaaacctgccctatttgcctaagccggtgatgctgcaccaggtgccccattatttagcctccaggcatcatcaaagggtggcactggtggttttggatggcatgagttatgtccagtgggtgcaaatacgtaagtatttgcaaggccaaaactttgcttttaccgaacagggtgtgttcgcctgggtgcccaccatcacgtcaatttccaggcaggccctgtttaccggcgaaatgccgttgtattttccccatacacttggcaccaccaggaaagaagaagcagcctggaaacttttttgggaaaaccatgacgtgtttaaaaactataccggctaccataaaagctttggccagggggagggggggtatcaatcccacgccatcttgcagcaaccttccatcaaggtgattggattagtgattggtaccattgataatctggtacataccgctctccaggggcagcgaggcatgtacggtgagctaaagctttggctggagagtggctatttaacaggccttttgaacgagttattggacaagggctttgcggtgtacctcacttccgatcatggcaacaaagaaagccggggcattggccgtattgccgaaggcgtgttagccgaaacccggggtgaacgggtaaggatttatcgggataaaatgctacgtgataaggcggctgccagtcactcagccattccttggccgggaacaggtctgccggaggatgtctatgtcctgctggctaaaagtggggaagcttttctaccagcaggtgaggtggtagtcagccacggcggtattagtctggaagaagttgtcgttcccttcattcatgtaacaagacagaataaatga

SEQ ID NO: 1667 - DNA, 1995 bp, Dethiosulfovibrio peptidovorans
gtgagtagctggcgaagcaccatccttgaaaattttgtaccgaatgtcgccaaactgacgctggtatctgatcctgattgcctgctgaccgaggaaaaactggcaatggggctgcgagaccgtgggtttgatctcatcgagtttaatgaccccatggagttcagatatgcctatgagtcgaaatatcgatccatttgggactggggcgaatataccgatttggttgtggtccttcgcttgcagaatgctgagctggaatcgctgccttacgacctgctccaggctggccgcaaactgtcgttcaacctgggtgacctcttccccaatctgagctatccggtcattgagaaactcgaccggggcttgctggacttgctttatgaagcccagcgcaagtcgccaccggatcgcatgggcgacaacaccaccaaggattttatccttcgacatgtatttggtgtggcaccagaactcatatcaacagaggttgagcttctccgctttttgttgcggttacactacgggaatttggcaataccatcgatgctggcagataggttggttgatgtatttgaaagcagtggaagttttaaaggctggagtctgtctcagatcattccagatgcagagcagttctttgtattcatacaggaacgctggccaatattccttgaaaacctgaatcaagcaaatcaggtcaaagaagattctgaagcctacggcttaaagttccaagggcctgtgatacttcctttcgaccatcaggatattagggtttatatcgataatttatttgttgagggtaaacttacaccggtcgacttgcccggcatggatatagcgaaagattcgtgggttttaagcggtatttcagcagccaaatcagatggcgagggtctcaggctttcccgactgtttgagattgttgatgcagcagatttatcgatggattcgagatacactgactggattgcgttcgccatgaaatgggcggagatctcggcgcttatacatacgacaagcaatgcccgttataagaagcgttatagtgaaacaggtcaaaagctgaacgggctctttgccgactggctggaagctcattatgccagcctgacaaacctgccaccttcaactccggcaatgttgcaccatgtgccgcgacacctggctcgatccattgaagatcaaacgagtaaaaaggtcgtattggtggtaatagatggcctttcgctggatcagtgggtaacggttcgaaacataatccagaagcaaaacagtgatctggtcctgcgcgagtcggcaacgttcgcgtggataccaacgcttacgtccgtttcacgacaagccatattttcaggtaagccgccgatctattttccatcttccattaactcaacaaacagcgaagagaagctgtggaaacagttttggcaaggccatgacgtttcgaagctggatatcgtttataaacgcagtctcggagatggtgatgccgaggccacaatggatagtttgattaatccggcacaaaccaaggttgtcggtttggtgatagataaagtggataaaatcatgcatgggatgcagctcggagccgcaggcatgcataaccagatagatcaatggtgtcgaggtgaatacctaatttctctccttaattacctgagcaaccataactatgaagtctggataacctcagaccatggcaacgtagaatcgatcggcaagggaagaccaacagaaggttctattgcggagagtcgtggagaaagggttcgcatatatccgacaccggagctgcgctcacaggtctcttctaggtttccctttgcgcgtgaatggccgccgtcggggctgcctgacgattatttcccattagttgctaccggaaatgatgcatttgttaatgagggtgactcaattgtcggccatggaggtgttgctatcgaagaagttattgtgcctctgatcaaagtagaaaggaggacacaatag

SEQ ID NO: 1668 - DNA, 2016 bp, Kingella denitrificans
atgagccagtggtcagaacgcattctcagccacttcacggccgatctcacccggctgtgggtggcgtgcgaccccgacgatgtgctgctggacgaaaagctgttgtccgaactgcgcggtcgcggcttcgaggtcatgctgtacgaagacccgttcgccttccgtgctgaatacgaggaacgctatcgcgcagcctgggattgcggtgagccggggccagcgccttcgctggttctgcatctgcgcagcgccgacgcgaatgcgctgccttgggacatcgtgcaccacggacgtgtggttcgattgagccttgcggagctcttccccagactggcatacagcgcggtacagcaagtcgagccggagcattttgccgggctgtttcatgcccaccagaccgaattgcagtcagcgcgcagcgagaacgagtccaaggacttcattctcgaacacgtctaccaactgacgccgagatccattcgcaactcggttgacttctggcgcgagctgctgcggatgcactttgccaatcgctcgttgccacccctgtttgctcaacacgcggcaggcatcattcaaggcaaggggctgttcgtcgaccaacccgtcgccacatggctggcatccaagagtgcgctgctgcgcgtcgtgcaggacgcgtggtatcgctacctgaaaaacctggggctggatggcacccgaactggcgaacctccgccaccggactacgtcgcaaagatcgagattccgttcgatcactccgatgtgcaggtgctggtcgactccatgttcctcgacggcagcttgagtccgctcgcggcgcacagtgttccggcggggatgccgagttggatcaaggccggcatcgtccaggaccccgctgcattgcaggctttggtgctcaaaggcatcgatggcctgatcgagacgaccccaacagccgcctcctcgcacaaggactggaacgagttcgccaagcgctacggcgagatcctggctcgcacgcatagcctgcccggcacggaaggcagcgaacacctacccgtgattcgggaacggatcaagaccttgcaggcgcaatcggacgagcatctgcaagcctgggtcgcagccaagcattacgccgacctgatcctgcaaccagtgaccaaaggcccggtgatggtgcaccacgtgccacgcttcttgcgccatcggcggtccgcaggggaaaccaaggtcgcattgctggtattcgacgggttggccttcgaccagtgggtgcagatccgggagcgcctgattgccaccaccaagcgcttcgcgttcgatgagggaaccgcattcgcatggctgccgaccgtgacatcggtatcgcgccaggcgctgttttctggattgaaaccgcgtgagttcgacgactccatcgaccggacagacaaggaggaatccttgtggaagacgttctggcagaacgaaggcgtcaacgcgaatgaggtgatgtatcgacgtgcgctacgtcagacccatcagctagacgcacttgaagtggatttgaatgaccgtcgaccgaaggtggtgggcctggtcatcgatgaggtggacgatcggctccacaaggagcggtccaagaaggacgtggcgatgtggatcgggaactggttgacgactggtttcgtcgaccggcttttctcgctgctgctggacaagggataccacatctatctcacggcggaccacggcaacgtagagtccaccggcgtcggcagacccaaccaaggtgtgattgccgagacgcgcggcgagcgcgttcgggtctaccggagtgagccactgctggccgattctgctgcggcctatcccaccacagtcaggttggacatcgctggactgcccgcgaacttcatgcccctattcgcaggcggacgaaccgcctttgtgccggagggtgagcaggtggtggtccacggcggggtgtcggtcgaagagttgatcgtgccctttgtgaaagtcagttatgtgattggtaccgaatga

SEQ ID NO: 1669 - DNA, 2001 bp, Alcanivorax hongdengensis
gtgacgaataccgcttgggtaaaccgtatcgttgaagatctcccatccgatgtatctcgcctgtggattgtctcggacccggatggcgtcctgctcgatgaacatgttctggcgagtttgcgtgaacgtggttttgagacgctgctgttcgaggatagtgtagcgttccgagcagaatacgaagaacgctatcgcgcggcctgggatcagggagaagctgccccctcggatgcactcattttgcatctacgggaacaccagacgagcgaactgccatgggactacttgcgtcatgggcgcagcttgaacctgagtctatccacgctgctgccaaaactcagttattcagtcttgcggcaactggacaacgagatgctgcccgccctgttcgaggcacagtcccagcatgcacagcaggttctgggggaagcggccaccaaagaatttgtgctgacacatatctttgaacttggccctcatctgataaaaaagccggagcaattttggcgggaactgctgcgcttgcattaccgcgagtcgacactgccattggtgctggctcagtatgtagagcaagtgctaggcagccagacgacattcaaagacatccctctcgccgaactgttctcgaatagaagccatacactgcgagtggtgcaggaagcctggtatgacttcctggaaatgcatggtcttactggcaaccgtatcagggaaccctcaccaccagaatctagcaacaagctgaacattccctttgatcaccctgatgtctggctgatcgttgactccatgttcctggatggcactctgcacccactggaagtctcggggacatctgcagcgttgcctgagtgggccaaggtggggatagtccagaccccgctggacatgcgtaccctggtgtcgagcggcatcaagacattgcaggacgagataccaagcaccgattcaagttatcgcgactgggcacactttgcccgccgtcttggcgaaattatttcgcgcttcaacggcctggatgccagccgtgccgaaggtttaagaaatgatctactaacattgcagatgttggctgactctcagctccaggcatggttggtgaagcactactctgacctgccatcgctcccggccgtgaagggtccgatcatgttgcatcatgtccctcgttttctatcgatacggcgagatcatggtgaacagaaaatcgcgctgcttctgttcgacggactggccatcgaccagtgggttcagatccgggaaagcatcaccaaatccatgtctcaattgatattcgatgagcaagcttgttttgcctggctgccaacgctgacatcagtttctcggcaagccctgttttcaggtctgcgcccacgtgagtttgccgacagcatcgaaacgacatccaaagaaccaggactgtgggatcgcttctggcgagaccatgggctgacatccagagaggttttctatcgtaaggccatcaagcgaaatgacgacttgactggcctggaagctgatttgtctaaccccgctgtcaaggtggcaggcattgtcgtcgacactgtagacgagatgattcacggtgcggtgcttggcaaatccggcgtggcagcgcaaataacaaaatggtgtgaatccggctttgttgaaaaactgttccagatgttgctcagcaatggcttcagtatttacctgacggcggatcacggtaatgtagaggcggtaggcataggccgaccgaatcagggccttgctcctgagcttaggggcgagcgggtgcgaacttatcgtagcgaagcactgcttgccgaagccttggcgacgaaccctgatgccttcaacttgagcattggcggcttgccaacggactttatgccgctttttgctggaggccgtggagccttcgtaccgaaagatgaccaaatagtagtgcacggtggaccttccgttgaggaactcatcgtgccgtttgtaaaagtgagccgtgtagtttga

SEQ ID NO: 1670 - DNA, 1899 bp, Bacillus cereus
ttgaattgggctgataaattagcagcatattttacaagcaaaggtgctctatatatcgtttcagatgaatatggcttattccaccaccaagctgttcagcatgtaatatctcaaaatggtgccatgattcatacttatcaagatcctgttgtatttcgtcttcaatacgaaaccgcttttcgtcatgaaaaacgtgaaaatcgaccaacttggattgtaacaatcgagacaaacgaattcaatcaattgccttttgacatactatctgatgccaatcgactgtctgtatcatgggaaaatatcttttcttctctcgatcctactgtcatccagtattgtccagaagaaacattacagttattattagatgcttctattactcaattcaagccattaaactataacgaatccattgattttatattaacggctgtttatcaattagatgctgctctattcagtcatgagattaacattgtaaaagcagctatacgttattatgatcaatttagcgaaggtcttccttctctatttttccatcgattaaaacaaaacttgcagaaagtagatccgtttacttcaacggatctactttctatttttgaatcaaaaggtacgttaacccatttattaaataaacaatggcaacattatattcataactttttaaagcaatgtcatgaacaaattgcagaaacatcacctaattatggattctcttattttgatgatccaatgattcgacgaagacttgctcattttattacaccaattaaagtacctaatcatgtgcaatttgatgaatggatggaaccaggactagtcagagaagtctcaccttcgattgatgtagaagttttatttaaccaagactttacaaaactttcaagacaagaatggagcaatttagctagcaaaattgggcgaatgcaatacaattatttaaacaatggagcattaccaactaattggggcatacagatgcagaaaatcaaccatcattttgaaaactggatggtacatgaatatacaaatctacgtacattgcctgttgtaccaaaaccaaaaatggttcatcaaattccacattatcttgcacgaaaaatagatagtaaagtggctttaattgttatggatggaatgaatttcactcaatggtatataatcaaacagcatttagctaacaatgcttggtcctttgaagaggatgctgtatttgcttgggtaccaagcgtgacttctgtttcaagacaagctattttctctggattagagcctagacaatttgctgataccattcaatcaacaagaaaagaaaagacctattggtttaacttttgggaacaagtaggatttacaaaacaaaatattgcctatgaaaaatcacttggattaaaagtatataaccagtctacccttgcttatatgcagtttccttctgttcgtatttatggtgctgttgtagatgtcatcgatcaatttatgcatggtgctacacaaggccatcaaacgatgttttctgagctctcaacatggctatctacaaactatctagaacaactgttaacagacttagtccaacaaggatttgatgtgtatttaacagctgatcatggaaatgtagaatgttacggtataggacgaattcaggaaggtgtaacagtggattctaaaggcgaacgggctcgcatttatcaatcggaaaatattcgaaaccaaacacatctcgaccattcattgacaacaattccttgggatcatccaggacttccggatggttataatgtgctattagctaaaaataatcacgcttttgtagcaaaagatgataaaattgttactcacggaggcattcatcttgaagaagtgattgtcccctttgtgaaagtgaaccgctag

SEQ ID NO: 1671 - DNA, 1995 bp, Nitrosococcus oceani; identical to SEQ ID NO: 1320

SEQ ID NO: 1672 - DNA, 2016 bp, Methyloversatilis universalis
atgagccagtggtcagaacgcattctcagccacttcacggccgatctcacccggctgtgggtggcgtgcgaccccgacgatgtgctgctggacgaaaagctgttgtccgaactgcgcagccggggcttcgaggtcatgctgtacgaagacccgttcgcctttcgggcggaatacgaggaacgctatcgtgcagcctgggatcgcggtgaggcggggccagcgccgtcactggttctgcatcttcgcagcgccgacgcgaatgcgttgccgtgggacatcgtgcatcacgggcgtgtggtgcgcctcagccttgccgatctgttccccaagctggcttacagcgcagtgcagcaagtcgagccggagcatcttgccgggctgtttcatgcccaccagacggaattgcagaatgcacggggcgagaacgagtccaaggacttcatcctcgaacacgtctaccaactggcgccgaggtcgattcgcaacccggtggacttctggcgtgagctgctgcggcttcactttgccaaccgctcgttgccgcccctgtttgcccaacacgcggcaggcatcattcatggcaaggggctgttcaccgaccaacccgtcgccacatggctagcgtccaagagcgcgctgctgcgcgtggtgcaggatgcgtggtatcgctacctgaagacacttggactggatggcacgcgcacgggcgaaccgccaccgccagactacgccgccaagatcgagatcccgttcgatcactccgatgtgcaggtgttggtcgactccatgttcctcgacggcagcttgcatccgctggcggtgcacagcgtcccggcggggatgccgagctggatcaaggccgggatcgtccaggacccggcagcattgcaggctttggtactcaaaggcatcgatggcctgatcgagacgacgccaacggccgcctcctcgcacaaggattggagtgagtttgccaaacgctacggcgagatcctggcccgcacgcatggtctgccagacacggaaggcagcgaacacctgccggtgattcgagagcggatcaagaccttgcaggcgcaatcagacgagggtctgcgagtctgggtcgcagctaagcattacgccgacctgatcctgcagccggtgaccaagggcccggtgatggtgcaccacgtgccgcgcttcttgcgccatcggcggtccgcaggggaaaccaaggtggctctactggtattcgacgggctggccttcgaccagtgggtacagatccgcgagcgcttgatcgccaccacgaaacgtttcgcgttcgacgagggaaccgcgtttgcatggttgccgactgtgacatcggtgtcgcgccaggcgctgttctccggcctgaaaccgcgcgagttcgacgactccatcgacaggacggacaaggaggaatccttgtggaagacgttctggcagaacgaaggcgtcaactcgaatgaggtgatgtaccgacgcgcgctgcgccagattgatcaactggatgtgcttgaggcggacttgaacgaccggcgcccgaaggtggtgggcctggtcatcgatgaggtggatgaccggctccacaaggagcgatcgaagaaagacgtggcgatgtggatcggtaactggctgtcaaccggtttcgtcgatcggctgttctcgctgctgctggataagggataccacatctatctcacggcggaccacggcaatgtggagtccactggcgttggcaggcccagccagggcgtgattgccgagacccgcggtgagcgcgttcggatctaccggagtgagccattgctggccgattccgctgcggcctatccctccacagtcagattggacatcgctggactgcccgcgaacttcatgcccctattcgcaggcggacgaaccgcctttgtgccggagggcgagcaggtggtggtccacggcggggtgtcgatcgaagagttgatcgtgccctttgtgaaagtcagttatgtgattggtaccgaatga

SEQ ID NO: 1673 - DNA, 1533 bp, Thermoplasmatales archaeon
atgataaacatggaaaaaaagtggtttgaaaaaataataaattcaatacttgaactaaaaacaaatattgtgtttgttattgatccagataatattctttcaataccagaaataagagatatattgcaagaacacaacaaaaatataacagagtttaaaaacgaaataaatcttagaatattattgaaacaaatagaaaaaaacacaattgttacctttaaaaataaacaagaaataccatatgatttactttctacacaagcaacaataaacatagatataggtgaaatattttctcttttagataaaaccgagttactgcaacttccttttgaaaattatcaaatacttttcgaaaaacatgaaacgctcaaagaagaaaattatgatagacttagcaaagaaaaaacacaaaaatttataaaagaaataccagcaaaatatatttctacagatacaaaaagaattttagaactaaaaacagatctaacaaaaatatcaaaagattttatatctgatagtaacacctggggtgaaataggcagaaaatttggagaattaatgtatcatctacataaaaatgaaattgaaattaataaggaaattcttgaagcagaatccatattaaactacaaatttatggcatatatactaaaatattatgaggatttattatatcactcaaatccacttataaactcaaatttactaaaaattatttttgaagatagtcaacaaaaaaatgcaataatatgttttgattgtatgggttatgaagaatggtatgcaatcaaaaattatttagaacaattacaatcatttcaatttatagaaaaacattctttttcaatgttgccaagtgaaaccaattattcaagtagtgctttatttgctggaatgacaccaaaggaaatcaaaaaccaatcatttatcaactcaattaattggaggaacgaagaaaaacttttcagaaatgccttaaaaaagaaagatatagacgactcgcaaatattctttcaaagatgcattgaaccaaaagatattaacataccagacattgaatcatttagtgactatcactcaattggaataatcttttcatttatagatagatttatacatacagattttctaaatgataaaaaccttgtaatacaaaatatagaaaaatatctacaaaaaacaaaaatatcaaattttatcctatcattattaaaccaagatttcaaagtattcataacatcagatcatggaaatattctgtcctcaggaaataatatacaagtaaaaagagatttagtagattcaaaagctaaaagatatcttatccaagaacgtagagaattacttgaagaatataaagttgaaaaagaatcagtgataatgcagttgaaaaacatgaacggagacgaatatctactactgcaaacaggaaacaaaatgtttggaagaaaaaacgaaaaagaactaactcatggaggaatttctcttagtgaggtaatcataccctttatcgaggtgaaaaaagcatga

SEQ ID NO: 1674 - DNA, 2001 bp, Pseudomonas sp.
ttgaacccatggattgagtcgattctcaaagagtttcctgcagatatggtgcgcctttgggttgctgctgacccggatgatgtcctgctcgatgagcaggtgctggctgaattgcgtgagcgtggtttcgatctgctgccgttcgaggactcggtggtcttccgtgccgagttcgaagcgcgttaccgtgaggattgggatcgcggcgggcgaggcccggccaaagcgttgatcttgcatctggcgcgcgctgacagcagtgagctgccatgggattacctgaatcaggcgagagttgtacgcttgagcctggcggagctgtttccacagcttagctacagtgtagtgcgtcagttggctcccgagcatcgccagaacttgtttgctgcccaggacaagtttgccaaacagatgcatggggagcgcttgaccaaggagtttctgcttacccatatctacaagataaatccacatttgctgtcaaaagctgaggatctgtggggcaatctgctgcgtttgcactatgacgagaccgaactaccgcaggatctcgttcggcatatggtgcacattttggctgaagagcaggcgtttcggcatttgccactcgcggaactgttcagttcgcgcagttattttctacgggtattgcaggaagcttggtattgctacctgcatggtctgggggtaattcgccagggtgtggctgagccgcacgtgcaatatgagcgaattatcgatgttccttttgaccgcccacagatacgggcagtgatcgactcgctgtttttggatggcgcactgcatccattggagatcagtggtggcgctagcggaatcccagcgtgggcccgagttggggtggtggaagatccttttgccatgcgtaacctgattgttgagggcatgaaaagcctggaaacaaccctgccggcgctggatgcgagctacagagattggagccagtttgcgcggcgcttcggcgagctactggctcgtttccatcgactggaaattgagcgggccaatggcatacacaatcagatcgtggcgctgcagcagctgatcgacgagaggttactggcttgggtaaaacagcactacgctgacttgccgtctttgcctgcggtgaaaggaccggtgatggttcaccatgttccacattacctggccaggtgccgcaataatggcgaagtacgtgtggcgttgttggtatttgatggtttgtctgtcgatcagtgggtgcatattcgtgagcacctaaccaagtacgcgcccgcattgagctatgacgagagcaccacctttgcctggcttccgacgctgacatcagtgtcgcgtcaggcgctgttctccggattgcgccctcgtgaatttgaagggtcgattgaacatactagtaaagagccggtgctctggtctgctttctggcaaggggaaaacctgcgcgccaacgaggtgatgtatcacaagagcatcaagcgtgtggacgacttaccggggctggctgacaaactttcaaactctgcaatcaaggtggcagggttggtgatcgataccgtggatgagatcgtgcatggtgcagtgctgggcaagcgcggtatcgccagtctgatcaccagttggtgtgagactggctttgttgagcagttgttcgagctgttgttgagccatggctaccatgtctacctgacagcggatcacggtaacgtcgaagcggtgggtgccggtcgcatcaatgaaggtgcgttgcctgacctgcggggtgagcgggcgcgtgcttatcgtaatgaaattcttcgtgaccaggcattagtcacctgcccgactgcagttgaacttaaaataccaggcttgccagaaagcttcctacctgtgtttgctgctgaacgcacagcgtttgtcactcagggggagcaactggtagttcacggcggcatttcggtggaagagctgatcgtgccctttgtaaaaatatctcgcacaagttgggctccatga

SEQ ID NO: 1675 - DNA, 1935 bp, Bacillus cereus
atggggaattggcgtgatggagtactgaaaaaatttcaataccaaaacagcaaaatgatattagtacatgatcaagattttcttttaaatgatgaattacttttaaatcgtttaaaagaagatggttatgaggttattcgttttgaagatagtgtttcttttcggtatttgtatgagcagcaatatcgtgagtcagtaaagtctgataaattattggtatacacgaatgatgatattacgtttccatacgagtatataaagagaaactttagtatgaagattgatattagtacaatttttccaaagttttctgcgccaatacttcgaagtatgaaccgtgaagatttagatgccttgtttactgtgcatgcacagtatcaaggctcttcttctaataaaaatactttggagtatatcgtaaaacatttatataaaatatcgtatgaaattattgatagtgaagtggaattgtacaagctccttctttttcttcattatagaaaaaaagaaatacctcaggttgtacaagattttcttatagaaaagttgaagcagtgtagagtgtttcataagttaccgatagaaaaattgatttcttcagctggctctttttatgcttttttagaggatcaatgggcctattttgtatctgaatatacaaagtgtgagagtgagaaaatcttggaaccttcgtcgttatatggaacacatccatttacaaatgatgatgtatggagactaatggttaacttatttatggaagggaccatttcaaaagtaaagaaaggaccaactttacagattccaaagtggatgaagataggaattgaggaagaatctaaattggagactcttcacgaaaagctaaatcacattagtgaaatggtgaatgagaaacttgcaaggattaagttgtataaagactggatcgagttaattgatctggttgctgaatataagtacactgcattggaaagtaatgatgcagtatatgtgggagaggcaaatgcattaatgatgaaagtaaaccagaattttcaggactggatgttaaagcagtatcatactttaataagcttgcctccgattccaaagccaaagatggttcatcatgtaccgcatgtattacatgcacaaagaagagaaaacgaaaaggtagctctgctagtgttggatggtatgagttttattcagtggaaacaagtgaaaaaacatttgaaagaaaatggtttttcttttgaggaaagtggtatatttgcatgggtaccaacacttacttctgtatctcgtcaagctattttttcagggagcattccatttacatttagcaaaacaataaaaacaaccgcagcggaagagcgatattggaaagctttctgggaaaaacaaggtatgttaaagcaatatgtagcatatcaaaaaggattaggtaaagaagattacagtagggagaatattcttgcgttaaaaagaaattctgtgaaaatatatggagcagtaattgatgtaattgataagttcacacatcatgcagttttaggtgaaaaaagcttagtttctaatttagaaatatggctacagtccaattatctcgtaaacttattagctgatttaataaaagagaagtatactatttacctcactgctgaccacggtaacacgatagctaaaggaatgggacggatttcagaaggtgttttagtggatcaaaaaggagaaagagtacgaatatatagtgacccaatactttataaagattcggcatctaagattggtgcaatgagttggaataatgctggtcttcctgaaaattacaaggttcttttatctcaatatggtcaagcgtttgttcaaagaggtgaagaaattgtgacacatggcggaattagtatagaagaagtagttgtaccttttataaaagtacaacaaaattaa

SEQ ID NO: 1676 - DNA, 1443 bp, Treponema primitia
atgttttttacaagattaaaagaaatatttgataaactatatgttccccatgttattttttatgattgttatgatttttctaaatattgtgattatcttgttattttagaatcattgggatataatatagttgaatataaaaatgttgaaatgttcagaatcgaatacgaaaatattattaagaattcagaaaataaatatgccataataatcaataataatatttatgttccttatgacattataaaaaattgtgaaataattacattatcgctaaaattgatattcccttacttgaacaacgcatatttagagaaatacaagcatgacttagatttaatcagctttgcttataaagaatgttattctgatttatcagacgaaaaagaaaccgagaaatttataactaatatagtattttctgatgaaatgatatatcaatatatcattgaaattttaataaaaaaattatatgaaatatgtcaaaatgccccatcatattttgaatggttaaaagcaggacagataaaagcaaaaattgattattatggttcaaaaataaatacaataatcgatacagattttttattggatcctttttataactatataatgactggttatggaaaactgtcattggaatcaaataatgcattcccggtaatattatctaaagttctaccattcatcgctaaaaataaatttgctcttatcgtaatggacggtatgtctttgtttgattttgaaatattatcaagatattttgtagaaattcaatacgaatattttaattcttttgcattaattccgaccatgacttctatttctcgtcaatgcttgctatctggtaaatatcccataaaattatcagaaccttttaatttaagtaaagaagaaaaagaattcattcaagcaatgagtgaattaggatataagcaaaataccatccagtattcaagaggctataacccagaggttagtcctttgaccaaggccttatgcattataattaatgatatagatgatattgtacacggacaacaacaaggccgtcaagggatgttaagggagattgatttacttggaaagaaaggaaaattacaatccttgataaaagaactatttgaaaatggattttcggtatatattacttccgatcacgggaacacgccatgcactggtattggcgccatgcgcggcttgggtatagaagtagaaacaaaatcaaaacgtatgcttgttctaaaagattttgccaaacttaataaaacagtacaagaaaatactatagaatatcctggttattatcttgataaaaaatataaatacttaatttgtaaagatggtatttcatttgacaatatagatgacgaagtaatgacacatggcggtatctctatagatgaggtaatagttccttttattaagataaggtcggtataa

SEQ ID NO: 1677 - DNA, 1953 bp, Bacillus methanolicus
atgaaaacttggcgtgatgaaattgtccaaaagtttgtcaatcagccttattcgttattgttagtcaatgatccggattttttattgaatgatgaagaaattcttcaacgattaagagagaatgaatatgaggtcattcattttaatgatagcatctttattcgttacctgtatgagtctcaatttagagagaaagtcgagcaaaatcaattaaaattgcttttctttagtaatgatgaaaattacacttattttccatatgattttttgcaacatggataccatattgaattaaagattagcgagttatttccaaagttttcaccaggaattgttaaacagctagacaaagaagatttcgatgtcttgtatactgcacataaacagtatcagggttcttcttctgataaggaaacgttggaatacatcgttaaacatgtttataaaattgttcatgagctaattgatagcgaagttgagttatataaattacttctttcggttcattatgctaagaaacaattaccgtcgattgtacagcagtttttaatcgaaaagttatcaggcaaaaacgtatttgaaggaatacctataaaacgtttgcttacatcttctagttatttttttcaatatatagagaagcaatggactacatttgttcatcaattactggatttacaagagggaagtgtattagaagaaactcctttgtatttagctcatccattttctaatccagatgttagaaggctgatgaacgatttatttgcagaaggttatattagaaaaatcaaaacgaacgtatcatattcttttccaacttggatgaaatacggtgtagaagtggatgaggatggttcattgcaggaaaaaattcgtcatcttcatgaaaaaatcatggagcaaatcacttctgcatctcgctataaagattggattaacataatggaactgatggctgaatacaagtgtacagttttagatacaaacaaacaagaatatgagagggaagtaagcgctctttttcgtaaagtaaacgaaatgtttgaaaaatggatgatggaaggctaccgttcattaacaagcttgccaccggttcctaaaccgaaaatggttcatcatattgtacaatttcttgcatcgaagcggggacaaaatgaaaaaatcgctttgctagtattggacgggatgagctatgttcaatggaaaaaaatcaagtattatttaaccaataaaggcttctcctttgaagaaaacggtgtgttttcttgggttccgacattaacatcggtttctcgtcaagccattttcgctggtaattttccatctgcattttcacaaagtattggcacaaccgcaaaagaagagaactattggaaaacattttgggaaaatagcggactattaaaacaatatgtttcatatcaaaagggattaggaaaagaagcttataaaaaggaaggaattgcagcctttaaacgtccgaacgttaaagtatatggcgctgttattgacataatcgaccaatttatccatggagccgtacaaggtgaaaaaagtttaatgtctgagttgcaattatggttaaatacagactatttaatgcaattattaactgatttgcaccgcgaaaaattcaccatttacattacatctgaccatgggaatacggaaagtgtaggtattggtagaatttctgaaggagtattagtagaacaaaaaggagaacgagtgcgagtttacacagataccattttgtttaaagacgcagccgaaaaaatagatggtattccttggactggtgtagggttaccggaagactatcatgctttattagctcaatatggacaagcatttgtcaataaaaatgagcgaattgttagccatggtagtattagtattgaggaagtcatcgttccttttgtgaaagtgattccgtctttaggaggataa

SEQ ID NO: 1678 - DNA, 1980 bp, Vibrio scophthalmi
atgaactggcaagagaagcttactagtcagatggctttgacagagcctgttcactatattgttaacgaccctgataatttatgttttgaacccgcaatagctgatctaatcgaacaggcaggagctgtacttttcgcggatgctgatcctctcgcactaaggttatgttttgaagaatggcttggtagtgatgagtgcagagctctattaattagggttgtcgatgaacagcctagtattccttatgatattgaattttcagctaagcgtgttgattttgatattagtgaagtgataccagagttggatgcatcagtactgagagctttattacctaaagattatgagcagctgcagtctgcagtgaagagctatggtgcggataagctaaaccgaaatgctagtttggattttgtcttacgacatatctacaaaattgctccggagatcgttcaatctgagacagatttagttcgtttgctcattcgaaagcattaccttggtatcgagatgccgttggtttttgaagagaggttaattgaaactctccaagttcgtgagcagtttagtcgttgggatttctcaagggttgtgcctgatagaacagagttcttcgcgtttcttcaacagcagtggttgcttcacttgcagcgaaaagcccagaggcatgagattaaggaatcatcatggcctgacgatgagcttgttgttccatttgacgaccaagatattaaagtatttgttgataatttatttgctgacgggattctccaagctgtagattttgacggcttaggaaaagatgattgggaatgggttggagttatcgcggatgatgagtctagggatttattgcgagtaaggcagctatttaataagctttcggatcaattcatcgtgcaggacttgccgctacctgaagattcagaaaagtgggaagagatcgcacgcgaacttggtgtactgaattcgttatcccactctttgaaaggttcagatatctatgctctgagcgctgagattgctaatttaaactctaaagtagatgaatactttgaaacgtggttgcaaacgaactttggcaagctgataaacacgccgacaacccgcttccctaagatgctgcataaaataccggattggttgaaccttaaagtctgcaaaggtcaaaaggtgtgtctactagtgatggatggtatggggtttcaacagtggaattacgttaaagagcacattattgatatacctcatgttcgagttgaggagagaggtgttttttcatgggttccaactattacctccatagcgaggcaggccttattctcaggcaaacagccacgttcatttcctgattcatggcatacgaccgcaaaagaaaaagcgctctggcatgcgttttgggaagataaaggtttaagcaagaccgaagtagcatatgaagttactcttgagaagcataaagatctagaatccttcaaagaccgctttcattcgcccaagctaaaggttgcaggtttcgttatcaattatatagataagcagatgcacggaattgagggtgggatgccattactaaatgttgcagtgagtaaatggctcgagctgtggcagttttcttcaaagatagaggctttactggattctggttttgaagtggtgattacggctgatcacggtaaccaagaagcaataggtcaaagttggccaaatgaaggtgttaaagcagagacaaaaggtgaaagagttaggctgtataaacatacagttgaatattcgaatgataaggcagacgtgctagaatggccagctaagaaatttggactaccatcggatttgtatccgcttgtgagtagaggtcgtcatgcgttcatccagaaaggcaaacagattgtcgggcatggcgggattagcttacatgaggtggttgtcccattagctattgttacgagagagcaacatgtcaaagagagtcaactttag

SEQ ID NO: 1679 - DNA, 2043 bp, Thiorhodovibrio sp.
atgcctagctggcgcgaccagatcctcaaggagttcgtgccgaacctgagcaagctgacgctggtcgccgatccggatgcgctgctgacggaagagcgactcgcggtggcgttgcgccaacgcggattcgagctgatcgagttcaccgatccggttgagtttcgctatgtctatgagtcgggttatcggtcggtctgggatcgtggcgagcaaacagacttggtggtgatcctgcgcgcggctgacgataatctggagtcgctgccgttcgatcttcttcaggccgggcgaacgctggcattcgacttaggatccattttcccgcagctgagctatccggtcatcgagacgctggatcgggggctgctcgatgctctgtttgctgcccaacagcagggaccttcagatcgcctgggtgacaatgcaacgcgggattttatcctccgacacgtctttggcgtcgctgcggagctggtgaccaccgacgcggatttgttgcgcgcattactgcgcttgcattattccaacctgtcatcttcggcatccccgcgcctgccatccgcgctggctgaacgcttgatcgcggtctttaaagcccaggccagattcagcgactggccgttggagcacctgttgcccgacgcggaggccttttttgctttcatgcaggaacgctggccggtctttgtcgctggtttggcgcagggtgatgaggtcgccgagccgaggttggtgcccgtcgccagtcaaggcggattccaataccccggccctgaccatctgcctttcgatcatcacgatatccgcgtctatatcgacaatctctttcttgaaggtcggctcacgcccatcctgaccaacaacatcgagctgccgtctgactcctgggtgcgcagcggtcttgttcgcgctgcggtcgatgacgaggcgatacgcatggcgcgactgtttgaccgcgtcgcgcaggaatgtccgcccgcggatgcccggcatagcgactggatcagcttcgccttgttgtgggctgagttgagcgccaaggttcacgccagcacccaaaccgagccgcgccggcaatggcagacaatagccacgaccatcaacagccgttttgtcgactggcttgccgaccactatgccagtctcatcaacctgccgccaaccgaaccggccatgctgcatcaaatgccgcgccggctggcaagggagatggagcaagctccgcagactccgggcggccagcgggtggcgctgatcgtggtcgatggactggcgctggatcaatgggtcggcctgcgtccgctgctgcaccagcaaatcccggcgctcgtcatgcgcgagtcggcgaccttcgcctggattccgaccctgacgtcggtgtcccggcaagccatcttcgccggcaaaccgccgcgcgcctttccggattccatccacagcacccatcgtgaggagaagctatggacgcagttctgggaaagccaggggctttcgcggctggacctggcgtttcagcggggtctgggcgacggcgatgcgcgctccgtcttgggcgatttgatccatccgcgcaagacgcgcgcggtcggtctggttgtcgataaagtcgataagatcatgcatgggatgcagcttggcgcggccggcatgcatcagcaaatccagcagtggtgccaaaccggctttctcgctgggctaatcgatcaattgctcgactggggttttgccgtttggctgaccgccgatcatggcaacctggaatgtcagggtcaggggcggcccaacgagggggtggtggcggaaacgcgcggcgaacgggtgcgggtgtatccatcacctgtactgcgttccccggtcacgcaagcctattcctttgcgcgcgaatggccgccgattggtctaccagagcactattacccgttgctggccggtgatcggcatgccttcgttactcaaggggaaaccatcgttgggcatggcggcgcggcgattgaggaggtcatcgtcccgctgattcgcttcgagcggcggatggcagggtaa

SEQ ID NO: 1680 - DNA, 1992 bp, Ectothiorhodospira sp.
atgacgtatttatccagggacaatgtcgcccatcgcagcacactgctggctgatcggattctcaaggagttcccgtctgacctggcccggctgtggattgtggcggacccggacaacgttctgctggacgagcaggtactggctggactgcgtgaacgcggcttcgaggtgctgccgtttgaggacagcatcgcctttcgggccgagtacgaagagcgctaccgcgccgcctgggaggctgaggaggccaatgcacccagcgccctggtcattcaggtgcgcgattccagcactgcggagctgccctgggattatttacgccaggcgcgcaaggtcagtctgtcgctcgcagagctgttcccaaaactcagctatgcggtgctcaggcagctcggtagcgagatcctgccgtcgctgttcgaggtgcaggcgcgccacgcgacgcaggcgatgggcgaagccgccaccaaagaatttgtgctgacgcatatctaccgggtaagcccccacctgattacccggccagaggatctgtggcgtgagctgctgcggctgcactaccgcgagacgctactaccccagaccctggccgggcatatccaccaggtattggctgaccgactggtgttcgccagcagcccgattgccgagctattctccaacagaagttttgcgctgcgtgtggtgcaggacgcctggtaccgctacctgaacaaactgggactgatcggcagacgtacggcggagccggtagcgccggactacataccgcaactcgacattcccttcgaacatcacgacatccgcgtcatcgttgattcgatgttcctggacggcacgctacacccgctggccattcagggcgtgccggtcagcttgccggagtgggcaaaagctggcgtagtgcaggaccccgcagcgatgcgcaacctggtgctggagggtatcaagagcctcagtgaagagctgcctggcgctacatcgtctcacagggattggacccactttgcccggcggcttggtgaagtgatctcgcgctttcacagcctggatgccgtgcgcgcagaaggtctgaaggcggacatgaaggatctggtggcacgcgccgacagtgagctgcaaacctgggttcaggcgcactacgctgacttaccttccctgcccgctgccaaggggccggtgatggtgcatcaagtgccgcgctacctggcaatgcgccgagctaacggtgaggaaaaaattgcgctggtcgtcttcgacgggttggctgtcgatcagtggacacagattcgcgaaaacctcatccagcatgcgccacgtctgatgtttgatgaaaatgcctgctttgcctggctgcccacgctgacatccatttccaggcaggcgttattctccggcctgcgcccacgggagttcgctgaacacatcgaaacaacctcaaaagaacctcagcattggacccggttctggcaggaccagggattgcgtgccaacgagatcctctatcgaaaggcgatcaagcgcactgatgagctgccggagttgcaggagctgctctcaaatcctgccctgaaagtcgccggcctggtggtggataccgtggatgaaatcatccacggcgccgtgctcggcaaacgcggtgtagctgcgcagatcaacagctggtgtgagtcgggatttgttgatcggctgtttgcgatgctgctcaaccagggcttccacatctacctgactgccgaccacggcaatgcagaagctgtgggcattggccgcccgaaccagggggtggcttcggagctgcgcggcgaacgggtgcgcacctatcgcagtgaaaccattattgccgagacagcaactgcaataccggacagcttccgcctcgatatcgctggcctgccggccaatttcatgccgctgtttgcaggagagcgcggagcctttgttccaaagggtgaccaggtagtggtccacggtggcatctggggtatcccc

SEQ ID NO: 1681 - DNA, 1941 bp, Clostridium papyrosolvens
atgattaatgaaattattttagaaaagctatatctaaaagaaaatgaatttattctggtctttgatcctgataacctacttggtgcggaggctattgtagagcatgtaaaccaggctgggttttctattgtcaattatgaggacccagaggtctttcggtattattatgaggagaatatccgcagttttctggatcggggaaaacctcttgataataaggttctgataaggtatacagtggaacagtctatcccttatgatataagggctaaatgcttctttgttgaagtaaccttgcgggagctgttccctaaattgagctataccgtaataaaagagctttacagtgaggtgtttgacaaactgtataaggtatactcacgatatagcggaccgattttgggagacaaaggaacaaaagattttatattgaaaaatgcgtatggtgtaataccagaggttattgccgattttcaagagttggttaagacctttattccgctatattatagaggggaagagctgcctcgactaattgcagattatgcagcagaagctataagtagtaatggtcagcttaaacaatatccagttaagactatagtgagtggtaaggtgtcctgtttccactttattcaggaacagtgggaactgtatatcaggaaaacaaatggagaagctgttgaaacagttattgatttcggaaattacgagattagagcgtatatagataatcttttccaggaaaactatttgactccagtaaaacagcttaagctacgggaataccctacctggatgcaatcaggtgttgtatatgatatagcaggaaatatagaacgcaagtttgataactatattgataaaattataaataatgtccagagtgtaaaatcgtataaagactggttcggtattgcggccttgtgggcggaagttcttacgcttaaatacgatcagagcaaaagttactcacttgataacaaaaaattcaaagacactggcagtttactaaaagaatgctttaaggattggctgcttgcaaactacaatatgctggcatcgttgtcatatgctaaagctccagtaatggttcataaaataccctggcacataaatcaccgttttcccaaacaggaaaataaaaaggttgctctgcttgttatcgatggaatgtcgctggacgattggtttgttattaaagaagctataaatgaaaacaataaatacatatttgaagagaccctatgttttgcatggattcccactatgacatcagtatccaggcaagcaatattttcaggagagatacctacaaattatgcagatactcttttgtctaccaaccacgacgataaacagtggaagaaattctggcgtaatatcggctataataataacagtgttgcatttaagcgtaatataaaagagttcagggaagacggacttgacgatattttgaatgataacgggctacgggtattgggattggtagtaaatatggtagatgatattatgcatggccagcagctttcaattgaaggtatgcaccaggatataagattatgggcaaataaaggtagccttgtaaggtttattgataggctgtattcaaaagactttgaagtttttataacttctgatcatggtaatatcggtgctgttggacaaggaaccctccaagaagggttagctgtcgaaagcccaggggaaagagtacgcttctataatagtgatataaattgtgatacaattatgtcgaaatataaggcactaaagtgggaagcatcagggttgcctaaaaaatataattatgttgtgtcggaagaaaatctggcgtttgtaaaagaaggaaagaagattgttgctcatggaggcttggctatagaagaagtaattgtaccatttatacatatgagaaaggaaaatcagaatgcttga

SEQ ID NO: 1682 - DNA, 1923 bp, Thermoanaerobacter ethanolicus
atgattaaggattatatcagagataaattatctttagaaggttctaatcttatattgttagaggataaagatgacattttaaatgaagaaagcattatagagatgctgcataaggatgaatatgaggtatataattatcaggaaccggatagttttaggttttattatgaattgaactatagaaaattttatgattcttttgtagaacccaataagaaatttatacttaagtgtaaagaaataaatgaaattccttatgatatacagacagtttttcatcatgtgtccatatcattgaaagaaattttcccaaaacttgattatgctgttttaaaagaattgggtacggactttttggggaaaatttatgaggcatatcagttatacgatggaaatgtgttgggggaaaatgggacaaaagattatgtgatgaaggctgtttttggaattattccagagcacataaataatttaaatgagcttgtaaaggcatttttacgactgtattacaaaaatattgagctacctaaggtgctttctgattatttggagtataaattaaggcagaaagagaatttaaaagatgtacctttaaatgaaattttatcaggaaaggatagattttttagatttgtaagggtacaatggaagaattatatcaatgatttaatagaagggacgcataatgccaaaattgattttagtgactatgatattagggcatatcttgataatattttttatgaaaaatatattgaacctatagaagtggaaaatattgaaaggcttcccaaatggacatatgttggaattttgtatgatgagaatgaaaggtatttgaaagaatatagaaaaatgatagaaaaaataaaggagttgttgagttttagtaagtcgtataaggattggatgaatttgtcttctttatgggcagaggttttgaacattttttatagtaaaaaacttgctttaaatgagaatgaatttaatgagataagtaagttgattgaaaacagttttatggaatgggttgttttgaattatagcaatcttacttcaatttcttatgtaaatggacctgtaatggttcatcaaattccatggtatttgaattatattatgaaaaaacaaaaatatgatagggtagcacttttagttttcgatggtatgtcggtagataattggtatttgataaaaagatatttgaataaaaatgctctgtggaatattgaagagaaaaagtcttttgcatggatcccaactttgacatccatttcaaggcaggcaattttctctggtgatatacctttatattttaaagatacgattttttctacaaattacgaagaaaaacgatggaaaaggttttggatgaatcaaggatataaaggtgatgatgttttttacataagaaatgttatggagttcaataaaagagaaataaatgatataataaataaccgtaatgcgaagatagtaggtattgttgtcaatattatagatgaactaatacatagtgcgattttatcagttgaaggattatatcaaaacatacagttatggcttgaaaagagtagggtggaggattttttaaaaaaattgatttctaaaggatatgagatttttatagcttcagatcacggaaatattgcatcaataggcaaagggaaattaaatgaagggcttcttgttgaaaaagctggagaaagggtaaggatatatgagagtggaatagattatgggagaagtttatatgatgataaatcttttaaatggattggttttggtcttcctaaggaatacaattttataatatgtaaagaaaataatgcttttggtgctcaaggagaacagatgataagtcacggtggtatttcaattgaagaagttatagttccatttgtgcacataagtcatatttaa

SEQ ID NO: 1683 - DNA, 1923 bp, Thermoanaerobacter ethanolicus
atgattaaggattatatcagagataaattatctttagaaggttctaatcttatattgttagaggataaagatgacattttaaatgaagaaagtattatagagatgctacataaggatgaatatgaggtatataattatcaggaaccggatagttttaggttttattatgaattgaactatagaaaattttatgattcttttgtagaacccaataagaaatttatacttaagtgtaaagaaataaatgaaattccttatgatatacagacagtttttcatcatgtgtccatatcattgaaagaaattttcccaaaacttgattatgctgttttaaaagaattgggtacggactttttggggaaaatttatgaggcatatcagttatacgatggaaatgtgttgggggaaaatgggacaaaagattatgtgatgaaggctgtttttggaattattccagagcacataaataatttaaatgagcttgtaaaggcatttttacggctgtattacaaaaatatggaactacctaaggtgctatctgattatttggagtataaattaaggcagaaagagaatttaaaagatgtacctttaaatgaaattttatcaggaaaggatagattttttagatttgtaagggtacaatggaaaaattatatcaatgatttaatagaagggacgcataatgccaaaattgattttagtgattatgacattagggcatatcttgataatattttttatgaaaaatatattgaacctatagaaatggaaaatattgaaagacttcccgaatggacgtatgttggaattttgtatgatgagaatgaaaggtatttgaaagaatataaaaaaataatagaaaaaataaaggagttgttgagttttagtaagtcgtataaggattggatgaatttgtcttctttatgggcagaggttttgaacattttttatagtaaaaaacttgctttaaatgagaatgaatttaatgagataagtaagttgattgaaaacagttttatggaatgggttgttttgaattatagcaatcttacttcagtttcttatgtaaatggacctgtaatggttcatcaaattccatggtatttgaattatattatgaaaaaacaaaaatatgataggatagcacttttagttttcgatagtatgtcggtagataattggtatttgataagaagatatttgaataaaaatgctctgtggaatattgaagagaaaaagtcttttgcatggatcccaactttgacatccatttcaaggcaggcaattttctctggtgatatacctttatattttaaagatacgattttttctacaaattacgaagaaaaacgatggaaaaggttttggatgaatcaaggatataaaggtgatgatgttttttacataagaaatgttatggagttcaataaaagagaaataaatgatataataaataaccgtaatgcgaagatagtaggtattgttgtcaatattatagatgaactaatacatagtgcgattttatcagttgaaggattatatcaaaacatacagttatggattgaaaagagtagggtggaggattttttaaaaaaattgatttctaaaggatatgagatttttatagcttcagatcacggaaatattgcatcaataggcaaagggaaattaaatgaagggcttcttgttgaaaaagctggagaaagggtaaggatatatgagagtggaatagattatgggagaagtttatatgatgataaatcttttaaatggattggttttggtcttcctaaggaatacaattttataatatgtaaagaaaataatgcttttggtgctcaaggagaacagatgataagtcacggtggtatttcaattgaagaagttatagttccatttgtgcacataagtcatatttaa

SEQ ID NO: 1684 - DNA, 1995 bp, Nitrococcus mobilis
atgacggcttgggtgggccgcatcctgaaggagtttccggccgatctggcccggctctggattatcgccgatccggacgatgtgctgttagacgagcaggtgctgtctgggctgcgcgagcgcggcttcgaggtgctgcccttcgaggacagtgttgccttccgtacggagtacgagggacgctatcgagcagcgtgggatcagggccaaccggctccatcccccgccttggtcttgcatttgcgaagcacgaacgtcagtgacttaccctgggactatctgcgtcaagcgcggaggctgagcctgagcctcgccgagttgttccccaagctgagttacggcgtggtgcggcagctgggcggtgagatgctcgagccgttgttcgaggcgcaggcgcggcacgcccatcaggcgctgggcgaagccgcgaccaaagagttcatgctgacgcatattttccggctcagtccacatctgatcacgcgtccagaggacctttggcgtgaacttcttcggctgcactaccgcgaggcggcactgccgccgctgctcgcgctgcacgtgggacaggtcgtcggtgagcatagcgccttcaaaagtctgccgatctccgagttgttctcgcaaaagagcctcacgctgcgtgtggtgcaagacgcctggtaccgctacctggccaagctggggctgacgggtacaagaacaggggagcctgcgtcgccggactacgttccccagattgacatacccttcgatcatcacgacgtgcgggtgatcgtcgactcgatgttcctggatggcaagctgcacccgctggcggttgcgggcgagtcggcggctttgccggaatgggccaggacgggggtcgtccaggacccggcgtcgatgcgaaatctggtgatcgaagggataaagaatctggccgccgagatgccggcgatcgagtccccgcaccgcgactggacccatttctcgcgtcgcctgggcgaggtcatatcgcgctctcatcgattggattcagcccgcgccgagagcgtcaaggaagcgctgctggacctggtcgtctctgccgacggtaggctccgtgaatgggtggggaagcatttcgcggatctaccatcgttgccggcggccaaagggcccgttatggttcaccatgtacctcgttttctagctatgcgcagggatagcggcgaggaacggcttgcgcttctggtgttcgacgggctggccgttgaccagtggacccagattcgtgagagcgtcatcaatcagtcgaagcgattgatgttcgaagagaatgcctgcttcgcgtggctgccaaccttgacgtcagtgtcccggcaggcgctgttctccgggctgcgcccgcgcgagttcgccgacagcatcgaaacaacttcgcgcgagccttccctttgggctcggttctggcaagaccatggtcttcgtgcgaacgaggtcctgtaccgcaagtctatcaagcgtaccgacgacctgccggcgctcgaggcagcgctgacgaatcctgccgtgaaggtggtcggactcgtcatagacacggtcgacgagatcatccatggcgccgtgcttggtaagagaggcatatcggcacagatcgcaagctggtgcgaatcgggctttgtggatcgcctgtttgcgctcctgctggacaatggatttcatgtttacctgaccgcagaccacggcaacgtcgaagctgtagggatcggtcgcccaaaccagggcgttgcctccgaactgcgcggcgagcgggtcagaacctatcgtagtgaggcattggtcgcggatgcggcagccgccaatcccgaagcatttcgtttggacgtagcgggactgccggcgaacttcatgcccctattcgcaggcgcgcgaggcgcgtttgtgccgaaggacgagcaggtcgttgttcacgggggagtctccgtggaggagctgctggtgcccttcgtcaaagtgagttacgtaaattga

SEQ ID NO: 1685 - DNA, 2763 bp, Saccharomonospora glauca
atgagcgcaccgcccgaggtcgaccggcggatgctggaggcgctggtcgaacactggctgcccgaggcgaacgggcggcggctcctgctcgtccacggccgctacgccgacggcggcgatcgggagttcggcatccggacgaaggaatgccgctgccgcgtccacgtcgccgaccggcactccctgctgggggtgctggaggcctggcaggaccaccagcgtgagcacggctccgagaccgacacagccgacacactgctggtcgtgaccaccggcgtcgaggaccaccagttcggctgggacctgctcgcctacgccgtgcagcggcgggtgctgtcggtggaccgggcgcagatcatcgcccagcggttcggcgcacgggacgtcgacccgcgcatccgccgggagcactggctcgtcgacgccctgctggacgccgaaccggtcgaaggctggccccgcaccggctcggtgctcacccgcgaccgggccattcacgccctgatcggcgtgcggctcggacgcgccgcgctcggcgaggacgccgtggacatcggcacgctgctcgacttctccctcgatgtcgcgggcaccacccggttcgccgcgttgcccgcagccgaacgcgacgggctgaccgactggctcacccacaccgtcggcgacgccgccgggctgctgctgcgcctggccgccgaaggacgggcggccgacgccatgccgctcggcatcgtcggcaccgccgccgtcggggagaacgcctccccagcggcggccctggccttcggcggactgctgggcggggtgcggccggagcagctcggagcgttcaccgaggcggtggagggggcgctggaacgctgggtcagcgaagccgagtccggcggcaggaacagcgcaggcgcgcgggagaaggtgctcgccgtgacccgcagggcggaggagctggccgccacggcggggctgaccgccgagctggcgggcaaccggttcctgccctcggcgttcaccgcgcggctgcacgacttcgccaccgcgctcaccgccgccctcgacgggacggggaagctggacgcggccgaggacgccctcggggcgctgcgcacccaccacctcgccaggctggcgggcgagcggatgcgggcggtggacatggccgtgcggctggcccgctggcttgagcaccccgtgcccgaacccacctcggtggccgacgcgatccggcgatacagcaccgagtgggcgtgggtggaccgcgcgctgaccacgctgtgggcgggagaccccgccggtgatccggtgctgggccgggcgtatcaggcggtgttccgggcggtgcgcgaacgccgcgccgccctcgacgaggcgttcgccacccacctgccgagctggaccaggcacgcgagcatcgacgaccccggcgggtgcctgctcatcgagcgggtgctccacgaggtggtggtgccgctggcacgccagaaggcaccggtgatcgtggtgctcgacggcatgagcggagccgtcgccgccgacctcgccgagcaactcacccaacgcacgtggctggaggcctccccgaaggccaggcgcatcgccgcggtgtcggccgtcccctcggtcacccgggccagccgccccagcctgctcaccggcactctcaccgcgggcgaccagaccgtcgagaaggacgggttcgccgcgttctggaagcgccccggcggttccgggctgctgttccacaaggccgacatcgcgggcgacgccggacaccggctgtccgaccaactgctgacggcgctctccgacgagtcgaacgtggtcggcgtggtgctgaacaccatcgacgccgccctcgaccacggtagggaaggcgaccgcaccggctggcaacccggcgacatcacctacctgccggaactgctggatgccgcccgcaactacggccgacccgtcgtgctcgtctccgaccacggccacgtgctcgaccggcccgacggcacgaaggtgcccgtcgacgacgtcgagtcggcccgctggcgcgtcggcgagccgggggagggcgagctcgcactgagcgggccccgcgtgctcctcggaggtggcagcgtggtcgtcccgtggcgggaggacatccgctacaccaaccgcaaggccggttaccacggtggtgtggccctcgcggagctggccgtgccggtgctggtgctgctgcccgccctgaacaccctgcccgacggctgggagctgctgcccgccgaccgcgtggcgccgacgtggtggcagcgacgcgccgaacagccgtcgcccccgcaggcacagccgaaaccggccgaaccctcggcaacagcggcaccgcccgcccgccgcgcgaggaaggagcagcccgacgcgctaccgctgttcggtgtggacgaccagaaggcacgggacgccgacggcgaccgcgccgaacagccatcgctggggcagcgggtcgtggactcggaggtgtacgcggggcagcgcgcgttcgtgcccaaggcacccgaccgcagggtcgtcgcggcgatcgtcgacgcgctcgtcgaggcgggcaaccggctaccgctgaacaccgtggccgaactcgcgggccgcaagagccgagggcccgagttcttcgccacgatcctgcaacgactgctcaacgtcgacggctaccccgtactgtccgtggacggtgggcagtggctgagcctggacaccgacaccctgtgtctccagttcggactcacccgggactga

SEQ ID NO: 1686 - DNA, 2790 bp, Rhodococcus triatomae
gtgaccacggcgaccagccttcccgaggccgacctccccggaatccgaacgctcatcgggcaactccgggtcaaaggccaccgacgcggtgtcctcgcagttgccgcggtgccgacgtggtccggtcccgacacgctcgacctcgacggctcgacggtccgaatccgtaccgcgcccagtgtccttgcgatccgcgacgcccttaccgaacggtctgcctacgactgggtggtcgtgctcaccgaccgcgatgcgagcgagctgcccgtcggcgtcctcgaccacctcaccgtcggacgcctgtcgaacctcgacccctggcccgcgctgcgcgaactcttcaaggcgaaccggcaggagttcaacctactgtcgctggagaacaacgccgcacgctctgcgctgcggtccctcgacgacgccgtgccgcccgcacccggcggcgtcctcacctccgaccacctgttcggggccctggccggccgcaacttcggtctcaccccggacaagttcacaccacaccaggtcgccctgtggtccaccgacaccgagcgcaccacgcagttcaccgcatggcagtcccgcaccgacgagtccctcgtcgagcagttcttcacctggctcgaacgcaaactcgggccgctcggccggaccaccgccctggtgctgcggtccagcggccccgagcagctcgtgccgctcggcctcgtcgcggcgctcatcgacgattcggcctcctctgctgcaatcgtccccgccgcctccaacgtcaccggcaaagtgagcaccctcctcgaagtcgaactcggacggcacaccgtcaccgaagccgagatcaaggtgtggggaaacaccgccaccctcgccgtcgccggcagcgacgtccccgacgccacgcttcgccgcgccgaagacctcgtcaccaagctgcaggccaccgcgctcgtcggccgatccgacgtgctgccgtccgccctcgcaccgcggatcgcccggttcgccgccgcgctcgacgcggccgaacgcaccccggacgacaccgcgatcactgccgtcgagaacgcgtgggcggatgtcactgcgcaccgcctggcccgcgtcgatggcgccgacgcctcacgcgatgtccgcgtcgccgccgccgcccttcgcctgctgcggtggacccgccgcaccgacaccgcacccacgacgctcgctgggtggctcacctactaccgcgcggatctgtcgtgggtggacggtgccgtcgacgaggcgttcatcggtgccgacaacgcagtgctcgcgaacacggcccaccgcatcgtcaccaccgtccgcggccgccgagccaggcacgatcgcgctttcgcggcgctgctcgccacctccggcacgtaccgcacgacgggatccgatgcccccacctacgtcgaggatctcctcgaccgcgtggtcaagcctctcactgtccgctcgcaaggatccatgcaggatgcgcgcccgtccccggtgctgctcatcgtcgccgacggcatgagcggttccgccgcgaacgaggtggttgccgacgcggtgcgccgcaaccgaccgcaatggcaggcgtacattccccgcgacaccgagcccgtcaccgtcgtcatggccgcgctgccgaccctcaccgagttctcccgatgctccctactgtccggcgtcctcgaccgcggtgggcaggcgcaggaacgggacgggttctcggcgtggctcgccggccagggcatgcgcgggcaggggccggtgctgttccacaaggccgacctcgaaaccgtgtcccgcggaaacgcactcgccgtcgacgtccgcgccgccatcgacgacaccgatcatcggcccgtcgtcgcgtgcgtcctcaacgacatcgacgacgcccttgaccggtccgaccccatcggcaccgtgtggaccatcgaccgcttcaagcggctcgacgcgctgatgtccgcagccgctgcagtgagccggaccgtcgtcctcgtttccgatcacgggcacgtcgtcgaacgccgcgagcaacccagtgtgcagcgcggcgaacaggtttcggcacgctaccgcctcgccgccggcgtcgaccccgcgacgctgccggcagacgaggtgttcgtcgaagggcctcgagtcctcaccgacgaccaccgcgccgttctcgccgtcgacgaacagcttcgctacacgggcctcaaggccggctaccacggcggcggcgcgctggcggaggtcgcgatcccggtgacgatcctcgtcaacggcgcggccccgtcccacctcgggctcatcgaggcacccgcgccgcaaccggcgtggtgggacccgatccgcaccaccacacccgcacccacggtcgtgacgacaccgacgaagcccacgcgcaagccgacgacgaaggctcccgcgcaggaagagtcactgttcgagttcggcggcaccaccacgacgcagccgaccacgaccgcaccggtgggcggccgcgaccggatcacggagctgctcgccaccgacctgttcgcgcagcagtacaagacgtacggccgcaagatgagccgcgacgccatcgccgccctcctccgcgagaccgtcgacggcggcggcgtgctgccgctcgcccaggcagcgcagatcctcgacgtcaaggcgttccgcgcgggcccggctgtgcaggtgatcgcccaggtgctcggcatcgacggcgtcgtcgtcctctcggtgaccggcagcgacctcgagctcgaatccgccgcgctgttcgaacagttcggagtcgcctga

SEQ ID NO: 1687 - DNA, 2754 bp, Saccharomonospora cyanea
atgagcgcaccgcccgaggtcgaccggcggatgctggaggcgctggtcgaacactggctgcccgaggcgaacgggcggcggctcctgctcgtccacggccgctacgccgacggcggcgatcgggagttcggcatccggacgaaggaatgccgctgccgcgtccacgtcgccgaccggcactccctgctgggggtgctggaggcctggcaggaccaccagcgtgagcacggctccgagaccgacacagccgacacactgctggtcgtgaccaccggcgtcgaggaccaccagttcggctgggacctgctcgcctacgccgtgcagcggcgggtgctgtcggtggaccgggcgcagatcatcgcccagcggttcggcgcacgggacgtcgacccgcgcatccgccgggagcactggctcgtcgacgccctgctggacgccgaaccggtcgaaggctggccccgcaccggctcggtgctcacccgcgaccgggccatccacgccctgatcggcgtgcggctcgggcgcgccgcgctcggcgaggacgccgtggacatcggcacgctgctcgacttctccctcgacgtcgcgggcaccacccggttcgccgcgctgcccgcagccgaacgcgacgggctcaccgactggctcacccacaccgtcggcgacgccgccgggttgctgctgcgcctggccgccgaaggacgcgcggccgacgccatgccgctcggcatcgtcggcaccgccgccgtcggggagaacgcctcccccgcggcggccctggccttcggcggactgctgggcggggtgcggccggagcagctcggagcgttcaccgaggcggtggagggggcgctggaacgctgggtcagcgaagccgagtccggcggcaggaacagcgtaggcgcgcgggagaaggtgctcgccgtgacccgcagggcggaggagctggccgccacggcggggctgaccgccgagctggcgggcaaccggttcctgccctcggcgttcaccgcgcggctgcacgacctcgccaccgcgctcatcgccgccctcgacgggacggggaagctggacgcggccgaggacgccctcggtgcgctgcgcacccaccacctcgccaggctggcgggcgagcggatgcgggcggtggacatggccgtgcggctggtccgctggctcgctcaccccgcgcccgaaccctcctcggtggccgacgcgatccggcgatacagcaccgaatgggcgtgggtggaccgcgcgctgaccacgctgtgggcgggagaccccgccggcgatcccgtgctgggccgggcgtatcaggcggtgttccgggcggtgcgcgaacgccgcgccaccctcgacgagacgttcgccgcccacctgccgaactggaccagacacgcgagcatcgacgaccccggcgggtgcctgctcatcgagcgggtgctccacgaggtggtggtgccgctggcacgccagaaggcaccggtgatcgtggtgctcgacggcatgagcggagccgtcgccgccgacctcgccgagcaactcacccaacgcacgtggctggaggcctccccgaaggccaggcgcatcgccgcggtgtcggccgtcccctcggtcacccgggccagccgccccagcctgctcaccggcaccctcaccgcgggcgaccagaccgtcgagaaggacgggttcgccgcgttctggaagcgccccggcggttccgggctgctgttccacaaggccgacatcgcgggcgacgccggacaccggctgtccgaccaactgctgacggcgctctccgacgagtcgaacgtggtcggcgtggtgctgaacaccatcgacgccgccctcgaccacggtagggaaggcgaccgcaccggctggcaacccggcgacatcacctacctgccggaactgctcgacgccgcccgtaactacggccgacccgtcgtgctcgtctccgaccacggccacgtgctcgaccggcccgacggcacgaaggtgcccgtcgacgacgtcgaatcggcccgctggcgcgtcggcgagccgggggagggcgagatcgcactgagcgggccccgcgtgctcctcggcggtggcagcgtggtcgtcccgtggcgggaggacatccgctacaccaaccgcaaggccggctaccacggcggcgtggccctcgcggagctggccgtgccggtgctggtgctgctgcccgccctgaacaccctgcccgacggctgggagctgctgcccgccgaccgcgtggcgccgacgtggtggcagcgacgcgccgaacagccggcccccccaaaggcgcagtcggcacgggccgaaccggcggcaccgcccgcccgccgcgcgaggaaggagcagcccgacgcgctaccgctgttcggtgtggacgaccagaaggcgcgggacgccgacggcgaccgcgccgaacagccgtcgctggggcagcgggtcgtggactcggaggtgtacgcggggcaacgcgcgttcgtgcccaaggcacccgaccgcagggtcgtcgcggcgatcgtcgacgcgctcgtcgaagcgggcaaccggctaccgctgaacaccgtggccgaactcgcgggccgcaagagccgagggcccgagttcttcgccacgatcctgcaacgactgctcaacgtcgacggctaccccgtactgtccgtggacggtgggcagtggctgagcctggacaccgacaccctgtgtctccagttcggactcacccgggactga

SEQ ID NO: 1688 - DNA, 2838 bp, Gordonia polyisoprenivorans
atgaccactgcaacgggtttgccggaggctgatctcgcgtcgatcaagggcgtgatcggtgaactttcgggcaagaactaccgccccggcgtggttgcggtggcggcagtcccgcactgggcgggtcccgcggaactcgcccatgccgggacgcgagtactgatcaccaccgcttccagtgtgctcgccatccgtgacgtgctgcgacggcgtaccgagaccgattggctggtgattctcaccgaccggccgtccacggagattcccgcgggaatcgccgagcacctggtgaccggccgactccgcaacctcgatccgttccccttgttgcgcaacgtttttgctgcatccaagcaagagttcggtctcttgggcgaccagacagagatcgctcgggcgatgctccgggagatcggcgaaaagcccaccccggcgcccggcggggtgctgaccgacgaccacgtcttcaccgagctcggccagcggaagttcgacctcgcccgtgccaacatgaccccccatcacgtggcccggtggtcgatggatccggtggcgacgcagcgctacacggcgtgggcggagcatgcgcatccggcgctcgtcgagcggtacctcctttggctcacccggcagctcggcgagctggggccgatgttgatgtcggcatggcggcgccaaggaccggcatcgatcgtgccgctcggtctgatcgccggcgtggtcgccggcacaccgcagcccgatgaggatgcggccgaatcgatcccgcgtattcgcactcggctggagatgaaggtggacgacgtcgtcctgtccgaatcgcagctcgccgcgtggggcgcggtggcgaccctggcggtggccggcgcccacgatcccggaccggcgctcaccgcggccgaagcgttggtcaccgaactccacgccgagccgctggtggctcgctccgatgttctgccgtcggcgctcgtggtgcgtatcgcagcgttcgcaagccggttggccattgcgacacagcacgccgtagggggtgacaccgctgcggatgtgaacccggtggatctcaccccggtcgacaatgcgtgggccgccgtgcgcgcacaccgcgatcacgatgcagccaccgccccccgagacgttccggtgggggctgcggcgttgcgcttgatccgccgattggtcgaaccgtggcaacaccccgcgacactgtcggaatggctgactcggtaccgcaccgattggtcgtgggtcgacagtgcggtcaatcgtgcccacatcggtgccgacaacccgcgactcgcacacgccgttcaccaactcctcggagcagtccgcacgcgacgcgcgcagatggatcgcgagttcgcgacacgtctggcagccgccggcgtgcaccgcgaatccggttcgggtgcaccgctctacgccgaggacatcctcgacgccgtggttctgccactcacggcacgcgatcatggcgccaccggcgccggactcggcggcagcgaaccgtcccgctcgccggtgctcctcatcgtcgccgacggtatggacgtcgcgtccgccaacgacgtcgtgaccgatgccacccggcaccggcgtccgcaatggcaggactgcatccgcgccgacgacgacggcccgctcactgcgctgtcggtgctcccgagcgtcaccaggttctcgcggtgctcgttgttgaccggcgcccttgcagccggaagtcaagatcgcgaacggtcgggcttcgcggactggttgcagcagcgaggattacgcggccaggggcaagtgctgttccacaaggccgacctcgacgcggtatcgaagggacactcgttggcgctcgacgttcgccaagccgtacaggacaccgccagccgcacagtggttgcgtgtgttctcaacgacatcgacgacgcgctggatcggtccgatccgatcgggtcctcgtggacggtttcgtcgttcaaacacctcgacgcgctgttgaccgaggcggccgccgtcggccggacggtggtgctcgtcagcgaccacggccatgtggtggagcgtcgtgagcagcccagtgtgcaacgcggagatcagatctcggcacgttaccgcggggcgtcgggaacacctgcagcagatggcgagatgctcgtcgacggagaacgcgtactcaccgacgatcatcgcgccgtcctcgccgtcgatgagcaacttcgctacaccgggctcaaggccggatatcacggcggggcagccctctcggaggtgagtatcccggtctcgattctggtcaacggtgccattcgctcgtcactgccgctggttccctcgggtttcgctcccccgtcatggtgggatctcgatgatgccgcgccgactccgctgcccgcgccggtcacgccgtcaccagctcctgcgccggcgaagcgaccggccaagaacgcgaagcctgctccgacctcgggacaggaatcactcttcgacgtcggtgaaacccctgcgggctcaacggcggatgatgcggtcgccgacgcggcattcgatccgatcggtcgacttctcaccagcggactgttcctcagtcagttcaagcagttcggtcgtacgctcacgcaccagtcggtggggtcgctgctccgggaatctcaggcggccaacggcgtgctgccgatgagcagggtggccgagatcctcggactgcgtccggcacaggcccgtggggcggtcgcgcacctgagccaggtgttcaacatcgacggtgtgtcggtgatcgcgcaacacggtgacgacgtgacgatttcttcggcattactgttcgagcagttcggggtgagcccatga

SEQ ID NO: 1689 - DNA, 2727 bp, Amycolatopsis azurea
gtggcgtgttgtcgacgggaaggcttgatggcccaggttccgcctatcacgcgagcagggatcgagtcgctgctcacgcaacacagacacgcgctggacaagcagccaggccgatgcctggtgcttgtccacggcaggtatgagcctggtgaacgcaccgagttccggctgaagccgatcgaaggtgaccaaggcgagcgggcagtgcgcgtcaccgaccaaccctccatactggggatcactgccgaatggctggactaccagcacactggagcggcctctggtgtgctggtaatcaccaccggtgtagagcctgccgagctcgactgggacttgcggggacacgctctcgagaccagcctgctgcgaatcgacccggtcgagaacctgaagtttcggttcggcgccaatcgcttggacccccgagtctggcagtccacctggctcgtccaggcagtcctcgacgccgaacccaccagtggctggccccgccgtggtggcgtgctgacctatgacgacgccttgctggctctcgtcggacagcggcttggcgtcgacgccgcaactctcgacctcgaccgcctgctcgagtggtcccggagcaccgcaacgaccagctgggctgaactggacaacgctgaacgtgacggcatccgcagctggctcgtcgagcgtctcggcctggcggcggaggctgttctcacgttggtcgcggctggtcgaggccgcgacgctctggcgctgggggtcgtcggcgcggcattaagcgatcaatcgctgtcgcgcgacgccttggtgtcggtcggtgggctcttccccggtatccgctcagatgccgtcgaagcgttcgccctggcggtcgacggcacgctgagccggtggatcactgccgccggacctgccgattcccctgcccgccatgacgtcctcaccgtgcttgaacgggccgacgagctggccaagcaaaccggcctcaccgaggccttgtctagcaacccactactgccctccgcatggcgagcacgtcttcgttcggtgggcgcggcgctccccgatccggaggctgcgaaccgcgcgctcggcgaactcggcgaacatcgcctcgccgaattgttcagttctcagaagaccacagcgaccatggccgtccggctcgcacggtggctcgcaacaccggaatccggagtcccgtccgtgtcggcaggtgtgcaacagcaagtggcccaatggggctgggtcgactacgcccttgctgttctttgggcaggcgacgtggcaggcgaaccggtgagcgccaaggcttaccgcgatctctgtgagcaggttacggctcgacgcaccgcgtcggacgaagaattcgcgctccgcctggcctcctgggttccgcatgctcgcgcacagctgtccgaaggcgcgttgctgatcgaagacatcctgacgacagccgcggttccgctggccggtgactcagctcccctgatcatcgtgctcgatggaatgagcgcttctgtcgcggcgcagctcggcgacgaactgagccgtcggcccaactggctggaggccagcccggtatccggcacccgtctggctgcagtgtcagtgtttccgtcgatcacgacggtgagcaggccgtccctcttgtgcgggaaacccatcgcaggaggccagtcgacagaaaaagacggctttgcctcgttctggaagaagcaccacaagcaagcgcgacttttccacgagaacgaagtcggcggcggcgccggccagagtctcaatcccgagctcgttgcggcgttggcaggcgtcgaagtcgtcggtgtcgtactcaacacgatcgatgacacgctcggccccggtcgcgagggcgatgggacgacctggcgcctccaggacatccggtacctgaccagcctgctcactcaggcacgcagctacggacggccggtcgtcgtgacatcggaccacgggcacgttctcgagcgtggcctcgctagcggcccatccccggcaactgccgaatacggtggacggtggcggacaggagcaccggctgagggcgaagtcgcgctgcacggtccgcgagtcctcgaagggaacggaaaggtggttctcccgtggcgcgaggatatccgatacacgcaaaagcgcgcggggtaccacggcggtgccgctttggccgaggtaagtattcccgtcttggtcctgctgccgtctgtcgacgtattaccggacagttgggcgggattgcccgctgaacagacaacgccttcgtggtggcggggcagcccagagcaggtaattgtggagcccgctccggcacccaaggcgccgcgtaagaaacaaaaggctatccccgacgggccagggctgttcgatcatgtgctgccggagcccataccacctgtgccggccgtgcagaagactcttggccagcaggtaaccgcttcgaagatcttcgccacgcaagagaaattcatccgtcgtggacccaatagcgacgttgtggccgccgtaattgacagccttgccgacgcaggcggcaagctctcgcttgccgcaattgcctccaccgcaggcaaagcagccagaaacatcgatggattccttgccacccttcagcgtttgctcaacgtggagagctacccggtactcgaactcatcgatggcggccgaacggtggaactcaaccttgagctccttcgaacacaattcgacctggacaagccgtga

SEQ ID NO: 1690 - DNA, 2778 bp, Marinobacter sp.
atgccagctatggacccaggcaatttgttgccaattccgatattgacccagctgcaggctgtgtttcaacgcgaccctgaagcggactgtattgctttggtatggcctacagagctgcctgcgtctgaggttctggttgccgtggggccgcatcgggtaagggccgtttactgcgtgtctgagctggctctgcgcgaagtgttggttgcgcatcaacaacagcccgctggcaaacgcccgcgactggtgctgttgtcaaaatttgacggcgttcatctggccctggatgtgctggcgcggctctggaaaaatgagccgcaacgcatcagcccctggaagacgctgcaacagctgattcgggttcgcgatattgaccctcgccttacccgcaagcatgggcgttggattgccgaggcgctgctaagcggctacgaccgctatcacaaaaaaatcacatttggcgatgtgctggatcaggaatcggcctggcgagcgattgccataggccatctgcattatcaggagccgtcactggatcttcagtcattgcttgaatggagcgcgcaggatgccgtgccgggctgggtcggggccttgcccgacgagataaaggccaatctgggcgaatggttagcgccggcgttgccggacagccacgaggcggtgtcaacgattttgttgaacggtcaggcgggggacttgttacctatcgccctggcttgttcaaccttgttttcagacgccatcgaaaaacagaaagccgttgaaccggcgcagctacatggcagccgcggggttttccgtgaacgctatttggcgggtaaaacgttgccactaaaggcgcttcagcctttgggtgacgctgcaacagcgttaataggccgctggatagcaggccgcagctttcaatgttatgagccggttctggcaaaaacagaacaaatactggccagccttgatatgcaggctcaggcccaattgtctggcctgttgacttgcggtttacaggcgcgcctgagcaattttgcctgtgagcttgaggccgccgctacgcaaaatgacggcgccttggctgaacaggctttgcagcaaatcaaaactcatcagcttgcgggtattgggctgtttaaagacacggttcagcgcgcagagatggcaatgcgcctggttcgttggctgaaacagcgacccatcaccacgggcacagcagccagtttgatgatcgactatatcgaccaaggcggtttctgcgattgggcgcgtacggcgatttggagtggagacgtccacagtgagttgaatcatgtgtacaaacagctgtcggagcgagtcagtgagttgcgcgagcgccaaaactttgcttttggtcagcaactggcaggtattggccgcggggacagcttaccggcgcgactgacgccggtggagagtgcgattgataccgtgctggcgcctttggctgagcaaagtccggcgcttttgttggtgctcgacggtatgagtgaagccgtttatcgccagctgagtggcgacctgtcccgttataattggcttgaaattcagtcgcaggcagccagtagcgatacctgccttgttgctgcgttgccgacgcgcacccaaactagccgctgttcgctgctgtctggggcgctgtctgcaggagtggcaacggatgagaaaagggcgtttgcggcgcaccccagactcaaaaaaattgcgtcaacaaaatttccaccccgggtgtttcacaagcaagatttgtctcagcccggttctggtagccttcgcagtgatgtgcgcggtgttattgctggaaccgaacatcgtgttttagcggttgtgattaacgccattgatgaccagctgtctagcagctcccaggtgaatgtggagtggggtttcgagagcatcgccctgttgcgccaggtaatggatgcggcccgcgaggcagggcgagtggttgttataaccagcgaccacggccatgtgctggatcacgactcggtcttccagccgccaagtggcgaatacggtgagcgttaccgctcagtggctgagggcgcgccgtcagagctggaggtaaaggtttcgggcaaacgagtactggcgccgggccagtcggtgatattgccatggtcagagcggctacgttatacccgggggaaaagccatggctatcacggtggagcaagtttgcaggaggtggtgattccattgggtgtttttgtgaatgccagtgtacgtcagcacttggatggttggcaggaagtgccgcgccggctgccagactggtggcttgttccgcaacagccgttaagggttaatgactcaaaagttgagtcgggcgtcgtaaatagagcccccaaagcgccagcacgctcaaagttagcagctgtgtcagaggttgttgatgacatgtttggggctgctgagtctgcgccggcgcagcccgatgcatcaacaccgctcgaagctgattggattgaccggtttttggagtcttcggtgtatcagcaagcccgccagcgtgccggccgtacagcgattagtgacgatgatttgctgaaatttattcggttgctacaggcccagcagtggcaaatcatggaggcgaccctgtgcagggagttgcaaattcctaaactgcgagtgcgcggttttctctcaaatatacagaaactgcttaacgtggatggctacccaattctctctgtagatcgtgaatcacagaccattcgcctgaacgtgtcggacttcagaaaacaatttgaagtttga

SEQ ID NO: 1691 - DNA, 2655 bp, Saccharopolyspora erythraea
gtggaccaccgggtcatcgaggcgctcgtcaaagaccagctccagcaccacaccaaccggcggctgctgctggtctacgcccgctacgccgacacggtggagtctttcccgctaaccgggcagcgtcgtcgagtgcacgtagccgaccatcattcggtgctgggcatgtccgaggcgtggcaacggcatctggcggaccaccctgccgacgacgatctgctggtggtcaccaccagcgtgccggaggagcaactcggctgggacctgcgggcgtatgcgatcaagcggtcgatccgcaacgttgaccgggcgcggatcgtggcgcaacggttcggggcggtcgacgtcgatgcgcgggtgcgggccgaggaatggcttatcgacgggctgctcgacgccgaaccttccaccggttggccgcgcgccggctcggtgctcacccgggaccgagcgatccgggcgttgatcggcgcccggctgggccgcaccgtccccgccgacggaactctggatgcgggcacgctgctggaatggtcacgcggcgcggaggccggcaggttcagcgaactctccccggccgagcgcgacgggctggtgcgctggctgaccgataccgtcggaccagccgcggccgtgctgctgcgcctggtggaggagggcaaggcgaccgacgcgatgccgttgggcgtcgtcgcggctgtcgcggccggaccgaacccgcccttggaagccggacttgcgctcggcggactgctcgggagcgcacatggctctgaactgcgtgccttcaccgatgccgtcgaaggcaccctgacccggtgggcccacgaggccgaggtgagtcgtaacggcgaacccgcacgacgccgcgtgtgggaggtcgtgcggcggtcggacgagattgcggcccaggttaggttgacggagtcgttgcgagggaacgggttcttgccctcggcgttcagcgcgcgactgcaggcactcgcgactgccgtgtcggggccccgggcgcgcctaggcgacgcggagcgggcattggagtcgctgcgcgatcacgtggtggcccggttggcgccggaacgggtgcgggtcgcagagatggccgtgcgtctggtgcggtggttgcaggaggctcggaccgacgtggcgtcggtggccgacggcatcgcccggtacatctccgacacggcgtgggtggaccgggcgctgcaggtgctttggcacggcgatcctggcggcgacgcggtcgtgggccaggcgtatcgctcggtgtgggaggagatccgcagcgtgcgagaccgcatcgacgaggcattcgcggggcgattggagtcttgggcgcagcacgcgagcagcgttgagtcgagcggtgcgctgctgatcgagcaggtactcggtgagatcgcggcgccggtggcgcgtaagactgcccctctggtgatcgtgctagacggtatgaacggcgccgtggctgccggactcggcgaacagttggcggagtggtcggagaccagccgcgagccggggcgccgggacgcggcggtggcggcgatcccgtcggtgacgcagatcagccgcacgagtctactcacggggaccgtgaccgaaggcggacagaccgtcgagaaggacgggttcaagaaattctggcgcacacgacgccgccaggcccagttgttccacaaagccgacatcgtggggcaggcgggatcgtggttgtcggacgagctcttcgccgcgttggcggaccccgacatcgtggtcggcgccgtcctcaacacgatcgacgacgccctggaccatgggcaggagggcgaccgcgtcgaatggcgcctcgacgacatcacctacctgtccactctgctcaacgaggcacgcaactacggacgccctgtcgtgctggtctccgaccacgggcacgtgctcgaccgcggcgggcagcagacccaggccgacggagtggagtcggcacgttggcggcgcggtgcgccgagcacgggtgaggtcgcgttgcgcggcccgcgcgtcgtccccggtgacctcgtggcgccatggcgggaagaccttcgctacaccccgcgcaaggccggatatcacggcggcgcgtccctcgcggagatgacggtgcccgtgctcgtgctgttgccgagcctggaactgctgcccaacggctggcacgtgctaccacgtgagcgcaccgaaccaccgtggtggtcggcgcgcaccgtgcacgcagagacggaatcggcaccggtgaaggctccgtcgcggcggaagaagacacccgatcccgccgtagaagcgctgttccccgttgacgcggccgctgtcgagcccgtcacctcgctgggcgatcgggttgcctccggggaggtctacgaacaccagcggaagctcgtgccgcgcccgccggacaatcaggcggtcgcggcggtgatcgacgctctggccgcgcaacccgacggaatgctcaccacgagcgcggtcgccgcggcggcggggcgtgcggcacggcgcccggagttcttcatgagcgtgctcggtcgactgctcaacgtcgacggctatccggtcgtgtccgttgtggatggaggagcgcgcgtgaaactgagtctggagaaccttcgcacacagttcgggatcgacaagccgtga

SEQ ID NO: 1692 - DNA, 2907 bp, Streptomyces turgidiscabies
atgacggacactgtcgccgccgccccgggcgccgtccggctgaacaccgcgaccgtcacccagtacctgtcctcgcagtcatccctcgccgcctctctgacgggagacggcgggggcaggcgccgggtcgtgctgctgcggtccgcgctccagtgggacgggcccgccgaacccgcctggggcgagggccggacggcctgcgtcgcggtggctccctccccgctcgccgtccacgaactcgtcctcgaccatctgacgggccgacgccccggccccgccgtcctggtcgtcctcaccgaccgcgaacagaacgaactcgacccggcgatcaccgcccgcgtccacaagcagcgcatcgacatggtcgacagctgggacgtcgtgcgggaggcgttcggtgcccggcagatcgacccgcgcctgaaggacgtcaactgggccgccgaagccctgctcgacgccaccccgccgggcggttggcagccggtgcccggtggctggctgtcccggcagtacgccctcaccgcgctcgcccagcgccgcctgcgcctcggccgctacgacaccgaggacggcccgcgacgcctcggcgaagaccggctcgacgcgcagaccctgctgcactggtcgaccgggcccggcgcccccgagcggctgctgggcctacgagggcctgagcgcgccggcctggccgccttcctcggcgaggaggaccaggccggtctcgccggacgcgctctgctcgctctcgtcgacgccgagcgcggttcggacgccgcagccttcggcctcgtgtgcgcggccctgtggcagcacgccgaaactgcccccgagacgtatcagtcccggggccgtgccgaacgctacttcggcgatcagcccccggctgtcggggaacaactcgacgccctggtgggcgtcttcggccggtccgccgaggagtacgtgagcacgctgctgacggccggacacaggggcggcggcatcgacgccgaccaggcccgcgaggcgcgccgcaccagcggcatcgtgctcgaccgggctgccgtactggcccgccagttcggcgcggaggcggccgtcgcgtcgagccccgtcctgcgcggcggcatggaagcccggttcaccgccatcggccgggcgctcgcggcgggcgacacggccgcggtcgcggaggccgtcggacggctcgcggaccacagactcgccaccgatccggaggagtccgcccgcatcgaacgcgcccgcatggggcagcgcctcgcccgctggctggccaccgacccgtccgccgacgcacccagcgtcggcgacgccatacagcggcacaccgccgagaccggatgggccgacctcgccctggaacacatcgaggccggcggcgacccggactccgttctcaaggccgcctacgacacgctgggcacgcgcgtcagggaccggcggcggcagatcgacgcgtccttcgcgcgctcgctggccggctggacgcaggacggcaccccgcccggcggcatgctcaccgtcgagaccttcctcgaccgggtggtcgggcccgtcgtccggcgcggggaggaacggcgggtgctgctgctcgtgctcgacggcatgagcgcggccatagcgaacgaactcggcgaggaactgcgccgctcctgggcggagttcgaccccctggccgaggacactccgcgtcggcgggcgatggccgccgcgctgcccacggtgacggccgtgtcccggacctcgctcttcgcgggcatcctgatgaagggcactcaggccgacgagaagaggctctttcccgcgctgaagctgtggagcggggcaccggccgccgtcttccacaaggacgacctgcgcaccgagacagcgggtgacaccttcggccaggccctcaccggagtgctcaccgacggcaggacccatgtcgccgtcgtcctcaacgccatcgacgaccgcctcgccaaggaacagaaactcggcgacggtacctggcgggtcgacgacgtacccggcctgcgcgagctgctccgggtggcggcggcccagggcatggcggtcatcgtcaccagcgaccacggccacgtcgtcgaccggcacggtacgaaggccgacgcggccaccgaaccgcagtccgcgcgccaccgcctgcccggcggcggcccgctcggcgaacgggagatcgctctctccgggccgcgtgtggtctggcccgacccgggcgcgtccatcgtcgccctctgggacgcggactcccgctacaccgccctcaaggccggctaccacggcggggcgtctctcgccgagttcaccatcccggtgcttgccttcctgccgttcggggcggaaccgcccaagggatggcgagagttgggggaccaacggccgccttggtgggctccggaggaggcggggagatcggcatcggacgagcgttcgactcggcttgccggtgtggctccgaagaaggcgacggcgaagccccgcaagaagcagcccgatccggagtcgctgcccgacgcgctgttcgacgtgatgctgaccgccgggggagacgacgccctgctcacaccgaccgtcgtctcccggaccgaggtgctcgtggcggcgctgctcgactcggagacgtatcaggggcagctcgaaggtctggcgcgcaagccgcagcaggagcaggtccacaaggccctcgccgccctgctcgacgccggtggcaccctgcccgtgaccgcgctcgcccagcgcgcgggcctgcccaccaaccggggcgacggcttcgccgcggtgctccggcaactcctcaactacgacggcgtacaggtgctggaaaccctgccggacgggcgcacgctacggctccacgatgcgctgctgcgtgagcagttcgccctcaggacgggctga

SEQ ID NO: 1693 - DNA, 2685 bp, Gemmata obscuriglobus
gtgacgcagccggcacctacgttcggccagatccgggccaaggtccaggccgtccgccgcaagatcccggacgccagtgcggtgggcatccacgcgccaggccggtacgcgggcgaccgcgtccgccgggagggtgcggacacctaccggatcgagcagtgcgactcaccgctcgcggcccgcatcgccctgctcggcgacgagccggcggcgacggtcaccgtgctggtcaccggcctcgccgaccaggatctgggcgacgacgtgctggtccggctcgcgggccgcaggctctacccgctggacccgtggcagatcgtcaaggaactgttccaggcgcacgccgtcgatccccggctgcgcggccaggggtggatcgccgaccggctgctggaactcgccaccgccgcgggggtgccggccgccgcggggggctacctggacgcggaaatcgtctggcccatgctcctccagcggctgctcggcctggagggggaccggcccgaccttcccctcctgcttcgctggtcggccgtccccgagaacgtcggacgcttccgccgactgccggacgagccccggcgggcgatcgaggggtggctgtccgcctcgctggggccgaccgcggcagccgttctccggtgcgccggtgctaccgaccaacccgacgccctgcccgtcggcctggccctcggcgtcgtccaccacccggcggccgccgggcagctggaccgggccgcggggcggctggaacggttcctgggcggccccacccccgaacccgcggtcaccgaccgctggcacgccgccgccaccgaggcggtgcgactgctggacgccgacacgcgggcgaggaacgggctgctgcaccgtgcggaggaggtgctccgggaggtccaggcggacgagttcgcgcacctgaccgacgtgctcccgcgggggttcgagcagcgactggcccggctcggcgggctgctcgcggtgacggccgacgagccgccggcggtcgccgaactgaccgccgcccgcgacgcggtccgccggcacgaccaggcccgacgggagccgcggcgggtggagcgggtcgacatggccctgcggctggcacggtggctggctgccgccggccccgaagtcgccccgcggtcgctgggcgcggcggcggccgagtacgtggcacagggcagcttcgtggactgggcccgctcggccctccgggcgggcgacccggttcgggagctgtcggaggggtacgcccggctgctggcccgggtcgccgcccggcgggaggcccagaaccgccgcttcgccgaactcctgcgggaccagaccgccgcggcggcccggcccgccgacgtcacccccgtcgaggccgtcctcgaccaactggtcgccccgctcgcggccctggccccggtgctggtcgtcctcctggacgggatgagcccggccgtgtcgcgggagctgacggccgacctgacccggctggactgggcgtcgctcggccccggcgggcgcgcactgccgcccggcctggcggcgatcccgtgcgtcaccgaggcgtcgcggaccagcctgttctgcggccggctcgccaccgggtccgtcgcggacgaggcggccgggttcgccgcgcacgccgccctcaagctacactgccgcgccggtcagccgccggtcctgttccacaagatcgctctcaccggacccggcgacgccgccctggcggccaacgtccgggaggcggtcgcctcggcgcagaagcgggtcgtcggggtcgtggtgaacgcggtcgacgaccacctcctcaagggcgagcagctcgacctgcggtggacgcgggacgagatcaaggtcctgctgccgctcctgtacgaggcccggtcggcccggcgggtggtcgtgctcctgagcgaccacgggcacctgctcgacgaccagacgcgagccgcggacggggacggcggggagcggtggcgttcggacgacgggcgtccgggcgagggcgaactggccctccgcgggccgcgggttctgctcggcgacggccaccggctgatcgccccgtggaccgaacggctccgttatgtgggccggaagaatggctaccacggcgggttgaccccccaggagatgttgatcccgatcaccgtgctggcggccggcgacctccgcccggacgggtgggtggacgcccccgacccggccccagactggtgggagccggctccgcccctcgctgctctgccggcagtcgtgttgccgccgaaaccctcggccccgaaggtcccgacgagcctgttcgacgacgaagaagagaccccggcagtacctcccgttgcccctgcggtcgcatcgtccccaatttgggtggccgccctgctggcgtcgccggttttcaccgagcagaagaagctgggcgggcgggccgtgccggacgacgccaccttcgccgggctgctggccgccctcgacgaggccggcggcaagttgacctcggccgccctcgcccggcggatgagcttgccaccgttccgccttcgggggctgctggcggtctgtcagcgggtcctgaacgtcgacggcttcgcggtcctgggccgggacgacccgtccgacaccgttgaactgaaccggtcactgctgttgcggcagttcgacctcatcgcggaggaccgcccgtga

SEQ ID NO: 1694 - DNA, 2658 bp, Rhodococcus ruber
gtgaacactctcaccgccacccgcccgatcatcactgccaagctcgcgaaggccgtcgaaaagcgttacaagggcggtgttctcggtctccgtgccgcgcctgcgtgggacggcggtaccttccaccacgacggaaccccggtgactgtggtgccgtgcccgtccaccctcgcggtgtgggaagccctcgaatcccgcgccgacgatcagtggctcgtcatcctcacccccgtcgacgacaaggacctcggcgacggggtgctggcccacctcatcgacggccggctcctcagccccgacccgtgggacgcgctgcgctcgacattcgccgccacgaccatcgaacccgccctctaccgcgtacccaacgaccgtgcattggcgctcggattgctcgcggcgatccccaccgccgcgatcacccccgcgccgggtggcgtgctcacccgcacgcacgtgatgtccaccctcgcacgcggtgttctcgcgatcaccgacgatcccgccaccgagatcgacaccctggcgattctcgaatggagccgtcgttccgacgtcaccgacaacctcgctcgtctccgcgtagacggtggccccgaggtgatgaaggccgtcgcggagtggctcgccgaacgagcgggaagactcggcaagcctgtggcggcgctgctgcaatcccagcggatcaccgagttggtgccactcggacttctcgccgggctggtcgccgaccccgccagcaccctcgatcggggactgttcctcggcgagtacgggctccgtcgcctcgacatcgaggacctcgaagcctggcacgacgacaccgccgggctcgtcgtcggcactctcgtcgaacgggaacggcgggcggtcctcgaatccgcagccgcgcacgtgcgtgagttgaacatcgaacatctcgccgcgcggtccgaacttcttccccagggactcaccgctcgcctcgacgagttggcgaaggccatcgaggtagccctgcccgccgacgcttcccacggaccgaagcagggcggcatcgacggcgttgaactggcatggcagcaggtcctgcagcacatgtcggcgcgcacctccacgtcctgccgagctgccgaagcggccgtgcggttactacggtggctcaccgtcgacacccccaccgcgggcgggctcgacgtgctcacccgccggtacgtcgatgtggacggctgggtcgacgccgctctcgtgacggcgcacagaggtgcggatcaccggcgtctggccgaggcgatcacccaggtcatcgctgtggtcaccgcgcgccgtcgtggccacgaccgccgattcgccaccgctctggcagacacgccgcaccccaccggtgcgctcgtcgaacaactgctgcccgatgtggtgctgcccctggccaagtcgacgcccacgctcctgatcgtggtcgacgcgctctcggtcgctgccgccacagaactcgccgcggccgccgccgagtccgggtggatcgaagccggtgtgctcggatcgtcctgtcgcacaggagctctcgctgtcctgcccacactgacccagcgcagccgctgctcactcctcaccggtgaattgaaggaaggaaacgacgccgctgaacgcaccggcttcctgaaacttctgcgcgacgcgaagttgcaggcggcaccggggcgtatcgacccgatcttccacaagaaggcattggacaccgtgcccgccggtgcggatctggccaccgacgtcgccaacgccatcgcagacaccgccggccggccgctggtggccgcggtgctgaacttcgtcgacgacacgttgcaccacaccgatcctggcgggacgaactggggcatcgacaccatcacccacttgcgcgcattgctgcaggccgcgcagcgagcgggccgtgctgtggtcatcacctccgatcacgggcacatcatcgaacgtcgcacctccgtcaaacacgaccgcgtcaccgtgtacgggcagcgcgcacacggagacctcgaccgcgtggaagacggcgagattcttgtgcggggcccgcgggtgctcaccgacagttcggctgtggtgctcgccgtcgacgacaccatccgctacggacccgtcaacgccggctaccacggcggggccagccctgcggaggtggtggtgcccgtgctcgccctgcacaccggcgagtgtcccgacacactcaccacactcgaccccgtcgaaccgcactggtggcacagccccgtccgactcgacacccccgaggcgagccccgcacccgctgtgaatcaggcagcgcccaccctgttcgacaacgatgagcctgccgttgccgacaccggtggggacgtggccgagggggtgctcgccaccacggtcttcgccgaccagttccgtctggcgggccggatcgtggtgcgtcccgaccagatccgcgcgctgctggctgcactgcttgcggcacccgcgcgggaactgaccaccgcccatgcagcggctctcctcggactggccccgagccgagtcggtggcgcgttgctacagatcaagcgggttctggacgtcgaaggctacgaggtgttgctgctcgacagtggtgtcgtcggactcgacgaagcagcgctgcgtgaacagttcgggatcgggtcgtga

SEQ ID NO: 1695 - DNA, 2610 bp, Mycobacterium xenopi
gtgagcacactggccgtgaccgaacccatcatccgggcacgcctgggcaaggccaaggccaaacggtacgcccgcggcgtgctcgggctgcgcgccaagcccgaatggaacggcgaaactttcgatttcgaaggcacaccggtgaccgtcgtggcctgcccgtcggtgctggcgatctgggaggcgatcgacacccgcgactccgacgcgtggacggtggtgctgaccgacgtcgacgacgacgagctcagcgacaccgtgctggcgcatctgctcgacggcaggctcatcacccccgacccgtgggacgcgttgcgcagcaacttcgccgcgtccaccatcgaaccggcgctgtatcgggtccacaacgaccgcgccatcgccaacggcctgctgaacatcctgtcgcccgacgcctacaccccggcgccaggcggggtgctcaccctggaccacgccatggccgccgtcgcgcgcgacgtgctgaagatcgtcaaccggcccgacgtggagatcgacacgctcgcggtgctggagtggagcctgtcgggtaaggccgctgatggtctctcggcgctggctgcgcgcggggggaccgaactcacctcggtgttccacggctggctggcgggacgcgccgcggccatcgccggaccgctgagagcgctgctggccaccgaccggatcagcgagttggtgccgctgggcatcgtggccgggttgttctcgcaggctcatcacgatgcgaaggccctcggcgtgttcctgggccgatacgggctgacctccctgacgcccgccgacctggacgactggtacgtcaacgcccgcgggctggtgaccaacgcgctgacgtcaccccactccgtgctgcaggccgcggcgggcgtggtcgacgaccttggaatcggcgcggccgctgcgtcatcggagttgttgcgccacggcctcgaacaccggctcacggtcctcgccgacgcggtgacgacggcgctcacccggccggaaacgctgcccggcgtcgaaagcgcatggaccgacgtgcagaaccatttcctgtccggatccgacccatcgtgcccggcattcgccggcgctgtccgcctcgttcgctggcttgcccaaacacccacccctgcaacgggactcgccaatgccagcgcactttacgtgcgcgagctgtcgtgggtcgacacggcgttggtggcggcgcggcgaggtgccgacggcccgcacctcgccgaggcgttgcgcgcggtcatcgacaccgtcgcggcccgccgcttccaccacgatcgcgggttcgcgcaggcgctggccgacgcgccgaatcctccggtgcagaccatcgagaatgtgttggcgcagtgggtgataccgctcgccaagaagacgccgacgctactgctcgtcatcgacgcgctgtcactggccgccgccaacgacctcgtcgcggccgcccaacgcgacggatgggtggagatctccgccgccgccgacggacaccgtggcgctgcgctggcggtgctgcccaccctgacccagcgcagccgatgctcgctgctgtgcggggaactgcgcgaaggccccgacaccgtcgagcgggccggcttcgtcgcgctcatccgcgaggcccagctcgaagccaccggcggcgcgccggacccgatcttccacaagaaggcgctcgacgccattcccgccggcgcctcgctggccaccgacgtcagcaacgcgatcgccgacgtcgaacaccaaccgctggtcgccgccgtgctcaactacgtcgacgacaccctgcaccacaccgacccgggcagcgccgactggacactgaccaccatcacgcatctgcgcgcgctgctgcacgccgcgaagaacgccggacgcgcggtggtgatcacctccgaccacggccacatcatcgagtacggcaccagcaccaaagtcgagcgcgccaacacctacggccaacgcgcccacggggattacgccaacatcgaccccgaccgcgagacgctcgtcgagggcccccgcgtgctgaccaccgaccacaaggtcgtgctggcagtggaccccgacgtgcgctaccaggcgcgcaacgccggctaccacggcgggggatcacccgccgaagcgctggtgccggtggtggtgctggcggccggcacgctgcctgacttcgcggtacccgtcgcgggcgccgagcccccgtggtggcacgcctccgccccggtcatcaccccggtcatcacgaaaaaaccgcaagagcccagcctgttcgacaccgccgagccgccaagcgcgctgcccgaaaaagtgttacgcagcaaggtgttcggcgagcaactcaagcttgccaagcgaaacgtagtgcagcagagccaaatccgggatctgttggctgcgttgctcgccaccagcgcgcatgagatcgcgctggcgcaggcggcagtggtgctcggcgtcgcaaccgcccgcgtcaatggcgcgctgatgcaggccaaacgagtgctggacgtcgaaggatacgaggtgctgcgggtcgccaacggcgtggtgcgcctcgacgtcgacgcgctcaaggaacagttcggggtgtcggagtga

SEQ ID NO: 1696 - DNA, 2493 bp, Micromonospora sp.
cccacgtcagcatgcagaagggccgcagcgtcgacccgtgggacctggtcacccaggtgttcggcggccaggtgcggctcgactccaccctcgtgcgcaccggccgatgggtcgccgacgccctcaccgaccttgcgccggcccagggctggccgccgcccgccggcctcatcctcacccgggaccacgcgctgcggcacctcgccggggcggtactcggcctcgaccccgacgcactggacggagccggcctcctccagtggagcaccgacgcacccaaccagctccgcttcggcgacctgcccaccgaatggtccgacgggatcgccacgttcctccgcgaggtcgccggcccggtcgccgtgccggtcctcgccgccgtcggagccgggcacggcgtcgacgccatcccactcgggctgctcgccggggtactctggccccgggccgccgagtcgcggcccgacatggatctggtggtcgcccgcacccggctcgagccgcgcttcggcggtgcccgcctcacggaggaacaggccagcgcgttcggggaggcgaccgaggcgtggatctaccgggccctcgacggcgaccatgcggtacgccacgacgcgcgccggatgctgcgccgggcggaggacatcgcggccgagatcgacgtcgccggacggctcgccgcgtccgacctgttgccggcccggcttcacgcagcggatgcgtgcattcggcgaggccgtgcggctcgccgtgccggcggccggggctcccgtcgcgcccgccggtgagctgatcgagcgggcgcaggaccggctcgccgaggtcgaaacccaccggtcggccgagcgctcccgggtggagaccgcgcggatggccgtccgcctgctgcggtggctggccacgcccgaggggtccgcccccgccacgatgctcgacgccgtgcagcggcaggtccgcgacgacggctgggtcgaccgggcccgccttgacatcttcgtcggggacgtcgacccgcaggtcgcgcgggcctaccggctgctgcacgcggccgtggaagctcgtcgtgcccgccacgaccaccagttcgccgagctgctgcaggacacgaccgttgccgagcgggacccgggcaccctgctgcgcgtggaggacgtgctggaccgcgtcgtccgtcccatcgtggacaacggacgacgggtcctgatgctcgtcctcgacggcatgggaaccgcggcggccgtcgagatcgccgagtccctgggccgtggcggcgcctgggaggagctgacgcccggcggcggcccccgcgtcggcgtcctcgccgcgctgccgacggtcacgcaggtcaaccggtgcagcctgttcagcgggcggatcgccgtgggcgaccgtggcaccgaactgcgggccttccgcgagcagttcccgggcggcgtgctgttgcacaagtccgacctgcgcaccccggccgggctggccgtcgaccccgaggtggccgccgccctcggtgacccggccgtcccgctggtcgccgccgtcatcaacaccatcgacgacgccctggaccgcagcgatcccggcatcaccgagtggagcaccgacaccgtcaacgggctgcggaacctgctcgtgctcgcccaggaccgggtcgtggtgttggtctcggaccacgggcacgtcgtcgaccggggcaccgaggcggtcctgcggcccgccgactccagcgagaaccggtggcggctgacaaccggcgagcccggtgacggcgagctgctcttcaagggcagccgggtggcgctcggcggcggcgaggtgatcctgccctggcgggaggagctgcggtacgggccgcgcaaggccggataccacggcggggcagcccctgccgaagcggtgatcccgctgctgctcttcgccgcccacgacgagaacgccgtaccggggtgggcgggagcgccggtgtccagcccggagtggtggcgggagccgctgcgccaagcggcggaggaggcggtttcccacgagcccgcgccgacggagagccggcgccccgcccgccgtgccgcccggccgccagcccaggacgagggcctgttcgacctgcccgcccccgccgcgaccgcgccgccgtcgtccgctccgaccgtcccaccagccccgtcgtccccacctccggccgactcggcggcgaccatcgtgaaggcgctgctggccagcccggtctacgccgaccgcaggggcaccagggcgcccctgcccgacgagcgggtggccgccatggtcgccaccctcgtcgccggcaacggacgggcgaccctggagaccctggcgaccagagccgggatacccgtgcaccgggtcaccggcacgttcaccgtcctgcgccgcctgctgcaggtcgaggggtaccccgtgctcagcctcgacccggacgggcggacggccaagctcgacatcgccctcatggtcgagcagttcgggctggaggtcccgtga

SEQ ID NO: 1697 - DNA, 2748 bp, Saccharomonospora xinjiangensis
atgagcgcggcacccgacatcgaccggcgcatgctcgaagcgctggtggagcactggctgcccgaagcaggggagcgacagctgttgctcgtgcacggccgctacaccgagggcgccgacaggtcgttcccggtgaagaccagcgagcgccgctgccgagtccacgtcgccgaccagcactcgctgctcggggccctcgaagcctggcaggaacaccagagcagccacgccgacgaccccgacgcgctgctcgtggtcaccaccagcgtcgccgaccagcaattcggctgggacctgctcgcctacgccgtgcagcggcgggtgctgtcggtggatcgggcggagatcgtggcccggcgcttcggggcgagagacgtcgatccccgcatccggcaggaaccgtggctgatcgacgccctgctggacgccgaacccgccgaaggctggccacgcaccgcgtcggtgctcacccgcgaccgcgcgatccaggcactgatcagcgtgcggctcggcagggccgccctcggcgacgacgccgtggacatcggcaccctgctcgacttctccctcgacccggctggcaccacccggttcgccgcgctgccggacgccgaacgagacgggctcaccgactggctcacccacaccgtcggcgacgcggcggggctgctgctgcgcctcgccgccgaagggcgtgcggccgacgccatgccgcttggggtggtgggcaccgccgccgtcggcgagacggcgtccacctcggcggcgctggccttcggcggcctgctcggcggagtgcggcccgaacagctcatcgcgttcaccgaggcggtggagggggcgctcgaacgctgggtcagcgaggccgagtccgggggcaggcacagccgcgccgcgcgggacagggtgctcgcggtgacccgcagagcggaggagttggccacccgcgccgggctgaccgccgacctggcaggcaaccggttcctgccgtcggcgttcaccgcccgcctgcacagtgtcgccaccgcgctcaccgcggccctcgacggcgcggggctcgacgcggccgagaacgcactcgtggccctgcgcgaacaccacctcgccaggctggaggacgagcggatgcgggcggtggacctggccgtgcgggtcgtccgctggctcacgttgccgctgcgcgaacccgcgtcggtggccgacggcatcaccacctacagcacggaatgggcgtgggtggaccgggcgctgaccacactgtgggcgggcgaccccgctggtgatccggtgctggggcgggcgttcgagctggtgttccgcgcggcccgccagcggcgggacgccctcgacgcggcgttcgcggcgcacctgccgaggtggacgacccgcgcgggcgtgcacgacacgggagggtgcctgctcatcgagcaggtgctcgacgaggtggcgatgccactggcccgccagagcgcacccgtgatcgtcgtgctcgacggcatgagcgcggccgtcgccgccgaactcgccgagcaactcgccgagaacgcatggctggaggtgtcgccgcgcgagcaccggatcgccgcggtgtcggccattccctccgtgacccgcgccagccgccccagcctgctcgcaggcaccctcaccgcaggcgaccagacggtggagcgcgacgggttcgcccggttctggaagggcccgggacggtcggggcagctcttccacaaggccgacatcggcggcgacgccggacaccggctgtcggaccggctgctggaagcgttgtccgacgaaacggtggcggtcgccgtggtgctgaacaccatcgacgccgcactcgaccacggcagggaaggcgaccgcaccggctggcgacttcacgacatcacctaccttcccgaactgctcgacgccgcccgcaactacgggcggcccgtggtgctcgcctccgaccacggccacgtgctcgacagggcggacggcccgcccgtgcccggagccggtgccgagtcggcgcgctggcgaaccggcgagcccggcgacggtgagatcgcgctgcgcggcccccgcgtcctcctcggcggcggcaccgtggtggtgccgtggcgggaggacatccgctacacgcatcgcaaggccggctaccacggcggcgcggcgctggccgagctgacggtgcccgtgctggtggtgctgccgtcgctccaccggctgccacccggctggaccgtgctcgccgccgaccgggtcgcaccggcgtggtggcatcgacgtgccgagcaggctccggctcctgcttctgttccagtttcgtccgagcgggcgccgcgcgcggtgccgccgattgtggcgtcgccgcgtgtggtgtcgcagctcgatccgcacgagatgtcactgttcgccgtggacgcgccggaggagtccgcgaaacccggcgagtcgctgggggagcgggtcgtggccagcgaggtgtatgcggggcagaaggcgttcctgcccaaggcccccgaccgcaaggcggtggccgcggtcatcgacgcgctcgtggagtcaggcaaccggctaccactcaccaccgtcgccacgctgacgggccggacggtgaccagggcggcggtgctcaccaccacgttgcagcgactgctcaatgtggacggatatcccgtgctgtccatggacggtgggcagtggctgacgctcgacgtggagaccctgtgcttgcagttcggagtggagcgtgactga

SEQ ID NO: 1698 - DNA, 2775 bp, Bradyrhizobium sp.
atgaccgaggcgccgctgctctcggatgcggacattcggttggaggtggagcgcctgttccggcgcgatcaccgctccaagctgctcgcgctcttcggtcgagggcagctcgggcacatcgatctcgatggcctgaagtgggagatcatccccacgtcttgtgaactggagcttcgctcgaagctgccggcacccggcgcgccacccacaacgggcagcgtatacttggtagattgggctgaggacgcgcttccgcttgacgtctcgtgccgcctcgcgggcgggcgcatctaccacgtcgcgcgcgatgcccggctcgccgcgctcttcggtgcgcgccaagtcgatcaaggcttggtatcgaccgcgcttgcgcggctggtgctctcgggcagcgtcgatgggcttcgcaagatcacgggcctccgcctcacgacaaacgacctctgcaagcgcgtgcttgaagcccgctttggcacccccgagagcgcgctcgagtccgggacggcatggctccgctgggtacgcaactcagatgctggaacggccttcgcgcgcgcgtgcgagggcgacggcctcctgcgggcggtgcgacacgagctgttcgtctgggtcggcgagcggctcggctccgtcggcatacttggcttccgcgcctgggaactcggccttgttgaccgcgcgatcgaggcactcctgctgctagcagcagtcgagaagagcgaggacgcctaccttcggggtctcgtgaatggacagattgcgagcattgcgcccggcctcgcgaacgaagtgcgagacgcgcacgagcacggatccgcagaggcgttaatcgctgcagtgctgtcagtggagaacgaggccgatcggcgactcctcgagcttgcccagcagcacgcgatgagcggcggggcttcagctctcgcggcggcgagcgattggctgcccgccggtcacgctgcgcgcgaggaagctgttgctgctgcgttgactacgctcgtcgactcgcctagcgccgactcaatgacagccgtgctcacggcgttcgaccacctgagcgcgcatcgcctcgatcgcatcattcgcggctccgaacacatcgaagctcggaagatggcagcgcgtctatcggcctggctgcttgcgcggagggtacgcccgcagctcgccgagcatggcacgccgtggcaaccggcgatcgagctcgcgcgccgctacaccgaagagggcggctttctcgactgggcgcgccagagcgcgcgcgggatgcgcggcgccggcgacgcgctaatgaccgccgtccaccgactgtgcggagccatcgacgcggaggcccgtgccgacgatcagcgatttgcccaagcgtacgtgtcgtggatcgcggccgggaagccctcgaacgaggtgctccctatcgaggacgttaccaagcgcgttgttgcgcagttcctcaaaggcggacagcatcggcgcctgctgctcgtcttgatggacggcatgagctacgcgacggcggtgcagatccttcaacgcctgcgcgaccagcgtaggtggagccccatcgcctggcgcacaccaaactggagcgggcaacttccgatcccgcctgtattggcgacggcgccgactctcacccaggttagccgggccgcactcttcgcgggcgtcgccgatccacgcttcggcgaccagggcaccgacaaggacgaggagcgctgggcctcgaacccgcacgtgcgcgaactcgtcggtgaggaacctctcaatgtgttctttcgacgcgagatccttgccggtcacgagctcaccgaggaggtgaagaaagcgattgcggacgacgagcgtgtcgtcgcggtgatcgtcaacgccgtcgacgaacagctcaagggcagcctccaggtcgccgtcgactacagtaaaacatccatccttccgcttgaggcattactctccgccgccggcggcgccgaaagagctgtgctgctcgtggcggatcacgggcatgccgctggcgacgcaatgcgcgtcgcgagcgggcgtatcccagttgggcgcgagggcggtgcccggtggcgtgcattggccgaaggggagcagccgcaggacggcgaagtgctcttgccgcgatcctcctggaagccgcgcggatcggctggcatcgccgcattgtgggacacgacgctcgcgaaccgcgcgcccaactatggcgagcacggcggcctctctctcgcagaggccgtagcgccggcatttctgattggtcccgagtggctggatcgcgtcgcggatgacgacgtcgagctgtcatgccgggtgctgcccgagcctgattggtgggcgctcaaaattgctcgtccggctaccgttccagtcgctccaatcaaggagccaaagacaccgaaggcgcagctcgagctccttcccgtggagcaggcaaagactcccatcgcgccgccagaggcgcccacagaacccacgctcgtcgcgcgtctgcgcacgtccaagctcttcacgctgcagatcgcgggtgtgccgaaggctgacgtcgagcgggtgctcacgtggctgaccgtgctcgtagacgcaggtggaagcatgactgccgccgactttgcgaggctctgcggcgtgcgcccccaccaagtgggcggcgtcgtggcgcggatgggtgttttgaacgctgacggcttcgcaatcgtcgagcacgatgtcgcaggccgccgagtcgtactgcacaaggcaagactgctatcgcagtttggagtgactgaatga

SEQ ID NO: 1699 - DNA, 2217 bp, Burkholderia thailandensis; identical to SEQ ID NO: 1335

SEQ ID NO: 1700 - DNA, 2706 bp, Planctomyces maris
atgacgcttacagccccgacattcagtcagatcaaagcacaggtcgcgacaatccagcagaaatcatcccgggccgacgtgattggtatccagtcatcaggacgctggagtgatgacacgcgcattcaggacggcgaccagacctacctgatctaccaatgcgattcccccctggcctgccgtattgccatcagggaaccggtggagaaaaaaacaaccaaagtgctgatcactggcctggatgagaacgaactcggcgatgatttacgctatcggctcgccaaacacaaactgttcaatatcgatccctggcagatggtctgttcccagttcaatgcccgcaatgtggatacgcggctgacgcatcacccctggctcgcggagaccctgctggaactgggatcccgccatggttttcctccggcgcggggcggttttctcgatgccgaatcggcctggtcgttcttactggaacatcagattcaactgcggggggaagcgcctgacctgacctcacttttgaaatggactctggaccacacagcgacacaacatttccgtcacagtactcctgaattccaggaagcaaccatcaagtggctcagtgaacaggcaggtcccgtcgcgcgattgattctgcaatgtgtgcagcaggagcaattccagcaggatcccctgccgatcggaatagccatgattgtcctgttccatcaagaggcccaaggcaaactggagaaagcgtgcggaaagttcgaaggacgatatttcaagaatcactccccagagccggaactgatgcagcgctggatttcgtccgcccgtgaggtagtccgttcactgcagcatgctgctcctaagcgacatcgccagattgttcagcgctcagatgagatcctgaaagaactctctgcagagaagtatgcctatctgagtcattcgtccctgctcggtttcgagcaacggttaattcgctttggcgaaaccctgtcggatatggtaagccggaactcctggagtgaaatcagtgtgctccaggaactgagcgagtctgtccggaaacatgatctggcgaaccaggatcctcgacagctggaacggctggagatgtcattgcgtctggtacgctggctgcgcgaagagagccagtctcaccaaaaggatccacagtcactgggagcggctgcccgcttccagctggaaacgggtggctttcttgactgggcacgtctccagttgcggcacggtgatgcggtagaagttttatcgcaggcctatctgcaactttttgagaaggtcacacaggtccgcgaacgacaggcacagcatgtttctcagttactggcggactggacttcagctggttcgaagggaaatgatgtcataccagtcgaacagatcctggaacagatcgtcgccccgctggctgcagaacagccagtgttgttaatcgtcattgacggcatgagtgtagccgtctgtcgtgaactactcagtaatctcactcgacacgagtgggtagcactggcagaaccgaatcaccgcttcaaccgtcccgccatggcagtgataccctctgtgaccgaattctcccggaccagcctgctgacaggaaaattgaaacagggaggtcaaaacgaagaaaaaaagggattccaaaatcaccctcaactcacaggcagcaacaaaaatgcacagcctccgctgctgtatcataaagcagggctgcagggacctgatcaaagtgatctggcgggagacctgcgaaaagaaatcgcttcttcacgaagtgtggtaggcgtcatagtgaatgccgtggatgataatttactcaaaggggaacagcttgatacgcgctggtctcgcgaacagatccaggtcctgcccaccctgttacacgaagcccgcaatgccagccgcctggtagtactagtcagcgatcatggtcatgtgctcgactgccagacacaacacagaccgggcaccgatgaaaccacgggaggcgaacgctggagaccggcaggtgtgtcaccgacagagggcgagacactgatttcaggcagtcgagtcttaagtgcagggcagaaactggtggccccctggagcgaacgcatccgctacaccatgaagaaaaacggttaccatggcggtctgtcaccacaggaaatgattgtgccgatcgtggtactgtccagtacagatgaaatcccgacgggctggagtgaacaacccatcgatacaccggcctggtgggatgaagttttacctgagatcgaagaaattaaaccggcagcgcccgccaaaccaaaacggaagccagtctccaaaacgccaatgctgtttaatgacctcgaagacgaaccggaaacatctgcccccgcagaagcaccagcagtacctgcgtggattcagagtttactgaaaagcccggtttttaaagatcagaaacgtctgggtggacgacatcttcccgatgatgccacctttacccgtctgctgcatgccctggaccgacgggagggaacaatgacactgcgagcactgacgcgcgcactcgaagcacctccaatgcgaatgcggggtatcctggcaaaaaccgaacgcgtgctgaacgtagacggttacgatgtcattcgctacgacgaaacatccgataccgtagagctccagcgtgatctgctactcaaacaatttggtctggaggactag

SEQ ID NO: 1701 - DNA, 2925 bp, Streptomyces gancidicus
atgacggacaccgtcgttgccgtcccgggtgcggtccggctgaacaccgcgaccgtcacccagtacctgtcctcccagccgtcccttgccgcctccctcacgggggacggcgaggccaggcgtcgggtcgtgctgctgcggtccgcaccgcagtgggacgggcccgccgagcccgtctggggtgagggccgcacggctggcgtggcggttgcgccgtccccgctcgccgtccacgaactcgtcctcgaccatctggcgggccgccgccccggccccgctgtgctggtcgtcctcaccgaccgggagcagaacgaactcgacccggcgatcctcgcccgcgtccacaagctccgcatcgacacggtcgacagctgggacgtcgtccgcgaggcgttcggcgcccggcagatagacccccggctcaaggacgtcaactgggccgccgaggctctgctcgacgccaccccgcccggcggctgggcggccgtgcccggcggctggctgtcccgccagtacgccctcaccgcgctcgcccagcgccgcatgcgcctgggccgctacgacaccgagggcggcacgcgccgccccggcgacgaccggctcgacgcccaggccctgctgcactggtcgacccgccccggagcccccgaacggctcctcgccctgcgcggtcccgaacgcgccggactgtccgccttcctcggcgaggaggaccaggcaggcctcgccggacgcgccctgctcgccctcgtcgacgccgagcgcggcgcggacgccgccgccttcggcctcgtctgcgcggcgctgtggcagcacgccgggcccgcccccgagacctaccgggcccgcggccgcgccgaacgctacttcggcgaccagcccccggcgaccggtgaccagctcgacgtcctggtgaccgtcttcggacgagccgccgaggagtacgtgaccacgctgctggcggccgggcaccacaccggtggcaccgacgccgatcaggcccgcgaagcacgccgcaccaccggcatcgtgctcgacagggcgtccgccctggcccggcagttcggcgcggaggacgccgtggcggcgagccccgtcctgcgcggtggactcgaagcccggttcaccgccgtcggtcagaccctcacgtcgggcgacaccgccgcggtggcggacgccgtccgccgcctggaggaccaccggctcgccgccgagtcggaagaggccccccgcatcgaacgcgcccgcatgggccagcgcctcgcccgctggctggccaccgacccgcccgcagaagcccccaccgtcgccgacgccatacagcggcacgtcgccgagaccggctgggtggacctcgccctggagcacatcgaggccggcggcgacccggatcccgtcctcaaggccgcctacgacaccctcggcacccgcgtcagggaccggcgccggcagatcgacgcgtccttcgcgcgctccctggcggcctggacggaggccgggacccagcccggctctatgctcaccgtcgagaccttcctcgaccgcgtggtcggcccggccgtgcgacgcggggaggaacggcgggtgctgctgctcgtgctcgacggtatgagcgcggccatcgcgaacgagctgggggaggaactgcgccgctactgggccgagttcgacccgctgcccgaaggcgacgctccgcgccgaagggcgatggccgccgccctgcccaccgtgacggccgtgtcccgcacctccctcttcgcgggcaccctgatgaagggcacccaggcggacgagaagcggctcttccccgcgctgaaactgtggggcggggcccgtgccgccgtgttccacaaggacgacctgcgcaccgagaccgcgggcgacaccttcggcccggcgctcacagaggcgctggccgacggcaggacccacgtcgccgtcgtcctcaacgccatcgacgaccggctcgccaaggagcagaagctcggcgacggcgcctggcggatcgacgacgtgcccggcctgcgcgacctgctgcgggccgcggccaccgagggcatggcggtcgtcctcaccagcgaccacggccacgtcgtggaccggcacggcacgaaggtcgacaccgccgccgaccccgcctccgcccgccaccgcctgcccggcggcggcccgctcggggaacgcgagatcgccctgtccgggccgcgcgtggtctggcccgaacccggcgcgtccgtcgtcgtcctgtgggacgccgattcccgctacaccgccctcaaggccggctaccacggcggggcgtcgctcgccgaggtcaccatcccggtgctggccttcctgccgttcggcgcggagccgcccaagggatggcgggaactgggcgaccaacggccggcctggtgggcgccggaggagaccgggaaggcaccgctgctggacggccatgccgctcggccggtggccgcgatggctcccgctccccggaagccgtcggcgaaggccaagaaggctcaggcagaagtcgcccgcatgcaccacggcgagctcttcgacgtggcgctgaccaccgggggagacgacgccctgctcaccccgaccctcgtctcccgcaccgagacgctcgtgacgacactgctcgactcggagacgtaccaggcgcagctcggaggactcgcccgcaagccgcagcaggagcaggtccacaaggcactcgccgctctgctggacgcaggcggcaccctgcccgtgaccgcgctcgcccaacgcgccggcatgcccgtcacccgcggtgacggcttcgccgccgtcctgcggcaactcctcaactacgacggcgtacaggtcctggaaaccctgccggacggccgcacgctacggctccacgaggcgcttctgcgggaacagttcgcccttcgagcgggctga

SEQ ID NO: 1702 - DNA, 2820 bp, Gordonia amicalis
gtgacagctgcgactggactgcccgaagcggacctcgcagcgatccgcggtttgatccgcgatctgcgggtcaagaatcacacccgaggtgtgattgctgtggcagccgtaccccaatggtcgggcgaaggcgagttctcggtggacgggcaacggatacgcgtccgtactgcgcctagtgtcctcgcaatccgcgacgcgatcaccaatcgtcgcgaagtcgattgggtggtgattctcactgatcgtgatgcgtctgagctacctgcaggtgtactcgagcatctgacaggaaaccgactgtcgaacttcgacccgttcccaatgctgcgtgatgccttcgcagcctcccagcacgagttccggttactcgatctcgatacccgcgcagcgcgggcggtgctccgcgagctgggtgacaccaccacgccggcgccgggcggtgtactcaccaacgaacatgtgtttgccacgctggcgaaactcaagttcggccttgatcccgtcgagttcacaccgcaccacgtagccctgtggtcgatcgacgtatctcggacccaacgattcgacacttggtcaaagaccaccgaaccggcgctgcttgaacagttttacgcgtggatctcagcccgtctgggaacagtcggcccactcttcaccaccgtctggcgggtgaacggcccggaacacatcgtcccgctcggtatggtcgctgcgttgctgtccgattcggcgaaagccgccgcctcgtttcccgcgaccgccgacgtgatcgtcgaggttcgtactcggctgaagctggaactcggcgacaacgtctactccgagcaacagctggcaacgtggggcaacgtggctacgctcgcggtcaccgccgcggaagaccccacagccgcgttgacgcgagctgagtctttcgtgacgaaactacatgcatcgcccctggttgcccggtccgatgtcctgtcgtccgcgctcgcgccgcgcataaagcacttcgccggcgcactcgcgacgtcgatagacagcgacgatctcgctccagccgaaaacgcgtgggccgatgtccttgcacatcgcgatgcacgagccgacacctccgacgctccgcgagacgtccaggttggtgcggccgcgcttcgactgcttcgtcgactccgagcaccctggcagcagcccaccacgctggcggactggttacaagaacatcgaaccgacctctcgtgggtagacagcgccgtcaacaatgcattcgtcggtgccaccgacccacaacttgccgcggtggcacacaaactcgtcacggagattcgcgagaagcgcgcagccctcgatcgcagtttcgcccgcatgctggcggcggccggtacccatcgcgaaagtggaacgggcgcaccgctctacatcgaggacgtcctcgaccagatcgtgaagccgctgactgctcctgtttcgggcccaaccggtctgggtgcacacgaagcgcaggcgtcacctgtgctcgtcgtcgtagcggatggtatggatgctgcgacgtcccatgatgttgttgctgacgcactgcgtcgtcaccgcccgcaatggcaggactgtcgattcaccggagcagacggaccacatactgcccttgccacactgcctacagtcaccaagttctcgcgctgctcgttgctgaccggagcgcttgccgcggggacgcaggatgtcgagcgaaccggattttcgaattggttgcagcacaacgggttacgtggaactggccaagtgcttttccacaaggccgatctcgaagcggtggcgcaaggtcacgcgttggccgtcgacgtccgaacagcagttgaagataccgatgaccgtccagtcgtcgcgtgcatactcaacgacatcgacgacgccctcgatcgttccgatccgatcggaacatcctggaccacatcaacttttaagcgactcgacgcactactcgcgacagcggcgacggtgggccgcaccgtggtgctgctcagtgaccacgggcacgttgtcgagcgccgagaacaagcaagcaaacaacgcgggcagcaaatctccgcacggtataggtccgcagtcagtgtcgatggcgcctccctgcctgccgacgaggttcttgtcgaaggtcaacgtgttctcaccgaggatcaccgcgcggtgcttgctgttgatgaacagctgcggtacaccgggctcaaagctggctaccacggcggtgcgacacttgcagaggccgtgatccctatatcgattctcgtgaacggtacggtctcggttgacgggtacgtgtccagacacctagggctggaagcggcaccgaacccccaaccatcctggtggacgccagcgcgcatcacgtccgcacccgttacgcaggtacacgtatctgcaccgaccgcgacgaagaagaaagctgcgaccaagatgccgcaagttgataccttgttcgacgtcggtgaacctgaatctctggtggcgtccccggactcgtcgccaactgaaggccatgaccaggttgccaagctcttgaccagcgcgctgttcaaggaacagttcaagctgtatggaaggcgaatgtctacagacgctattggaactctgcttcgcgagacgatcgccgggggtggtgtgcttaccttgccccgtgccggagaaattcttggcgtcaaggcatctcgcgccaacagctcggtacaggtagttgcccagattttcaacaccgatggcgtcatagtgctcacagtcaacggtggtgagctcgcgctcgaagccccactgatgttcgagcagttccaggtgaaggcatga

SEQ ID NO: 1703 - DNA, 1440 bp, Mycobacterium intracellulare
gtggacgaagaaccgctgtcgcatggccttcgggcggtacttgaggcagtccggttgcgtcgcgacaaccacgacagggagttcgccacgagcttggcgctccagaccatcggcagttccacattgcccgaggacatcctcctcatcgaggatctactcgcggacgtggtcgtcccgctggccaaggaacctcgaccagtcctacttatcgtcgccgacggcatgagcgccgctgtcgccaccgagattatcgacgatgtggagcgtcgctacgacacgtggcttgagtgcttgcccaggggaaaggcacggcgcagcgtggcggtatcagcgcttccgtcacttacgaaagtatcccggtgcagtttgttgtccgggatgctcgcaaccggccagcaggacgccgaacgcaacggttttgcgtcgttcatgcgggctcatggactaaccagtgctctgttccataagcttcggctcgaaacttcaggagctggctttgcgctgtcaccggaagttggcacggctgtcgatgacatcgcgggcaccggcgtcgtggcatgtgttttgaacaccatcgacgatgcactcgatcgttcggacccgggcatcgactggacaactgacgccgtctcccacctacggcctttactggaacgcgcacggcgggcgggtcgagcagtagtcctcacttcagatcacggccatgtcatcgagcgccgcgaagggcggatgctttcggttggagcagtttccagtaaccgttcacgaccagcggagggcggtccagaaccggaactcggcgaggtccgcgtcactggcacccgtgtgcttatgcacaacggtgatgccgtgttggctgtcgacgaaagactacgatacggcccgttgaaggccggctaccacggaggcgcagcgcccgccgaggtcgtcgtaccgctgcacatcctgacacccaacgaacccccgaccggatgggcactcgcgacgcctcaacaaccgctgtggtggcactcctcagtaatggcagacgcagtcgggcgcgcagagacaccacccgtgccactgcaccggttcccgaagactgaaaggcccacgctattcgacgatttcgaccaacccgctgcgggagacctggcagcgcaagttcttgcttccgagaccttcgccgagcagcgtaagcgcgcccagcgtgttactttgtccaatcagcagatcggctcacttattcggcacctcgtggccgctcctgggaaccgtatcgaccaagcaaccgcctcaatcgcgctcgacgtcccactcgtgcgattgagcggcgcgctaccgatggctcaaaggctgctcaacgtggagcagtatccagttcttgaccgcgatgcagacggcgtgacagtcgtgcttgacctagatctactcaaagaacagttcggactgagcggatga

SEQ ID NO: 1704 - DNA, 2676 bp, Phaeospirillum molischianum
gtgacggttggcgccctttccccccagcgcatcgtcggccaggtcgattgggtcctgaagaagcggcgtgatgcccgttttatcgccatccgttcgccgtcccgtggggcttggccaccgcacctggattgcggtgaacgccgtttccagatccggtggtgcagttctcccctggaaatgcgcgaagtgctttccgaaacgacggaggacggtgtcgtcatcctaaccgacttgcaggagacggatctgggcggcgatgtcctcgcccgactgtgtctggaaaggctgttctctatcgagagctggcgcatgttgggagatgcctttcaggcaaggaaacttgatccccggctgcgggggtgcgactggatggccgacctgctgctggaatatcgtccgcccgagggctatgccccagtacccggcggcattctcgatgccgacaccgcgtggcgaacattgctgtcctccgtgctgggtattgccgaggcacggccggatatcgaaacgctgctgcactggacggtcgtggacgatgggccataccggttcgtgcggttgcccgatgctgcacaaaaggggattgccggttatctgcgtggtgtctgcggcgcggctggtgaactgatcattgacaccctcttggcaggaaatggcggtgaggcggtcgcactcggcctggtctgcgaggtggtgtttagcgacggctggacaaattccgatttgctctctgctgcggtccggctggagccattggtgggacgatcccaaattcccgccccggcggctcgtctttgggcgcaggccgccatccgcgtagctcggaagcagccgcaattctcacgcgtgatttttcagcaggcagaagatgttctccggggtatccatgcctttgatcatgttgttcatagcagcatgctccccgcagcgttcgatgttcgactcagtgaggcggctgcagccatcggacccgtcctgaccggaggggggagtggggaagccatggtccgcgccgagcaggctgcatttcgtgtcttcgagcaccaccaagcggcgctgcagcccctgcggggcgaacgcctgcgaatggcattgcggctgctgcgttgggttgctgcgaccaacgcgagcgaggcatcaaattttgaggatatcgcgctcgcctatgtggctgaaggcagctttgtcgactgggctcgcacggctctgctgggcggggatgaccttgcaccggtttccgctgtttatgtccgtctcgctcaggaaatccgggcgaggcgggaacgccagaaccaggctttcgcatcggcgcttgtccagtggaacaggcaagccagtcccgtccggtctctgacccctgttgaagccatcttggatcgcgtggttgtgagcgcggcatcctcggcgccagtgctgttgctgttgctcgatggcatgagtttcccggtgttccgccagcttgccggggatctggcggatgaggggtggaacgaattggccgtggatggtgccccgcttcacgcggcagtctcgatcattccgacggtcaccgaggtggcccgggcgagcctgctctgtggcaggatatgccaaggcgcggctaacgttgagaagagcgggttcgcaaaccaccccggccttatgcggattaccaagagcggcccggcaccgatcctatttcacaagggtgaactcagcaatggtggggcactggccgacgtggtgcgcgctgcgctagccgatgcccgccatcgcgtcgtcgctatcgtctataatgccgtcgacgatcatctgtcgggtgccgatcaggcacggccacggtggtcgttggatgatatgcagttgcttcgccccattttccacgaggcgagaaatgccggtcgcatggtcgtgatgacggcggaccacgggcatgtgctggaggacggcagtcgacaagctggcaaagggacgggtgatcggtggcgccctatggatgttaccgctgacggagaaatggcgtttgcgggcgcgcgcgtcctctcgcccgacggagccaaggaggtgctggttccatggagtgagttgctccggtatggcgcgaagaaggccggataccacggtggtgcaacacctcaggaggtgcttgtacctctagctgtcttctctgccgccaatgacgctcccctctgggagttttcccctccggccacccctgaatggtggaattcggtgccgttgtcgatggaagtgccgacgcccaagccaacagcagaaatacgccgtcgacccaagaaaggaccacttgcggccagccaaccgaccctgttctcggagcagcctccccccaatccgacattgccggaaagcgggtctccatcccctgacgctggctggatcggtaggctgatgacctgcgagatctacgaggctcagtgcaaactggctggcaagggagcggcccgcaacgaggacgttcgcgccgtacttgcggccctggaagcacggggtcggttgccgcggaccgcgctggcgcggcagatcggaattcctcttttccgcctaaacggcctgctgtccaatgtccgccgcctcatcaacgtcgatcagtcccccatccttgtggtggacgatacgggagactgggtcgaacttgatgtgaggcaactcgccgctcagtttgagatcaaggtgtga

SEQ ID NO: 1705 - DNA, 2595 bp, Nitrococcus mobilis
gtgagcctgacgccgacgcaattggcaacgcatgccgccaaggccctacagcaggccaccggccccgtcactctggcgtaccactggccgcagccctggaacggcggggatagcatcgtggtcgatggccaaacgttgccgctgcgccattgcgtatcgccgctggaaatccgtgaagcgctggctgaagccagcgatgtgtcacgcgtgctgctggtatcgcagcaggaaaccgggctggggcaggacgtgcttgctcgagtgttccgtcatcgcttgctgcacgtggaccgctggcaactggtgcaggagatctacggcgtgtgccagatcgacccgcgcctgttcggcatgacctggctgccggacgcgctgctcgccgccgcaccggcgcgccgtaccacagccgctgccgcgctgacgctcgacgaggccatgagcacgtgtcttgcgccggtgctgggcaccggcgctgcccaaattgatctggaaagactgctgcacgcctgtgaggacagcggccaacgttgggccgagctgggcgccgaagcgcgcgagcaatttcgccactttttggtgaatcgactcggggcgctggccgacgccttgctgcgcacgctggatgccggcaacggtcacgccgcgctcggcatcggcctcgcctgcgaggtgctgtactcgccccatgccgcgcagcaactggggctgcgcgatgcgcgggtacggctggaacagcgtctcgatggcttgcgtcttaaggacgacgccggccggcagtgggccgaactgtcgcaacgggccatactgcagcgcgatacgctgcagcggcaggaggatttccggttggcgatggagctgctcgagtggctcggcgcggccgacttcatcggcttgagctccctgcttccgcaagcattggaccgacgcctggcggacctgggaaaggccgtgacgagcttcatgcgttcacccgccaccttgcctgatgtcgaagcggcctctcagcgggtgttggatcatcggctgccgccggccgaccacccgggtccggaatgcgcgcgcatgctcgcccggctgtgccgttacgaagccagcctgtccacggccgaaccggctgcggatccggttgcggactacctcacccacggcgcctgggaggattgggtgcgccgatcgctgcgcggcgcgcgcccggaggcattggcacgggcggtagcacgcctgcttgaccgcgtctcccaacgccgcacgagcggcgaccgtgcattcgccgaaaagctggcgcaggccacggctgccgacgaaacgccccgcgctctgttgccgatcgaatcggcattgtcttttgtggtagcgccgctggcgcaacataaccccgtggtattggtcgtgctggacggaatgagccaggacgtttacctggccattgccgagacgatggcccatcgcggctggtgcgcttggagccgacccaggcaaccacgcgcgctgttggccaccattccatcggtgaccgaatgcagtcgcgccagcctgcttgccggccgccttgcgcgtggtggcgccgcgcaggaaaggcaggctttcgccaggcacgaggatttgcgccaggcctcacgcgccggtaagccgcctctgctattgcacaaagcgggactggagcaaagccatcagctgagcgctgcggcggtggaagccctgagtgatcccgagcagcgtatcgtggctgtggtgatcaatgccatcgatgacgccctggccaagtccgagcaagtgcgcatcgattggacgctggaatcgatcccgctgctcgccgcggtattggagcaggcgcggcgcggcgggcgaacggtcgtactgaccgccgatcacggccatgtgctggagcgtcagagcacgctgcgtggcaacggtgagggtgagcgctggcgacgtcccggcaaccctcccgaagacggtgagatcctcatgtccggcccgcgtgttagcaccttgatgggtgagccgctggtggctccgtggtcggaacagatccgctatggcgtaaagaagaacggctatcacggcggtgtggcccggcaggagatgctggtgccgttgggcctgtggacagcggatgcggcgccgccgcgcagcgacgcggacgagctggttgccgccgtcccgatggcacctgagtggtggaatgcgacagacgatggcgccaccgccgcgccgccgcgtccagccaaacggcgtgggcgctgcgtaaggccaccaatcgatgacctgttcgccacctcggcacccagcgcctggttggatgatcttctgcaaagcccgcagctcgccaggcagcgccaacgcgccgggcgcatggcgttacaggaggcgcgtttatgcgcgctgttgacatacctcgatgagcacggcggtcgcgccggcatcgatcaactggccgcggcgatcgagcaaccgcgattgcgcatgcgcggcatcgtctcagcgatggaacgcatgctcaacatcgatggcttcccggtgatcacgcttgagcaaggcagcggtacggtgctgctggatatcgagctgttgaaaaagcaatttctggcatga

SEQ ID NO: 1706 - DNA, 3378 bp, Frankia sp.
gtgaccgttctgccctcctcgtcatccgccgggcacgccgccccgagtggcatgtccggtgccggtgccccgcgggtcaccccggccatcgtgctgggccgggtcgcccggctgcggcgcggcgggcacagcgatcaccgtgaccagccgcgggtgctgctcgtccgggcccggcccgagtggtccggacccgccgacctcgacctcggcggccgaccggtccgggtggtggcgtgcgtgtcgcccctcgcggtgctcgaggaggtcgtccgctggacgcacgcccccgtcgaggacggctggctggtgctgctcaccgacgccgacgaggagtcgctgggagactcgctgctcgcgcaggtccaccggcagcgggtcgacgtcatcgagccgtggctcgccgtcctggaggacttcggggccacccaggccgacccgcggctgcgggcccccgagtaccgctgggtcgctccggcgctgctggaggcccggcccgcggccggctggccgcgccggcccggtggtctgctcggccgggaggacgcgctggccgagctggccgccgcccgactcggcctcaccgagctgggcctgggcgccgccgacctggacatcgccaccctgctgcgctggacgacgacgcccggcgcgaccgcggcgctcggccggctcggtgacgacgaacgcgccggcgtcaccagatatctggtggaacgcaccggccgcgccgggcaggcgctgttcacgctgacagctgccggcaacggggaccgggctcttgccctcggcctggtctgcgactgcctgtggccccgtccgcagccagcgcaacgcggttccgcggaaccgcccgccgggacgtcgggcccaggtgccggacctggctcgggtgcgggtgcgggtgcggtcgagcgcgtggttgagcgggcccgggttcgggtggagcgctacttcggagatgtgcttctcgacgacgtgaccatgcgggcgttcgccgacgccgtccacgaggtggtgacgacggcgctgctcaccgcccgcccgggcgccggcagcctcggcgtcggcgcggccggtgggaggggtgccaccgaggacgcctcggtgacgctgcacccggacgacggcgtgccggcgctgctcgacacggccgaccggctgctcggtgacctggatgcccgcgccgcgggcgctgccagcgacatcctgcggtccgggttcgaccatcggctgggcatggtcgccggcgccgtccgggactttctcgccgcggcggagtccggcgtccaccgttcgctgctcgcgagggcggcccgcgacgtcatgaccgccgtcgggtcgttgcgcggacatctgctggctggcctgaatcgtcccgaggtggaacgggcggcgatggccgcccggctcgtcggctggctcgccacccagcccaccggctcgctcaccaccaccggcgcgcctgccaccggcgcgactgccgggccgacgtcgctggccgcggccctcgacgcgcacctcgacgacggtgcctgggccgacatcgcgctcagccatctcgccgccggcacgcccgcacccgtggtcggctcggcgtacggtgatctctacctggtggtggcacgccgccgccgcgccctcgacgcggctttcgcgcggctgctcgcccagtggaccaccaccggccggccggcaccggcggtgcagccggtgccggcggggccggcggcgccgctgtgtgtcgaggacgtgctcgaccgggtggtcaggccggtcgtgaccgcccgcggcggccgcgcgcttctgctcgtgctcgacgggatgagcgccgccgtcgccgcccagctcgccgccgagctgcgcagggagcgttgggaggaatgcgacccgctgggcctgccggaagccgatcccgccggctcggcgcgccggcgggcagccctcgccgtgctcccgaccgtcaccaccacctcgcggacgtcgctgctcgccggccggctggtcaccggggacaagacgacggagaagaccgagttcgagaaccatccacgctggggccgccggcccaccagtctgtttcaccacgccgacctggccggcgcgcccggcgtcgctctcgacggggcgctcaccgacgcactgacctcggacatcccgctcgtcgcggtggtcatcaacacgatcgacgacatgctcgaccggggccggccgcacgacgacggcggttggagcctggcggacgtcggccggctgcgcgcggtgctcggctacgcccgcaccgccgggcgggccgtcatcctgaccagcgaccacggccatgtcgtcgaccaccgtgccgaacggctgacccccgccgctgacgccgagatcctgtcggcccgccaccgtgcctgcgccccgggtgaaggcgaaggcgtcgcggccgaggtgctgctcgccgggccacgggtgctcgcacccggtgggcggatcgtcgcgctgtgggatcccgacacgcactacctgggccgccacggcggatatcacggtggggcgtcgcccgcggaggtgaccgtgcccgtactggcgttcctgccattccgcctctccgcggcgtcgacgaaccgtcacctgccgcccggctggcgcccgctgcccgaccagcgtccccgctggtggtccttggagacgacggacctgctcggcggcctggacagcctcgccggtggcgagacggtgctgctcgggcggcccgcctcgtccgctgcccttgctgcctccgctgcttctgccgccacggcggccgacggtggcgcggaggcaacggtcgccctgccccgcaaacggcgccggccggcggaggaacagaccggcccggcgttgttcgacctgcctgcggcggcgaccgggggaccctcggcccgcccttcggctgatccggcagctggcggcgctccggagccaggcgctcggatgcccggcggcgcggtggccggtgcttcggtgcccggcggtgcggcggctgacgaggcggtcgccctcggagcaacgggcaggcctggggcgggtggcgggcccgcggacccgatcgacgttctcgtcgccgggctgctcgcgtccgagctgttccgctcccagctcgacggactggcccgcaaggtgccggtggagaaggtggaggccgcggtgcgggcgctgctcggcgcgaacggcaccctggcgacgtccgtcgtcgccgcacgggccggtgagcgccccgtgcgggccggcgggttcgccgtcaccctgcggcgcctgttcaacatcgacaactatccggtgctggagccgatcgacgacggccacaccctgcgcctcaacgtcgacctgctgcgcgcccagttcgggctggcggtatga

SEQ ID NO: 1707 - DNA, 2790 bp, Pseudomonas stutzeri
atgtcgatcatgcaggcgagcgcgacattgccgatgccggtggtgacccaactgcaggcagtttttcagcgtgacgctgaggctgactgcgtggcattagtgtggccaaaccctttagcggctttagctgtagagcaagttgttgaagggcggaaagtcagggccatctactgcgtctctgagttggcgatgcgagaggccttggtcaagcatcaacaagatcgaaaggaaacctccgagcgtcttgtgctgctgtccggctttgccgagacggatctagctatggatgtgctggccagaatttggcgcaacgagccgcagcggataagcccttggaagaccctgcagcaactaattcgtgtcagggacatagatcctcgtctaacacgcaagcagagccgttgggtggctgaggcgatgctcaatggtgttgaacgctatcaggggaaaatcagcttcggagagattctggatgaggagacagcctggcgctctatcgccatggctcatctgaactaccaagaagccacgttggatctgcagtcggtgttgagctggagcactaagggtgatgtcagtgcactgattacggctctgccaggcgatattcgagacaaccttggggattggttggcccgcggcctgcccgacactcatgaggtggtatcgacgctgcttctgaatgatcaggggagtgatctgctcgccgtcgccttggcgtgctccgtgctgttttcctcggacattgaacgtctgcaagcgcttgatttaacccagctgtatatcagtcgtgggattttccgtgagcgctttttgggtgggaagaagatcgaattccgagtcctgcagccactgggtgaggtcgcagttgccctggtcaggcaatggataggtgctctcggtttccctagctatgcacgcttcttgtcgaaagcagagcagattcttgcaagcttggatatgcaggctgccgccgagcattcctcgctgttgccttgcggtttacatgctcgctttagcgcttttgcttctgccttggatcaagctctggatggtggcgactccatggctgcggatttcgctctgcagcagatagaggggcatcgactggctggtttggatcgctacagcgagacagttgctcgggccaatatggccatgcgccttctacgttggctcaagcaggcgccgaacgtggacggaacagcagttagcctgatcggtgattacatcgagcaaggtggtttttgtgattgggcacgaaccgaaatttgggcgggagatgctgaggagtccctgagtacggtttaccagaggctctcgcagcacgttgggcgttacagggaacggcaaaaccaggctttcgggcagcaactggcaagcatcgctcgcggtgatcatctgcctgctcgattcattcctgtcgagcgcggcctggatgatctggttgcaccattggccgagcaggggcaagtgcttttgcttgtgctggatgggatgagcgaagccgtctaccggcagttaagttcagacctcacccgtaatcattggttggagctacagcccgttggcgcacagggcgatgcatgtctggttgcagccttgccaacggtgactcaggtcagccgttgctcgctgatatcaggggctctgtgtgagggcaatgccaacgacgagaagaaagctttcagtagccaccctcagctaaaaaagctggcctccaccaagtttccaccgcaagtgttccataagcaggatttgtcccagcctggatctggcagtttgcatagcagcgttcgcggggtaattgctggtacagagcaccgagttctggcggtggtgatcaatgcgatcgatgatcagctgtccagtagctcgcaagttaaggttgactggtcctttgaaaccgtggccttactccggcatgtgatggaggctgctcgcgaggctggccgtgtggtgatcattaccagtgatcacggtcacgtgctggatcatgattcggtttaccagcagtcagccgacgaaaacggtgagcgctatcagccggttgctcccggcatcacgccctctgagctggaagtcctgttgtcgggggagcgtgtcgtcacggcgaataaacaggtgatcctgccttggtcagagcggctgcgttataccaaaagtaggagccatggctaccacggtggtggttcgctccaggaggttgtgataccgcttggggtctatatcaatgccgccacgcggcaaagggtagaaggctggcgtgaggtgcctcgacgactgccagcctggtggtattcgacgaaggccattcagtcagacacgccgagcgcggttgatgagcccaccgtatctgtcgaagcacccaccaagaaagcagctggcaagaagcaggctgtggctgaggttgtcgaggacatgttcggctttgcatcgccagcgaaagccttgagcaaaagcgctccggtggtaggtacaagcgattgggtttctgagttgctcagttcgccggtctatggccaagttcgcgatagggcaggccgcacagcgatcagcgatgaccaaatgcagacgctgctgaggctgatggaaaagtaccgctggcaggttatggaggcggtgctttgttccgagttgatgatcccgaaactgcggatccgtgggttcctcgcgggagcacagaaactgctcaatgtggatggatatccaatactttcagtcgaacgtgattcccagacagtccgtttgaacgttgcagatctgaagaagcagtttgaaattcaataa

SEQ ID NO: 1708 - DNA, 2910 bp, Dietzia cinnamea
gtgaccacggccagtgcaggggttgcggggggagccacctcgtcgtcgtccctcggtacggcgaccgccgccgacctcattccactcctccacggcctctaccgggacaagcagcacaagcgcggtttactggtgatgcacgcccgtcccgaatgggacggcaccgagctgcgcgtcgacgacctcaccgtgccggtccactgctgccggactgtgctggagatccgggacgtggtgcggcaccgcaaggattccgaggtgccgtggcgcgtcgtgctcaccgacctccccgaggagcagattccccagggagttaaggagcacttccaaccgctcgggcgcatgcgggagctcgaccccgtgggcaccctgctcgggatgttctccgccgacaagaccgacggccgcatcccccgagggcgggacgacgtccgggggctcacgaccgcgctggccgaccaccgcgacaccctcgcccccaccccgactccggtcctcaccgccgaccacctctacgggtccatcagcacgctcgtgctgggtctggaacaggactaccggctcgcggaccttctggcctggagcgccacccccgacgcccacgccgcgtgggacgagctggcctcgcggctcacatctaacgtccgcgcggggctcatcacgtggctgtgccgcacgttcacgttgaccggccccgggatccgcagcctgtgggccaagagcgggccacggtcgctcctgcccgccggcctggcagcagagaccctccgcacgcccgactggcaggacacacccaccgaactcaccggagcgcgtgccctgttcagccaccacatcggcgccacactcggcgaccagtccctgcgcgaatgggggtccgccgccgccaaggccgtccgcacctcactcgatcacgggcagccgctcaccgccgtactcggcgaggcccaccggttgatcaccggattcgagcagaacggcggcgcctccctcctcgccggatccaccgtcctgcccggcgccttccaacgacgcctcgacgtgtacgcacgcggcctgaccaccgccctcgacggagggagcgagaccgcgttgttgcgggggctcgaagcgctgcgggcgcacgtcgaagccgagcgctcccggcccgatgacctcgagaccgccgccgctctggtccggctccaccggtggaaccggaccgaggccacggccgtggccgaccggatgcgttccgccggtcacgtcgaggcgatgcgcgcgtacgttgacgagctgagctgggtggaccgggccgtcaactcggcgtggcgtggattcaccgccgatcccaagcccgcgatcgggcagtctgcggcggaccccgacgcgctcggtcgtcgcgtcctcgaccgcaccctcgccgtacgacgcgacatcgatcggaccttcgctgcgctcgtcggtgcgcgacttgccgaccggtccaccgccggcggcgctctgctcgtggaggacgtgctggacagggtcgtcgcgcccctgcgtaagtccgggccggtcgagtccggtcaacggagtgagcgggcgctgctcgtagtggtgatcgatggcctttccgtggccgccgcgcacgggctcctcgaggacgtggccgcacgtcacgccaccgtctggcagcggctcgacttggcctccctcggactcgacgtggccgcctccgccctgccgtcggtgaccaccgcgtcccggacctccctgctcagcggagagctggccctcggcgggcagcaggaggagcggacagggttcgccgccctgttccccgcccacccctcggtcagcgacgggccgctgttccacaaggcagacctcgacgcgagcatcggcgataccgtccgcagcgccatctacgacaccaagcacgtccccgtggtgggcgcggtgctcaacaccgtcgacgacgccctcgaccggtccgaccccatcgccaccacctggaccacctcgcgcatcacccacctagacaagctgctcgactacgcccgcgccgtcggacgagacgtggtcctgctctccgaccacggacacgtggtcgaacgcagtcgaatcggcaaggtcaccgccgacggcgccgtgagcgcccgctggcggcccgccaccgggggccccgccggggagaacgagcggtacgtctccggtgaccggatcctcgcgccaggtgtcgacggcacaccccggcacgaggcgatcctggccgtggacgaggacctgcgctacaccggcaagaaggccggctaccacggcggcgcctcccccgccgaggtctgcgcgcccgtcgccgtcctggtccagagtctcgacgggctcggagaggactcgccgttccccgctgggccgcccgtccaggacccgtggcccgcgtggtggccgctcgcgacggcgacctcgaccgttgctgaggccaagacggccgtggggcagcccgccgcaggacgggccgagcagccgaccgcgccgacaccctccacgcgccgcgccgcgcagagagacgccaaccaggtctcgctgttcgagtcgctcgacgccgatgagccgcctgtttccccgactcccgaccggtcgcggaagcccgccgataagtttgcggatctgagccgtagcccgtacttcaaggaccgggtcaaaacgcaacagctcaagcccactccacgcgaggtggcggacgtgctgcgcgaagtcgccgccaacaacggccgcatgcccgtcgcagtgctcggcaacttgctagggctcaatgcgcttcaagtcagcggcaccatcgcgaggatccagaaggtggtcaacgtcgacggcatgccggtcctcgagcgcgaggacaacgatgtggtgctgacgacccagaccctctttgagcagttcggactgtag

SEQ ID NO: 1709 - DNA, 2523 bp, Eubacterium saburreum
atggcagaattaaacctgaaacaaattatagaccgcctgaatgcggaatttaccggggagacccggaaactggttttttggtacgatgacaaggcggaatttgccgaggacatggagacggtggagcttcagaatgcgaagatttaccatctccagccggataaccagttctatacaaagtattttctggagcgtgttgataagaccacgaattatctgatctatgcaccgttccccaaaccggatgtaagggataaccatctggaagacacttgtgcttattccagacggttctttgctgaccgtgcatccctgctgtcggttgacctgggtattgaggaaaagtacaagccggttattgagaagcacatcaagtttttcgccaacaaggagcgtactcagcggttctatgatctggaaattgagaactttaatgaagaaaatatacttgtcggcctgctgagtgccgtctgcaaggcacgtacctgctcttttgaggaagttgtgcgcatcgtgttaacggatggtgagctggcggacaatgctctcttgcaggagtttgaaaaatacgatctgctgtctgcgttctggcagctttgtgagcagcattttggttacaccgatacaaaaccgagtttggaacggcttctggtgacgttgttcgttacttataccgggcgatatgtgcatgcagagtttccggcagcatggaagagctttgtctcctacaagtccggtaatatcatcgcatttctcgatagccttatgaacagcgtcctgtaccgggacaaatacgatgctctgtcggcacatgttaccaaagggctgaatgttcttttggcatttgcaggaatgcgagtggacgatttggtggagtgcgacactttccttgctgtggatcaggtgctggtaaagtggctcattggcagacttgtttcggaagacattggtgcaatcgcaaacggacttaccattccggaactttgtgaaaaacgggtcaaaatgcactttggcagaaagacagggaagacctatcagatgctttccagtgcgtgcagcatggtgaaggaagcggattaccatgccgcagatggcttaaagccaatcatcgaccgatatcttgctgcggattacaatatggatcggcagtatcggaaattctactattattacgaccagctggagagtacagaaagctttgaaccgcttcgggaattggtagaaaatatctacacgaacgaatatctggcttgcctgctccctgcctggaatgctggaatccagacagacggcgcattttctgcaattccgttgcagcgtgagttttacaatgccaatttgcgctataccaaggaacgcaccgtggtcatcatttcggatgccatgcgttacgaggtcggacaagagttgtttgcccgaatgcaggatgacccgaaatgcacggcaaaactttctgtacaactaagtgttctgccgtcttatacaaggctcggcatggcagcacttttgccgcataagacgctggagatgacggatgactttcaggtactggcagatggtatcctttgcgatgatctggccggtcggcagcaggtgctgcaaagctataacccggatagtgtctgtgtacagttcgatgatatcaaaaatttgaaagtggcagagttgcgagatgtgctgacaaaacgtcagattatctatgtatatcataatcagattgatgcgcgcggagacaaggcaaacactgaggatgaggtatttaatgcgtgtgaggaagccgttcaggaaattatggatttgattcatcgaatctccgtcagtggcaacacctatcattttatcgtcactgccgatcatggctttatttacaagcgtgataagctgacagaaagtgacaagatttctgggaaaagcgcggaaaaagcatttgtcaatcgcagatttattgtgtccaaggcggcactggaagatgacggcatcgaccatatgggcatgggacgcgttctggggaatgaggacagcaaggtggtgtcctatcctgtcagcagcaatgtctttaaggtggccggaggcggtgcgaacttcgtgcatggcggttcctcaccgcaggaaatgctggtgccggtgctggagtttaagatggagcgcggtcacatggaaacaaagaatgcagagatcgcgctggtcagcatcgtccataagattacgaacttgatcacgtccatggactttatccagtcggatgccgtcagtgatactgtaaaagcggcaaaataccgcattttcttcctctcggaggacaatgagaaaatctcgaacgaaaacagttatgtggcggacagtcgtgaggaaaatgcacagaagcgtatcttccggatgcggttcacattcaaaaataagaaatacgacaaggacaagcagtattaccttgtggtttatgacgaagaaagcggtctggagcagtggaggcagcatgtcatcatggacattgcctttgcagatgactttggattcggattctga

SEQ ID NO: 1710 - DNA, 2304 bp, Vibrio cholerae; identical to SEQ ID NO: 1292

SEQ ID NO: 1711 - DNA, 2523 bp, Eubacterium saburreum
atggcagaattgaacctgaaacaaattatagaccgcctgaatgcggaatttaccggggagacccggaaactggttttctggtacgatgacaaggcagaatttgccgaggatatggagacagtggagcttcagaatgcgaagatctaccatctccagccggataaccagttctatacaaagtattttctggagcgtgtggataagaccacgaattatctgatctatgcaccgtttctgaagccggatgtaagggacaaccatctggaagacacttgtgcttattccagacggttctttgccgaccgagcctccttgctgtctgttgacctgggtatcgaggaaaagtacaagccggttattgagaagcacatcaagtttttcgccaacaaagagcgcactcagcggttctatgatttggaaatcgaaaacttcaatgaagaaaatatccttgtcggtctgctaagtgcagtctgcaaggcgcgtacctgctcttttgaggaagtcgtgcgcatcgtgttgacggatggcgagctggtggacaatgctttcttgcaggagtttgaaaaatacgacctgctgtctgcattctggcagctctgtgagcagcatttcggatacaccgatacaaaaccgagtttggaacggcttttggtaacattgttcgttacttatactgggcgatatgtgcaggcagagcttccggcagcatggaagagctttgtctcctacaagtcaggcaatattatcgcattccttgatagcctgatgaacagcgttctgtacagggacaaatacgacgctctgtcggcacacgttgccaaagggctgaatgttttttcggcatttgcaggaatgcgagtggacgatttgatggagtgcgatactttccttgctgtggatcaggttctggtaaagtggctcattggcagacttgtttcggaagatatcggtgcaatcgtaaacggatttaccattccggaactctgtgaaaaacgggctaaaatgcactttggaagaaagaccgggaagacatatcagttgctttccagtgcgtacagcatggtgaaggaagcggattaccatgccgcagatggcttaaagccaattatcgaccgatatcttgctgcggattacaatatggatcagcagtatcggaaattctactattattatgaccagctggagagtacggaaagttttgagtcgcttcgggaactggtggaaaatatctacacgaacgaatatctggcatgtctgctccctgcttggaatgccggaatccagacagacggcgcattttctgcaattccgttgcagcgggagttttacaatacaaacctgcgatatacaaaagaacgcacagtggtcatcatttcggatgccatgcgttacgaagttggacaggaattgtttgcccgaatgcaggatgacccgaaatgcacggcaaaactttctgtacagctgagtgtcctgccgtcttatacaaggctcggcatggcagcagttttaccgcataagacactggagatgacggatgattttcaggtgctggcagatggtattctttgcgataacctggcaggtcggcagcaggtgctgcaaaactataacccggatagtgtctgtgtgcagtttgatgatatcaaaaacctgaaagtggcagagctgcgagatgtgctgacaagacgtcagattatctatgtatatcataatcagattgacgcgcgcggagacaaggcaaacaccgaggacgaggtgtttaatgcgtgcgaggaagccgttcaggaaatcatggatttgatccatcgagtctccgtcagcggcaacacctatcattttatcgtcactgccgatcatggctttatttacaatcgtgataaactgacagaaagtgacaaaatttccgggaaaagcgcagaaaaagcatttgtcaatcgcagatttattgtgtccaaggcggcactggaagatgacggcatcgaccatatgagcatgggacgtgttctgggaaacgaggacagcaaggtggtgtcctatccagtcagcagcaatgtctttaaggtggccggaggcggtgctaactatgtgcatggcggttcctcaccgcaggaaatgctggtgccggtgctggagtttaagatggagcgcggtcacatggaaacaaagaatgcagagattgctctggtcagcattgtccataagattacgaacctgatcacgtccatggactttattcagccggacgccgttagcgatactgtaaaagctgcaaaataccgcattttctttatctcggaggacaatgagaaaatctcgaacgaaaacagttatgtggcggatagccgggaagaaaatgcgcagaagcgtatcttccggatgcggttcacattcaagaataagaaatacgacaaggacaagcagtattaccttgtggtttacgacgaagaaagcggtctggagcagtggaggcagcctgtcatcatggacattgcctttgcagatgactttggattcggattctga

SEQ ID NO: 1712 - DNA, 2523 bp, Lachnospiraceae bacterium
atggcagaattgaacctgaaacaaattatagaccgcctgaatgcggaatttaccggcgagacccggaaactggttttctggtacgatgacaaggcagattttgccgaggatatggaaacggtagagcttcagaatgcgaagatataccgtcttcagccggataaccagttctatacaaagtattttctggagcgtatagatcagactacgaattatctgatttatgcgccgttccccaaaccggacgtaagggacaaccatctggaggacacttgtgcttattcgagacgcttttttgccgaccgggcctccctgctgtcgcttgacctcggaattgaggaaaagtataagtcggtgattgaaaagcacatcaagttttttgccaacaaggagcgtacccagcggttttatgatctggagatcgaaaacttcaacgaagaaacgattctggtcggcctgctgagtgcagtctgcaaggcgcgtacctgctcgtttgaggaagtggtgcgcgtcgtgttgacgggcaatgagccggtggacaatgttttcttgcaggagtttgaaaaatacgacctgctgtccgcattctggaagctctgtgagcagcatttcggatacaccgatgcgaaaccgggtttggaacggctcctggtgaccttgttcgtcacttataccgggcgatatgtgcaggcagagcttccggcagcatggaagagctttgtctcctacaagtccggcaatatcatcgcctttctcgatagcctgatgaacagcgtcctgtaccgggatcaatacgatgtgctttcggcgcatgtggccaaagagctgaatgttcttcctgcgtttgcgggaatgcgagcggacgatttgacggagtgcgacactttccttgccgtggatcaggtgcttattaaatggctccttgacagacttgtttcggaagacatcggcgcagtcgcaaacggacttacgattccggaactctgcgaaaagcgggctaaaatgcactttggcagaaagactgggaaaatctatcggatgctttccgctgcgtacagcatggtgaagggagcggattaccatgccgcagagggcttcaagcccatcatcgaccgctatcttgctgcggattaccgtatggatcggcagtaccggaaattctactattattacgaccggctggagagcacggaaagctttgagccgcttcgggaactggtggaaaatatctacacgaacgaatatctggcttctctgctccccgcttggaatgccggaatccggcaggatgccgcattttcggcaattccgttgcaacgggagttttacaataccaacctccgctacgccaaagagcgcacggtggtcatcctttcggatgccatgcgttatgaagtcgggcaggaattgtttgcccgtatgcaggatgacccgaaatgtacggcaaaactttccgtacagctgagcgtcctgccgtcttatacaaggctcggtatggcagcgcttttaccgcataagacactggagatgacggatgactttcaggtactggcagatggtattctttgcgataatctggccggtcggcagcaggtgctgcaaaactataacccggatagtgtctgtgtgcagttcgatgatatcaaaaatctgaaagtggcagagctgcgggatgtgctgacaaaacggcagctgatctatgtatatcacaatcagattgacgcgcgcggcgacaaggccaacaccgaggatgaggtgtttcatgcgtgtgaggaggcggttcgggaaatcatggatttcattcatcgcatctctgtcagcggcaacacctatcattttatcgtcactgccgatcacggctttctttacaagcgtgataagctgacagagagtgataaaatttccggaaaaagcgcggaaaaagcctttgttaatcgcagatttattgtgtccgaggcggctttggaagatgacggcattgatcacatgagcatggggcgtgttctgggaaatgcggacggcaaggtggtgtcctatccggtcagcagcaatgtctttaaggtagccggaggcggcgcgaacttcgtgcatggcggttcctccccgcaggaaatgctggtgccggtgctggaaattaagatggagcgcggtcatatggaaacaaagaatgcagaaatcgctctggtcagcattgtccgtaagattacgaacctgattacttccctggactttatccagtcggatgccgtcagcgatactgtgaagacagcaaaataccgcatcttcttcctctcggaagacaacgagaaaatctcgaatgaaaacagttatgtggcggacagtcgggaagaaaatgctaagaagcgcatcttccggatgcggttcacattcaagaataagaaatacgacaaggacaagcagtattaccttgtggtgtatgacgaacaaagcggtctggagcagtggaggcagcctgtgatgatggacattgcctttgcggatgactttggattcggattctga

SEQ ID NO: 1713 - DNA, 2604 bp, Lachnospiraceae bacterium
atggatgccgaaaagataatacaggatttgaaccgacgttttacggctcctctgccggagttttataagcgtcgtgtcatcttctggtatgacgaagacagggagtttgaaaatcagattgacgagatctcgctaaatgatgcaaagctcgtaaagcttaacggttctaactgttttgcaatcaaaaagttgttgctcatggatgatacagcgagtaattacctggtctattgtccggtttcttttgagcatccggaggataactggcttcttaatatcgagctgtacagcggagagccgttccgagcggatttgaatacgatttgggtggatgagatgggactccccgcctcgcagatgttccgcaagcaggtcaagcagtatcacaagttctttaattccaaggatcgccgcacaaaggttgcagctatggctggtagcataagcatgtcagcacagatgcatctggcagtgatggcagtcatctgtggcgtaaaggatattagtccgaacagtatcattcgcgccgtcctgaaagttggactggatgttgaaaataacgccatctatcggggaattgtgaactatggagcacaggcggctttttgggcgttgatcgcacaggccaccgggtataagaacactgaagaacagaaccttgctcagcttgcaacgcatatccttctgactgcggctacgcgtaccttgcgccgagagtatctgaacggcttggatagctttatctccacgccacatcagtctttttgctatgactttgtttccgattggctacattctgacgatttgcatgacctgtataaagtcgcacgcatcgtggaaacggaggctcggctctatcagcgtttcagcaagttgagtgttgaggatctgcgagatacagagtgcttcccgtgcatcaatgaagtgattctcaccaagatgatgacggaaatcaaagaccaaatcattcaggtggatgtgattgcgcagacagtggaaaaacgccgaacaatggtctggtatgctttcatgtccagctattacgagggactcctgcaaatcgcgaagatgcaggcgttcttcttggaacattcggcgggcttccataccgcaaaagcgaaggacatctggaaggaatataccaccgattattatcggatggatagctattaccgtgcgttccatctgtgttttcagcgcagtttgaaagtatctaacgatctgctggatgacctctttaagcatgtggtggagaaggtcgaggcgctgtattccggatggtatctgaacggtctcggcagcaactggtcagatattgcggccgaagagctgaagaagcacggatacattgaagaagtgaatcgacatacggcgttttatctgagcaacattcagcactgcgatactcgtgtgtttgtgattatctcggatgccctgcgctatgaggtggcagcatccctgtctgaacagctccgccgtgagacgcagagtaaggtaacgcttgacagtatgtgcggaatcttcccgacgattacgccttatggcatggcggcacttttgccgcataaaaagctgtctgtgcaggcaagaccgaatggcggccttgcggtgctggcagacggtcagtctacggagagcacgaaccgcggcaagttgctgagagcggcgaatccggccagtgtggcactgcaataccgcaatatcatcggactgaaacgtgcagaccgacaggcgctcataaagggcatggaggtcgtatatatctatcatgacaagattgatgaggcgtcccatacctcggatagctctgtgttccctgcttgcgatgaggcaatcgaggaaatcaagaatcttgtacgaatcattgtcaatgaatttagcggaacacgcattctgattaccgctgaccatggattcctctatacatatagtcctctcacggaagacgataaggtgtccaagaacagctggaacggtaaggaagtagattacggcagacgctatgccatcatggagaaggatgcacaaccggaatatctgatgccggttcagttcctggatggcaggacggattacgcggcgtttgcgcctcgtgaaaatgtccgcatcaagatgaacggcggcgggctgaattttgtccatggcggtatcagcttgcaggaaatggtcgttccgctgattgactatcattatattcgcacggacagcagggagtatcagagaaaccgcgccaagattgatacgaagccggtcgaggtgagtttgctttcggcaaaccgcaagatcagtaacatgattttctctcttaacttctatcagaaagatgctgtgggagacaatcgtgaaaaggcaaattatttgctgtactttgctgattccgccggtaaggtggtaagcgatactgcgcgcatcatcgcggataaaacaagcgatactgcgcaggagcgaacgttccgctgtacctttaatctgaaatcactgtcctttgacaacaaggagatctattaccttgtgattacagatgaaagcggattgcagctaccgcaacgcgaggaattccagattgatattgcttccgaggtcgatgaattcaagttcttctaa

SEQ ID NO: 1714 - protein, 1108 aa, Thermomicrobium roseum; identical to SEQ ID NO: 614

SEQ ID NO: 1715 - protein, 649 aa, Pelotomaculum thermopropionicum
MNWRDHILKNLQPGVSRLTLAADPDGLLLEEDVLSALREMGFDVLVFSDSITFRYAYEANYRSRWDRGEAVHLAVVVQGGPQELRRLPFDVWRKGHKFFFSLADIFPKLSYPVVAAMEKSDLDKLYRAYQDYNGPALGEKATKDFILKRVFGIIPDLINSPVELMKMLLSRHCSYVTVPSILDEHLIHCLREKSVFKDWPLEDIIPSREAFFAFLQEKWRRFLESTARGENFTEVPFEHYDIRVYIDNLFLEGSLRPVPVASMEGMPAWVLAGVLFDKQAEERRRIKWLLEKIRQDLPGETASHRDWQRLAVLWAELLVLSGELNQDVKTETKPQIEELHDQLEERFASWMLVRYGSLANLSYTSKPVMLHHIPRYLAHLRAKGMAKNIALLVIDGLALDQWLVIRNFLRDRCPAWRFEENQVFAWVPTLTSISRQALFAAEPPLYFKDTLTTTSKEGQHWHKFWEDSGVRRGNTYYRKGLGDELASEIGEFLGSQFEIVGLVIDKVDRIMHGMELGSAGMHRQIRLWAEQGYLIQLIDHLLKNKFAVYLTSDHGNIAARGMGRLPDGVLAESRGERARIYHYEVFRQQMMEERENVIRWPGFGLPQGYSVLLARGRSAFISEGEEVVSHGGISLEEVVVPFVRIWEEH

SEQ ID NO: 1716 - protein, 850 aa, Acidiphilium multivorum
MHPLNEYISKQLAEKLKARKVVVWYDPRREFAPFIGELRGGARTSDEAVPVAVGGLAARLAEFDGSMFELRAVVEPFVCDDAPSEWVIIYLPGCERDRHGSVLMELEKAGECYEPQLKRLARNVLRQRYTDGVIDEMLAPERVSYEDLARASSDTSSTEPPSVLKSIFHGASGNDGIIAPWLASDGRDAEIESKEATRELVKLIRSKLGLELPDDAPLSRLRSITLRYVLAGEFRGDLSGALPLALDSIPAPRTRDEEGAVRELAHLLRTKFSEAYPGMADRVEAELGLNAAAISAGTLGSIDTFRFEERALLAHCGDLVAQKKFDQALELITGREQSFWLDRDVGRKAQWEACRRMAELGALGVAVRAAVGKASVDANGWIDAYVAKDGWFRLDQAQRRLEAWVANLDDEPEERPLGIVRGVYEDACRAMADGFTRALVAANWAVSSCLHQTRIFSEVVSEQPKPVAYFFVDAMRFEMGVELSERLPKSVEVSVRAAVCALPSITPIGMAALQPGASSSFSVVEQGGALGARIDDAFLPDLTARKKFAASRIPKVADIALDELLSLQPSRLAKKVEGSQVIIVRSQEIDHAGERGFTFQARQVMDTVIDNLARAIRKLAAAGVEHCVLTADHGHLFFPSDRDESMRIESPGGDEVDLHRRCWIGRGGTTPSGCVRVTASALGYDSDLDFVFPLGSGVFKAGGDLAFHHGGPSLQEMVIPVVTVRMKTSAPGRSSSGPVAAIGLPEAVTNRIFSVVIQLDGKNLSLFSTELVVRPLLMSAGKQVGGVGMAIDGEFDRSTGCVKLEAGKQVTVAFLLSDESVPSLRVVIQDPTTDAELYRSPTDIPVRLGV

SEQ ID NO: 1717 - protein, 835 aa, Acidithiobacillus ferrivorans
MTNPKITQALSSLFTKQRIIFWYDTRQEFRADFETLELPGVEKIELLNNEFGVKYRLLRQQPDQQFLLYREGAEPPPLQNWLLDVQLASGHSFRTDQVALWLAELELGPDFYQVLEAHSAFFESGKRREALRKMLESGDSHNLLRRKMLAVAAGSEPRLDAILETLLGDLARGDEARIKLIERSTLTAYLWEQMKRAYGYTSEQPGLHDFVIELFKTCFQSGIDPTCKASLSAEALVFLKRWKDSRSHAQGFEVLSKQCAVVLQIEDKLQTLDYRRLMTLDYFELIDRKILSELVRAVLARTTTAQDLQQWVRQRRQSHWFDRFKDIYLAVEHAAQFIQLLDMTQLEMDSLADGVRKYAKNWYQLDQRYRKFVFHLRESGQASLLGELSTLIDNFYSNNFLTRLNDRWQQHVDAVQHWEAAPVLLQRHFFTRCVQPFLERKGKVCVIISDAFRYEIGEELQSLIRQEDRFEAELEPALSMLPSYTQLGMAALLPNADLQLVDNESGDAMVNGQSAKGSANRGKILANAVPASAVVLAKDLMNMDRDTSRALLRDHEVVYIYHNLIDKTGDTRDTEERVFAAVEETLDELLRLVKKLTNANASNLLVTSDHGFLYQNHPLEESGFLSSEPEGEPVLYHDRRFVLGHGLRDNASFKTFTSAQLGLAGTMEAQFPKSIHRLRLQGSGSRFVHGGATLQEVVIPVIRINKKRQSDVGRVEVEIIGAGSKTITTGQLAVVLYQTDAITEKSQPRRLRAGLFTLQGELISDQHELLFDFSATHPRERELPVRFILSRKADSANNQEVELRLEERVEGTSHFTTYKAARHTIRLSLSSEFDF

SEQ ID NO: 1718 - protein, 874 aa, Acinetobacter baumannii
MNLDQLKQGLEQAFYTEQHRIVFWYDAEQSFTEEIKALKLNDVHILNMAEESSLAIKLKLELEDQQGKYLLYFPSPEPETEKDWLLDIKLYSRSFYADRFSIIFNELGLQQQSLREHLAKREEFLKAKARLSTLKRYIQSDADAQDLDMAMIAAVVKADSVELMHIVLALADEVVQQNLALEVNPESFAELEKFQLVPALITALQTEIGYPASVEELNGEAPFKLGTFFIRLMSTGFCESLGDIPLWAQELVMSSVSSRATARAFLSRWRDSSKYYPTFDTLSQTVANALRIQEKVGAFDLEQLLDVMTFEVIEQKIIVDLASHIPAATQAELEHFRTIISTRLDGYWASKHKDDATRRKYRTVYTALQAAIDLFSLRQQFDSGFYFDSSEALYKAYEQELYRFDMTYRHYSTASQRAHVDILKKLDEEIENCYSYWFIDYLARNWGERIEAEQRLNVWKIADIPNQQNFYDTHVRPLLGSATKRRIVVIISDAFRYEAAVEVCDRINEKRYSEATLSSQLGVVPSYTTLGMASLLPHQTLEYKESAGDDVLVDGQSSKGTAARSKILAAYNGLAVTAETVKGWSRDEGREALKDHDLIYVYHNVIDARGDSVSTESETFMAVEHAIEELTELSRKILLHFNISTLLITADHGFLFQQSKLESADRSILTEKPANVLKSKKRYVIGHGLPVSKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDVKVSSEETLTFDSSTDSIAERVKQVRLSLSGTDFDRKKDYFLVLKDKDLNIEMQRYKVSIDLAFTDDFF

SEQ ID NO: 1719 - protein, 684 aa, Alteromonas macleodii
MPSMLLINYLIEQLRNSANYNRSVQVAPAAILWTDIDKQWQTAMPFIKQHLPELIELGDYKPEERIGPAIWVKCAIAGKLDDCNLPEDRTPIIYLPGVGRKELRAIESCPEFLKPLAELQYRGCWWAYNTAGRDWTVSSFLTNPKVGIELDLAKDKNTQQAILNVLPDLLETPDSNLRGKKLESEDFISLVLDDPTKDILGWLNDPCEKRSQWQDSRWDIFVQSCQSQFSFTPDEKSIPTALKLLCAAEGQWEAVWQRFEDTAVNLPLLVEKLKAIESDDLAIVNPENYLSENMKDEAAIESHFFNVGEKPRDTISQELMALWEKQKDRKNWIWYSLGHSGWLKILEYVIGAIEHTEIVYSGSTPEMMANHYQERFWQADQCVIKAMSLAKDIHQQEVVAKLLGTVYSPWLEQTTLRFQQLVEQHGYPGNKIKVKESTANYSVGGQVVFFVDGLRFDTAKILEDKLKDRGLTTELNSKWAAIPSLTATAKAAVTPIANMLTGIEENDDFIPSVSLSKSSFSSHHLKQLLNEKGWQYLDGLETGDPKGFAWVQTGDLDHMGHEQQRKMPLFIDQILDDVVARVVSLFDAGWMNIKIVTDHGWLWVPDGLPKGVLHKSLGKNRQRRCAILKDNVQHDGMVMPWYWNPSVSVALAPGITAFVKGDHYNHGGLSIQECLTPELLLTKT

SEQ ID NO: 1720 - protein, 785 aa, Anaeromyxobacter dehalogenans
MNAPPSRRRAGAPARARNLVDALEQSFLHALRQAEGEAAPAALIWADTERQWAGLMARLQTALPHLFVLGAYDAARRTGPAIWLRCVVDRVLEDVALEPGVVPILYLPGIARQSLRAGDECPRELRPLVELQYRGRVWHQKNGRDWTVEAFLVSEDGLQLDVAQDAKTRDAALRSLPLLAETPLDGLRGHRLEADDFDRLAVSDPTRDLLRWMGAGDALLKAEGQGRWKAFCGVCTSDFKFDPDKKSPADAANALVEGNGKWVNVWQRFKEAPKLYPEVAKLLRDTATPLLHRGSERDAGGNAKAEQELRAGLAALANKPHAAALADVAALEAAHGKRREWVWAELGESPLAGALAPLAKLARAAATTVGGATVDAAINAYVNEGWRCDRAALEALATVKQPADVALIQSVVRALYLPWLDASARHFQSLIEGAGNVLRAKVSGSQYEKDACLMFADGLRYDVAGMLAERLEAKSYRTRLNHRLAPLPTVTSTAKPFATLSHDRLEGGEDVIDFNPRFKDSPQAANAQRLREDMASRGTDLLGDEIRPAKQGTTGGWVETGKLDELGHKLGARLAAQIESELDTLVDQVTGLVEAGWTRIRIVTDHGWLLVPGGLPTVALPKHLTVTKWSRAATVKGDATPGVPVYPWYWNPHVRIASPPGVASFAANTEYSHGGISPQECIVPELVVERGGGGATASITAVSWRGMRCRVSVATNDPEVRVDLRLNWKQANTSIVASDKEVGPAGEASLAVADDAHEGAAATVVVVDGAGSVLDRKTTTVGEAS

SEQ ID NO: 1721 - protein, 872 aa, Aromatoleum aromaticum
MSHQRIIEALQAQFATQQLLFWDDPEGEFSTWVDGLSLHGVKILRLDRTSALQVKLDVEHSPGTRWLFYRPAAEPDPAKDWLLDLRLRGRAFRADSNSMLLDDLGLTSQALRPHLKARSKFLRAKDRVEKLRRLVTPGDDAEALDRKMLAVLVRSEQADFQTILLRLLSSMVHEGEADLAGEPRVWQDIVANELDSAFWALALQTLGYGADGVAPAFTLRDLLYRILVTDFCRSLSGKAPESLQHFVLPDRMLAANASVFAARWRTDMAAYESYSLLSDAVAGEIALDGVLGALPGEALAETMTFAAVERRILKNLKDRVLAGPGASDEAMQALIARRRDGHWASRLMAQSSSESRALAACYDAIEAGAAFFALKARFDAGFSFAGAEAALKAYQSELFRFDQLYRHFHEAAEKVEPMGWAVLHELRARIEDTYTGWFLPQFGTIWAKVIEGEGGLLSHWTVAGMPNQHRFFDTQVAPLLKVGAKRVFVVISDAFRFEAAEELVQQLNSKSRFKAALSSQLGVLPSYTTLGMAALLPHHSLAYKINSNLDVLADGQPVSTLEQRNAHLAKYEGLAIKADELLTLGKDKGRTLVRERRVIYVYHDHIDALGDKQATEGMTFRAVDEAIGQLSQLVSFIINSLNGSTVLVTADHGFIYQEAPLLAADKSALDAQPEGTLKAKKRYLLGRGIGTSPKAWCGNTALTAGTAPEGSLDFWVPKGASRFHFAGGARFVHGSAMPQEIVVPVITVRESESDKEKARHVEFSLLGASNKVVTNTQRFEFIQTEAVSDKVLPRTVVIALRDGDRLISNEQTLTFDSASQLLDERKRSVFLTVLAGTYDKTHDYWLTVRDAAIKVEVLRVPLRVDLAFTNDF

SEQ ID NO: 1722 - protein, 830 aa, Arthrobacter sp.
MTEASTVKSHLEQRFTEKRVVFWHDADGDYINDLDSLGIDGVQIIRVAGDEFAIKNRLLEIEPKAKFLIYRQGAAPAGLDNWLLDLELAYGVFTADRASLLQQELGLTDPRVIPVLEARTKFFGASARRQALAKLLSPSDDPTTLQAKMCAALLKQSEHSLLEITRALLLEAAEWTSAKYEELTAYGLDGFYWEGVASIYGYSSATPTLPDFVLWVFRKAMDNFKADTPNSLRNIRLDFAALRYDMRSKEALATLASRAADDLDVKPKIADVNLGELIGSDLFEQIDQKIITDLARGVVEQSMTPRQVADVVRQRQSSIWIDRYRKLYTAIESASELLSTIAALPGTIDSFDTGLKRYQTEWFRIDQLYRRFTYAAKTADFQAPLTALRAEVEKFYANKYLFNFGTAWQQKVDLVSDWTSGSFRSQASFYAGYVAPLVSDGRKAVVIISDGMRYEVADELGARIRRENKFEAELSAVLGVLPSYTQLGMASLLPHSILELSPEGMPVYADGKRTDGTVNRAKVLESVHGFAVQAEELLGKTRDEVRAVLQQHQVIYVYHDRIDATGDKAATESQVFEAAEETLRVLVDLVKKMASADASNIFITADHGFQYQDTPLDETFFLSTPPQGDQITRTNRRYVLGKGLKHDPAFMTFQPAQVGLGGEIEVQIPKSIHRIKQPGAGTRYVHGGASLQEIVVPVVTVSKKKKSDVRPVNVEIVPESDKITTGQLAVRLYQVDPVSDKVQSRTVRAGIYVGETALSNIPELVFDQTSTDKRDRYQTATLYLSQEADDFNNRPVEVRLEEPIPNTNQWKVFTKAPYTLKRSFTADFDF

SEQ ID NO: 1723 - protein, 771 aa, Azospirillum lipoferum
MSPKTLLEAIQHGLADAGKTADGVAPPAAILWTDPDGQWRPLVEPLRKLVPHLYALGPYDPEHKTGPAIWLKCVVDRALPDLDLPADAIPVLYLPGVARAVLRSAEDCPPAHQPLVELCYRGQTWHHRNGRDWTVEGFVEAVLEIDLAGDQATRKALLRMLPRVATEPVVSLLGRRIDAENLLKLDVDDPVGDLLSWMSEPGAFRQRCDDGKWQSIRQLWLKTYGFDPEADGVTAAGDKLVNDQSPTWAGVWRRFCAAPKLYPGLSKVLRMSYKDLFAGSDRNPRFNEDGEVKLRAGLEAAVDLPHQDACDKVIALEAEHADRRNSPWAELGESPLADALQPLAKLAQMARSGLGGANAAAMADAYAADGWRCDRAALEALTKAMAHKPQAGLLCRVIRALYLPWLDQSARHLQDLLGASDTAASALVHPFTPEAGTCFLFVDGLRYDVAMALKEQLEGLQLPCTAGHRFAPLPTVTATAKPVAMPVGPIIGPGGAPEDFCPHLSGTTAAAGVLKLRQALEQKGAVIVAPASPQGPARAGDVGWCETGKLDELGHKLDIGLVRQIEDELSDLVMLIDSLLSVGWPRVRIVTDHGWLLMPDGLPKVDLPKSVTSAKWARCAAVKDGASPGAATFPWYWDPHVRIAMPPGVGSYLANAAYAHGGISPQECVIPELTVSRGAAPISATIKQVGWRGLRVRIKVETSTPGLAVDLRQKRNNPGTSIAASVKELKDTGEASLAVEDDSNMGTAAFVVVLDTDGNVIAAQMTTVGDE

SEQ ID NO: 1724 - protein, 880 aa, Bifidobacterium animalis
MSELNAVAAMLAKRYAEPGERGRIVFWLDEKGDYADDVQSMFGPDSSFEALRDIELIMAADTPFANRHTMMIKHPDRKFAVYMTGAQPAPSDDWLLDMKLAYAPVFSADRLSMTLTEITPDAPQETKEQWLAIMRRTPRFFESKTRIHKLAERLNAQDDTRRLQAKMIAVLLDLPQGQHSLQDIWRALLTQDTEDDDTGIRKIERMGLAPFHWAGTEAIYHYPASTRSEDNLTVKDFKLWLFDLAWHGFTTKSHDESYYAGIQRDFVGWCNNVQTRGTMRTLADSVMQDLGIPAEVDEMDVHALAQHGLFQAVDQRLIMRLLEKLGNQSITDTDVQRIANDRKTMLWYDQFEHEYQAISAAGAFRAALSKVEDPIELQSPQQGFESYVSYYYRVDQAYRHFRMAFDQAPDLDAIAISNDLEADYVRFQLNLGAAWQRQLNTMNAWRIPNVADQQDFFLNKVENGFLKSGKKVAVIISDALRYEVAEEFTRRIDTENRFTASVNAQLGVLPSYTQLGMAALLPHERITFNTKSSHALDNGLVLVDDHASSGTGNRDAILQTRNGHTIQAKDLLAMNTGEARELVKSCDVLYIYHDEIDKEGDKGDEDKVFGACESTINTLITIARKLTNANVNNILVTADHGFLYQRSELDAGEWLSEQPHGDAVWMRKRRFTTGAHLIPNDAFMTFTAQQVGLANPPEEGVTIQLPNSILRLRHQGDGVKYVHGGASLQEVVVPVVSINKGRSASGDRRAVNFTILQSTNLITTGQITVDFLQSEPVGGKVRERITFVGLYGRDEHGDWTLISNETPITFNSTSKEAANRHNRVTFMLTPEADAFNGQPIMLLCHEIVAGSSARRLLAQKAQFTLKRDIQSGDADLLDWD

SEQ ID NO: 1725 - protein, 832 aa, Bordetella parapertussis
MENRIAQALTKLFDRHRIVFWYDAKQELRDDFDALQLPGVEKLELINNEYGIKYRLLREQPEQKFLLYREGPQPADLDNWLLDVQLAHGEFRTDQVAIWLSELELGLEFTDVVQAHAEFFQAIKRKDALKKLLKADDTAGQIRLKMLAVCTGSEPRMDAVVENLLQELADGRDEKIKLIGRCSLDGFLWEQMTRCYGYKSDAPGIRDFAIELFKSCYAMGTAGQVKLTGDALVFLKRWKDSRQFEGGFETLSGECAEVLGIEQDLAKRDFRELIELDYFRLIDQKIISDLVRAVAARTASSGNVAIWVRQRRQGHWYREYRHLYEAVDYAAQFTHALGEAKLAMDSLAEGVQRYSRFWYQLDQLYRKFTYHVRMSGQASLMGSLTEQIENLYTNNYLLKLGDRFQTFVDAASKWEAFPVRKQKEFFEYWVRPFLRKDNKVCVIISDAMRYEIGDELLSLIRQEDRYSAELEPALSMLPSYTQLGMAALLPNKTLAIVDNETGTVLVDGQSSQGTVNRTKILQAALNGRGEAITAEDFMQLDRDGSRELLKSNDVLYIYHNRIDHTGDKMHSEGQAFEAAEQTLGDIVRLVKKLTAANANNILVTADHGFIYQHRPLDESDFASVEAKGEVILYRDRRFVLGKGLAESASLHSFSSEQLGLSGEVEVQIPKSINRLRLKGSGSRFVHGGASLQEVVIPVLKINKKRQSDVTAVEVDILRGASSVITSGQLAVTMYQAGPVTDKIQPRVLRAGIYTEAGDLISDSHDLTFDLSSDNPRERELQVRFVLTRKADEANGQEVILRLEEKHAGTSHYKEYKSLRYLMRRSFTSDFDF

SEQ ID NO: 1726 - protein, 776 aa, Burkholderia sp.
MSDTVLSRLANALGKAATGNSHAAVPTTVVLWPDKERLWESVLERAMTVMPELVVLGSYQPERRRGPAIWLKCVVARSLSIVPTGAVPVVYLPGVSRADLRAIESCARDLQPLAELQYRGAFWSQANAKDWTPSAFLTSKNGGLGLNVAQDKATQEALGQALKAGVLLDQRVDSLKERQINAEWLYSLLAPNPTRDLLVWLNDPDSARSRWEGVRWDVFAKLCKSEFGVDPVSDGALVAAELLAKTEGKWKAVAELYRDSYTSFPNVFNLLATVQPPQMGLFPDLDKLAGYPLANEQSESALRIALLACAPMDAQQARTAILDAEKEHGIRRSWLWSRMGRSPLAAALAHLSKVAELSATVPIGQTPAELAASYQQSGWQVDDAALLALGSVHLRSDVDAVSAALRAVYLPWVEEAAKRLQEAIKVAGGLTPLSTESAGEQSAGTCTLFVDGLRFDVAGRLRERLSGLGETSLFTRWTSLPSVTASGKAWCSPVAAQVSGAADAVEFEPRVASDGKPLSGHNFRKLLAEHGVQSLDKHETGDPQGRAWTETGDLDHYGHEHGVRLARDLETQLDQVVERVGELCQAGWKRIRIVTDHGWLLLPGGLPKTELPKHQAETRWGRCAVLKDTAHGTPLTFGWDWCKDVQVAYAPGVASFKAGDEYAHGGISLQECLVPVLELKVTASATTELMVTIKAVTWKGLRCVVEVDTTSPGLKVDIRTKPALANTSLAANTKSVDGGKANIAVDDDDHMGSAAVVVVLGPTGEVLQKQATTVGG

SEQ ID NO: 1727 - protein, 872 aa, Burkholderia gladioli
MTSAPHTFLPALSRLLAEGHSLVFWNDAEGEFASQLDGVELDGVRVVRLDQVPALQVKIWIEQEKDARWLFYAPFAEPEPAADWLLDARLRGKAFSADTASIQLDELGLTTQSLRAHLKHRAKFLRARERLERLKRWSDPQDTAEDLDRKMLAVVVRAETPDASAILLKVFAGLAMEADDLGATPKALADIATNDLDDAFWTLVEREMGYREAEPEARCLRGLLYAIFATDFCNGVRATPAPMAHLLIRERARAAHASVFANRWRKDMANYGSYDTLSKLVASDLRVDDLIRPMSAEGLVDAMTFERVEKRVIADLKGRIIAGGGANMDSIRALIGRRRDGHWANPLLAGANDSTRALAASYDALEAAAGFFELKAKRGAGFSFPDAPTAFAAYRSEIFQFDQLYRWFMRATESVEPMGWALLHELRDRMEGAYSGWFIPQLASAWASVIEGEGGLLSAWTLPGVVNQQAFYAQVVQPEFDSAKRVFVIISDAFRYEAAEELTRDLNTRNRVKARLDAMLGVLPSYTTLGMASLLPHERLAYKSNANLDVMVDAKPSATLEQRSAVLAQHEGVAIGRDELMEKGKERGREFVKPHRLVYIYHDRIDAIGDKRATETKAFEATAQTIKELADTVNFIVNSLNGSTVIVTADHGFLYQESALEEADRSVLDAEPEGAIKSKKRYILGRGMGSTPKAWCGSTERTAGTDAGEGSVDFWAPKAAGRFHFAGGARFVHGSAMPQEIAVPVIVVKESESEKVRSKSVEVSPLGSSNRVVTNKQRFEFIQNEAISERVLPVTLIFSIRDGDTPVSDEQAITFDSASPLLDERKRSVMLTIQAGSHDRTKDYFLVARDAKTKAEAWRQPVRIDLAFSNDF

SEQ ID NO: 1728 - protein, 872 aa, Burkholderia vietnamiensis
MTSGQLAFLPALARLFAEGHSLVFWNDADGEFAVHVDQLDLPGVRVVRLDQTAALQVKIDIEREHGAQWLFYAPFPEPAPSTDWLLDARLRGKAFRADTASMQLDELGLSTQALRGHLKRRAKFLRARDRLDRLKRWTERDDTAEDLDRKMLAVVVRAETPETSSIFLKVFAGLANEGGDLDATPKALAEIESNELMDSFWALAEREFGYREATPDAHSLRSLLYAIFATDFCNNVRSTLAPLQHLLIRERALAAHSTVFANRWRSDMVNYGSYDALSATVSVDLRVIDLIRPLGAEDLIDSMTFEDVEKRVIADLKSRIIAGGGANMDSVRALIARRRDGHWANPLLAGANDSTRALAASYDALEAAASFFELQAAHSAGFSFPDASTAFGAYRSEIFRFDQRYRWFMRAAESVEPMGWALLHELRERIEDAYSGWFIGQLGSAWASVIEGDGGLLSTWALPDVVNQQAFYSRMVQPEFDNAKRVFVIISDAFRYEAAEELARDLNSRNRVKARLDAMLGVLPSYTTLGMASLLPHERLAYKSNANLDVMVDAKPSATLEQRSAILAQHGGVAIGRDELMEKGKERGREFVKPHRLVYIYHDRIDAIGDKRATETKAFEATAQTIKELADTVNFIVNSLNGSTVFVTADHGFLYQESALEEADRSVLDKEPEGAIKSKKRYILGRGMGSTPKAWCGSTERTAGTDAGEGSIDFWAPKAAGRFHFSGGARFVHGSAMPQEIAVPVVVVKESESEKVRTKSVEVSPLGSSNRVVTNKQRFEFIQNEAISERVLPVTLIFSIRDGDTAVSDEQTVTFDSASPLLDERKRSVMLTIQAGSHDRTKDYFLVARDAKTKAEAWRVPVRIDLAFSNDF

SEQ ID NO: 1729 - protein, 834 aa, Calditerrivibrio nitroreducens
MDIKEKLLDKFSKSRIVFWFDEEGSFEDELENISLEGINIHKVENNEFYLKYLIEKEKPTESFLLYYNRKQPKIEENWLADILLYSETFFADHKFLIKDELNIRFEKFDSLYKDFKAFFKNKKRINKLKTYLSDNPDYKELSLGMIATVINAEKNDLENILFKVFENGLDEEDNEALKQLEKYNLDSMFYIIIKDHFKIKKDEELTLLKLAFLFVCSYMVLTAPNLVSLNSIKEYFDLFEGKGLQVAGHFVEEWIYNSKYNDLYSTISQEVDNKTKISQKLKNLSLEDLANIYALENIENIILVKILNENLENNIDFYLDIIKKREQSFWWGSYKNNYLSLENYLRFEKTLLLMNLAADTVENLVLSYTKQLYLIDTYYRNFIFYYKNSNNDLIFDYYKKIENKYQNVMNFLNSKWDDLLTSDFIHNNPKNQSNFYHNHLDQHLQKSERICIIISDALRYEIGCELENKLYSSRDRFEVSMDYMVANIPTITAVGMASLLPNKKIEIKDDGTVLVDDKPATNLKMRQDLLKTFNDDSLALTEEEVNSCTTSQLRELFKGKNLIYIYQNMIDKIGDDYTSEGNVFDMVDQCLNSLEKVIKKLVSSGIINIIVTSDHGFIYQDSNVEEYQKIEFPFDKKNIVLNPRYVLGDSLISISGSHFFEKIDNDKIKRSNILIPKSTLRFKSTSGAGKRFLHGGVTLQELILPLVKIRYTKKQNKKIVDFEMISPTKNIITSNNPKFKFLQSEPVSNNVLPLKARFGIYDSKNNLLSNFGYINFDTSSEDVNERTKILTLQLKPISFSKDDVYKLKAYDEDNDVLIKEYDFKIHILISNEFF

SEQ ID NO: 1730 - protein, 852 aa, Carboxydothermus hydrogenoformans
MELNEVKKKLEEILNKELTDGRKRNIVFWYDDNGEFKEDIDALNLSNAKILKLNGRNSFYVKYILERVDKESNYLIYAPYSKPKARENYLLDIQKYSFEFSTDRATIIMMDLNVTDYSLHDAFKKYLKFFNNKERYRAFKEYALSSYTEEILDIAVLSVLCKLPYPDLEEVLKTLLAEYAYGESTLYENIIKFGDINAFWELVRKYYGYNLEQKDLEKLSIFLLITGLAFSLKRDLPKQWEPFVSPKQTNVVVFLSHFMGGNSTKKAFRLLSQMVEEKIRLKEYITKWDVDSYKDSDIFRLFDEGIIQNILDNLLSDVGEFDRYKEIIMDRRSKHWFEDYENEYNALYWACVLLEEWKNQKDTIKEYPPHDFFKKYTEEYYKVDMAYRKFIYFFDRLDNKEWFAALKEKIENTYINGFINILSIKWSNSIETLQEYWSISSVPCQWEFFREKIKPHLNKGERVFVIISDALRFEAGRELAEMLNTERRGTTEISAMQGVLPSYTKLGMAALLPHKKIEIDSDYEVFVDGISVEGTDNRNMILQNHVNKSIAVQYKDIIDLRRDDLRKLLGGKELIYIYHNSIDARGDHYLTEREVFDAVAEAFEQLKSLVNNLVNHLSATHIYIISDHGFVYKRGSVEKSEKTSMDKIEDAYENRRFILTDKPMEIEGTLSFDMKYLLGEATQLKCITPRSTNRFELKGAGANYVHGGSSLQEIVIPVIYFKNERGKSAKDVQKVRVTLLSLTRKITNTITYLEFFQTEKVGDKMVPCRLKVYFADEDGNRVSNENIIIADSKSENPEERKFREKFVLKNMKYDKTKKYYLILEDEEETVENIYDRIPFTIDLAITNEDFGF

SEQ ID NO: 1731 - protein, 832 aa, Chlorobium phaeobacteroides
MENRIAQALTKLFDRHRIVFWYDAKQELRDDFEALSLPGVEKLELTNNEYGIKYKLLREQPEQKFLLYREGPQPADLDNWLLDVQLAHGEFRTDQVAIWLSELELGLEFTDVVQAHAEFFQAIKRKDALKKLLKADDTAGQIRLKMLAVCTGSESRMDAVVENLLQELADGRDEKIKLIGRCNLDGFLWEQMTRCYGYKSDEPGIRDFTIELFKSCYAMGTDGQVKLTGDAMVFLKRWKDSRQFEGGFETLSGECAEVLGIEQDLAKRDFRELIELDYFRLIDQKIISDLVRAVASRTASSGDVAIWVRQRRQGHWYREYRHLYEAVDYAAQFTHALGEAKLAMDSLAEGVQRYSRFWYLLDQLYRKFTYHVRMSGQASLMGSLTDQVENLYSNNYLLKLGDRFQTFVDAASKWEAFPVRKQKEFFEHWVRPFLRKDNKVCVIISDAMRYEIGDELLSLIRQEDRYSAELEPALSMLPSYTQLGMAALLPNKALAIADNETGTVLVDGQSSQGTANRIKILGQAISQRATACKADELMAMKGDDCRALVRDHDVIYVYHNRIDATGDKRESEERVFEAVEETLQELIRLIKKLTGANANNLLVTSDHGFIYQNRAIDESDFSGVDAEGEQILFRDRRFVLGKGLAEASSLHKFTPEQLGLAGEVEVQIPKSINRLRLKGSGSRFVHGGASLQEVVIPVLKINKKRQSDVTAVEVDILRGASSVITSGQLAVTMYQAGPVTDKIQPRVLRAGIYTEAGDLISDSHDLTFDLSSDNPRERELQVRFVLTRKADEANGQEVILRLEEKHAGTSHYKEYKSLRYLMRRSFTSDFDF

SEQ ID NO: 1732 - protein, 853 aa, Clostridium clariflavum
MDLKQIKTLLEDTFNKELSEGEKRHIVFWYDDNGEFKEDIDELNLENAKILKLNNNNNFFVKYQLEKADTESNYLIYAPFGKPSPRENYLLDILKYSMEFSTDKATVIMRDLNISDDSLKSTFRKYIKFFNNKDRYRIFKGYEIERYTEEIVDMSVLSALCRLPYPDFDEVLRVLLMEEDLENNKHLEAIEKFGRLDVLWKLVDKYYGYSDNEPTLEKLAIFMLVTNVAYCLSGELPDTWRKYVSSRKTDCVVFLSNFMNHSLYSAAYDRLANSIEGKLKVHEYIDNWEMEDYINCDIFKAFDEAIIRKLKEQLLSDIGEFERYRDIIQARRTKHWYIFFKSEYECIYWAIELFDCWKDVSQNIRQYTPLEFAKRYAEQYYKLDTAYRKFYTSFDRLQNKELLMELRDKVENTYVNGYLNTLSIKWSDSLETLNGNWTIPGMIMQKDFYNAYIKPFKNRKERVFVIISDALRYEVAREFCDMLNKERKGSTEIVYMQGCIPSSTRLGMASLLPHKSITIDEDYKVYVDGISSEGTDNRNKILNNYSQESIAVQFTDVIDMKRDDMRKIFGGKELIYIYHNTIDARGDNNKTEREVFDAVEETFKELMLLINNLVNNVTATNIIITADHGFIYKRGNLMESDKISKGSIEDAYENRRFVLSTNALELDGTLTFDMEYLLGPDTSLKYISPRGVNRFKVQGTGANYVHGGTSLQEILIPVIKFKNDRSKDSKNEVTKVDVKLTSITRKITNTISYLEFFQTEKIEDKRVPLRLKVYFVDEENNRISNENIIIADSKSETYEERSFREKFVLKNRKYDKTKKYYLIMEDEEETVEKIYDKIPFIIDIAISNDDFGF

SEQ ID NO: 1733 - protein, 852 aa, Clostridium clariflavum
MDLKQIKTLLEDAFNKELTDGKKRHIVFWYDDDGEFKEDIDSLELENAKILTLSDNNIFFVKYQLEKADTQSNYLIYAPFGKPSSRENYLLDVLKYSMEFSTDKATVIMRDLNVSEDSLKSTFRKYIKFFNNKDRYKIFKSYEIENYTEEIIDVAVLSALCRLPYPDFDEVLRVLLMEEDFKSNKYLEAIEKFGRTDVLWKLADKYYGYTDHEPDLEKLAILLLVTNVSYSLSGDIPENWRKYISSKKADCVVFLSNFMNHSLYSESYDRLANNIEEKLKLSEYIKNWEVEDYIRCDTFKVFDETIVKKLKEQLVADIGEFEKYRDIIQERRTKHWYNLYKYEYECIYWAIDLFDFWKRTGSEIKQYSPLEFMEKYSKEYYKIDTAYRKFYVSFDRLSNKELLMELKDKVENVYVNGYLNTLSIKWADSLETLKEDWKIPGMIMQKDFYSTYIKPFNNRGERVFVIISDGLRFEAAKEFCDLLNRERKGSTEILYMQGSIPSNTSIGMASLLPHKSISIDEEFKVYVDDIDSKGTGNRNKILNNYSKESLAVQFTDIVDMKRDEMRKFFSGKELIYIYHNTVDARGDNDKTEREVFDAVEEAYKELMALINDLVNNVSATNIVVTSDHGFIYKRGNLTESDKITKGSIEDAYENRRFVLSTKPLKLEGTMTFGMEYLLEPGSNLKYISPRGINRFKVQGAGANYVHGGTSLQEILIPVIKFKNDRSKDRKNELRKVDVKLTSITRKITNTISYLEFFQTEKIEDKRIPLRLKVYFVDEDNNRISNENIIIADSKSENYEDRSFREKFVLKNRKYDKTKKYYLVMEDEEETVEKIYERIPFIIDIAISDDFGF

SEQ ID NO: 1734 - protein, 853 aa, Clostridium ljungdahlii
MNLKEIKNVLTETFNKELDCGKKRHIVFWYDEEGEFAEDIDELSPDNVRVLKLTENNSYAIKYEIEKVDKISHFLIYANMQKPSPRENYLLDILKYSTEFSTDKTTAIMRELGVNDDSLKGVFKRYLKFFNNKERYASFMKYEIENYTEEKIDIAVLSVLCKLDVCDIESVIKALFAEELKDNNKYLEAIEKFGDVKAFWRLAEKYYGFNLEDKNLEKLILFFMVTNLSYTLDEAIPRTWGKYVSSKKSDCIVFMSHFMSHSVDSKIYDALSNKFEDKLNIQLYIKEWDIDNYIKCDVFKAFDKAIISKLVEQLLDDIGEYDKYTEIISARRTTHFFNDFEQEYEAINAAVELFKVKKNIGEFIRQYKVQEFFEKYTNENYVIDKAYRRFYAAFDKLEDKEALVELREKVENTYVNWFVDELSVKWSNAISDELQDNWNIPLITEQKDFYNTFIRQHVIKGERVFVIISDALRYEAAKEFSDILNIERKGFTEIYAMQGVIPSYTKLGMASLLPNDKIEIDDKAEIIVDGINSAGTDNREKVLLKYSENSVAIQYKDLIEMSRSEFRKTFNGKKLIYIYHNSIDAVGDHAATEREVFNAVDETFKELKTLINDLINNVSASNIYITSDHGFIYKRGLITESDKTSKNAEDAAVEKRRFIISDKKQNMEGTICFSMDYILGKDSGKYVTVPRGSNRFKVQGEGANFVHGGATLQEIVVPVIKFKNDRSKNGKSDTRKVEVKLTNISRKITSVITYLEFFQTEKVEDKKIPVRLKIYFTDEEGNRISNENIIIADSKSTKPEDRSYKEKFILKSMTYDKKKKYYLIMEDEEEAVENIYEKIPFIIDIAISNDFEF

SEQ ID NO: 1735 - protein, 839 aa, Clostridium saccharolyticum
MAELNLKQITDKLNAEFASDVRKLIFWYDAGAEFSSDIESIELENAKVLKLERDNQFYIKYFLEREDTTTNYLIYAPFPKPALKENHLADTIRYSKEFFADRASLLAVDLGIDEKYKPVLQHYIKFFGSKERTQKFYELEIENFNKSIIEIALMGVLCKTKIVSFEEIVRTVITDGDIEDNNYLTEFEKFDLLKPFWKMCEETFGYTDVSPTLNKLVYALFVTYTSKVIRTELPQSWKNYCSYKSGNIIAFLDSMMNSLIFKENFDVLSDMVYSTLNGDTIFDKLNVNDYSDLEIFKKTDIFILKWLIDRLEGEDTAAKLNGHSIPELCRMRRKMHFGQMYFSHYYILENAYHLIMAARFEPQKSSLDIWKSYVAKDHIVDQKYRYFYYHYDQLANNSPYENLRDLVENIYTNRYLDPLSVAWNRAFSECKGDTGLIKQHEFYNKFVRHAKERVVVIISDALRFEVGQTLLKRLISDEKCNASMNVMQSVLPSYTRFGMSALLPHKELSMSEDYKVLVDGKVCDDLKTREQVLQGFIPNSRTVQFDDIKTMKIADLKEIFTGQEVVYVYHNQIDARGDKLNTENEVFSACEEAIEEIHTMIKRLTSANNTRFIITADHGFLYKRDKLAESDKIGGFDKKDAFVGRRYVVAREAVTAEGIGTVTLGDILGNHDERIISVPIGSDIFKVAGGGQNFVHGGSSLQEILIPVIDVKTNKAHTETKAVSIALVSLIHKITNLTTNLDFIQTDAVTDVNKETTYKLFFISGDNEKISNDNIYVADKKDEDASKRVFRLKFTFKNKKYDKTRKYYLVAYDEKNVLEVLRHEVQMDLAFADDFGFNL

SEQ ID NO: 1736 - protein, 840 aa, Clostridium saccharolyticum
MAELNLKQIIDRLNAEFTGETRKLVFWYDDKAEFAEDMETVELQNAKIYHLQPDNQFYTKYFLERVDKTTNYLIYAPFPKPDVRDNHLEDTMLYSRRFFADRASLLSVDLGIEEKYKPVIEKHIKFFANKERTQRFYDLEIENFNEENILVGLLSAVCKARTCSFEEVVRIMLTDGELVDNAFLQEFEKYDLLSAFWQLCEQHFGYTDTKPSLERLLVTLFVTYTGRYVQAELPAAWKSFVSYKSGNIIAFLDSLMNSVLYRDKYDALSAHVAKGMNVLSAFAGMRVDDLVECDTFLAVDQVLVKWLISRLVSEDIGAIVNGFTIPELCEMRAKMHFGRKTGKTYQMLSSAYSMVKEADYHAADGLKPIIDRYLAADYNMDQQYRKFYYYYDQLESTESFEPLRELVENIYTNEYLACLLPAWNAGIQQDAAFSAIPLQREFYNANLRYTKERTVVIISDAMRYEVGQELFARMQDDPKCTAKLSVQLSVLPSYTRLGMAALLPHKTLEMTDDFQVLADGILCDNLAGRQQVLQSYNPDSVCVQFDDIKNLKVAELRDVLTKRQIIYVYHNQIDARGDKANTEDEVFNACEEAVQEIMDLIHRISVSGNTYHFIVTADHGFIYKRDKLTESDKISGKSAEKAFVNRRFIVSKAALEDDGIDHMSMGRVLGNEDSKVVSYPVSSNVFKVAGGGANYVHGGSSPQEMLVPVLEFKMERGHMETKNAEIALVSIVHKITNLITSMDFIQSDAVSDTVKAAKYRIFFLSEDNEKISNENSYVADSREENAQKRIFRMRFTFKNKKYDKDKQYYLVVYDEESGLEQWRQPVIMDIAFADDFGFGF

SEQ ID NO: 1737 - protein, 839 aa, Clostridium sticklandii
MAELNLKQITDKLSSEFSSDVRRLIFWYDARGDFALDIDSMELENAKIIKLEPDNQFYIKYLLERQDTSTNYLIYAPFAKPSLRDNHLADTIKYSKEFFADRASLLAVDLGIDEKYKQVLQKYIKFFASKDRTQKFYDLEIERFNQRIIETALMSVLCKSKVVSFEEVVRTVITARDLEDNRYLQEFEKYDLLSAFWQMCEETFGGNFSSPSLVKLVNTMFTTYTSKVVMSELPSAWRNYCSHKSGNIIAFLDSLMNSMIYRGDFDGLSDMVYSTLDGETVLSSVDVSQLIELEIFKKTDVFILKWMIDRLEHDDLDARLNDYSIVDICKKRRKMHFKHVFSSHYYILENAYYLLKEARYKPAEELEEITKNYITKDYIIDQKYRYFYYHYDNVPDSSIYENLRELVENVYTNRFLNPLAVAFSRALCENKAKISLTSQQDFYSRFVKNSKERTVVIISDAFRYEVGQTLLKRLMEDEKCTASIQAMMSMIPSYTRFGMSALLPHKSLDMTEDYRVTVDGKICDDLKSREQILKSYNENSRALQFDDIKGMKMTQLKELFTGQEVVYIYHNQIDARGDKLNTENEVFIACEEAIKEIHMMIKRLTNANNTRFLVTADHGFIYKRDKLDESDKISGFDKESAFVGRRYIVSAQKVSSEGVCSMTLGDVMRSDDERTISLPLGTDVFKVAGGGQNFVHGGSSLQEVIVPVLDVKTNKGYTQTQAVKISLISLVSKITNLNTNLEFIQTEAVSDVNKETNYKIYFISDDNEKISNENIYVADKKDIDASKRVFRLRFTFKNKKYDKSNKYYLVAYDEKNDLEVIRHEIQMDLAFADDFEFNL

SEQ ID NO: 1738 - protein, 855 aa, Clostridium sp.
MAELNLKQIIDRLNAEFTGDTRKLVFWYDDKGEFAEDMDSVVLENAKIYHLEPDNQFYTKRFLEREDTTTNYLIYAPFPKPDVKDNHLEDTLLYSKRFFADRVSLLSVDLGIEEKYKPVIEKHIKFFANKERTQRFYDLEIENFNEENILVGMLASICHTRTCSFEEVIRVILTDGSLEDNKFLVEIEKYDLLSAFWKLCEQHFGYTDPKPNLEKLLVTMFVTATERELSGEVPQPWKTFVSYKSGNIIAFLDNLSNSVLYRDRYDELSAHVATGLNLTTALSGYLPEDLVDCDTFIAIDQIIVKWIVERLTAEDTGAKLDRYDIPTLCDKRSKMHFGRRTEKTYQLLSSAFRLIEAANYIAPEGFKNIIDRYRKTDHLIDQEYRKFYYAFDKVNAFEESREGGLGRAMEETSAFETLRSLVENIYTNEYLAKLLPKWNEGIQEENAMSEIPLQRNFYRRHVLNSKERTVVIISDAMRYEVGQELFRRMQDDPKCTAKMDVQLSVLPSYTRLGMASLLPHNTLTMTDDFRVLADDVLCDSLSGRQTVLQSHETNGVCVQFDDIKNLKSMDLRNIFTGKQVVYIYHNQIDARGDKANTEDEVFVACEEAIQEIMSLITKINGSANTHHFIVTADHGFIYKRDKVTESDKIGGVSGKSAFINRRFIVAKDPVVDEGVEFLPMSIILGNQDPKIVFYPISSNVFKVAGGGQNFVHGGSSPQEMLVPVLDIKMERGTVETRPAQIALVSMVQKITNLITTMDFIQSDPVSDTVKIATYKLYFISEDNEKISNENIYKADSRDPDATKRIFRMRFTFKNKKYDKNKQYYLVAYDDTTGLESFRHPVIMDLAFVDDFGFGF

SEQ ID NO: 1739 - protein, 842 aa, Cupriavidus necator
MTIAEFIRECVLRPRLKEAGCLVVYDADRRYREQCFDLAADKVRVVDAAESSIESREAALLALREVGQPKAPLEGVLIYVPSRRPETEEQKQADPFALYAECGAVFPQDDGDEYLSLCLRARPDHATEIRQVFAGSSAGPTFAVIDAIGGGVSWPQLRATLKVESGREILAALLAPNAAQAEALKGQEGWVQEARDFLRATLAMTVKTRGKTWAALADELWRYVLFSEFVFDLPGALPDTLKGVPHAPMEARPIVEEVCDRLRSDPRARAVYIERAEAIEAELNLSELCGAIDDLGERDTFPFEERTFLRTAIKGVTSNDTDAARRVLARHKNSVWRGKGESQAQWELVRAGLSLVEACEDYERQLPDHARSQADLLDFYLGSLREADRLQREFEQAVGDFLDQHGLMHEVISQARARYRRLAEKVQGVFVKHVETAGWPPTGRMANADAFDRLVADRLKESGRKVAYLMVDALRYELGVALEKLLAEDGPVELQAAYAQLPTITLVGMASLLPGANAKLTLALENESLIPKLAGAPVGNVNQRMDAFRRRLGDRFDEMVLNDFVRGKAKIAETVDLLVLRSTEIDSHLESNPETTLSLIPGTLKLIRVALHKLRGMGFKEAVIVTDHGFFLNAQAEAGDVCVKPQGKWPVNAHDRMMLGEGAADSHSLVVSAEKVGIRGDFAQVAMPRSMAPYRSGHLYFHGGASLAEAVVPLLIARLDAAEQPELRKVNVELSYKSGAKRITTRVPVLEVILVSEDIFSQGMSVEILLEAQDSKGNVVGEPRPGGDVNPATRTVTLMSGQRKQIALRMEPDFEGKFSVKALNPTTLASYCSLNLETDYTV

SEQ ID NO: 1740 - protein, 835 aa, Cyanothece sp.
MDLNIKQALNKLFERHRIVFWYDTEKELRSDFERLELEGIEKIEINHNEFGLKYRILREQPQQKFLLYYEGKEPEYLDNWLLDIQLAQGKFCTDQVSLWLTELELGLEFGDVVQPHREFFQSRQRREALKQLLHPHDTKTNIRLKMLAVCTAAEPRLDTILERLLEEYAQQQDEKIKLCDRAGLTKFLWQQMEQVYGYRSQELSIKDFVIELFKSCYTAAVEGEGTLTGDALIFLNRWKDSRQFEQSFESLSHQCADILKIEQKLNQRYYQDLIEIDYFRLIDQKIIHDLVQFVSNRTIATHDVTNIVRQRKQGHWYREFEHFYEAINYASQFIQVLDEANLSIESLTDGLEKYCQSWFKIDQLYRKFIYHVSTSANPTLTEKLTEQIENLYANHYLLNLNNYWQVLIDDINDWNRIEFPSQRAFFSKWVEPFLKKDKKVCVIISDALRYEIGDELVSLIRQEDRYEATLKAAVTLLPSYTQLGMAALFPNETLEIVDHPNAIVYVDQQSSQGTENRGKILEKAFQKRQKKATVIQAKDLLELNRDESRSLFRDHAVVYVYHNRIDQIGDKLATEEQVFEAVENTFSDLIKLIKKLTGANASNLLITADHGFIYQHSAIADSDFSMVEVKGDKIIKENRRFVIGEGLKDSDGLRKFKAQEIGLIGELEIQIPKSINRLRIKGSGSRFVHGGASLQEIIIPIVKVNKKRRGDLSTVEVEIIRNSTSSITSGQLAVTFYQQEPVTDKVQPRILKTGIYTQTGELISDLHELTFDSPSENPREREFQVRFILTSQANNINNQEVLLRLEEKLTDTSHFTEYKSVSYTIRRSFTSDFDF

SEQ ID NO: 1741 - protein, 841 aa, Dehalococcoides sp.
MKFTSFLHKKLADLLNDRRIVVWYDAQGDFKEFAASFGAPNCEVLSADASVLKIRRRADEVYRLMNESEDSSERERYMLIYIPRGRGVTEDEKMRDPFEVYAIAGVAFGDTEDQKIESLARQAMPNKAEEISRLFREGNPDIALLDELENTQKWPVLNEVFHTETPSDIAALALCNTVKAEEVDSRPGCIAELLRLFEDVFGFKTSERRKWKTLRPKAAEYILISEFLFDLPDRFPEALSAVPRASNDAKSTVYAACDRMRADLGLQETYIELAGAIEDSLHLSTILPGDLKLGGRDTFPFEERRLLSRAVTHVVFGDATAARIVNERQKHSIWRHDPQRSLAWTVIERATVLIELCTLVSHGLSSKKELVGLIKAYTECGWSNLDRASRLFEAALTACPDEDIIEPIIDPCRRRYREAVVQLQDNLLMAVQAEGWPPDGAPRQTRIFDDLVAPLLERRKKTAFFMVDSLRYEMGRDLADALAGTGSVEINYAAGTIPTVTGCGMAALMPGADGMLRLVAKDGGLVPAVGNRFLKTSADRMRFLSEIYGDRFFETTLDEMLGSPKKIAANIKNAELFVVRTQDPDAVAENLGGWRARRYLSDVVGDIASAVRWLASQGYNHIVISADHGHMMLPEIPPGDVVQTPPGGWLENKRRCRLGSGLAGAAGTITLKASNLGIQGDVHDVCLPVGFRVFSEGEGYFHGGLSLQEAVVPVVVFQAGAEKQSTAGKPDIDILYRSDKFTSRVIGLKFRLQGDMFGTANRVRIESFDGPGIKAKIIGEAADCEARDEKTHEVSLQAGKETPVPILIDPDFDGPEVEIRVSDPETRVVWAKLKLKNAMLD

SEQ ID NO: 1742 - protein, 840 aa, Dehalogenimonas lykanthroporepellens
MTIKQFIQEEVLRPKLKKASVLVVYDPERRYRDLCCEMVADKCAVVDATESSIESREQALALLQELGKPGAMFENLLVYVPAAQPLTDEDRQQDPFAIYGAVGTEFPEGDGDEYQSLCLKAKADYATEIRRIFADNPNPTFDVIDAVGGGAGWPTLQAHLKVESARDILFAMLAPTAKQLESLKSSDAWVPEIRTLLTNTLGLKLKTKSKNWSPIADELWRFLLFSEFVYDLPGTLPGALSDVPCAMTEARPLIEDLCDRLRDSTANQPLYIERAETIETDLGLRDVCKDLEDLGVRDTFPFEERSFFAQAVDALKRDNIDKLRQMLGRHKSSVWIGRGENQAQWQLLQAAVSLVEACEDADRQLPDHAKTQEALIDFYTSSMREVDRLQREFEQAERDLLIKQDGVDVVIPHARTAYRKLVDKVQGVFIRHLEQSGWPPAGRLANCDVFDKMVAPKLQESGRRVAVLLIDALRYELGVELEKQLVDDGQVEMHAAFAQLPSITPVGMASLLPGAGSELKLIRKEDQVVVALGEQSLPQVTQRMDVLKKRFGDRFAEMSLTEFVRGKGKVDGGVELFVLRSTTIDQHMESTPEMALRLIHESLKSIRVAIHKLRGLGFKDAFVVTDHGFYLNTATEAGDVCAKPQGKWINVHERCLLGDGVSDTGNFVISAQHLGIRGDFNQIGGPRAMVPYRAGEWYFHGGASLQEAVVPVIAVRMQEPEGKFVPQAKITLNYKRGATKITTRLPVIEISASSADLFSMSATFEILVEAHDKQGNVVGEIKLGGMVNPATRTLSIKPGQNIAVTLRMDLEFEGSFTVKALDPVTLTTYSKLDLETDYTV

SEQ ID NO: 1743 - protein, 870 aa, Desulfitobacterium hafniense
MLSETIKSRLAERFAAPLTEFHKRRIIFWYDEDGEFAEAVDQLALDGVTLVKLTGKNNFAVKKLLAEDDLTRDYLVYDPLTYEKDQRDDWLLDIKLHSEEFRADLISIQMEELLVEPTSAMRKTMKLYAKFLGNKDRKAKLRRIGKSYQTPLGLHIDIMAVLCGLNGGTAQDVIIAVLSAGLDKENNAPLANIEKFGSIEAFWQLVQKYTGYVNGDARPLSDLAAHILISALSQTISNSALRGLERFITDSCKAYCYQLVHEWQHENHSLTPAPDSLTLIDICRHIEGELRLADRFDKIEISLLLKTDAFPAINESILKRFYGEIGERVIKVDSILEAVENRRTSGWYNLIGNYLESLYYIAKMQEFYLAHIEGFHFVEPAKIWKLYTIDAYQMDSHYRHFHYYFGNTLKAPNALLEDPLKKCSDVVEGLYHQWFLKELTLNWTNAIADDLDSLGYVSEVNKQRDFYRRYVFPNVSKGNRVFVVISDALRFEVAAELSEVLSHTTKGKATLEAVQAVFPSITKFGMAALLPGKKLSVSDKMEVSIDGNLTGSTANRGSILSAANPDSVVVTYKDLLQMKKTERRALVHGKEIIYIYHNTIDAFGDKFATETKVFEACDAAISELNAIVKIIVNDLSGINIFITADHGFLYTHKPLEESQKISRQNFNGEIYEIGRRYALVPPATSADYLLPVKMEREIGGIPLKGYAPQDTVRIKVQGGGENYVHGGISLQEMVVPVIVYKGMRSGYKQYVEVQNPGLSLISESRKVSNLIFSLDFLQKQPVGEKVQACGYTLHFSDDVGVPVSDTQTVIADRTSSNASERVFRVRFTLKPMQFNKSKIYRLVIANDTDMPEEIEFRIDIAFADDFGFDL

SEQ ID NO: 1744 - protein, 831 aa, Desulfobacula toluolica
MTQIIKSLEKIFKKHRIVFWYDAKKELRKDYEELEFQDIEKIELNNNEFRVKHRILREEPDKKFLLYHEAEAPSDLDNWLLDVQLAFGEFRADQSALRLNELGLGIEFVDIVNDHAVFFNAAKRKEKLKKILASDDTQNAVRIKMLAVCAASEPRLDDILENLLSESAVKKDEKLKLIENSGLDAFLWNRLELSFGYTSDSPGIKDFTIRLFKSCYDMSLGNDSNLVPDALVFLKRWKDSVKHQKAFETLSKECADILAIEKDLQTRDIASLEEIDYFELVDLKILSDLVKSVVDQTVSSGDRERLIRKRKLSHWYKTYKALYQAIDYGARFIKFLDETEFAIESMDDGLTKYANYWYRLDQLYRKYIFHTRQSGQVSMLKALSDKVENMYSNNYLLTVNNNWQNQVDKCDCWGKTRIEFQRHFFQQQVVPFLNDKKKVFVIISDALRYEIGHELLSRIRQEDRFDAKISPMLTTLPSFTQLGMASLLPNKDIRFSDNHSTTVFVDGKSTQGTENRSKILQNAVSGAARAMRADELMGMNKTECRELFREHDVVYVYHNLIDDTGDKKESEGRVFNAAEDTLEALIKIIKKLVSANATNLLVTSDHGFIYQDRVLEDSDFLGTDISGIEALHRDRRFLLGKDLPQSTGMKCFTAKQAGIEGDMEIQIPKSINRLRLKGSGSRFVHGGATLQEVVVPVINIHKKRTSDISKVGIDIFSGSTSFITTGQFAVIFYQAQPVTDKVQSRSLRAGIYSKNNDLVSDCHNLNFEFTSENPRERELKIRFVLTQKADDQNEQEVYLRLEEKEPGTAYFKEYKSARYVIRRSFTSDFDF

SEQ ID NO: 1745 - protein, 777 aa, Desulfomicrobium baculatum
MPNILKELANTIRSSGNHNPEIQTPPVCILWPDKERQWEGIILLLLDELPELFILGDYSSDKRTGPAIWLRCVLANTLSNIPRPLNQTPILYLPGVSRQDLRAVENCPEHLKPLAELQYRGTIWNQSNAKDWTILAFLRSAQGGLGLDVAQDNDTKQSMLLALSRLLDEEVEPLKNKRLDAEFFKKLLIGDPRRQILEWIDHSEKYRTNSSENEWLAFIEVCRSQFGIHPEKDGPLVASERLALREGPWKTVWDRFCEAPNRYPNIPAQIKKCKMPGNSMLWSMGKASEYEGWPQWNELQETALRQGLLSLAKHDASTCRTELIKFEQHHVARRSLVWAELREASLALALEHLMVMASEIRKSLNAGSLDDVVQAYLNSAWKADDAVLSALACVESSEDFNAVTVAIRSVYLPWLEDSARHLQNIWEPIAKIDNLSSDAESCIVFVDGLRADSARRLKSILASKGAVVKEQIRWAALPSVTGTGKPAVAPLASTSAAENPSSTDFQAMSPYQFEKALKDSGWMVIRAKDPIPAPICQGYPVASTVNKLWVEIGNIDHEGHERGAKLAKQLPALLAEVAERIEALLSAGWSRIRVVTDHGWLLLPGGLPKSNLPSAVSESKWGRCALIKSGAITDHRIFPWHWNPDESVVLADGISCFRSNEEYTHGGLSLQECLTLDLIVSSDSLQEAVTIAEVRWKGLRCSVLAQGALSGLQLDVRKFAEDADTSLINQAKPIEDDGRASVLIVDMDGDLDGTDAFIVLTNDAGTVTTQISTRIGG

SEQ ID NO: 1746 - protein, 838 aa, Desulfosporosinus meridiei
MAELNFKQIIDKLNAEFAGDIRKLVFWYDEKAEFADDIDTLELTNAKVYHLESDNQFYTKYFLERLDQTTNYLIYAPFPKPSVRNNHLEDTLLYSKQFFADRASLLAVDLGIDEKYKPVIQKYIKFFGAKDRTQRFYDLEIENFNRDTIEVALMSALCKTRIASFDEVVRVIMTDDGFEDNKYLAEFGKYDLLPAFWRLCEDQFGYTDVKPTLEKLVVTMFVTYTERYLHCELPQSWRSFVSFKSGSIITFLDNLMNNVLYRGRYNQISANVGDELNVTAVFESYPPQALIDCDTFAVVDRFIIGWINERLLAEDTGAKLNEMSIPVVCQERRKKHFGESYEGQYQLLENAYYLILAANYHCPDQFMGIVDQYRASDCLIDTHYRNFYFYYDQLTDNAPFEKLRDLVEAIYTNEYLSAVIPKWNAGFTGEEALTVLPLQSDFFNRYVRSCKERVVVIISDALRYEVGRSLWVKLQEDEKCSAQLEAMISVLPSYTRLGMAALLPHKTLEMTEDYRVLVDGSPCDDLKQRETVLQSYVKNSRCLQYDNLKSRDVIRQAFAGMEVIYIYHNQIDARGDKHNTENEVFTACEEAIGEIYNLIKRLTEDVSATHYIVTADHGFIYKRDKLQESDKITNIAEKGSFVNRRFIVSDQALQEDGIFSVPMSWILRNEDPKMVSFPISANVFKVAGGGQNYVHGGSSPQEMIVPVLDIKTAKGHKETRTVQITLVSMVQKITNMIASLDFIQTEPVSDVVKGTRYKIFFISEDNEKISNEAIYVADKKELEPQKRIFRLRFNFKNKKYDKSKQYYLVAYDEKNDLEILRHAVVMDIAFGDDFGFNL

SEQ ID NO: 1747 - protein, 872 aa, Desulfovibrio magneticus
MDSAKIQEALSKIYDIEEYRIVFWYDPEQEFLETLSMLSIEGVTVVNLLDESLLELKIRLETQDRTGKYLLYSPSPEPNPENDWLLDIRLYSRPFHADRASILLNELGLTSQSLRAHLNERKKFFKSQDRLNRLRKLVVAEDKESDLDQKMLAVLTRSDQASTFDVLMNLFSEMCTGVSCDFKSPTSSWGDIEKFGVAPFFWEKMAMTFGYVADSPSLSDLLIRLLVSDFSNTLKGTIPGSLAHFQFTDKSLAINSSVFIAQWRSHLSHFREYAAISQEIATELRLEEQLGGYNEESLLDVMTFEVVERQVLRALRKKIKQDQWDKPESLKPVIQRRRDGYWATIQLDQYTESGNIYKTTYDALEAALDLLTLRKIHDAGFSFAKAGTMYQAYTSELFRFDQLYRLFHEYADRLELAGWDVLKDVQKIVEACYSGWFLDQLSISWGSFLDGRDGLLKEWSIENIPNQQDFFSLTAQPVLQSHARSKVFVIVSDALRYEVAEELTRELNSKFRFKATISTQLGILPSYTALGMASLLPHRGYGYKEQSDQILIAGQPCATLEQRSSILSNVNGIAVKADELLAMTKDDGRELVRPWRVVYIYHNQIDATGDSAQTEGKAFTAVRKAIEELSSLVRFIVNSLNGANVFVTADHGFIYQDTPPSPLEKSDLAFKPDGVIKAKKRYILGRDLGESEKAWHGSTRVTAGTSDDMEFWIPKGVNRFHFSGGARFIHGGAMPQEIVVPVVQVRELEGKTAANEAVKQVNVSLLGSNRKIVNSLQKFELIQTEKVSDRMTPRTLVVSLRDGELLISTEEMVTFNSSSDSMEERKRSLTLRLKKGSYDNKREYFLVFRDPGTQIEYERIPMTIDLAFMNDF

SEQ ID NO: 1748 - protein, 832 aa, Desulfovibrio vulgaris
MNDRIAQALTKLFDRHRIVFWYDAKLELRDDFEALHLPGVEKLELTNNEYGIKYKLLREQPEQKFLLYREGPQPADLDNWLLDVQLAHGEFRTDQVAIWLSELELGLEFTDVVQAHAEFFQAIKRKDALKKLLKADDTAGQIRLKMLAVCTGSEPRMDAVVENLLQELADGRDEKIKLVGRCSLDGFLWEQMTRCYGYKSEEPGIRDFAIELFKSCYAMGTDGQVKLTGDALVFLKRWKDSRQFEGGFETLSGECAEVLGIEQDLTKRDFRELIELDYFRLIDQKIISDLVRAVAARTASSGDVAIWVRQRRQGHWYREYRHLYEAVDYAAQFTNALGEAKLAMDSLAEGVQRYSRFWYQLDQLYRKFTYHVRMSGQASLMGSLTDQVENLYSNNYLLKLGDRFQTFVDAATKWEAFPVRKQKEFFEHWVRPFLRKDNKVCVIISDAMRYEIGDELLSLIRQEDRYSAELEPALSMLPSYTQLGMAALLPNKALAIADNETGTVLVDGQSSQGTANRIKILGQAISHRATACKADELMAMKGDDCRALVRDHDVIYVYHNRIDATGDKRESEERVFEAVEETLQELIRLIKKLTGANANNLLVTSDHGFIYQNRAIDESDFSGVDAEGEQILFRDRRFVLGKGLAEASSLHKFTPEPLGLAGEVEVQIPKSINRLRLKGSGSRFVHGGASLQEVVIPVLKINKKRQSDVTAVEVDILRGASSVITSGQLVVTMYQAGPVTDKIQPRVLRAGIYTEAGDLISDSHDLTFDLSSDNPRERELQVRFVLTRKADEANGQEVILRLEEKHAGTSHYKEYKSIRYLVRRSFTSDFDF

SEQ ID NO: 1749 - protein, 832 aa, Desulfovibrio vulgaris; identical to SEQ ID NO: 1748

SEQ ID NO: 1750 - protein, 779 aa, Desulfurivibrio alkaliphilus
MRVIDQLLQAVRGAAVYNPEVQVAPACILWPDHDRQWEAVIPRLQAELPELFVLGDYAPEQRTGPAIWLRCVVAGKIEEVAPPAHRPPILYLPGVSRQDLRAIESCPEPLKPLAELQYRGVIWSQINAKDWTILAWLKTDQGGLGLDVAQDQEARKAMQLALYRLLDEEVERLRDKRLDKDYFNTLLTGGDPVRDLLQWLDQGENFLADRNANERQAMVEVCKSQLGFDPAKQGILAGAARLASRQGPWQGVWERFCEAPLRYPGIPAQIRKCQPPSGSLVWLTAAPVNHGWPQWNESQENILRRELQGLAEVAAPAARQKLAELEKQHGFRRELVWAELGEAPLALALEHLAVLAGITASGLVAGTAADLADRYGQQGWQADDALLRALAKVTAPADLAALTAAIRAVYLPWAEESARYLQQSVAAAGYPGGSIVTRKVAPPQPGECLMFVDGLRFDLARRLQSMLTAKGYEIGQRPYWVPLPSVTATGKPAMAPILASPELGEGTAGYNFEPMTSYLLRKLIIEQGWQILERNDNGDGQGNAWCEFGDIDHEGHGRGWKLARQVDPLLEEIRDRIMALLAAGWGRVRVRVVTDHGWLLLPGGLPKIELPACLVDSKWGRCATIKQGAATDEHLYPWYWNPEQQVALADGICCYRRGEEYAHGGLSLQECLALELSVRRSAETPEAAEALEFTDIVWKGLRCTVAVAGNFAGLTLDIRRQAGDPASSVVVGTKGLKSNGTASVVVEDEELEGQEAALVLLTADGALAAQVVTVIGGAK

SEQ ID NO: 1751 - protein, 867 aa, Enterobacter cloacae
MDITQLQTGLNNKFTADRIVFWHDPEQSFTAQLTELSILWNGLPVTVLNMAEQSQLQTRKRIEIDEPMQGFLLYWPSSEPSPAKDWLLDIRRYSTTFYADAASILLNDLGLANMALRDHIASRKSFFANKERTAAFKRRLDGRGGIEDPLSLDMKMISVVLACHAQIAEIMKSIGDRLLENAETALVPLEQHGLLPGFWHLMNLEYGYHIAEGTEPSLRELIRKLLVSECYEQLDTKERPVWLQSQLLATPTGRANAMALLSGWRDSNQYSSNFADISAQVADQLELASRLTAQDIWLWGEVEGFEAVEQGLIRELISGLNNGDLKLNRVEFAQLISRRRHGFWARTVPKYAYIYQALQQAELLLELRRSKPDGFHYTSAQEMYLAYEAELFQFDAAYRLFNEALLHLQGQSVEVLAVLASKIEDLYVNWYLYQLGLTWDGLLVKERLLDNWQLGLPSQHRFYDTVIKQRFAQSGVKRQFVIISDALRYEVAHELQGQINEAKRFTAQLKSQLGVLPSYTQLGMAALLPHQQLDYAATNSTVLVDGQSSAGLENRSTILSKVGGIAISAKSLLSWTRAEANEAVGDAKVIYVYHDVIDAQSESQKSELKTFIHARQAIDELNGLINKIINGFGVTRVVITADHGFLFQQASVENGVKSPLKHEPSGTLEASKRYLLGRNLPTNEDVWHGQLRNVVGGNSDVEFWLPKGVSRFHFVGGARFVHGGAMLQEVCVPILEVQELRGKKQTLHEKTKVDIVPAYQPIKLVNVIDKIRFLQTDAVDERHKSRMVRFSVVDSSEQTVSAIEKLLFEATSSNLDQRQQDVRLKLTGAQFDRKAQYQLLLVDDEDGIEMARYPVTIDLAIQDEFGF

SEQ ID NO: 1752 - protein, 867 aa, Erwinia sp.
MTLQNQEFIAGLKAKFAEHRIVFWHDPDKRFLEELGNLKLENVTLLDMTDQSQLAVKKRIEIDEPEQQFLLWFPHDVPAKEFDWLLDIRLYSAEFHADFAAITLNTLGIPQPGLRDHIQRRKAFFSPRRLSALKGLVTEQENEASLDKKMVAVIAGVKTAKTEEILFSLMTQYVNQQQDDDSDLENTLALLKRHDLQGVLWGILNQEMGYQAEHPSLENLILKLFCTDLSAQADPHKSAWLEKNVLATPSGRASALAFMVTWRADRRYKDAYDYCAQQMQDALRPEDQYRLSSPYDLHACETTLSIEQTIIHALVTQLQEESTTLDREAFKKLMSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLAAENRMQAWRIPGVPSQQNFYNEAVKPQFNNPQIKRVFVIISDALRYEVAEELGNQIKTEKRFTAELRSQLGVLPSYTQLGMAALLPHDEMGYQPGNGDIVYADGLSTSGTPNRNTILKKYKGMAVKSDDLLKWKNQEGRDLIRDYEVVYIWHNTIDAIGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFMIPKGIQRFHFSGGARFVHGGATLQEVCVPVLQVKALQKTAADKQPQRRPVDIVAYHPMIKLVNNIDKVSLLQTHPVSELYETRILNIFIVDSANNMVSSKERISFDSDNGTMEKRVRDVTLKLIGANFNRRNEYWLVLEDAQTETGYQKYPVIIDLAFQDDFF

SEQ ID NO: 1753 - protein, 867 aa, Erwinia pyrifoliae
MTLQNQEFIAGLKAKFAEHRIVFWHDPDKRFLEELGNLKLENVTLLNMSDQSQLAVKKRIEIDEPEQQFLLWFPHDVPAKEFDWLLDIRLYSAEFHADFAAITLNTLGIPQPGLRDHIQRRKAFFSLRRLSALKGLVTEQENEASLDKKMVAVIAGVKTAKTEEILFSLMTQYVNQQQDDDSDLENTLAMLKRHDLQGVLWGILNQEMGYQAEHPSLENLILKLFCTDLSAQADPHKSAWLEKNVLATPSGRASALAFMVTWRADRRYKDAYDYCAQQMQDALRPEDQYRLSSPYDLHACETTLSIEQTIIHALVTQLQEESTTLDREAFKKLMSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLAAENRMQAWRIPGVPSQQNFYNEAVKPQFNNPQIKRVFVIISDALRYEVAEELGNQIKTEKRFTAELRSQLGVLPSYTQLGMAALLPHDEMGYQPGNGDIVYADGLSTSGTPNRNTILKKYKGMAVKSDDLLKWKNQEGRDLIRDYEVVYIWHNTIDAIGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFMIPKGIQRFHFSGGARFVHGGATLQEVCVPVLQVKALQKTAADKQPQRRPVDIVAYHPMIKLVNNIDKVSLLQTHPVSELYETRTLNIFIVDSANNMVSSKERISFDSDNGTMEKRVRDVTLKLIGANFNRRNEYWLVLEDAQTETGYQKYPVIIDLAFQDDFF

SEQ ID NO: 1754 - protein, 865 aa, Erwinia pyrifoliae
MQNQEFIAGLKAKFAEHRIVFWHDPDKRFLEELGNLKLENVTLLNMSDQSQLAVKKRIEIDEPEQQFLLWFPHDVPAKEFDWLLDIRLYSAEFHADFAAITLNTLGIPQPGLRDHIQRRKAFFSLRRLSALKGLVTEQENEASLDKKMVAVIAGVKTAKTEEILFSLMTQYVNQQQDDDSDLENTLAMLKRHDLQGVLWGILNQEMGYQAEHPSLENLILKLFCTDLSAQADPHKSAWLEKNVLATPSGRASALAFMVTWRADRRYKDAYDYCAQQMQDALRPEDQYRLSSPYDLHACETTLSIEQTIIHALVTQLQEESTTLDREAFKKLMSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLAAENRMQAWRIPGVPSQQNFYNEAVKPQFNNPQIKRVFVIISDALRYEVAEELGNQIKTEKRFTAELRSQLGVLPSYTQLGMAALLPHDEMGYQPGNGDIVYADGLSTSGTPNRNTILKKYKGMAVKSDDLLKWKNQEGRDLIRDYEVVYIWHNTIDAIGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFMIPKGIQRFHFSGGARFVHGGATLQEVCVPVLQVKALQKTAADKQPQRRPVDIVAYHPMIKLVNNIDKVSLLQTHPVSELYETRTLNIFIVDSANNMVSSKERISFDSDNGTMEKRVRDVTLKLIGANFNRRNEYWLVLEDAQTETGYQKYPVIIDLAFQDDFF

SEQ ID NO: 1755 - protein, 831 aa, Erythrobacter litoralis
MSDRIKTGLKLLFDEHRIVFWYDAARDMRGEFDAVKLPGVQKIEIANNEFALKYRMLRQEPRQKFLVFHDGPAPEMDDNWLLDLYFASGVFKADQAAIWLAELGLPLQFEDVVRNHMEFYRSKVRIEALKQSVTPSDTKSEVLRRMIAVCAGAQGALDTVIEELLAELADERDDAMRLIERSGLTDFFWKQVENAYGYTSEEPDFEDFAITLFQSCYARALGEDGKLNGEALLVFRRWKNNRLWSTAFETLSGEYQDLLKIPEDTQDRDIKTLGAIDHFEEIDRHIIRSLVHEMASQTVSSAEVLKAVRERRQSHWYPTYEDIYEAIRHATEFQQALAEANLTMTSPDEGVKRYVSHWYRIDQLYRKFIYHMQKSGQASLLSALFESVENRYTTNFLQAVNDAWQDHIAELKDWKISGFAHQTDFYVDQAAEFRRRDQKVVVIISDALRYEVAEEALREIRKLNRFDAELEPMISALPSYTQLGMAALLPNKDLTLEADASVSSFSLPTQGTVNREKVLGMGRSGDRAKAMKADDFMSLKADQGKEIFRDHDILYLYHNRIDNIGDKLATEEHTAEAAQDAIEDLTKLVRKLTTANFSNILVTADHGFIYQHRALDETEFSIADPDGAEILVKNRRFVIGSDLQETSGMKKFSSADLGLAGDLDVLLPNSINRMRVKGSGSRFVHGGATLQEIVIPVIRVGKQRDADVEKVEVQIIVAGKSLISSGQTSVTLYQAQPVSEKQQQRDLLAGIYASDGTLISDEHALTFDYTSQNARERELPLKFLLSRDADRFNNQDVLLKLRERVGKTSHYEDYTSHRFQLRRGISTDFDF

SEQ ID NO: 1756 - protein, 865 aa, Escherichia coli
MQNQDFIAGLKAKFAEHRIVFWHDPDKRFIEELEQLELENVTLINMTHASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMITVIAGAKTAKTEDILFNLITQYVNQQTEDDSELENTQAMLKRHGLDPVLWEMLNHEMGYQAEEPSLENLLLKLFCTDLSAQADPQQRAWLEKNVLLTPSGRASALAFMVTWRADRRYKEAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERFSFDSDNNTMEKRVREVTLKLIGANFNRRNEYWLILEDAQTETGYQKYPVIIDLAFQDDFF

SEQ ID NO: 1757 - protein, 865 aa, Escherichia coli; identical to SEQ ID NO: 1756

SEQ ID NO: 1758 - protein, 865 aa, Escherichia coli
MQNQDFIAGLKAKFAEHRIVFWHDPDKRFIEELEQLKLENVTLINMTHASQLAVKKRIEMDEPEQQFLLWFPHDAPPHEQDWLLDIRLYSSEFHADFAAITLNTLGIPQLGLREHIQRRKAFFSTKRTQALKNLVTEQEDETSLDKKMIAVIAGAKTAKTEDILFNLITQYVNQQTEDDSELENTQAMLKRHGLDPVLWEMLNHEMGYQAEEPSLENLLLKLFCTDLSAQADRQQRAWLEKNVLLTPSGRASALAFMVTWRADRRYKEAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQKNFFNEVVKPQFQNPQIKRVFVIISDALRYEVAEELGNQINTEKRFTAELRSQLGVLPSYTQLGMAALLPHEQLCYQPSNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 1759 - protein, 865 aa, Escherichia coli
MQNQDFIAGLKAKFAEHRIVFWHDPDKRFIEELEQLKLENVTLINMTHESQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKHHGLDSVLWEMLNHEMGYQAEEPSLENLLLKLFCTDLSAQADPQQRAWLEKNVLLTPSGRASALAFMVTWRADRRYKEAYDYCAQQMQTALHPEDHYRLSSPYDLHECETTLSIEQTIIHALVTQLLEESTTLDRETFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIVSDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVANTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 1760 - protein, 885 aa, Escherichia fergusonii
MQISELAQGVAAKLEQSRIVFWYDPEQSFTEELEHLANALSIAKEVGDSAADITARVLPNDLTILNMGNESVLAVKKRIEVDEREAKFLIYFPSAEPEPDRDWLLDVRLYSEQFFADHSSMLLNELGIPKMALRTHIRKRQSFFANKQRIAGLKKWVTENEDELSLDRKMMAVVVKADSASLSDILLGLLREYAAYIEDESLGQPLWSQLGKFDLETSLWAYLSEGFGYTVEEPTFPDFVLKLFCTEFWSQIEGVERDWLLNNVLKSASGRATALAFMVSWRDSRSFAAYYESISKVLSQQLEISTRAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYEKEVRTRLSLKQTKRVFVIISDALRFEIANELGAIINNEKRFKAEVSTQLGVLPSYTQLGMAALLPHKALSYQPEQGTAVYVDGISSQGLDNRNAILQKVGGMAVSSKELMSWSNQEGRDKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSDTEFLLPKAAQRFHFVGGAKFVHGGAMLQEVCVPVLHARELQKEQAAKHEKQPVGVVAATQPIKLVNNIDKVRFIQTDPVGERFVARLLDVYIVDTQGNEVSSRETINFDSVSKVMDERTREARLKLIGSQFDRNAQYTLVLENAEMRTRYSQYAVTIDLAFQDDFF

SEQ ID NO: 1761 - protein, 852 aa, Exiguobacterium sibiricum
MNMAQIESTLQDIFNEPLKDGEQRKLVFWVDKDEEFTEEIGQLALPNVKVQALSDRNSFYIKHLLEEEDSTSFYLIYTTLELSVEDNWLVDTVLYSKTFFADRISLILNELQIDSSLRAIIKKHERFFNNKERFRKFQSFAIESYSEETIELAIMSVLCNVKTPDFEAVLKEVLIDTLDEGENKLLSQLERFFDMDIFWRYVANYYGYVRETKTLKTLFIHLTVTAFTHSISDEYLTSVKDFIAVRNKANALVFIDHWMHHKTDSIVFDQYAEMVEQEIKLPSILQDIPVDEFKQADTFPYIDKVIIIYIANNLMERLEDYEEYTKLIKLRRVKHYYEKYASIYEALYYTVKMQEFYKAHQQGISQGSVIDLYKAYRDEYFVMDTYYRKFYVAYDEESNHELVKKLKELVEHLYTNWFIGELSSHWSQSVKSEMVEEWSLPGITSQQSFYSSAVAPHVRKGERVFVIVSDAMRYEVGLELIDLLNFETTGICEMQSMLGVVPSVTKLGMAALLPHRKLDFDENGRVLVDGKDSAGLENRKKIIESYVEDSLAIHFQDMLAMNKAARRETFKGKRVVYIYHDTIDAMGDKASTEIYTFNAVETSLNQLKALVKMIRDDLGGTNIYVTADHGFLYQRDALEDSDKISNEVLNAVEVKRRYVLSKEKRKISGQLGINLSSIVDNEEQLTAYVPNGTIRNRMQGTGVNFVHGGASLQEVVVPLVVYKNKRAGQKGSYALQKVDIKLTSSTRKITNSIFNLNFFQTEKVEDKMIPRTVVICIEDIDGTVLSNEETIIGDRTFDNPGDRIFKLQFVLKSISYDRNKMYYLLVKDLETGVVTEKIPFSISLGIVSDFDF

SEQ ID NO: 1762 - protein, 745 aa, Flavobacterium branchiophilum
MIDTWFKKEIEKIFNTHPIAVFIDESKEATFLQEGVKNEYVTFFTNNEIDELKVKYEIEKSLDKNKKYLIYTNTPKEQLKFIREYVETNGAVEIKHFDRYIKEKLINHLNINLHLEKEELIAAAKVSIGKDQTYWMNLSHNGAKEIFNLEKEIVPFLDNPKTYLNKYDKNVQELFFTKVNELIGQPYIEKPAAVLAQEVVFYLLDGLANNNPNKMLLEAYNNWLDSKTYQESFDKYLKKYKLEPKTEIFNCHPAHPFKELDELWLVELGKNINNKEYCVNFLPKINQRIVNKATIHLGITFWKNIKTLLEFDEKNINQIASHQECVSFYTNHFYKLDKAIRELYTEFLDRKNIIEPIQSYYKNYAVIYLDKWFKYFEDYQSNQTGKIQEIINNNALRTAIVVGDGVSFEFAKDIIERVSKEYTLCNQQQFMFAGLPSETEHNMSQLYVDTGVVVAKKQEREAYILNQNTDKSIGFIDLEMVNETTDKQNYLICSYKDPDKLGETYQQKALKYFDQVAALFATKIEQLLRNGYKNVFLVTDHGFVLTGVLENSDKIEVDFKGNVNKSERFIRTEEKQNIDTNLLVEKEIQYANFKYCYFAKRLGPFKTPGVYGYSHGGIAPQETIIPFLKWSNENNTSEQLQVVVSNKNDLNDVTGDLFSIALKATTTEASLFSTERKVILLFFVKNNKVNESDIITISKEMEVKKEFRFGSNAELEVKIVDAITKEQLDKVVVKQNKARDLGGLL

SEQ ID NO: 1763 - protein, 869 aa, Gallionella capsiferriformans
MSNQRIVDSLSSLYANHAIVFWHDADAEFSSVVDGLPLPDVQVVRTDSMPALKVKLDIERAPKQKWLLYSNKPEPELAQDWLLDIRLRSKSFSADAASILLEDLGLTSQTLRAHLKLRAKFLRAKDRVEKLKRLVVPTDTAEDIDRKMLAVLARADQPELTAVLFRLFSGLVAEGMADLNAETRQWQEIQSNELESAFWENVEREFGYAQSAPSLSDFLIHLLVTDFARSLTGTCPGQLAHFILANKTLAANAAVFVARWRSDMAHFASYNALSEQIAKELDIAGMLGGLSGASLSEVMTFAVVEQRIIKQIKDQIIAASGAESNAVRSLIARRRDGHWANRLLAQDNDVTRALAASYDALEAAYGFFELKAAHEAGFSFANAADGLAAYQAEIFRFDQLYRQFNFAAAAVEPMGWAVLHELIERVESAYSGWFIPQLTSSWSKVLEGDSGLLGKWKVDGLINQPDFYIKHVKPVLDGGAKRVFVVISDAFRYEAAEELTRIINSRNRLKASLSAMLGVLPSYTALGMASLLPHSKLAYKLNGNYDLSADGAVVSTSEQRSTHLEQYGGVAIKADDLMALGKDKGREFVRDKQVVYIYHDLIDMIGDKQASETKTFAAVNDALDELGRLANFIINSLNGSVVLLTADHGFMYQESALDVADKSTLDEKPTGLLKAKKRYLIGQGIGVSPKAWCGNTAVTAGTEAGEGSMDFWLPKGAARFHFAGGARFVHGSAMPQEVVVPVITLRASESDKAKTRFVNFSILGASIKVVTNRQRFEFIQDEAVSARILPRMVQISLRDGEEFISDEQSLTFDSDSDLMDSRKRTVMLTVRSGSYDRNKDYFLIARDAQTKVEVMRLPLRVDLAFSNDF

SEQ ID NO: 1764 - protein, 770 aa, Gallionella capsiferriformans
MKAIPTTVLAALIGKLHEQAKRYNPALESAPIAVLWTDEKREWEAVLPQIKQQLPELFSLGAYAPDQRIGPGVWLRMVADRQVGKLEGIPILYLPGVSNGSLRTDLRGVKEDPQLAPLAELQFRGLFWRQENSKDWTLRAFLESKRNGMGLTVAGNHETARALAAAFGKLLNRNLPALIGQNIDERFLDQLMNPNPDEDVLRWLTAPDEIQQEKANAWDTFVATSHTRFGVDMSKGPVEVAQKILACQTGDAAYPLWEKYCAHWHSYPDIYEVFKHISPPDLLQGAERYPSENEADERKLADALLQAVTLEPNAAANKVLELEQKHQSRRETLWAQMEHAPLATAMQYLAEISRAFLSPLNGGTVADFSQHYAETGWRIDAAARESIAIAQTADLEKPIYAVLETLYRRWLEKAAESFQQLVQRDGYPHWSLPDVPDGTVVVFVDGLRFDLARELKEKLVDEGLAAQLEHGFTSIPSVTSSGKVWVSPVGELAEGGSSGGFDPKLPKGDYTAEKLRKAIEANGFCIVDTENPSIANGQGWGEFPGDIDSDGHKKGLRLARAAPAHLDDLKRTIRRLFAAGWKEVWVVTDHGWILLPGGLPKAELPAKIAETKWGRCAILKDSVDDQDWLVLPWSYDATVRIALARGISAFSSGREYDHGGLSPQESIIPLLRVSRPGPVEGQPKLTSISWNSRKTICSVIASDAAELDLSLERLAFPIGEGNAIDKDGKGRVIFEEVDDLLGEQVSLVLRRDGQKVCEEKFNFGEVWHAA

SEQ ID NO: 1765 - protein, 850 aa, Geobacillus sp.
MDIVQELLQLFEKQLEENIGADRAIVFWYDAQSEERDLAEIEQALNEKGIKVWKLNDHNAFQTKVLLELEDTENSYLIYAPFAKPKDEDNFLLDILLYSGKYGEFQADEIAIMMKELRIDHLAIRPFIEEHWAFFKNKQRVSKFKKLLPNNPNANDVKQTMMAVLCDAKSIHPQELLKSVVAKKGGMSDDNEALMQMGKYLDVNLFFELIEDYFGVSPKEEHRLSHIIETIVYQHVASNIDEGVLHVHYPCSVPNICKVFIDDWLKSDEREILETILLELEQKWNVPQLVETHTYQAFIRCFTFPIIERKVLDALHELLLNETVLVNEWKSILAERRKGYWYQAHFAQEYELLEKILDFYEWKIIFERDDAPKNEQEWFSLYTEKYYRIDQLYRHIYLLYRKGTNLERYEQLIERVTFWYENKYLMTLAAHTDHMLETRLSKQWNIPSVMQQKNFYQHFIRPLLEATRERIFVIISDALRYEIGMELLEEFQQRLNTEVKIIPMQATLPTYTQLGMAALLPGKITGIKEDGTIYVNDFSTKGLQNRNNILQMYEVDSIALKMEDFIQLTKDEGQEYIRGKRVVYLYHDAIDAIGDSSKTEAYTYEAVENALERIKAAVRKLTGTYEAVRIFLTSDHGFLYQTSQVEQFQKAESLKGEIYDGNRRFAIGKNLTVPVGAIKVSLDYLGVDCEAVIAKGLNRFTAGGGLRFVHGGAMPQESIIPLIEYRQIKGKARKTEAERVNVQVALIQKVITSYRFIVPFFQEEKVSPERQPRTLRAAFYRNNERISNEVTITFDSTGEVSERQIEVVFHLLEDRYRMGEICVLRLEDVSGRTTELYAEEEFELKLYSIE

SEQ ID NO: 1766 - protein, 865 aa, Geobacter sulfurreducens
MGKVSDKVCELLNRQVKERGIVVWYDSEKVYDGLAKRLQIPETTVLCYENGFFPLRERMEQFLEFVTEDGRPQDDCGVPPKLIVYVPKSRSETGFALIEAESVGAVVEPGAPTADRNSRLSSLVEQVFNGVAPEKAAHVARQTEEGLLTLAELDQMAEEAGTVTTGALKLIFGAASPVDVILSFLAGNEFDVKLEKKHSLSELAVVAREELGLDVELIPTATELRTAIRRHLLLCELIQGLPEEGFPPSLSTIALPRKPVQFDTIRHVLNVWRQRLDLQEAYRETAENVQAMTQLDKAVFPTEALRGLETFPFIEYRLLLSARNNLAQRDTDSPLALAKERRASFWSRVYPEISLRWSLVEVAARLLQVSGLICDALKRRKFTAEELITAYTRHGEPWMLLDRYARHLESRYVRCETFGSTDDAGMDELMHQCRVEYANTLAVLAEAYSGALEREGFTPAGFDQQSQTFRNAVAPLLKDGGKVAYFLVDALRYEMADELCEGLSADFTVHLEPALGQLPGITSVGMAALLPAAENGLALEAVGGRMRVCVQGETVNDRSARVTWFQEKSDSPTKVFKLGDIVRLTPKRKRELAEAQLVIVTSQEIDRHGEEGGEDEETRLYMDEVLEKLRRGLRNLVQAGIMELVIAADHGFIFAEALESGLKMDPPGGKTIALHDRVWIGQGGVAADGFFRVNASDLELGGPLELAFPKGLGIFKVPGGGCSYFHGGASLQEQIIPVCRLTAKAPKRSAVITVNLKLQLAKPKITNRFFSVTVSLEAEGLFTDVAKRVRLEILSGKDEVGHTAMAAYGFEEGSREIVVDYGKPNSVTIMISETKKLEHIEIRAVDCESQLLLASLTGVPVELAI

SEQ ID NO: 1767 - protein, 771 aa, Haliscomenobacter hydrossis
MSLSLYDKVLQALKQAENHNSNVMVRPEVILWPDPDHQWLEVIPVLQASLPHLLRYGSYVPAQQQGPAIWLKCMVARMLPAANWDSSIIPIIYLPGVSKNDLRNVEQAVFDFQPLLEYQYTGTLFVQENGKEWTILAFVENPFSGLGLKVAKDSATKDALKKTLPTIFQDAQALSGKALIDADHLNKQVFPDIIPAILTWMCQGDRFLHSLEPGKREVFKLLCRSAYDFEPDHRNISAITEKLGAQKSAWKYVWQLYAAAPHKYPELEALLRLAKPADLGKGPAALPAESWPQVNEEAEEALAQALLKAASLDAPAAMAALHSLEKKHLPRLNWVWFELGKAPLAAALPYLVQLAFKVTVPFSTSSIEAMKTYYTDSGYLIDQSMRKALVGVKSERDKGIVKSLIQLFYRPWLENLTLKFQKLVAADASIFTTQTAQPEQESFVLFVDAFRYELAVEFAQRLAKTQCQVSLQANWSAIPSLTPTAKPSVSPIATAVSTQSGITEFRPHLQNGKDLLTAAFRDALKNQDVKYITNASEIQGPGKYWQEIGDIDTKGHEEQSGMVKRVEELFEGIEEVLALAFEKGITRIKIVTDHGWLLLPGGLPKVQLNAGLTETRWGRCALIKEGVNTDLLHLPWRWNPATFIAYAPGIAFFKANEEYAHGGISLHECLIPTLMVEQTQSATASAKISDIKWVNLKCNVTTAHASDQFTIDIRTKYNDEHTSIVESTRRNLKDNKGVLMVSDDADTKAATVVLLDETGRILDKKVTIVGG

SEQ ID NO: 1768 - protein, 831 aa, Halobacillus halophilus
MNVIEKLQEKIQQEKENKGRAIVFWYDAQAQVSIDELSQQLVGVEVRYLTDQNFFQLKVELELQRATDSYLIYSDVPRPDDKNNILLDILSYSTEFKADETAMLSETLHVSDQVLRPMMEKYASFFNSKERKRKLYKVLPEQANETQFEISMMAVITKATVADVRVISRQVLSSDLQLEDNEFVKAIKRNFSLDRTLEIVGRYFGVSLGDLNQPFKELINVLIYQHFKQKANFIVEEWEKRWISSSPNVCSLFIEEWLQQSDADILENHIKEWEKAFHVREKLGTQDISNYSLTDTFPVVDALIIEKCIDELLHQTIQGEERLSLIAQRLQTHWGSKGKLRALYKTLYEAIRMETLKTFVHRIHQESDFYENYAESLYEIDQAYRHFMDHFTRLDSKQMLEEVANRLTNWYENEYLGRLSGEMNFKLEDDYVPKIMPQRTFFSEKIQPILDKEQTRVFVIISDALRYEAGYELHDHLTKRENGSSSLQPMASSYPTYTQLGMASLLPHRQLEVDDKKGVLADGQSTKGMDNRRKILQTVESQTEVFKLKQLLDMKTSEAEQLLRGKRLVYLYHDHIDALGDSAKSERETYGAVHQAIQDLQIAVDRLSRLQAKRIFITADHGFLFQFKQIEEYGKIPAVEGNVLDGSRRFAIGHDLSVPEGAIKLAEHQTPLKNAEVVLAKSLNRFKTGGGLQFIHGGALPQEAVVPLIDYRRIEKAQPVDIAVAMINKVISNYRVPVSFYQEQSITDEYTSRKVRAAFYQGNERISNEVELVFDLKGENKERNRQVEFSLIEKHYKIGEKCKLRIDTVTKKGKETYLEEEFVLRLYEALY

SEQ ID NO: 1769 - protein, 840 aa, Halobacteroides halobius
MELEQIEKILTEKFNQPLTEEKDRQIIFWYDAEGDFKEDIDRLQVANAKIWKLTGDNKFATKYQLEVKDQESNYLVYASYPQPDYREDWLLDISSYADDFTADKVTVIMKDFGVEDPSLRPVFKKYKKFFNNKRRYNRLLDYDIEDYTERKLDTAIISAVCKLKATDLEEAVKKVLMNSLTNDQNKWLTKIKKFANEDKFWELIENKYGYLAEDKDLADLMALLTVTNLEHDLNVTLPEEWSDYLSYKDNNCIVFIDHWMNHSSQAEVYDNLSTEIETKLNLQEYITNWELEDFLECDTFKSFDTAIIDRIVDNLLNDIDDFKRYQDIISLRRTKHWYPEFEEVYEAIYWAVELFKQAKEQSIRQIKATDFFNKYTEKYYLFDQAYRKFYSTYDQAKNKSLLRELRDKVENLYTNSYLHELSINWSNSVDQELKESWPLGGITQQQEFYQEFIADKSERTFVIISDALRYEVAQEFSQKLNNRLKGTTELYAMQGSLPSYTKLGMASLLPHQELNINQQGQISVDGISSQGLKNREKILAEKEPDSTVITYEELVELSRSELRERMKGTQVVYIYHNEIDAKGDHATTEKEVFSAVENTFTQLDTILRILKHSLSATHVYITADHGFIYRRRALESSDKTERLKSDLIERKRRFIISDQQVEPDGTLSVNLDYIFGEDSNLQALVPRGVNRFTLQGPGQNYVHGGAALQEIVIPVVQFRNDRSKESDNEVNKVEVKLTSITRELTNNISYLDFFQTEKVAEKLIPRRLKLYFTDESGEKISNENIIIADSNSSEPNQRSFKEKFTLKNREYSREEDYYLVMIDQENNQVYKEIKFSINLL

SEQ ID NO: 1770 - protein, 867 aa, Klebsiella oxytoca
MTLQNQEFIAGLKAKFAEHRIIFWHDPDKRFLEELGNLELENITLLDMTDQSQLAVKKRIEIDEPEQQFLLWFPHDVPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQRKDDDSDLENTLAMLKRHDLEGVLWDILNQEMGYQAEYPSLENLILKLFCTDLSAQADPQKREWLEKNVLTTPSGRASALAFMVTWRADRRYKEAYDYCAQQMQDSLRPEDQYRLSSPYDLHECETTLSIEQTIIHALVTQLLEESTTLDREAFKKLLSERQSKYWCQTRQEYYAIYDALRQAERLLNLRNRHIDGFHYQDSATFWKAYCEELFRFDQAYRLFNEYALLVHSKGAMILKSLDDYIEVLYSNWYLAELSRSWNKVLEAENRMQEWRIAGVPRQQNFYNEVVKPQFNNPQIKRVFVIISDALRYEVAEELGNQINTERRFTAELRSQLGVLPSYTQLGMAALLPHDEICYQAGNGDIVYSDGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFLIPKGIQRFHFSGGARFVHGGAMLQEVCVPVLQVKALQKTAAEKQPQRRPVDIVNYHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 1771 - protein, 828 aa, Lactobacillus amylovorus
MPTLTTDKIIAKLNSYFTDNQYVFWYDDKQEFKDIIDSIAQRLSSVKLYKAQANQQFKSKIDLLNDSEHKYLIYAPYKRPAIQENYLTDMEHYSKLFTADATQIILEELQLPENQLLFVKKYNSYFGAKTRRADFVKYWSDTFDKTPEKGIIAAITKTEKLDMNELLMKVIAAGYTNNHYIFAFSKYDVLDTFWKMVMNYFGGETDSEVDLKYLVERIFITYLANELNNKLPDRFKNYYLKQSDNVQIFIDRFADSNKYQQYYDNCSSTVWRDLNLNTVLKHEPAMILTKISIFEEINHLILAKLVAKFDGKRITDYEQLLEIIDQMLDHTRNNFNGGTEPEYKFLRYAAELLNLRVPMVDDWQDELNDYLDNSYKIDTIYRKSLLAYTNIIDTDNYIDIKKTIDRYYGNILLDSSVKQWNETFDLKEVPAKLKQERFYHNYVRDVRERVVVIFSDALRYEVAKELEEELNSDDRLTMKMNHAITVLPSVTYMGMNVMLPHETLEWDNKTSKVKVNGENAENTDSRDKLLKSYDKNNLAFQLKNVLEMSSKEIKQMITGKNVIYLYHNQIDAKGHELKTTKELVEATEKAIDEIKQAVQVLRTNGITHIIITADHGFIYQEKPIEDKDKIDLQGQNYEGNAHLRYLITPSQISVMGVKNTTMGVSLNNDDPTNVYYPVSPNEFVARSGSKNYVHGGSSIQEMLIPVLDIKATSRRSIAQPAEIKLAATTFRINNLKMNLLFNQTAPISDTVLPAEYHAYFTDEDGNLISNNVTIEANRTGSAADRTIAITITMQDMQYDLDKKYYLVIDREGSTEEPKRFEYSMDLIN

SEQ ID NO: 1772 - protein, 832 aa, Lactobacillus casei
MAEVELKDVVTGIEKLFKGHTHFVFWYDKEGEFADNIDELGHQLTEPIVIMQPRTQLKTKIELLDIEKAGGKALVYAAFSEPDIHQNLLTDMILYSKKFTADMNVMLLHELGLPETELTFVQAQRKFFAAKTRIAKFKQRYQRGKNPEQVELAAIAKTNDLQLSNILIEVIKAPTLLDEFAKYQVLETFWSFVDRAYGYHGKHDLQELLATMMVNFAYYQMELDLPVTLRHYEVSYINNVVSFMLNWRNRNDTREVYKNTAAQVWCQLDGQQIFKNLKIADLLKADTFIEFDRHAVKWLISELLAGHLGEVINHMTLPAIAEKRGKMYFSPEYQLAYSMTVDAHNVLLPRENRDVDQFDDLIKAYITKDYLVDTAYRRYINALDQLPPTQVDLFDDLSRNVESAYNNEHLVPMISDWCQDYVPNMIKPQRRERNFYSSTVGPNKDRTVVIISDAFRFEAAKELQQRLDERDVFGTEMQYAVTGLPSVTYFGMPSLLPNHELSYQGNKELLVDGQKAINLEQRMHILQTIEPKSQATRLTDFLSLSSTEQKKYVADQKVIYFYHNTVDATGDKPASEVKVFRAVEDAIAELERGIDRLRTISIRNIYVTADHGFIYRRHLLDSTDKINLPSDVEFEHKNLRYAIGSTDFDEIGVDNIKLGDVLGNNDQRFVFYPSNANVFSVPGAGQNYVHGGCSPQEMIIPVLHVTTESRKSQASYATLAVTDSSRRITSHEVIVNMVQNDPVDETHRAATYALYFVDGNGRQISGEQLVHADITSINVNDRLIRRHIPLIDQDFERGGHYQLIIKNVDANTSTPIDYQMDLTVGGGFDFDI

SEQ ID NO: 1773 - protein, 828 aa, Lactobacillus helveticus
MPTLTTDKIIAKLNSYFTDNQYVFWYDDKQEFKDIIDSIAQHLSSVKLYKAQANQQFKSKIDLLNDSEHKYLIYAPYKRPAIQENYLTDMEHYSKLFTADATQIILEELQLPENQLLFVKKYNSYFGAKTRRADFVKYWSDTFDKTPEKGIIAAITKTEKLDMNELLMKVIAAGYTNNHYIFAFSKYDVLDTFWKMVMNYFGGEVDSEVDLKYLVERIFITYLANELNDKLPDRFKNYYFKQQDNVQIFIDRFADSNKYQQYYDNCSSTVWRDLNLNTVLKHEPAMILTKISIFEEINHLILAKLVAKFDGKRITDYEQLLEIIDQMLDHTRNNFNGGTEPEYKFLRYAAELLNLKVPMVDDWQDELNDYLDNSYKIDTIYRKSLLAYTNIIDTDNYIDIKKTIDRYYGNILLNSSVKQWNETFDLKEVPVKLKQERFYHNYVRDVRERVVVIFSDALRYEVAKELEEELNSDDRLTMKMNHAITVLPSVTYMGMNVMLPHETLEWDNKTSKVKVNGENAENTDSRDKLLKSYDENNLAFQLKNVLEMSSKEIKQMITGKNVIYLYHNQIDAKGHELKTTKELVEATEKAIDEIKQAVQVLRTNGITHIIITADHGFIYQEKPIEDKDKIDLQGQNYEGNAHLRYLITPSQISVMGVKNTTMGVSLNNDDPTNVYYPVSPNEFVARSGSKNYVHGGSSIQEMLIPVLDIKATSRRSIAQPAEIKLAATTFRINNLKMNLLFNQTAPISDTVLPAEYHAYFTDEDGNLISNNVTIEANRTGSAADRTIAITITMQDMQYDLDKKYYLVIDREGSTEEPKRFEYSMDLIN

SEQ ID NO: 1774 - protein, 828 aa, Lactobacillus helveticus
MPTLTTDKIIAKLNSYFTDNQYVFWYDDKQEFKDIIDSIAQHLSSVKLYKAQANQQFKSKIDLLNDSEHKYLIYAPYKRPAIQENYLTDMEHYSKLFTADATQIILEELQLPENQLLFVKKYNSYFGAKTRRADFVKYWSDTFDKTPEKGIIAAITKTEKLDMNELLMKVIAAGYTNNHYIFTFSKYDVLDTFWKLVMNYFGGEADSEVDLKYLVERIFITYLANELNNKLPDRFKNYYFKQQDNVQIFIDRIADSNKYQQYYDNCSSTVWRDLNLNTVLKHEPAMILTKISIFEEINHLILAKLVAKFDGKRITDYEQLLEIIDQMLDHTRNNFNGGTEPEYKFLRYAAELLNLKVPMVDDWQDELNDYLDNSYKIDTIYRKSLLAYTNIIDTDNYIDIKKTIDRYYGNMLLDSSVKQWNETFDLKEVPVKLKQERFYHNYVRDVRERVVVIFSDALRYEVAKELEEELNSDDRLTMKMNHAITVLPSVTYMGMNVMLPHETLEWDNKTSKVKVNGENAENTDSRDKLLKSYDENNLAFQLKNVLEMSSKEIKQMITGKNVIYLYHNQIDAKGHELKTTKELVEATEKAIDEIKQAVQVLRTNGIAHIIITADHGFIYQEKPIEDKDKIDLQGQNYEGNAHLRYLITPSQINVMGVKNTTMGVSLNNDDPTNVYYPVSPNEFVARSGSKNYVHGGSSIQEMLIPVLDIKATSRRSIAQPAEIKLAATTFRINNLKMNLLFNQTAPISDTVLPAEYHAYFTDEDGNLISNNVIIEANRTGSAADRTIAITITMQDMQYDLDKKYYLVIDREGSTEEPKRFEYSMDLIN

SEQ ID NO: 1775 - protein, 828 aa, Lactobacillus johnsonii
MPTLTTDKIIAKLNSYFTDNQYVFWYDDKQEFKDIIDSIAQRLSSVKLYKAQANQQFKSKIDLLNDSEHKYLIYAPYKRPAIQENYLTDMEHYSKLFTADATQIILEELQLPENQLLFVKKYNSYFGAKTRRADFVKYWSDTFDKTPEKGIIAAITKTEKLDMNELLMKVIAAGYTNNHYIFAFSKYDVLDTFWKMVMNYFGGETDSEVDLKYLVERIFITYLVNELNNKLPDRFKNYYLKQSDNVQIFIDRFADSNKYQQYYDNCSSTVWHDLNLNTVLKHEPAMILTKISIFEEINHLILAKLVAKFDGKRITDYEQLLEIIDQMLDHTRNNFNGGTEPEYKFLRYAAELLNLRVPMVDDWQDELNDYLDNSYKIDTIYRKSLLAYTNIIDTDKYIDIKKTIDRYYGNILLDSSVKQWNETFDLKEVPAKLKQERFYHNYVRDVRERVVVIFSDALRYEVAKELEEELNSDDRLTMKMNHAITVLPSVTYMGMNVMLPHETLEWDNKTSKVKVNGENAENTDSRDKLLKSYDKNNLAFQLKNVLEMSSKEIKQMITGKNVIYLYHNQIDAKGHELKTTKELVEATEKAIDEIKQAVQVLRTNGITHIIITADHGFIYQEKPIEDKDKIDLQGQNYEGNAHLRYLITPSQISVMGVKNTTMGVSLNNDDPTNVYYPVSPNEFVARSGSKNYVHGGSSIQEILIPVLDIKATSRRSIAQPAEIKLAATTFRINNLKMNLLFNQTAPISDTVLPAEYHAYFTDEDGNLISNNIIIQANRTGSAADRTIAITITMQDTQYSLDKKYYLVIEREGSAEEPKRFEYSMDLIN

SEQ ID NO: 1776 - protein, 835 aa, Lactobacillus reuteri
MVQLKLDKIVKEINHYFDQGYQYVFWYDPDGEFADDVTEDNQYLKDNLAAELQPVGAKEQFKIKRKLLDKKNQDRSFLVYVKAKRPQLQFDYFADMERYGHIFSAKASDIVFEQLAEQLNFDNSKRNFVKKYLKYFRAKSRRQTYIHNFESRLINHPELMILSNLAGLDQFDENSLLMAVFKGGMDESNNKIIRSFSKYDVLPLFWQIYDKYFGCSNVRSLKGLFDGALVTSVYSQLEEKIPSELLAQPFENYSNVQVFMKRFSDSRKYQELYQNLTGTAWNEFKLGTYLKDENVQDLLRVDGIRQIEELLLERVRANFSADGTVTDGDETIGVIDQVTRGVNAFNPEFNFLKETYHVLKYRPRFYDDWHEMLNDYVNKVFKVDTHYRYLVTNYRRISEDKRHKYEDIKRMVDDYYNDQILDQSVREWNTTFQLQDVESKQREQNFYRNFVHGANERIVVLISDAFRYEAAHELHAQIANDDRITSKMNYLLTGLPSVTYMGMPSLLPHHKLEWQKDNVLVDGHMANNADNRRKILQLWDKNNDLLKLDDILKATSKEIKAMIANKNVIYVYHNQVDAIGDNLKTEDETFRATDQAINEIRRAIQVLRTNSVSHIIVTADHGFIYREASVEEQSKIDIPASDYNGKISPRYLMTPDDLSNIPGVMSVKLGISLTNNDQTNVYYPATVNVFKSQGGKNYVHGGSSLQEMVIPVLDMRMNSSRSKAEFAEIRLAATQHSINALRMTLKFNQVEPISDLIRPRKFNIYFMNQFGRVISNVATINANRTDAEINQPLSADIVIQNRQYDRSEDYYLVIDPDKGSITNPRYHYQMNLIND

SEQ ID NO: 1777 - protein, 832 aa, Lactobacillus rhamnosus
MAEVEMKDVVTGIEKLFKSGTHFVFWYDKNGEFAENIDDLAQELNEPIVVMAVRTQLKTKLKLIKIEEAGEKALVYANFAEPDIHQNLLTDMILYSKKFTADMNVMLLHELGLPETELSFVEDQRKFFGAKPRIARFKQRYQHGKNPEQVELAAIAKTSDLQLSNILIEVIKNPALLDGFDKYQLLPTFWSFVDRAYGYHGKHELQDLLATMMINFAYYQMELDLPTSLQSYEVSYINNVVSFMLNWRNRRDTRAVYKKIATDVWQQLDGYQLFKNLKISERLKTDTFIQFDQQVVQWLVEQLLQGHLGEVIDQMSLPEIAGKRCRMYFAEENQLAYSMVVQAHSILTKREIHDTGKLDDLIHAYITDGYLIDTAYRKYTNASDQLPTSQVEVFEKLSQKVEAAYNNDHLAPTIHDWCQEYVPNVVEPRTLERNFYSSVVAPNKDRVVVIISDAFRFEAAKELQERLDSRDVFGTDMHYAITGVPSVTYFGMPSLLPNQKLTYQGDKELLVDGKKAVNLEQRLEILQSLEPQSRAMHLKDFISMSLADQKKYIVNQKVIYFYHDTVDATGDKPASETNVFRAVDDAIEELTRAIDRLRNISIRNIYVTADHGFIYRRHLLDSTDKISLPAEVDFEQKNLRYAIGSQDFDEIGVGRVKLGDILNNDDERMVFYPSNANVFSVPGAGQNYVHGGCSPQEMIVPVLHVLTESRKSQATYVTLSVTDSTRRITSHEVIVNMLQNDPVDETHRPATYALYFVDGSGRHISGEQVVQADSTSVNVNDRLIRKHIPLIDQDFDRAGHYQLIIQNVEANTTTSIDYQMDLTVGGGFDFDI

SEQ ID NO: 1778 - protein, 832 aa, Lactobacillus rhamnosus; identical to SEQ ID NO: 1777

SEQ ID NO: 1779 - protein, 842 aa, Leuconostoc kimchii
MVELNTGEIVERIRTLFAQGKQFVFWYDANADFADNIGEITAQLTQTTIEMLPGEQFKTKLEVLSLEKNGEAALIYSPAKKPGLSQNLMADVERYSVEFTADATVMLREELGLEEKHQEFVVDNMKFFGNKERINKFKALTKDRKINNPVIVILAALAKANGISSLDILKSVIQTDLEDNQALNEFKKFNVYDQFWQGMSSQFGYFSSEPKLKELLSGMLVITAFDQMELDLPSQVNVYQSFAKTNVIAAVSQLMNMANFTSRMKQIADEVWQFINGESVFKNVEMNDLIKSDVFRNFDLKIMDWAATSLVNSELQPNGVDLRFLTHERQDTMYANEYESAYKMIRKAIPVLAGKAFGDYENVEKFAEAYVDTKNGLANIDTSYRKFVDYRWTLDSELFDSFDTLAQRVEQSYLNGFLNPMIKRWSDVYDIKSIESQKLQRNFYRNKVASSKNPVVVIVSDALRFESGQDLAKFINRENQLSAEVDYMITGVPSVTYFGMPSLLPHEELTYDASVPTVLVDGVKATDLASRELVLQKRNAKSMTIAADKVMSTKTEDLKSEFVGKDVIYVYHNGIDAISDNAKTERKTFEATAQTVSEIQSIIKRLRSANRTNFIVTADHGFIYRDSELDTTDKIDLKPANFMKKAPRYAVSKEKFEQTGVDSVAISDVLDNDQEEIVYYPTSANVFMSQGAGKNYVHGGVSPQEMIVPVIAVHSKRGADTSETVEVQLSPVPHRITSRTIIVSFNQLQPISSDVNGATFEAKFVDQAGDVISSTEVINAFSDDQNPSKRIIKKRFVIADQVYDQTQSYFLIVENVENKQEIIREEFTMDLAITGGFDFDFS

SEQ ID NO: 1780 - protein, 834 aa, Methanobrevibacter smithii
MNLEEIENRINSIIDEAYHRQIVFWYDENQEFIEDINNIQLNNAKLHILKDNNLIKTKYQIEFEDKNSNYLVYAPFSQPDDNENYLADLIHYAVPFSADKIEMIGQELGISPEFYHLLKKYSLFWNAKSRVNAFKDLNVSFTELNIKQAILAVLSNQKTLNFDYIVREVIINNFNEENEIIKNFEKYNILEDFWELISRKFKYSEDNPSVKRLVRFLILNYTANSYRGSTPKSWDEYLVSDKNNASIFISEFMNNANYSEYYDRIARELESKLNITSLSKTNIDSYINCDSFERFDENIINHYTELLFETKVDLGAEFKEILENRKKTHFYLKYEDNYEVLKYANLFISLINEFMRSELPEKPEEIIKEYSEKWVYLDSYYRKFYYFYDKLDDTEYLEDLRQLVENLYVNRFLSVINPKFTKKLAEKPISELDIPKQWKFFKQHIPTSIRKHKTAVIISDAFRYGCAVELFAELEKDPTRTPEIKPMLSTIPSYTALGMASLLPNKEIVYEGDTILVDGMNCRSTDERNNILSSNVNEVIAISYEDVDKLKSKEFKELTKGLNLIYIYHNKIDARGDHAPSENEVFNAAQETIEDLEVLIKRLRNQGNFAKIFITADHGFIYKRDKLKEHDKVNLDKFPEKKHKRFILSEKPLKIDGAVSLSMEYLNMDKYVNVPIGADVFKAQGAGLNFVHGGASLEECIVPLLEVKAGKGAKNQRTVELQLISTKNTITNYDVMLTFFQKENVSQDVLPLEASVYFIDEENNKISGEQIIFADKNSDSAEDREFKEKFRLLQKQYDKSKNYYLIIRDLKEDVEVDRIPFTIDMAFQDGFDFF

SEQ ID NO: 1781 - protein, 763 aa, Methanoculleus bourgensis
MKTLLDAIDDAIRAAIKNYDRGDAVPPAALLWPDPTGEWQPVATLLREERGLPIITLGDYAPDRRQGPAIYIRCLVEDTLPGTGLPDNETPVIYLPGHSRIELRNIGDCPEPLRPLAELQYRGAIWSHRNGRDWTVAGFLQAHLGIDTASDQETKESLRNTVGKLCSEPVRSIQTHQPLNAAYFATLIHPDYRKQILLWMNAPKEEKERIGAEEWPLFRYMCKTDYGFDPHTDGVATAAERLASQDQRWAQVWERYREYPQAYPNIPTLLRNARMPPLPMFKDSWPQINDAMEEALRQALLGLQSASHGEARQEIVRLEEEHGERRSWVWADLGESPLAFALQHLARLAELTGDFRFGGTITEQAERYAQEYWKADDAIVRALAQIERKEDRAAVTAAVRTLARAWLEALATAFQEEWLASPPEQEKETWKPPQGEVLLFVDGLRMDLGRRLQEQLARAGCTCSLTHRLAALPSITETAKPAVMPIAGELAAGKNLTPATRTGAGAQISALRTLLKEQNIQVLGDNDDGDPEGRAWTECGNIDREGHDKGSELPVILDGELTTIERRIIDLLDAGWQQVRVVTDHGWLLLPGGLVKTELPPSLVAMKKGRCAELLPDSSVSLPTVPWFWNRTIRVALAPGITCFEAGKEYDHGGLSPQEVVVPDIVVTRGSPGARNLVIQTPAWRGLRCYVTVKGAGGYTADIRLKPGDPKTSVTMDAKPIPPEGDVALVVPDDGLEGTDAMIVILDEHGNTTAQRQTTIGGE

SEQ ID NO: 1782 - protein, 873 aa, Methanolobus psychrophilus
MLNPEKTTQSILKKFEILSDFEKRKIVFWYDKDGTADEEGLAQIGEALVERGIKLHVLKNNFFATKKMLENDDTKSSYLIYSDQAERDPESNWLLDIQLYSARFENSRISDIKSEFGIEGYDLDRFLEKHQQFFASKRRVVPLKKIYQSDWRDEEFTLGFLGVLSGSATTDLKEIIRKILISSLDENSNTLWEDIVRFELAEELWGLVNRYFGYRSEEPTLKKLFLSFVITHISRNTDINLKKYKAYSNSLSNECEIFIKGWMDNSRDSGVFDEYCRQLLEDNSSQLEKYLNAEIPKYDVPKYLEAESLALFDEHVIRRIVDELDNGKEDFEGYLEWIASRKTKHWYPGFENIYSALEYAVKLHQFAKEFSAEDLSSQNLNHFFRNYAERYYLMDYYYRKFYYHYDKDNQKEDLKTTREAIEKLYNNRLLDKLLTRWSELISKEMDGHWNIELIDRQDEFYKLYIRNIINRNDKDKIAVVISDAMRYEVAAELQEILNKDTRGTVELKCMTGSLPSYTKLGMASLLPHERLEYRNQSVFADGISTEGIENRGKILERMTPDSIALGYEDLMNLKRDEARERFKGIRLFYIYHDMIDATGDHSASEHGVFNAAEETISDVKKIIEKLTNAQIINNLIVTADHGFIYQRDNLESVDKVETNGFDKEKVIASSKRFILSEENIDLMNVHKFNMDYVVKSDSKKEMFAYVPQADLRFRMQGANKNFVHGGAAPQEIVVPVLKYSYNTTADLDRKGIKHGKVGVIITNPSRKITSSPFYINILQTEKVTDKLLPRRFRVALWDRDGDEYKVSDEKLVIAEGSSDEASDRQYKVTLTLTGNIENKIYYARLIDEDPTEINRDIIDPMPFEVDLLIVDDF

SEQ ID NO: 1783 - protein, 870 aa, Methanomethylovorans hollandica
MLNPEKTTQSILKKFETLSDFEKRKIVFWYDKDRTADEEGLAHIRGALAEKGIKLHILHNNFFATKKLLETDDTTSSYLIYSGEAERDPEANWLLDIQLYSSRFENSRISDIKSEFEIEGYDLDRFLDKHQQFFASKKRVTPFNRLYQKHWKEEEFIHGFLAVLSGSATTDLKEIVRKVLIDSLDESTNTAWEEITKFEFADDFWDMMHRHFGYQPEEPTLKKLFLSFIITHITRNTNLDLKKYKAYSNSLSNECEIFIRSWMDNSRDSTVFDEYCEQLLAGDSTLQKYLVNEIQKHEVSKYIEAESLDLFDKSIIRKIAEALQNGKEDFDTYLGWITNRKTKHWYSRFQNIYNSLEYALKLHQFAKEFDATNISEQNLTKFFRNYTERYYLMDYYYRKFYYHYDKDKEKEILKPTKDLVEKLYNNRLLDKLLTRWSQLITSEMEGRWNIELIDRQDEFYKLYVKNIITRNDKDKIAVIISDAMRYEVAAELQEVLNKDTRGTVELKCMAGSLPSYTKLGMASLLPHDRLEYNNQSVFADGISTEGTANRGKILEKITKDSVAIDYDELMNIKRDEARERFKGTRLFYIYHDKIDARGDHFASEHEVFDAAEDTISDIKKIIEKLTNFQILNNILITADHGFIYQRDELENVDKVETGGFDKQQIIASSKRFILSEQNVDLMNVHKFNMDYIIKSGQTMFAYVPQADLRFKMQGSNKNFVHGGAAPQEIVIPVLKYSYNKTADLERKGIKYGKVGLTVTNASRKITSSPFSINILQTEKVTDKLQPRRFKVALWNRDGNEFKVSDEKLVIAESSSDEPAERQYKVTLTLTGEVENKFYYIRLLDADPTEITKDIIDPIPFEVDLLIADDF

SEQ ID NO: 1784 - protein, 899 aa, Methanosarcina acetivorans
MVNVEKTSSSILKKFSPSELKDYEKRKIVFWYDRDKTAWDQEKQAPGEELEEIIHVLKENNIKFHILDNNYFETKKLLEIKDPESNYLIYCPDKERAHETNWLFDIQLYSSRFENSRISDIKSEFEIDGHELDDFFTKYEKFFGNQKERVQPLKKLYQKDWREKEFILGMLAVFSKTQAPEFKQIVRDIMLKSLDDAENPIWENISKFGLEENFWELTEEDFGFSAKNPTLKKLFLSFLITHMKRYSGISLSGYDQYVNRKENECQIFLKHWMDSSRDSKTFEKYTKDILEENNQDLEKNLQGALDKRDVQKYLEAEAVDTFDKALIVHILKFLNSPVDSTGEDFKNYLSWIDTRRTKHWFSEYENIYNALEYAVKLFQFSLEYYDNPKAADALENTRSLYDLFKAYAETYYQIDYLYRKFYYYYDKEQEKDILKKNLRPQVEDLYTNKLLGKLLLKWSSLIESDLKRQWKIELAESQKDFYKQHVNKILQKDDRSKVAVIVSDALRYEAAAELFETLNKDTWGIPELSYMAGVLPSYTKLGMASLLPHNALEYRGREIFVDGISSEGLEKRNKILQSKYEDSLAFNYEDFMRYSREEAREFIKGKRVLYIYHNKIDSTGDKQSSENNVFSAVEETIVEIKKLVKYLSDRLNTTNIIVTADHGFLYRRDDMENADKVDTSLFDKSRIIDTTKRFILSDQELSPENSLDNIHSFGMHYILGQDHTPLFAYVPKADLRFKLQGGGLNFVHGGASPQEIVIPVLTYNHRRNEKAIDKKGIKHGKVNVSVINDRKKITSSKFKVKIFQTEKVTDKMKPRTIKVSLWDIDGGQEKMVSDEKIIIANNESDEPEERQYNIMLTLGNNLENKTYYLRLIDEDPAEIKDIARIPFELDLLIGDFDDF

SEQ ID NO: 1785 - protein, 900 aa, Methanosarcina mazei
MVNVEKTSSSILKKFSPSELKDYEKRRIVFWHDRDKTAWDQEKNAPGEELEEIKHVLKENNIKFHILDNNYFETKKLLEIEDKESNYLIYCPDKERSHESNWLFDIQLYSSRFENSRISDIKSEFEIAGHELDDFFTKYEKFFGNQKERVQPLKKLYQKDWREKEFILGMLAVFSKTQAPEFKQIVRDIMLKSLNEAENPIWENISKFGLEENFWELAKEDFGFSAKNPTLKKLFLSFLITHMKRYSGISLSGYDQYVNRKENECQIFLKHWMDSSRDSKTFEKYAKDILEENGQDLEKNLQTALDKQDVKTYLEAEVVETFDKALILHILKSLNSPVDSTEEDFKNYLSWIDTRRTKHWFSEYENIYNALEYAVKLFQFSLEYYDNPKAADALENTRSLYELFKAYAETYYQIDYLYRKFYYYYDKEQEKDILKKNLRPQVEDLYTNKLLGKLLLKWSSLIDTELDGKWKIELADSQKDFFKRHVNRILQKDDRNTRVAVIISDAMRYEVAVEISEILNKDTWGLIDLDYMAGVLPSYTKLGMASLLPHKTLEYKEKEVFVDGINSEGLENRKKILQNNCLESFAIRYEDFMKCSREEARELVKGKKIFYIYHNKIDSTGDKQSSENSVFNAVEETIFEIQRLVRYLSDTISVANIVVTADHGFLYRRDNMESVDKVDTSLFDKSRIIDTTKRFILSDQELAKDNSLDNIHIFDMRHILGQNHTPLFAYVPKADLRFKLQGGGLNFVHGGASPQEIVIPVLTYNHRRNEKAIEKKGIKHGKVNVSVINDRKKITSSKFKVKIFQTEKVTDKMKPRTIKVSLWDIDDGQEKMVSDEKIIIANNESDEPEERQYNIMLTLGNNLENKTYYLKLIDEDPAEIKDTARIPFELDLLIGDFDDF

SEQ ID NO: 1786 - protein, 769 aa, Methanospirillum hungatei
MTKKLDEVICASLQKVSREYAQKDVVAPLSVFWFDKTGEWQPVIDRLKKRFTIYTYGSYNKETLTGPAIYIRTSVMHHEDNSRNIPILYLPGYSREELRDPTTVPGELKPLMGLYHRSVSWTSKTKKDWTLVTFLQSSDPGPGIAIKQDGETKEALRTSIGLLLDEPIERLSHHAPLHATYLHQIQLPDPRKQILTWIHDPVETEKQMKESGQWKPFCGISIKEYNLNPERDGSLAGATKLATQEGKWNEIWDRFTENPERYPNIPAILSTIKVPAFTPYQESWPQINEKEETELLKELESLLSLPLAQAQDLILEMEEKHKKRRDWVWARIGKADLAHSLKYLSILVENSRQIKTGGDLKAQIERYADETWKIDDAVLSAIASVHTSSHLALLQKVIAHVYKPWLNTTIDAFQKTWIQAPPEQKKKEIPAQAGVLYFFIDGLRMDLGHRLQSLLSAAGYQTTLTPQLSVIPSITETAKPAVMPVASKLYAGDELTPKTGSGAFARIESLRSLLKEQGYQVIKNDELGDPTGGGWTEFGNIDHEGHDKGLTLAHTVDRELSRIEARIIELIQTGWEKINIVTDHGFIYLPGGMEKAELPVGNTEIKKGRCALLRDNAQVSYPVLPWFWDRSKNIACAPKGACFEENTVFDHGGLSPQEMVIPEITIIKGRSLKTGVVIDEIKWKGMRCKITATTGPGYIIDIREQPGDATSTFLKDKDGNSLDQIKIPIDGVISIAIWDDTHEGKKAWLVITDQTGKIITQEETTIGGM

SEQ ID NO: 1787 - protein, 873 aa, Methanospirillum hungatei
MAILSIEKTTAAILEKFKTLSEFETRKIVFWYDGEQTAGEEDLTHIREALGEQGIRMHILNGNYFATKKLLEHEDITSSYLIYSAQPEPDYEKNWLLDIQLYSERFENSRISDIKAEIGIEGYDLDPFLGANQKFFSNKRRALGFKKFYEPAWREEDCIRGILAVLSNASAPDVREIIKSVLMGSLHEDENTLWEQIAKFDLTERFWEIVRKQFGYYQESPTLKKLFLSLLITHIDRNATLPLGHLEQFVNAKRQGNECELFISGWMHHARDSARFDSYCTDLLTEQDKKLEKELTSIVDNERIEGYLNPEAPDIFDKSIIRKIVSTLSDGGQDYDKYLSWIEARKTKHYFHEFEDIYAALVSAINLIRLAEQCEEEKILAATPHELFRTYTDRYYLLDYQYRKFYTSYDKTSDKDILKTHIREIVERQYLHITQKIQMKWSDLITAQDRTSWGVELIEPQEQFYTAHVDKIISRNDRDKVAVIISDAMRYEVAVELKENLNKNTNGTIELTSMAGCLPSYTKLGMAALLPHTILEFQKEHILVDGMNADGIENREKILTRTKEESIALRFKELRELRRDQAREKIRGKRVIYIYHNKIDDTGDNQQSEDEVFKAADETIQEIEDMVNRLVNSLNISNIIITADHGFLYTRNALEDIDVIDVAGFDKDQFISSNKRFIISSEKTNLMNTHRFLMDYISDEQKTLYIYTPYADLRFKMAGGGRNFVHGGLSLQEIAIPVLLYNHNKSLSDLDKKGIEYGKVGITLIGQSRKITNNPFKITLFQTENVTEKRGHLKCRIALYDNSGARVSDEKVILADRTTDDPNQRKINITLTMDSKIKNGIYILKAIDEDVKATFRDVLEIPVEVDILIPDDF

SEQ ID NO: 1788 - protein, 831 aa, Microlunatus phosphovorus
MTSLSAVLPHLEQTLATQRLVFWHDADGEYAADLDALDLSGVTTVRVENNEYAVKNRVLHDEPTGKFLLYRGGTVPPGTGNWLLDLELAYGVFTADRTALVRQELGLTGTGIDDVVREHEKFFRAAKRVQSLKALLAVDDDADRLRAKMSAVVLGQREHSMLELTRTLLIENADGNRTKYEALAEQGLDGFHWAGTAKIYGYGAGAPSIDDFVLWMFRQAINGFASDTPGALRNIQLDFASLRNDRRSANALASLARRASESLSYASSIEDAELAELVGNDLFEDVERKVISALAHAVVKRTMSAREVSETIRTRQSSIWVDGYRELYAALGAASDLLSELATARFEIASFDDGLDQYRESWFRVDQLYRRFHFAARTTEYAGPLEALRVEVEKHYANRYLYELGNAWQQQIDAVDEWRSVTLRPQTRFFADRIEPLARKGNRRAVVIISDALRYEVADELRSRIRQEDKFDADLDAMLGVLPSYTQLGMAALLPHKTLGHSPNGDPVLVDGQRSDGTGNRNKVLALANGFAVQAEDVLAMPRSELRELYGAHQVLYVYHDRIDAVGDKARTERQVFEAADDALRELVDLIKRLTNANATNILVTADHGFLYQDTALPDAFYLSTKPQGNDLVATNRRYVLGRGLKDDPAFRKFEPEQLGLSSDLEVQIPKSIHRLKLPGAGSRFVHGGASLQEVVVPVLTVNKKRKSDTRPVNVEVLPETDKITTGQLVVKLFQSEPVNDKVQPRTLRAGIYIGETLISNQPELIFDQSSDEKRDRYQNVRMLLSQDANEFNNRSVEFRLEEQIPNTTQWRTYQRAQYLLKRSFMSDFDF

SEQ ID NO: 1789 - protein, 784 aa, Moorella thermoacetica
MSSRTSEMLANTLLEAVRDSLLRAGRYDSATIVPPAAILWTDADGQWQPLVSQLRPLMPELLTLGDYNPEEKTGPAIWLRCVIERMLPDVELPDKAIPIIYLPNVSRQVLRAGEECPESLKPLVELQYRGTVWTQRNGKDWTVEAFLVSEDGLGLDVAKDKQTRQAMLRALPQLATAPVARLRGKRLEAEDFDRLMVADTQRDLLSWLSDPARTREKWGEEKWMAFCSRCKVEYEIDPDRDGEIAVAEKMGLQDNEAWQGLWRRYAEAPALYPGIPAILRRAKPSRLFVNREPWPDENEAEEEALRQSLLELEKLSSPDARQKIEELEKEHGERREWIWAQLGQSPLAGALKHLVTLARKTARGLGGDMPQAMAELYIEGGYLADDAVLQATGSVKSLEDAQAIQAAVRSIYLPWLEDVARHFQDLIKTFPLPNADDKDRTLIAANPGQCLLFIDGLRFDIARRLVAMAEARQLRVNINWRWAGLPTVTATAKPAASPIAGKLSGHLPGEYFIPEIAGANLPLTPDRFRKLLAEAGYQVFNSPETGHPGEPGARGWTEFGEFDRLGHTLQSRLAARIDEQLELVLDRIQGLLEAGWQQVRVVTDHGWLLVPGGLPAMKLPKYLTESRWTRCAAIRPGAHVDVPTAGWYWNAYQHIAFAPGVYCFINGNEYAHGGVSLQECLLPDLTFNSSGLTPVTVSIREIQWYGMRCRVAVDTSSSEVMADLRTKPNDPHSSITTPKPIDSGGRVGLLVADDALEGTTVSLVLLDPSGRVLAKQATTVGGDE

SEQ ID NO: 1790 - protein, 832 aa, Parvularcula bermudensis
MHDRLHASLARLFETERIVFWYDRDRDMREAFDAFALDGVEKVEIAKNEFGLKYRMLRQEPKTRFLLYKDGPEPPHSENWLLDVQLATAVFKADQAAIWLAELGLPPKFESVVREHLEFFRAKSRVESLKKIADTHDTPIRLRLRLLAVCAGAEGGLDTVIEGLLGDLANERDEGVRLIERSGLTKFFWDQVRQVYGYESDEPDFEDFAITLFQSAYARALQEGGKLNTEAALLFSRWKNNRTSLDAFAALSARYQDVLRIEEDVRARDFRDLVTADHFEEIDRHIIRSLVHAMSTQTVSAADVLGWVRARRQSHWYETYQDIYQAISFATEFQQALAEADLRMTSPVEGVRRYVASWYRLDQLYRKFLYHLQRSGQSSLLSELFDAVENRYANSFVLAINDAWQDQVARLEWWDIPGYERQLDFYRKHAASYRRKDQKVVVIISDALRYEIAEETLREIRKLNRFDAELSAIIGALPSYTQLGMAALLPHQSLSFKGDGALVLADGEETSGLAARGKLLAKGREGDRSKVISFEEMMNMRSDEGKDLFREHDIVYVYHNHIDAIGDKAATEDRLPEAAQKAIEDLVTLVRKLTSANFSNILITADHGFLYQHRALDETSYSIADPQGDEIIVRNRRFVIGRGLKETPGMTKFTAEQLGLTGDMDVLISNSVNRLRRQGAGARFVHGGASLQEIVVPVLRVGKRREADLAQVEVQIILSGKSQITSGQIAVTLYQAQAVSEKVQPRSLLAGIYALDDTLISDEHQLSFDFTSNNARERELPLKLLLSREADKYNNQEVVLKLRERVGKTSHYQDYATHRLQLRRGITTDFDF

SEQ ID NO: 1791 - protein, 867 aa, Pectobacterium carotovorum
MTLQNQEFIAGLKAKFAEHRIVFWHDPDKRFLEELGNLELENVTLLDMSDQSQLAVKKRIEIDEPEQQFLLWFPHDVPPKEFDWLLDIRLYSTEFHADFAAITLNTLGIPQLGLREHIQRRKAFFSTKRLAALKGLVTERENEASLDKKMVAVIAGVKTAKTEEILFSLITQYVNQQKDDDSDLENTLTMLKRHDLEGVLWDTLNQEMGYQAEQPSLENLILKLFCTDLSAQADPQKREWLGKNVLTTPSGKASALAFMVTWRADRRYKEAYDYCAQQMQDALRPEDQYRLSSPYDLHECETTLSIEQTIIHALVTQLLEESTTLNREAFKKLLSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLEAENRMQEWRIAGVPRQQNFYNEVVKPQFNNPQIKRVFVIISDALRYEVAEELGNQINTEKRFTAELRSQLGVLPSYTQLGMAALLPHDEMCYQPGNGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPTDDFCWKGKVADTAGVSDNSEFLIPKGIQRFHFSGGARFVHGGAMLQEVCVPVLQVKALQKTAAEKQPQRRPVDIVNYHPLIKLVNNIDKVSLLQTHPVGELYEPRTLNIFIVDNTNNVVSGKERICFDSDNSTMEKRVRDVTLKLIGANFNRRNEYWLILEDAQTETGYQKYPVIIDLAFQDNFF

SEQ ID NO: 1792 - protein, 866 aa, Pelobacter propionicus
MPKHQLTDTLQKIFKEEKQRIVFWYDTDREFEEGLPDLKLDGVKVIRLDEIGSLEIKILLELQDTTGKYLLYAPFVEPDAKNDWLLDIRLYSRIFHADQASILLNELGLTSQALRPFLTSRRTFFRNQDRLNRLKKWVKPEDVENELDLKMLAVLSRAELPDIFSILMKLFGELCNSGEQQLLLASQMSWEEIGKYDLLKPFWNLIATTFGYTEPEPSVNDLLIRILVTDFAKTLKGAVPLSLQHFVIPSKSLALTASVFANHWRSNINHYKCYNELAGNVAQQLKVDNQLGDLDEQALLEVMTFEAVERRIILCMLAKMKNGYSFGDEIKSVVAHRLDGYWSNAQISSGVINYRTLYGALLAAADLFELRSRHQTGLSYPDASGMYAAYTGELYRFDQLYRQFHEKADQIELSGTDILKGLRADVENCYSNWFIDQVAVTWGTMIEPPHGTGLLQDWRLNNIPNQQDFFKSCVEPALKAFPQGRVYVVISDALRYEAAAELTDELNAKTRFDADISSQLGVLPSYTALGMAALLPHNSLDYKASGDVEVDGQPTASLEQRNKILAEYSGTLIKAEELLAMSKDKGREFVKPHRLIYIYHNQIDATGDTASTESNTFRSVRETINELTALTGYIINNLNGSLVLITADHGFLFQETYPGQNDKSGLDTKPEGTLKAKKRYLLGNDLGGNAKAWHGYTSITAGTTNSVEFWIPKGANRFHFAGGARYVHGGAMLQEIVVPIVSVKGVRGVEKPGKVNVSLLGTVKKIVNNMQRFEFIQTEAISERVRPVTLTVSLRDVDQLISNEMTLTFDSASDQMNDRKKSASLMVKAGNYDKKKEYYLVLRDAADKTEIERIPLTIDLSFGNEF

SEQ ID NO: 1793 - protein, 740 aa, Pelodictyon phaeoclathratiforme
MFDKWLNQDIRKVLDRRNRVVVGAEASLLDLLRKVLTKELTIFVVHGSLEELECKYTVEKFHKGDKVVIIATSQKNKLTFIRDYAETCGYVDIRMVENYVAARVFQELGLNISLTPEELKVAAYNSIGKGREYWEELCRKGGERLFDIGSDILPFLHDPVGFCATRDAVVVAAFFEKINTWLGRGNISQPPEILAKEVAEQILGSLLTGKPKKKYLDVYKKWGDSKAMEGSLLGYCQEHPVRLELPELWKVYAAHPFDLVDLQWLKDLVAHLSDRVSIKDKLPLIHARFRSSHGRQWRKGLWGHLLQLLEFDTSRIKGIASLEEATTFYTTELYRVDTAIRSIYEEFWGDEKVIRPFQEYYNQLVSPFLHKWFQYFDDYRENQKGLLIERIRSAQGRIAIIVGDGISYEISQRVTAKISDTIKVDNQYRCCGIPSITENNMSLLYRDDGVVEPLQSRREAYLAAQVAMRIEFVQLEEVNFQHAEVDVLLCSCKDIDDIAEKMQHKALKFIGEIENMLAEKVGFLLNNGFQEVVLTSDHGFVLTGILDESDKAEVQFQGIVSKAERYIRTTGRQSPSPELIEYRQQYKEFNYVYFAKHMKPFKTPGKYGYAHGGLSPQELIIPFITFSHTISSLQELNISVANERQLSGVVGDYFSLHLKADDGAGDIFTQERKVQLLFIDNGKEFNKSDIVAIKAGELIKKEFSFDNHLNIEVIVVDALSRLTLTKVAVSQTVARDLGGL

SEQ ID NO: 1794 - protein, 866 aa, Photorhabdus asymbiotica
MQHADLLRRLMDHFIHHRIVFWYDPKQHFSEVLPKLELDGISVLNMHGASLLATKKLIELDQPEQKFLLYFARERPARELDWLLDIRLYSSEFHADHAAMILSDLKIPQSGLREYIQRRQDFFSVNTRIQTLKSWITEDESEDSLDKKMLAVVVGAKSFETKEILFSLLQQYVGQHKDEEDSALENTLAVMEHLQLAPVLWWLLEQEMSYQSEKPLLDDFILKLFCTDLWLQGDKAHRDWLSNNVLPTAAGKASALAFMVGWRADRRFSEDYDFIAGQLAGKFDLTEHYRHSSPYALQECETFEAIEQFIIKALVTQLLEESTTLDRVMFKNLLSQRLAAHWCQTRPEYHAIYEALRHAERLLNLRNHHIDGFKYPDSSSLWQAYTTEIYRFDQAYRLFNEQAMLVHRKGADILRDLDGHIEALYTNWYLAELSREWNRLLDGEQRIHSWEFSGIPLQRNFYSDVVKRELSTSQVKRVFVIISDALRYEVAQELASLIKREKRFSAELRSQTSVLPSYTQLGMAALLPHKELSYLPDNSGVVYADGQSTQGIAHRDAILRKVNGMAVSANELFNWNNSEGRDKIRNAEVVYIWHDTIDAIGDKGATEEKTFEACRKAINELKDLVARVINRLNATRVYITADHGFLFQQQPLSETDKTKLQIKPENTIEAKKRFIIGHQLPDDAFCWHGRLSDTAGSRDNSEFLLPKGIQRFHFTGGARFAHGGAMLQEICVPILQVKILQKTRVERRQQRLVGVVAKSQNIKLVSNIDKVSFIQTEPVNEQYRARQLTIYIVDSENHVVSAKETVNFDSDNHGMEQRVRDVTLKLTGKRFDRRHSYTLVLEDSETRTYFSRYAVTIDLAIQDDFF

SEQ ID NO: 1795 - protein, 868 aa, Polaromonas sp.
MSQQRLLESLGTLFNTHSVVFWHDVEAEFASAVDGLQLDGVRLVRLDETPALRVKLDIERAPEQRWLIYSAKPEPEPTNDWLLDVRMRSKSFRADSTSILLEDLGLTTQGLRQHLKERAKFLRAKDRVDRLKRLVLPGDNAADLDRKMLAVLTRADQPELFAILQRLYAAVVVDGVADLSAQPKAWQDIVANDLTPAFWELVQMQLGYSDVTPSLRDLLLRILVTDFCRGLDGDAPRQLAHFVLSDRTLAANASVFVARWRSDLAHFGSYNALAHAVANDVDLISLLSGQSAEQLVECMTFEDIELRVVQDLKQRIVAGAGANMEVVRALIARRRDGHWANPLLASANERTRALAACYDALTAAADFFSLKAEHAAGFSFTDAGAAFAHYRDALFRFDQLYRHFHTAEDAVEPTGWAVLHELRETIEGVYSGWFIPQLSTAWAKVVEGPQGLLKRWTVAGVTPQQEFFAREVLPLYEAGVKRVFVVISDAFRFEVAHELVQHTNSKSRFKASLGSMLGVLPSYTALGMASLLPHQTLAYKDNANLDVFADGHAVATLDQRSEHLEPFGGLAIKVEDLMALGKDKGRELVRDQRLIYIYHDRIDMIGDKQASETKTFEAAAQTVQDLSQLLGFIINGLNGSTVLVTADHGFMYQESALDESDKSTLDDKPAGTLKAKKRYLIGRGLGATPKAWSGNTATTAGTTPEGSVDFWVPKGASRFHFAGGARFVHGSAMPQEIVVPLITVRESEADHAKTRFVSISLLGASNKVVTSTQRFEFIQTDAVSERVLPRSVVVSLRDGDKPISNEQSLTFDSTSQLLDERKRSVFLTVLAGAHDPHKRYDLIMRDAITKVEVLRLPIKVNLAFGNDF

SEQ ID NO: 1796 - protein, 840 aa, Pseudomonas brassicacearum
MSIGEFIQNKILRPRLQKTGSLVVYDPAGHYQDVCKGLADEKLLVVDASKSSIESRVAAMQGLRDVIDRQLAGMLVYVPAKAPESDEERQADPFAPIAAAGSIFPEGDGDSFESLCLKAKPDHTTAIRAIFEQDASPSFAVVDAIGGGLGWPNLRALLAVESARDILFTLLVPNDAQQAALKGSDSWVIEARDLLRNSMGLSLKTRGKTWDSVANELWRFVLFSEFVFDLPGALPASLNDVPRAETQAKPLIEYLCDLLRNDRRTQSVYIDRAEEIERDLNLVSQFGSWSDLGDRDTFPFEERTFLSRAIEGILRDDIDRVRSISERHQQSVWTGKGESRAQWDLIRSATELLQTCDDMERQLSDNARNLDVLLTFYVSSLREADRLHREFEQAVSDYDWQDAQGVMTPVKQQVRKQYGKLVEKVQLIFTRHVQQSGWPLAGQLSNTDVFDRIVAPKLQKNGHKVAYFMIDALRYELGVALERQLTEDGQVEVQAAMAQLPSITPVGMASLLPGAGQQLRIKNDEQSLVPMLGDQVVETVAQRMDVFRKKYGQRFEEGRLEEFVRGRFDFSPETDLLVLRAVEIDSHFENHPDTAPAEITNALKRIRVAIHKLKERGFHEVVIATDHGFFMNTHAGAGDVCSKPAGNWIGIHDRCALGDGAGDSNHLVVSAEKMGIRGDFAKFTAPHSLAAYRSGLLYYHGGISLQECVVPVITMQLKTSNQPTLHKASVAISYKNGAKAITTRMPVIDLAVETADIFSTENEFEILLEAHDSKGEVVGEAKAGGAVNPATGTLSLKPGDKVQVTIKMQMDFEGKFKIKALHPTTYTVYCQLDLATDYAV

SEQ ID NO: 1797 - protein, 832 aa, Pseudomonas stutzeri
MENRIAQALTKLFDRHRIVFWYDAKQELRDDFDALQLPGVEKLELINNEYGIKYRLLREQPEQKFLLYREGPQPADLDNWLLDVQLAHGEFRTDQVAIWLSELELGLEFTDVVQAHAEFFQAIKRKDALKKLLKADDTAGQIRLKMLAVCTGSEPRMDAVVENLLQELADGRDEKIKLIGRCSLDGFLWEQMTRCYGYKSDAPGIRDFAIELFKSCYAMGTAGQVKLTGDALVFLKRWKDSRQFEGGFETLSGECAEVLGIEQDLAKRDFRELIELDYFRLIDQKIISDLVRAVAARTASSGDVAIWVRQRRQGHWYREYRHLYEAVDYAAQFTHALGEAKLAMDSLAEGVQRYSRFWYQLDQLYRKFTYHVRMSGQASLMGSLTEQIENLYTNNYLLKLGDRFQTFVDAASKWEAFPVRKQKEFFEYWVRPFLRKDNKVCVIISDAMRYEIGDELLSLIRQEDRYSAELEPALSMLPSYTQLGMAALLPNKTLAIVDNETGTVLVDGQSSQGTVNRTKILQAALNGRGEAITAEDFMQLDRDGSRELLKSNDVLYIYHNRIDHTGDKMHSEGQAFEAAEQTLGDIVRLVKKLTAANANNILVTADHGFIYQHRPLDESDFASVEAKGEVILYRDRRFVLGKGLAESASLHSFSSEQLGLSGEVEVQIPKSINRLRLKGSGSRFVHGGASLQEVVIPVLKINKKRQSDVTAVEVDILRGASSVITSGQLAVTMYQAGPVTDKIQPRVLRAGIYTEAGDLISDSHDLTFDLSSDNPRERELQVRFVLTRKADEANGQEVILRLEEKHAGTSHYKEYKSLRYLMRRSFTSDFDF

SEQ ID NO: 1798 - protein, 832 aa, Psychrobacter cryohalolentis
MNDRIINALQQLFKKHRIVFWYDAKHELRDDFDSLVLEDIEKIVLDNNEFSVKYKIIREQPNQKFLLYRAGAQPALFDNWLLDVQLAHGEFRTDQVAIWLSELSLGIEFAEVLKDHAEFFRAKSRKDALGKLIEPSDSSGMVQLKMLAVCAKSEPKMDTVVESLLQDLANDKGEKMSLISRSALDGFFWEQMNRYYGYNSTEPSIHDFAIELFKSSYAMATDGQVKLSNDALVFLKRWKDSRQYKDSFEMLSDKFSDDLDIRDDLSSRDFKQLIDIDYFRLIDNKIISALANAVLQSDFTAEQMAIWIRQRRQSHWYAEFEHTYQALDNAAQFIATFNQVKIDMDSLVQGVERYTQSWYKLDQLYRKFIYHKLESGEVSLLNHLNDKIENIYSNNYLLKLGNRFQEFVESESQWNAAPILRQDNFFGHWVKPFLDNNNKIYVIISDAMRYEIADELVSLIRQEDRYSADIAPMLSMLPSYTQLGMAALLPNDTLSIADNTSGTVLVNGQSSQGTSNRSKILKAALQDRGDAITADNFMQLNREGSRELLKANDVIYIYHNRIDHTGDKMHSEGQAFEAAEKTLSDLMKIIKKLAAANANNILITADHGFIYQNRAIEESDFSSAEPKGKEILYRDRRFILGKGLVDSPSLHKFSSEALGLIGDVEVQIPKSINRLRLSGSGSRFVHGGASLQEVVVPVVSINKKRQSDTTAVEVDILRGSNSLITTEELTVSLYQSTPVTEKNQPRVLRVGVYTESGELISDSYEMTFDLRSENPRAREQQVNLIFTRRIDELNGQEVILKLEEKVGGTSHYKEYKSLKYTVRRSFSSDFDF

SEQ ID NO: 1799 - protein, 831 aa, Rhodococcus erythropolis
MTETSSIQKHLERRFQRHRVVFWHDPEDEYAADLDALGLDGVEIIRVTNNEFAVKNQLLHVEPDTKFLVYRSGVVPTGIGNWLLDLELAYGIFTADRTSLVQQELGLTSEGITEVVQAHEKFFQTAKRVQSLKALLATDDDVLLLQAKMSAVVLGQRDHSLQEITRTLLIENADRTDTKFRALTDYNLSNFYWQGASSFYGYTSPNPSIDDFVLWIFRQAISGFISERPSGLREIQIIFSSLRYDVRSEKAMTTLAKRAARDLDYASTIVDLDFRDLLSNDLFEDVDQKIISDLARAVADRTITAREVAETIRSRQSSVWINEYRKLYTAIGSASDLLAALDALNVSMQSFDEGLDRYRKDWFRIDQLYRQFTYAARTAEHTGPLETLRAQVENFYANKFLHTLGSAWQQQVDSVDRWRSSILCSQTSFFTDHVKPITRDGRRKAVVIISDAMRYEVADELGSRIRQENRFDATLDAVLGVLPSYTQLGMAALLPHSTIGHSGKGDLADVDGQPTSGTANRSKILAGVQGTSILAEDLLSMTRDEIRELYQQHQVLYIYHNRIDATGDKQGTERQVFEAVEKTLDELVDLVKRLTNANATNILVTADHGFLFQDSALDDTGYLSVAPQGDDIAIQARRYVLGTGLKPDPAFTTFTSAQLGLTSDYEVQIPKSIHRLRLKGSGARFVHGGASLQEIVVPVLAIKKKRKSDTRLVNVEILPESDKITTGQLVVKLFQSDPVTEKIQTRTVRAGLYVGETLISEHVPLVFDQESTDKRDRYQSAVMFLSLDANDYNNRTAEFRLEEQITNTNQWRVYAKAMYKLKRSFASDFDF

SEQ ID NO: 1800 - protein, 856 aa, Rhodopseudomonas palustris
MHPLHDYIAGQIGDRIKDRRVVVMYDKREELRPFFAEVAGGHVVGDGTATVSFGRRKARLCVFDGSFLKARFAVEDLTKGDQPDDVVIYIPGLDRDSRGSLLMELEKAGIFYQQPALKQFARLVLRKRFTDVAIDEMLKSDALSYSDLAGMAQDDGGAAQGTSLLKSVFGVSDTVAIMTDWLGNAAFDADMQAKGAIGELRDAALARLGLALPQDATLSRARQIGFRYVLVNEFRADLDAKAELRPQVGTAIKNVAEAKTSDHQKAVQEVAKRLRERYSPAYIEAADKIEAELGFSTDTVHGASLGSIDTFRFEEAAVVAACFELVASEKFEAARALMASRESSFWVNREVTRKSVWAVCKLMVDLGLVAAAVDSTISKANGNPSVWVERYVSEKDGWYALDQAQRRLEAFLSSVDEGVDERAVARIRIIYENAVRRMSEGFLKALQKADWAVPNVLPQTRVWSDVVAARPLPVAYLMVDAMRFEMGHELIGRLNRASEVQIRPALAALPSITPIGMAALLPGASATFSVVAAKDRLGASVDGTFLPDLSARQKFMKSHVPDLVDLTLDEVISMSPKALQKKIGSSNHIVIRSTEIDAAGENATTTTYARRIMDNVVEDLARCLGRLAAVGIGEAVITADHGHLFFAADRDPSMRLETPGGDPIDLHRRCWIGRGGSTPAGSVRVGGAKLGYATDLDFAFPASTSVFKSGGDLAYHHGGTSLQEMVIPVISVKLKADGSTKAEKDAVTVSHEFDAVTNRIFTVQVELGAASKDLFAGARKIRPLVVSDDRPVASAAIATGAVIADGVLTLPPSVKAQVGFMLTDDTVKHVRIQVLDAETDALLYVSQKDIPVRLGV

SEQ ID NO: 1801 - protein, 775 aa, Saccharophagus degradans
MTTVLAALEHALLNSGSFNPDIEVAPAAVLWPDKDRLWQPVIGQLQARLPQLWTLGDYAPEQKTGPAIWLRCAMANRVEGVDAAGAIPILYLPGVSRQEIRAIESCPEALKPLAELQYRGVIWSQVNAKDWTILAFLRSDQGGLGLDVAQDRAALHAMQLALYRLLDVDISLLKGKRLDKDYFNTLLIDGDPIRDLLQWLDQGDAFKAAKGDTAWPAFVEIIKSQLGFDPDKQGTLSAAALLAAHEGPWQPVWDRYCEAPKRYPNIPALLEKTALPMDMFADKSGWPQWNRQQEHELRLALTRLEQSSPAQARKAIADLDNTHGERRTLVWAELGLSPLAQSLKWLKKLAEVTKSSIAGGTIADMANTYQTVAWQADDAAVQALKPIDQQEDFDAVSTAIRAMYTDWAQDAARYLQDSVQKHGYPGLGAAERKPVKYAKSETVFFVDGLRFDVGKRFAETLEAKGYSVELSTRWSALPSVTATAKPAVSPVAQLISGVVGSDAFEPCVKETEQKLSGHHFQKLLETSGWQKLAKAETGESTGQAWCEYGDIDSEGHDRGWKLAKHIDAILAEVEDRIDGLFSAGWKQVRLVTDHGWLLLPGGLPKTELPAALVDSKWGRCASIKPGSHTDELLYPWHWNAEQHFALANGISCYKLGEEYTHGGLSLQECLTPELIIRKAGNAYVDVKAEITDVSWRGLRCNVAVEGAFEGLLLDVRLDAGDASTSKVMSTKTIKDSGVGSVVVDDEDLDGVTAVIVLLTESGELIAQQQTRIGGE

SEQ ID NO: 1802 - protein, 865 aa, Salmonella enterica
MQNQEFIAGLKAKFAEHRIVFWHDPDKRFLEELDNLELENVTLLDMTDQSQLAVKKRIEIDEPEQQFLLWFPHDAPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLATPSGRASALAFMVTWRADRRYKEAYDYCAQQMQDALRPEDQYRLSSPYDLHECETTLSIEQTIIHALVTQLLEESTTLDREAFKKLLSERQSKYWCQTRQEYCAIYDALRQAERLLNLRNRHIDGFHYQDSATFWKAYCEELFRFDQAYRLFNEYALLVHSKGAMILKSLDDYIEALYSNWYLAELSRSWNKVLETENRMQEWRIAGVPRQQNFYNEVVKPQFNNPQIKRVFVIISDALRYEVAEELGNQINTEKRFTAELRSQLGVLPSYTQLGMAALLPHDEICYQPGSGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFLIPKGIQRFHFSGGARFVHGGAMLQEVCVPVLQVKALQKTAAEKQPQRRPVDIVKHHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 1803 - protein, 867 aa, Salmonella enterica
MTLQNQEFIAGLKAKFAEHRIVFWHDPDKRFLEELDNLELENVTLLDMTDQSQLAVKKRIEIDEPEQQFLLWFPHDAPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLATPSGRASALAFMVTWRADRRYKEAYDYCAQQMQDALRPEDQYRLSSPYDLHECETTLSIEQTIIHALVTQLLEESTTLDREAFKKLLSERQSKYWCQTRQEYCAIYDALRQAERLLNLRNRHIDGFHYQDSATFWKAYCEELFRFDQAYRLFNEYALLVHSKGAMILKSLDDYIEALYSNWYLAELSRSWNKVLETENRMQEWRIAGVPRQQNFYNEVVKPQFNNPQIKRVFVIISDALRYEVAEELGNQINTEKRFTAELRSQLGVLPSYTQLGMAALLPHDEICYQPGSGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFLIPKGIQRFHFSGGARFVHGGAMLQEVCVPVLQVKALQKTAAEKQPQRRPVDIVKHHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 1804 - protein, 865 aa, Salmonella enterica; identical to SEQ ID NO: 1802

SEQ ID NO: 1805 - protein, 820 aa, Salmonella enterica
MTDQSQLAVKKRIEIDEPEQQFLLWFPHDAPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLATPSGRASALAFMVTWRADRRYKEAYDYCAQQMQDALRPEDQYRLSSPYDLHECETTLSIEQTIIHALVTQLLEESTTLDREAFKKLLSERQSKYWCQTRQEYCAIYDALRQAERLLNLRNRHIDGFHYQDSATFWKAYCEELFRFDQAYRLFNEYALLVHSKGAMILKSLDDYIEALYSNWYLAELSRSWNKVLETENRMQEWRIAGVPRQQNFYNEVVKPQFNNPQIKRVFVIISDALRYEVAEELGNQINTEKRFTAELRSQLGVLPSYTQLGMAALLPHDEICYQPGSGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFLIPKGIQRFHFSGGARFVHGGAMLQEVCVPVLQVKALQKTAAEKQPQRRPVDIVKHHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 1806 - protein, 867 aa, Salmonella enterica; identical to SEQ ID NO: 1803

SEQ ID NO: 1807 - protein, 865 aa, Salmonella enterica; identical to SEQ ID NO: 1802

SEQ ID NO: 1808 - protein, 867 aa, Salmonella enterica; identical to SEQ ID NO: 1803

SEQ ID NO: 1809 - protein, 865 aa, Salmonella enterica; identical to SEQ ID NO: 1802

SEQ ID NO: 1810 - protein, 863 aa, Selenomonas sputigena
MDIEQIIADLNRRFAEPLPEFYRRRMIVWHDEEKEFVDKIDEIRLNNAKIAILTGTNYFSVKKLLAVDDTDSNYLLYSPFAYETLEDNWLLDIELYSEEFRADLISMWLSEMGLPQTPSLRSAIKPYRKFMNAKERRKKIMAQTNLPTTAGGLHLSIMAALAGIKDAKPAGIIKAVLKAGLNHSANNLWQDFEGYHIADVFWRMVAQGTGYAQENPTLGALAVHILLTAVSRTLRQEFLKGLDTYISTAHAAFCYDLVSDWLYAEDHHALHEIAEFAESEANLHERFMKLEIADLLHTAIFPCVNEIILVKLMRDMEKNVIDPKFVKEIVEKRRTFAWYEASRNFYEGLYQAANMQEFFKSHADGFHAIAPKKIWQGYTEEYYRFDTFYRRFHRSYDASLKNCHADLSDMFADIKDMAEGLYVNWFLEELGTSWLNAVEESLSAHGKASDIPMQTDFYRHKVYPADSRVYVIISDALRYEVAAELADDLRRETQSKVELGSMQGIFPTITKFGMAALLPHKRLSVEEKAGRLSVLADGESTEAPRRDKILKAANPKSVALKYKDMLGMKRPERSALVRGMDVVYIYHDTIDEAGHSESSIFGACGEAIEEIKNMVRIITGEFSGTRIFITADHGFLYTFNPLREDDKVDKITKSSQDVEIARRYAIVRKGAAPEYLLPVKFLDGDTEYDAFAPRGNLRIKMKGGGLNFVHGGISLQEMVVPLIDYRYLRNDSKEYKKNKARYDTKPVTLSLLSSSRKISNMIFSLNFYQKEAAAGNREAAVYTVYFTDSNGKVVSDTVHIIADKTSDHAEERTFRVGFNLKSLKYDSKENYYLVIADESGLPVRQEKFSIDIAFAVDEFDFFS

SEQ ID NO: 1811 - protein, 679 aa, Shewanella sp.
MLVVNYLIEQLRNAAAYNKSVQVKPAAVLWTDELCQWQSAMPLIKEYLPELLELGDYEPSQRTGPAIWLKCAIAGVLDEAPLVEGRTPIIYLPGVSRKALRAIEDCPDYLRPLAELQYRGSWWAYNTAGRDWSVGSFLTNPRVGLELDVAKDNSTQEVIPKVLRDLLETQVDALKGRRLEAKDFQELVFNDPIKDLLGWLNHPSQKRAQWDENKWQLFCQTCESEFGLKPGDDTHQQMLAAMLNAEGPWAAVWQRFEDSAHNLHSLLTAIATLVPVDLAADFSHYPIENAREEQRLMNAIVALGQGELSLVRSNIADLYKAHQVREGWLWYRLGQSKYLQILAELAKVAKLTAQPFTHQSPQEMAALYCETYWQADAAALQAMALAIEPQQQELVAEVLALIYSPWLSEVTHNFQGLVRRQGYPGDGEINEATAGYLAKGLVVFFVDGLRYDCAKWLEQKLLARQIQATLTSQWCALPSLTDTAKAAVTPIAGLLTGAQDTQDFTPSVAATSSDFSAYHLKKLLAEHGWQYLEGLDSGEQEGLAWLQTGDLDNLGHQQQRKLPLGIDAVLNEVADRVCHLLDAGWREVHIVTDHGWLWLPDKLPKVELDKPLVRKYLSRCAILHDNASTDLPQVGWHWNNAVSLAMAPGVGAFTAGDYYNHGGLSLQECLTPVLKITNS

SEQ ID NO: 1812 - protein, 679 aa, Shewanella sp.
MLVINYLIEQLRNAAAYNKSVQVKPAAVLWTDELCQWQSAMPLIKEYLPELLELGEYQPEQRTGPAIWLKCAIAGVLDEAPLVEERTPIIYLPGVGRKALRAIEECPDELRPLAELQYRGSWWAYNTAGRDWSVGSFLTNPRVGLELDVAKDNSTQEVIPKVLRDLLETQVDALKGRRLEAKDFQELVFNDPIKDLLGWLNHPSQKRAQWDENKWQLFCQTCESEFGLKPGDDTHQQMLAAMLNAEGPWAEVWQRFEDSAHNLHSLLTAIATLVPVDLAADFSHYPIENAREEQRLMNALVALGQGELSLVRSNIADLYKTHQVRESWLWYRLGQSKYLQILAELAKVAKLTAQPFTHQSPQEMAALYCDIYWQADAAALQAMALAIEPQQQELVAEVLALIYSPWLSEVTHNFQALVRRQGYPGDGEINEATAGYLAKGLVVFFVDGLRYDCAKWLEQKLFARQIQAKLTSQWSALPSLTDTAKAAVTPIAGLLTGAQDTQDFTPSVAATSSDFSAYHLKKLLAEHGWQYLEGLDSGEPEGLAWLQTGDLDNLGHQQQRKLPLGIDAVLNEVADRVCHLLDAGWREVRIVTDHGWLWLPDKLPKVVLDKPLVRKYLSRCAILHDNASTDLPQMGWHWNNSVSLAMAPGVGAFTAGDYYNHGGLSLQECLTPVLKITNS

SEQ ID NO: 1813 - protein, 856 aa, Slackia heliotrinireducens
MDIEYSEIENRLKAAFGHSTRLVFWEDESSEYADSIEGLKIEGADIVDATGHELATKRTILREQPGKRFVVYRHGGAPNPADDLLLDVKIAARPFSCSMEGVWADECGIPVTLAGMLADHAAFFNSKERRAALAATSLPKSGTQSFLFAMAAATMKAADAEERDAARSMAKKAVLEWARGDEQSMRMLVDAGLSGTFWAAMREHIGYRVGEGDAPNAGDLAFRLLEGMCGPIVQDDMRADDAEASRILGDLARDGRTRDEFDRVVQEYSKAVAALVPQDMRTAETLSEVDAIPEIDEWILSGFAAEVSASSTSSAAMERVRDARKHSLYHYRYGAYYSLLIAITGFRSECARYKKECGSGTGTAQILEKYCSAWHLVDRRYREAHLAFDRVPAGRFKSSMTKAMDELRGAYDLFLVDLTDRWQMHLMDDGAWPPSELPSQSRFFREHVELALPRAERGKRVGVIVSDALRYEAGSDLASRLSASKLKGIAGRAAVKCAYALSAIPSYTQLGMAALLPDGAMEIDPATTYVRKAGAPTWGTANRGKIISARIPGAVALQAKDVMGTKLDLSDAPVAVVYHNVIDKTGDTRDTEGDVFEAVERACAEIEKLVQALIQSGCGKVVITSDHGFIYQSQNPETYAYVDVPGLSQLKSADDVSCDHTRRFVVGKSIPKSESLVEYAAVDLSLEGDYNVAFPKGVTRLRLSGSGSRFVHGGASLQENVVPVITVEAAKGAKASRPTGVEGFVIGRPVVTGPSVSVTVYQSDPCSESVSPQTVKVGVYSKDGALVSATEKTIELASESDDVETRKTRVTMPLIDEVDDCASVVVRISARIGNTNAYESAWEQEYSVNRAFGMDF

SEQ ID NO: 1814 - protein, 868 aa, Spirosoma linguale
MNDLQRKINAFFQQHPARRVLFFFDTENRHIDDVAGLNGETFELVRLNPPYAFFSTKVQLNSRSADALPVLLYLPGLQSPRTEADRQEFPLFDLLVANDELRLDPVAELMARYGLQPHQRPLVERYQSELVRKDPSGILQPLLRADAFEEASLQHALTARLLGFKILPDVNSLLAKLLTDRADRPTEQANYLTRLEQLNLDAPLRRRIGDVFFDGPVTEPLTSGFVQQLVLRLKYNLMVSSLPTDGEPYPMLRLNRTDTLSRLAVIRETIGAAPLERLLTKVGEAVQEEKLLARYGTTANYGYYSIRLRELLLKKIMLASGPSVSPDSQLTALDELLADVPETHPQRLLLLTVRHGLSLLEATGNVLTYRLDTPEAYIKTYEETFYRIDLLYRWFVLARRDWQIVGSDDSAIGTTADDIAEWLIPFEQRIHDRYDRFLLELNREWLACLQERNYDLRSIAIPKQYDFYRQAVVRPHLRDTIQKVAVLISDGLRYEIARDLQAELNQDPKNQTTVGSMLTALPSATWLGMANLLPHNGLLFDGQTVTINGQHTKDIEARNAILKATNVRSQAIDYNKLESMSRSELRDLFKQEVVYVYHNRIDDVGDKRQSEGDTVKAVRETMDELKRLIKLLHSQYNVARVLLTADHGFIYQHIAPNDQALMKAPEVPVKLEKNRYVLTNQSNFSGATVTGSHVFSLASVSALATDVDWKVLVPEGINRYRRQGSGTRYVHGGASLQEVLVPLLESSRKREDVGQKVTIRLIREDLSLLANQVKVLFLQEQRVTDIDRPRTVAVGLYVGNELASNRVELLFDSVSESASGRTRDCTLHLTGNLPVQRQYTLRISDVTDELNPLLERPVTNKTIIERDF

SEQ ID NO: 1815 - protein, 830 aa, Sulfuricurvum kujiense
MSKITESLTKLFDKHRIIFWYDDGGALREEFEFLTLDNVEKRLIANNEFSLKVQIHRAPSDQRFLIYAPNPQPDDAHNWLLDLNLSGYLYSADRASMLIDELGIDPIHKELIQTYEKFFNAESRRSKLIPLIGKESDASALKTAMLAVVCGCEPRLESIILKVLSWVSEENDKKIAEISGYGLDSFFFDEMRRIYRYESAEPSFKDFAYALILAHFYNTLSPAKAGLNVDAVYFVKHQWIDSQRHRESFILLSRQVEEMLGIKETLESYSLSQLGECDTFESIDKRIIIELRNGILSSLLDADTLIETIRKREKSVWFEEYRHLYKALEYSALLLQRIKSSSLKIGGLKEGFERYASLWYETDTLYRKALYHSAMAEHIDVLKSLMSQVENAYLGSYLIPLGDAWQEHVNTMEEWKIPGLISQRQFYEHYVAPQTTNDRKVYVIISDALRYECAKELEKRLLEKNRYQCSTEAMVGVLPSYTQLGIASLLPHNELGLLGSDDTISVDGKSSAGVANRNKILEASPASATYLKWDEFIGMGRDEGREFVKGFQVFYIYHDRIDAIGDDAKTESHVFEAVEKAYDEIEKIITQVTNLNGTNIIITADHGFLYQNNVVEETDLCQIDRNGSTITKYNRRFVLGQNLNTHACVKKFSFEQLGLSGTGEALIPKSVNKLRLQGAGNRFVHGGASLQEIVVPVVLFSKKRKDDVENVDVDIVKSFSRISSNQITLTLWQKTPAGDKMLPRTLYAGFYAGDELVSNEEQLVFGSTDEDSRNREVKVKFHFVQTISQYNNQTISLRLSELEPGTSRRRVYKQEQFSINISFVSEFDDF

SEQ ID NO: 1816 - protein, 863 aa, Synechococcus sp.
MVGVVSDYLVQLITKQVDEKGLVVWYDPEQAYESVAVELSLPNTTVALFEGSFFKLREDIDHLLNDNHPPRLVVYVPMDRMETHHALIELDCAGVIMQPKQQPPSCNTRLSVVARNALKPILGDEQVSEIEHQVEAGKLSLDDLNSLADKGKDISTGILTLIFGTANPQEVALDFLHSDRHDNNVVKKAAEQELQHLFQVSFDVELSASQSLASWRKKLGQYILLTDLFASLKQLPSSLASVPIANTKSSIDACVRLTQTWRNSRNMRDSYVTVSKQIEKELALNQLQLPVESLQENETFLCVELALLEYVESELIKAANLALVELAKYRLSSFWSNVIPEIQARWALILSAAEVLIEADRVGRAIKKAPSSVLDLVKSYSDDDEPWCALDTHHRHMESRKYNFEFAGSNDHECLEKLLIRAEQRYTEVGSELAKHFITHYQQAEHPIKGLLQQREVFKKRVKPHLSDGKVAYLWVDALRFEMASELCRVLKEDFTFEIQPAIAMMPTITEIGMAALLPNADESAKVVSVGGGKLGLEIAGKVIKDRKDRIKFLREQAGVSVFDAKLDDLLPKPTKKVRDSIQNAELILITSQEIDELGEQDNISQARLQIDGVLSQLRRGIRLLADLGIKTIVLTADHGHIFADELGEDMKIEAPGGEVKDLHRRVWVGLGGTSELSYLRTSLASLGVDSEFDIATPWTFACFKSKGGGRAYFHGGLSPQELIVPVVVLNSIVKPQLQSTGVQWILTPGTPKLTTRFFSVQISGIQSELSLFGFTPPNVKLELRANKKCVSCPVSASYGFEDATGEVKLKIADHDNKQIEPNTITLMLLEEISQKTVGVYLLDATSGVELAEPLTIDVAISM

SEQ ID NO: 1817 - protein, 746 aa, Syntrophomonas wolfei
MTNQWFLEDIENLIKKRGRVVILDPRSQYGFLLPLLEFQGYTLLRTDSNLTEPWQTVKEELLLRYEAETRHKSDKVVFYVSREQDKLSFLLDYCFTHGCLDFSEPAKWLRKKLFSHTGLQVQLDDATLLTAGKIGAEKDLAWWKKILQNLEDLIDLEDELIPFMDDPEAYIADLEQDIRRMFETKVFQLLNQPYMTKPTKTLAEEVARKLLDGLAYNDIKTDLLSIYHRWADSETYSPSLMNYVANYNLDSSVDPWAAHPDHCFSALDQKALQQLTGHLRDKEYVSGKLDAIKARAKNTRVKRFVPGWWQDFIILMEFDNQPLTACSSFEQVVDFYTSHFAQVDRAIRNLYTAFLSDKSIIRPLQEYYESLNYELLQKWFEYAQQYKSDQQGYLPDLFKNAKAGTAVIVGDGIRYEIADYVATTLANKFKVDKQIMLAGLPSETEHNMSALYVGNNEVLASHKDREKKLGEISGKAITYMNLEAVSYGEKANYLVLNYKDIDYAGETLQQGALKLFTEFEQVLQDKIAQLLNMGYKEVHLVTDHGFVLTGLLDEADKIAPDAGKDKEVHERFIRTQDKPDNPDWLVFEKPYGEYKYLCAAKSHRPFKSKGAYGFAHGGFTPQEIILPRFVFRKDGFATSSLGVAISNKTELAEVAGEIFVVKLQADAGATDLFAFKRKVKILLYDDNINCGSSNLINMEPGKTETIEFTFDDRQTLKAVLLDAESQEQLDIVSVKKANIRDLGGLL

SEQ ID NO: 1818 - protein, 873 aa, Syntrophomonas wolfei
MEREQIEQSLNKKFEEALRPGEKRKIIFWYDSEGQFADLINELHLQPARVHQLTGHNYFYTKYLLEVDDTESNYLIYANHRPARDEDNWLIDTYLYSYEFYADRLLLQMEELGIPLSLRPQVKHYEKFFKNAERRKRLAGYREWGHAPGIPRTGNVTHGEDDVSKDASYDEATLEIAMMSALCGLKYPDQQEVYKKVLGSGLEEQNNRFLSDIKRFMDEEVFWKHAGRYFGYTREEHSLPKLAAHILINSLRRILDDKHLQPLQEYLADPGKGNCIYFVDHWMNNQTDNDRYETLSGAVDRTMGIAGRIEDIPVEELGECDGFECFDQRILGYIQESIGNQVENYDFCLNLIKARRTKHWYQKYENIYEALYHLLKIMDLKKTLAPIPMVGVKELWEGYAQNYFLVDYHYRNFYWHYDQNPVEFLKPLRALVENIYSNWFLQELGTAWSHALESNPPGWQVDGVTRQQNFYKREIEPMINGGERCFVIISDALRYEVAVDIAIRLNQETLATVSLDTMLGVLPSTTPYGMAALLPHRGLRLNQNQQVLADNRKTDSLQEREQVLQNWVSDAVATHCQTLIDMNKEARRELVKGKKLIYIYHDSIDATGHTAATEVKVFDAVGQSREEIYRLIRLIRDDLGGVNIFVTADHGFLYRRDPLPESDKMKKETVAAFAEKRRYLLSYKEVESEALMRFKPDYISSEEGALWVYVPRSAIRFKVQGAGANFVHGGAALQEVMVPLIKYKALRGSNRRKKEENKVKVKLTNESRKISNTLFSLEFFQSEKVDEEHLPRTVEVYMEDENGKIISNREILIVDKRSDKPAERSHKAKLTLKTGPYDKQKDYFLIVRDADTELIEEKIPFKINIAFSSDFDL

SEQ ID NO: 1819 - protein, 783 aa, Syntrophus aciditrophicus
MKDETTLIESVLASLAHAARYNPGDMVAPAAVLWTDTDGQWRLVVEQLRRFMPGLLTLGEYDPQTRTGPAIWLRCVIEPVVRKEKFTDLQWPDDATPVIYMPGVSRQTLRAVEECPDGLKPLVELQYRGTVWTQKNGKDWTVLAFLISEDGGMGLDVAGDRLTLQAIRGALSKLSVTPVKQLRNKRLEAEDFDRLMIGDPTRDLLRWLNDPDGVRKELDQGTWAAFRNRCRQDYSFNPETDGDIVAGEKLGIREGTWYGVWERFVEAPAFYPRVPELLRRSKPSGKLIFDKDSWPDENESMENELRSALLKTSAMSPDEARQQLEQLEVKHGVRRNWVWARLGMSPLANAMEHLAAVAKRTEVTLGGESVDAMARLYAEGGYLADDAMLRSLACVKTAEDTTAVQTAVRCVYLPWLEDTTRHFQQCHSVKSLPSVEQQEVAKVNTHECILFADGLRFDIGQRLAAMASERNIEVSVTWRWASLPTVTATAKPATSPIAGKLSGGHMREDFSPELKETGETLTTDRFRRLLSDAGFQILGQVDTGDPLTQDARGWTEYGEFDKLGHDLQVKLATMIEDQLELLFERVQGLLEAGWKRVVVVTDHGWLLVPGGMPKAPLQKYLAESRWSRCAAIKDTSHVEAPVSGWSWNSHEQFAHAPGAYCFVSGQEYAHGGVSLQECMVPILTFTAMMESPQLIVKVCEIQWIHQRCRVKVEPVAEGIMADLRTKPSVASSSISGLKRLDAHGKAALLVADDTLEGTTVSLVIVDASGRVICKEATTVGGDR

SEQ ID NO: 1820 - protein, 852 aa, Tepidanaerobacter acetatoxydans
MINLELDEVKKILEQNFNKGLSEGKKRNIIFWYDDNGEFKGQIDTLELSNAKILKLDGQNYFYAKYLLEKQDIKSNYLVYAPFCKPGPRENWLLDILKYSDEFSTDRTTIIMRNLGVKNEALKNIFEHYKKFFDNKERYRLLKSYNIEYCTEESVHIAILSALCKLPFSDLDEVVKSLLIEYAKDDNTYFTEIDKFGDINTFWALMEKYYGYILEEKTIEHLSAFFLITALYYTLEDKIPAHWEKFISPKKADCFVFLSNFMNNAKAMDYFDMLSIKVEKQLNLRDYADKWHIDNYVVSDVFKIFDETIINKLIENLISDAGEFERYTDIILQRRTKHWYRKYENDYNCVYWALVMLDSWRKIKDDIKEDKPYDLFQKYAGQYYIIDMAYRKFIYFFDKLPNKEPFFELKEKIENTYVNGYLNQLSIKWSDSLETLEQNWKISPLELQQDFYINHVKPYEDKDERVFVIISDGLRYEAAKELEEDLNTERKGSTKITPMLGILPSYTALGMAALLPHNEIKINDKFQVIVDGLSSDGTENRSKILQKAQKDSIAVGYEQLSGMKRDDFRKLFGGKKVVYIYHNSIDARGDNALTENEVFNAVEDTFGELKALINDLINNVSATNIYITADHGFIYKRGNIQESDKVSKESLEDSLQNRRFILTEEDVDFNGTLTFNMSHIEDTKLKCIVPRGVSRFKVQGKGANYVHGGAALQEVVIPVIKFKHERGKTAKEVKKVDVKLTSISRKITNNITYLEFFQVEKIQDKTVPRRLSVYLADEEGNRVSNENIIIADSTSDNPEDRTFREKFVLKSMKYDKSSKYYLVLEDEEETVERIYEKIPFIIDIAFMNDFGF

SEQ ID NO: 1821 - protein, 849 aa, Tepidanaerobacter acetatoxydans
MELDEVKKILEQNFNKGLSEGKKRNIIFWYDDNGEFKGQIDTLELSNAKILKLDGQNYFYAKYLLEKQDIKSNYLVYAPFCKPGPRENWLLDILKYSDEFSTDRTTIIMRNLGVKNEALKNIFEHYKKFFDNKERYRLLKSYNIEYCTEESVHIAILSALCKLPFSDLDEVVKSLLIEYAKDDNTYFTEIDKFGDINTFWALMEKYYGYILEEKTIEHLSAFFLITALYYTLEDKIPAHWEKFISPKKADCFVFLSNFMNNAKAMDYFDMLSIKVEKQLNLRDYADKWHIDNYVVSDVFKIFDETIINKLIENLISDAGEFERYTDIILQRRTKHWYRKYENDYNCVYWALVMLDSWRKIKDDIKEDKPYDLFQKYAGQYYIIDMAYRKFIYFFDKLPNKEPFFELKEKIENTYVNGYLNQLSIKWSDSLETLEQNWKISPLELQQDFYINHVKPYEDKDERVFVIISDGLRYEAAKELEEDLNTERKGSTKITPMLGILPSYTALGMAALLPHNEIKINDKFQVIVDGLSSDGTENRSKILQKAQKDSIAVGYEQLSGMKRDDFRKLFGGKKVVYIYHNSIDARGDNALTENEVFNAVEDTFGELKALINDLINNVSATNIYITADHGFIYKRGNIQESDKVSKESLEDSLQNRRFILTEEDVDFNGTLTFNMSHIEDTKLKCIVPRGVSRFKVQGKGANYVHGGAALQEVVIPVIKFKHERGKTAKEVKKVDVKLTSISRKITNNITYLEFFQVEKIQDKTVPRRLSVYLADEEGNRVSNENIIIADSTSDNPEDRTFREKFVLKSMKYDKSSKYYLVLEDEEETVERIYEKIPFIIDIAFMNDFGF

SEQ ID NO: 1822 - protein, 872 aa, Thauera sp.
MSHQRIIDALEAQFVAHQLLFWDDPEGEFAAWVDGLSLEGVQVLRLDRTPSLQVKLDVERSPGTRWLFYRPAAEPDPAKDWLLDLRLRGRAFRADSNSMLLDDLGLTSQALRPHLKARSKFLRAKDRVEKLRRLVTPSDDAEALDRKMLAVLVRSEQADFQTILLRLLSSMVHEGEADLAAEPRAWQDIVANELDSAFWALALQTLGYGADGVAPAFTLRDLLYRILVTDFCRSLSGAAPESLRHFVLPDRTLAANASVFAARWRTDMAAYESYNLLSDAVAGEIGLDGVLSVLPGEALAETMTFAVVERRILKDLKDRVLAGAGASDEAMQALIARRRDGHWASRLMAQSSSESRALAACYDAMEAGAAFFELKARFDAGFSFANAEAALMAYQAELFRFDQLYRHFHEAAEKVEPMGWAVLHELRVRIEETYTGWFLPQFGTAWARVIEGEGGLLSQWTAAGMPNQHRFFDIQVAPLLAAGAKRVFVVISDAFRYEAAEELVQQLNSKSRFKAGLSSQLGVLPSYTTLGMAALLPHHSLAYKANSNLDVLADGQPVSTLEQRNAHLAKYEGLAIKADELLALGKDKGRALVRDRRVIYVYHDHIDALGDKQATEGMTFRAVDEALAQLSQLVSFIINSLNGSTVLVTADHGFIYQEAPLLAADKSALETQPEGTLKAKKRYLLGRGIGTSPKAWCGNTALTAGTDPEASLDFWVPKGASRFHFAGGARFVHGSAMPQEILVPVITVRESESDKEKARYVEFSLLGASNKVVTNTQRFEFIQTEAVSDKVLPRTVVIALSDGERPISNEQTLTFDSASQLLDERKKSVFLTVLAGTYDKTRDYWLTARDVTTKVEVLRVPLRVDLAFTNDF

SEQ ID NO: 1823 - protein, 784 aa, Thermacetogenium phaeum
MSNRTSEMSANTLLEAVRRSLLRAARYDPGTLVPPAAILWTDADGQWQPLVSQLRHLMPELLTLGDYNPGEKTGPAVWLRCVIERMLPELELPENVIPIIYLPNVGRQILRAGEECPNGLKPLVELQYRGTVWTQRNGKDWTVEAFLVSEEGLGLDVAKDKQTRQAMLRALPQLAITPVSRLRGKRLESEDFDKLIVADTSRDLLLWLNDPVQVREKWGNEKWEAFCSRCKAEYGFDPEGEGELVAAEKLGLREKEEWKALWERYAESAAIYPGIPEILRRAKPARLIFDREPWPDENEKDENLLRRSLLELEGLSPAAARQKIEELEEKHGMRREWVWARLGQSPLAEALKHLVTLARRTSQGLGGGSPKAMADLYTESGYLADDAVLRAIGSVKSADDARAIQAAVRSIYLPWLDDAARHYQDLITTFPFPDAIGKDQALVAADPGQCLLFVDGLRFDIARRMVAMAEERQLQVNVDWRWAGLPTVTATCKPAVSPLAGKLSGDLPGDEFVPEVGETNLPLTTDRFRKLLAEAGYQVFNSFETGHPGERGARGWTEFGEFDRLGHTLQSRLAARIDEQLELVLERVQDLLEAGWKQVRIVTDHGWLLVPGGLPAMKLPKYLTESRWTRCAAIRQGTCVDVPTAGWYWNACQYFAFAPGVYCFVKGNEYAHGGVSLQECLIPDLTFNSFELPSVAVSIREIQWLGMRCRVAVDAVSSEVMADLRTKPNDPNSSITTPKQIDSTGRVGLLVADDSLEGTTVSLVLLDPSGRVLAKQATTVGGED

SEQ ID NO: 1824 - protein, 853 aa, Thermoanaerobacterium thermosaccharolyticum
MDLAQIKTLLEDTFSKELSEGKKRHIVFWYDDDGEFKEDIDELNLENAKIIKLSKNNYFYVKYQLEKVDTNSNYLIYAPFEKPSPKENYLLDVLKYSMEFSTDKAAVIMRDLNISDDSLKIVFRKYIKFFNNKDRYKIFKGYEIERYTEETVDVAVLSALCRLPYPDFDECLRVLLMEEDLKNNKYIEAIEKFGRLDVLWKLADKYYGYNDKEPTLEKLAVFMLVTNVAYSLNGEIPETWRKYVSSRKADCVVFLSNFMNHSLYSAFYDRLANSMEEKLKVREYIDNWEMEDYINCDTFKAFDEAIIKKIKEQLLISIGEFERYRDIIQARRTKHWYNLFKSEYECIYWAIELFDCWKNISQNMRQYTPLEFIERYTEQYYRLDTAYRKFYASFDRIQNKELLMELKEKVENTYVNGYLNILSIKWSDSLETLNGNWKIPGMVMQKDFYSTYIKPFESRGERVFVVISDALRYEAAREFCDMLNKERKGSCDIVFMQGSIPSSTNIGMAALLPHKAITIDEDYKVYVDGISSEGTDNRNKILNNYSQESIAIQYEDVIEMKRDDFRKTFGGKDLIYIYHNTIDARGDHAQTEREVFDAVEEAFEELKVLINNLVNNVTATNIIITADHGFIYKRGDLIESDKVAKGSIEDAYENRRFVLSTKPLELEGTLTFSMEYLLGPDTNLNFITPRGVNRFKVQGAGANYVHGGTSLQEIIIPVVIFKNDRSKSSKNEVKKVDVKLTSITRKITNTISYLEFFQTEKIEDKRIPLRLKVYFVDEDGNRISNENIIIADSKSETYEDRSFREKFVLKNRKYDKTKKYYLIMEDEEETVEKIYDKIPFIIDIAISNDDFGF

SEQ ID NO: 1825 - protein, 960 aa, Thiocystis violascens
MTIDLGPVSKTLEAEVRTWVRRNGTVVWLDLDNHYSGFVDRLAARRDAGELPYEVRAFRGSHLALILAPEEVSVGVDRLPLLLHLPGFNEETVRETPLYELYVAGSRYRKALDTLITEAAAGQVTPEQIAAFRTQPETTLEGADVWLAALLDESSNELVTLLRSLQPTAVLDDLLGGGFIAGQLGQPEAESALWEQIRVWTGWPSTWRETALPSVASRARLSAEEVAFAAAAWALCVEYVHDLKRPPVSAVLAGAIDLPPSLTETCRTLATHLRARHPGFYQRCADETEALLAEEVETAKAEDLGRIDTFRFEEDRVLKAAFAALQSSDWMRALEWADLRIGAKSKQPSFWVRDDLARTSAWQLVLAAAQLGQAIAQAGTLGAVGDLVTAISAYTERGAAVDQTHRHLEQRRVALLYPQLPEFESLRSCLDRLRGHWRSWADAWARDFNARCRAHGFLPEAGLQQRHLFDEQVRPLTGESGTTAYFLIDAFRYEMADELYRQLVDTPATTVTLKPCLAELPTCTEVGMNLLAPVATRGRVSPVLSTEGGGGRVLGFTRGEFRVTDPATRQRAIHDRVGGGTCPWLTLDEVVTRDPVSLKRAIAQARLVVVHSQEIDDAGEKGVGPAVFEHVMQKLRAGWRLLRDAGVRRFVLTADHGFLLLDPQAAAVQTHGRRIDPGRRHVFSPAAADHPGEVRVALAELGYEGVAGHLMFPESTALFDTGRPRRGFAHGGNSLQERVIPVLTLVHRAAAGGSAQRYVVWGERREGVAGMHCVAVRIEAAVQCELDFGSPRELELALRVPEAADVQVELCQTRGPARLVGGGVRAQVGAPFELFFRLSGSSDARVLIELYHPGAAADVESGMPEARFAVAAAGMSGTPSLRDPAGTPDVWLERLPEGGVRQLFAHLAQHGVVTESEAASMLGGQRGLRRFSLEFESFAVKVPFAVRIDLIGGVKRYVRD

SEQ ID NO: 1826 - protein, 851 aa, Thioflavicoccus mobilis
MKIRDYIQDQLRERLAAAECLVLYDAQGRYRELALGLAGPDCTVVDTSESSIQGRAEAMAAWLALGDAAPGSRQLLVYVPRKKPLADRECQADPFQTFALGGDTFPRGEGDSYLSLCLQAMPDHEASVYALFEGGAPPTFETVDALDSGATWPKLRTLLEVESPREILVGLLSPTDRQGPALQADQGWLGEYREFAQAALGLSSHIKVGGWADVREELARFVLFSEFVLDLPGDPPGNLPSALAAVPRADPHRRPLIYAVCDYLRDARTHQDVYIELANAVSRELNLPVQMAQTQEFGSRDTFLFEERAYLKRCGVAAGGGDLDTARTIVEQRRRSIWAQSEERGAAWVIADRGLEMLQAVIDLEAELGGLKKGLAALVDFYADRARLADSLHRSFERTVHDAYGQTEGLEDLIESARHRHRAFSDALQKRFMQAVREEGWPVSGFTRHTQVFDQFVAPVLAEQRRIALLMVDALRYELAAELATRLPQGMKARLDKALGQIPTITSVGMAALLPGADGKLALVRENGELVPTIGSKRVNGPTERVDYVRGIYGDRVAAVSLDDLLKAPRYRPKLKETVHLLLVKTTEIDTAGENMSGAALGVMQGVLEKFLRAVKILGEMGFERAVFAADHGFVLLGEQLPGDKVEKPQGEWTLSKVRCLMGSGSGSGSGAPAKGVACLRKEDLGVRGDLTHLAVPESLGAFVTGQTFMHSGVSLPECLVPVVTVDLAAETPAGRSAARLQLQYRGGKTDRITTRRPMIEVVLFLQQDLFGAETLRFSLEAKAGKRLVGQVAASANVDPATGLVVIEPGAAVKIPLRMDEKFEGDFTVVAIDPVTQVTYDTLKLKTDYLD

SEQ ID NO: 1827 - protein, 885 aa, Vibrio cholerae
MQISELAQGVAAKLEQSRIVFWYDPEQSFTEELEHLANALSIAKEVGDSAADITARVLPNDLTILNMGNESVLAVKKRIEVDEREAKFLIYFPSAEPEPDRDWLLDVRLYSEQFFADHSSMLLNELGIPKMALRTHIRKRQSFFANKQRIAGLKKWVTENEDELSLDRKMMAVVVKADSASLSDILLGLLREYAAYIEDESLGQPLWSQLGKFDLETSLWAYLSEGFGYTVEEPTFSDFVLKLFCTEFWSQIEGVERDWLLNNVLKSASGRATALAFMVSWRDSRSFAAYYESISKVLSQQLEISTRAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYEKEVRTRLSLKQTKRVFVIISDALRFEIANELGAIINNEKRFKAEVSTQLGVLPSYTQLGMAALLPHKALSYQPEQGTAVYVDGISSQGLDNRNSILQKVGGMAVSSKELMSWSNQEGRDKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSDTEFLLPKAAQRFHFVGGAKFVHGGAMLQEVCVPVLHVRELQKEQAAKHEKQPVGVVAATQPIKLVNNIDKVRFIQTDPVGERFVARLLDVYIVDAQGNEVSSRETINFDSVSKVMDERTREARLKLIGSQFDRNAQYTLVLENAEMRTRYSQYAVTIDLAFQDDFF

SEQ ID NO: 1828 - protein, 767 aa, Vibrio cholerae
MIDTWFKEDLARILEQHPVAIFIDESGEAEFLLKSLKRDCDVYRTNGELEELEAKYRVEKALQEHPKSEHKYVIYTQLSKEDLTFVREYCETNGCIEIRYLQNYIKDKVHRTLNLNINLPKDELIAAAKVSVGKDRTYWMDLSHKGASEIFDLDKELLPFVHDPENYVTEKYDAQLRETFYRKVNELLGQEYIDKPASTLASEVVSAMLKGLADNDCDKTLLSVYNSWLDSVSYRNSFGSYLTKHKLDSAFINSSAIWQVNPDHPFRQVDEAWLKELGNKLANKSLSKVESAQLVARLKQRHQSKQAQALGIVFWNDIIALLEFDPKDMSYLSSFAECVEFYKKHFCPLDTAIRNLYTEFMQQRDSLEPFQELYKEYVTLFLDKWFQYFSQYREDQTGILQAIIDRDIQIDRPGKNSKIAVIVGDGVAYEIAEQVAIKVKQLSNHSTLTRRHILADCPSETENNMSHIYMANGVVEPVQNKREKYLSAQNSHIDIDYIRLDEVSDQPLSGQVLICTYKDIDDMGDKLNHKALKYFPESIDFFAEKINQLLNIGYGKVYLITDHGFVLTGLLSEADKIVVKPSGQNYIDERFIWTSDKQESLIPQFIEVAKSYKDYNYLYFARSMNPFKTPGTYGFAHGGLAPQELVTPYFCWEQESDVMGELPVTIANKHDLVSVTGELYQLKLRAESGEGNMFTLDRKVMLLFFANKAQVNKSDVITVQSNGQVTKEYTFDGHNEIEVQLVDAMTKQQLDRVLIKKNNDRDLGGLF

SEQ ID NO: 1829 - protein, 835 aa, Zymomonas mobilis
MTDRITAGLMRLYEDQGHRIVFWYDAARDLRGAFDAVDLPGVTKLEIANNEFGLKYRMLRQEPKGRFLLYKDGPEPPMPENWLLDVQLASAIFRADQAAIWVADLGIPAKYEAAVRDHAEFYRSGKRLEALRAIERERPSQSANDVRRKMLAVCAGADGDLDTVIEALLAELAEGCDDALKLMDRVGLTEFFWKNVAARYGYAADAPDFQDFAITLFSSAWARAMGEAAPLNTDAALMFRRWSASRRWGEAFEKLSGDYQDVLKIRDNLASRDFRTLMPHDHFEEVDRRIVVAIVEGLARQSLSATDVLKWVRDRRQSHWYGRYADVYQAIGYATEFQQALAEADLTMTSLSDGVKRYSASWFRLDQLYRKFIYHMQKSGQSGLLSALYEAVENRYTTNFVLKLNDAWQDQVARLTDWAIPGFPRQMDFYREQAAEFRRKDQKVVVIISDALRYEVAEEALREIRKLNRFDADLKPMIGALPSYTQLGMAALLPHRQLTIRDDNDLVLLDGESTMGAAAREKALAAGRAGDRVKVLAAKDFMNLGSSEGKDLFRDHDILYLYHNQIDAIGDKLATEENVPAAAETAIEDLVKLVRKLTSANFSNILITADHGFLWQHRALEESGFALSEPEGDIVTRNRRYVIGQGLSSSGGMKKFTASQLGLGGDQDILIPNSINRLRVKGSGSRFVHGGASLQEVVLPVLRVGKQRKEDVGQVSVQIIPPPRAQITTGQIQITFYQAEPVTEKQQPRQVHAAIFADDGTLISDEAELEFDFASENPRERELSRGFLLTKAADAYNNQTVFLKLRTRIGKTSHFEDHASQPLLLKRGISTDFDF

SEQ ID NO: 1830 - protein, 860 aa, Magnetospirillum magneticum
MDKIIDALSSLYGEGNRIVFWNDPDREFEESLSSLGLDGVTLLRADQMPGLEAKIRMEREQPESRFLVYSATHVPLPSEDWLLDIRLYSRTFRADRASIILGELGLQEQSLHSHLQARAKFLGSKDRLTRLKKLVQPTDSIRDLDRKMLAVVTKVDQPEFLGILTALYHAIPDSDLDALPPAWDEIEKYDLSESFWSMVQGQFGYSENSPTLKNLLIRLMVSDFAHSITAELPAALAHLMLPRLFLSSASVCLSQWRDSNSRSDSYDRLSKMVGDALKIDSLLPGMKIEPLLDNKTFLVIEKFIAVSLRDRVTATTATINAEAVKAIAKHRQNGYWADRNRGAIGATREALHAVYDALIAAADLFGLRGEFSNGFDYNSAQAMFDGYATTLHQFDRLYRHFIEAADAATAQGWEILKTLRDGVEDCYTNWFLTNVSLKWGKFVEDELLKEWRVEGVIPQPWFFHKVEAALMESDRRVFVIISDALRYEAAKELVDVLNGTYRIQAEIQPMLGVLPSYTALGMAALLPHSKISYSDKGDVLVDGQSSAAGNRSNILATKKGVAVKADDLKDMKKDAGREFVKPYEVVYVYHNTIDAIGDSGSTEGKTFEAVRQALNELSDLIRMIMNNLNGTYIYVTADHGFLFQETALDATDKNALTDKPAGTLIAKKRYLLGRNLPDSAKAYHGSTAITAGSDGDMEFWVPKGNNRFHFVGGSRFVHGGAMLQEITVPLIRVRQIKGDAKSKTSVKNVGVMVMTQSPKITTNRYRFELMQTEKATDRVKPATLDIAVYEDGQAITNIERVTFDSTQDNLDSWKKSVWLSLQKRSYDKKGCYHLILRNAEDGIEVQRVEVSISIAFMDDF

SEQ ID NO: 1831 - protein, 838 aa, Marinobacter aquaeolei
MSQQINYALSRLFDKHRIVFWYDTKQELRGDFEAVSIPDVEKLEIANNEYGLKHRILREAPEQKFLLYKEGPQPEDLDNWLLDVQLAHGEFRTDQVAIWLSELELGLEFAEVAQAHAEFFQAIKRKEALKKLLKPDDTAGQLRLKMLAVCAGSEPRMDSIVEYLLDESCQLSAVSDQLGEKFRLIQRCNLDAFFWEQMTRLYGYISDTPSIRDFVIQLFKDSYYQNFTDHCTLTADSLVFLKRWKDSRQFEQGFETLSAECAEVLGIEQDLDKRDFRDLVELDYFRLIDQKIISDLVRAVVGRTVTSGDVALWVRQRRQGHWYGEFRHLYEAIEFAARFVQMLGEARLTMESLSDGVQRYSRSWYQLDQLYRKFTYHVRMSGQASLMGELSEQVENLYSNNYLLKLGDGFQVHVDAAPRWEAYPVVQQKAFFEHWVRPYLRKDKRICVIISDAMRYEIGDELLGLIRQEDRYSAELEPALSTLPSYTQLGMAALLPNKSLAIADNDTGTVLVDGQSSQGTVNRTKILQAALDGRGQAVKAEDFMQLNREDSRELLKGNDVLYIYHNRIDHTGDKMHSEGQAFEAAEQTLDDLIRLIKKLTAANANNLLITADHGFIYQNRELDESDFLGDVVSGDDIRYRDRRFVLGKGLSASPAFHHFSSQQLGLDGDMEVQIPKSINRLRLKGSGSRFVHGGASLQEVVIPVLKVNKKRQSDVSAVEVDILRGASSVITSGQLAVTLYQSGPVTEKVQPRNLRAGIYTQSGELISDSHELSFDLTSENPRERELQVRFVLSRKADEANGQEVFLRLEEQHAGTSHYKEYKSLRYLMRRSFTSDFDF

SEQ ID NO: 1832 - protein, 855 aa, Nostoc punctiforme
MNTIRIQNTLETLFQDSARWLHPGRRVVFWYDPEQQFISSFNELQLEGVEKLQLADTAFTVKYHLLVEQPNQTFLLYAPFAEPAPQENWLLDIQKSGLTFSANPAALIYADLGLRSRGLEIVIREHDKFFKSRKRTEALQAMGISPDSDERGLLLAMLSVLAGLKVPDAGTLIRRVLLGGLLESDNALWSDIERFISPEAFWEVVQEHTDFPKQNPSLNKLFVQLLITHFAKSLHDTIPPQLANQVITPGQRAYAFIDQWMRDQQDSLGWKILSSEVAEQLHIFDAIENLEPEVLFEAASFEVVDKVLIRTCVKTLQMQMRQQITELTPWRTWLQARHTLIWFPQYEKIYQALEAAIALLEFKQQYPEGFRQPAPILFKAYASDLHSFDKAYRHFIVKSDDAQGDILKGLIDDVENLYTQWFLDSLGEAWSDALGNNNWELEGIASQTRFFGRHVFPILERSDREKVFVIISDALRYEVASELEEVIKKEVRGETSLEAQLGVLPSVTRLGMAALLPGSKLELIPGDDDVRLDGLSTKGASARQKVLNQNSRVEATVLSAKDLLEMNTDEGRAAVQPYRLIYIYHNVIDAIGDQASSERQVLSACGTAISELLRLVKKICNSINGTNVIITADHGFLYQRRLIQEADKRPLPSGEVVLESKRRYLLAREQLNDSTLLHFSLPYTENGTVAIVPRGSLRFAVQGAGAQFVHGGASLQEICVPVITYHHQRAVKGDEGPARKVGVQVSARVRRVTNNRFTLTLVQSDAVEGRWRSRQITVAFYDPQTNIPITDVRGANLSSTSPHPSDREISLRLTVTTANPPTNVYLIVKDADDESELLRETWAVSLGIANDFGDF

SEQ ID NO: 1833 - protein, 835 aa, Rhodobacter sphaeroides
MSDRIAASLRQLFEDQRIVFWYDADRDMRAEFEAVDLPGVTKLEIANNEFGLKYRILRQEPKGQFLLFKDGPEPEMVDNWLLDLQLASAVFKADQAAIWLAELGLPLHFEDVVRAHIEFFRAKARVESLKRLMPTSSWDTQTQMRLRMLAVCAGAEGGLDTVIEALLGELAHGRDDALRLMERSGLTDFFWKQVGQAYGYKPDEPDFEDFAIVLFQSAYARVLGEDGALNAEALLVFRRWKNNRHWAEAFQALSARYQDLLKIPADLAKRDFRTLVGVDHFEEIDRQVIREIVRAMSAQSVSAPELLNWVRERRQSHWYPTYADIYQAIGYATEFQQALAEANLGMTSPAEGVQRYVTSWYRLDQLYRKFIYHMQKSGQASLLADLYASVENRYTNSFVLALNDAWQDQIAGLGEWKIPGFGSQANFYQEQAAEYRRKDQKVAVIISDALRFEVGEECLRRIRALDRFDAELKPMISSLPSYTQLGMAALLPHSTLALAEDGSGDVISDGENTKGIAAREKLLAAGRKGDSARALKSEDVMNMRTDDGKALFRDNHIVYVYHNRIDAIGDKLQTEDKLPEAAEDAIEDLTKLVRKLTSANFSNILITADHGFLYQHRALDESDFAIADPQGAEILFRNRRFVIGRGLTPTSGMKHFAAAELGLSGGLDVLIPNSINRMRVKGAGSRFVHGGASLQEVVIPVIRVGKQRETDVGQVDVQIFVTGRSLISSGQTAVTLYQTQPVSEKMRPRELLAGIYATDGTLISDEYTLIFDFRSDNAREREMPRKFLLSREADRFNNQDVILKLRERVGKTSHYQDYATHRFQLRRGMTTDFDI

SEQ ID NO: 1834 - protein, 837 aa, Runella slithyformis
MPDIITINDKVQAALEKLFQQHRLVFWYDDHAEMTDLFENLQLPEVEKVIIANNEFTLKYRLLIEQPHQRFLLYQPKEKPVDYENWLLDLLLSHYEFRTEPASLYLQELELPQEFKTLIQEHEGFFTHQKRIGDLKSLLEPDDRESLIRLKMLSVVCATEPEWDKILYALFAEAAKAKDTQYKAIENFGLSRFLWETVEKKYGYKSPKPSIKDVLLRLIQDNFERNTPIGKPILNKEAYLFVNRWKENSKARQVFYDWSLTLEKDLSIEAFVQNRPIEHLLEADTYSVIDKKIIVDLRDRILHHTLPTHTLQEWIDKRRVKFFFGDYAHLYDALSFAAAFLDEIRKMDLTMQSPEEGFVKYEKQWYKLDYLYRKYIFESEQAEHQGILKELSARIEKAYGNSFLLQLGDNWQAALEGMSRWSLERVTGQKQFYPQWVMPYIRKENRVFVIISDALRYESAAELRDLVVQEDRYTATLNAVLGSLPSYTQLGMASLLPHTQLTFEEESDTVFADGVSTKGTPNRTKVLQKSYAGSIAITAEEFLRMKASTEGREFIKPYHVLYIYSNQIDKTGDDTTSENKVFEATKLEFDYLLRIIKHISNMNGSNVIVTADHGYLYQHNRLDATDFSDFTPIGNVYKSSRRFVLGKNLVPNASVQKWKGEALGLGDQTEVLIPKSINRLRIQGAGSRFVHGGSSLQEIVVPVLEINKARKSDIEQVEIDIISGSSNITSNTFAVSFYQKQPVTGKVQPRQLKAGFYTEAGQVISDMITLLFNSPETDAAAREKRQSFLFTSAASKHNGQDVYLKLEEQIDGTNQFRMYKSITYRMLIAFSSEFDEF

SEQ ID NO: 1835 - protein, 730 aa, Halopiger xanaduensis
MQASKSLPDAAKSTIRSKFDRAESSDPIILWWDDGNYLEDIIEQACNELGVELKVADETPLELRANPVDGEQVWYVPHVKDPEDAEGEYDWFRDVEHTGGEVEMSIEDLTVHAFERGQLDAWELKTATQADDPAKRREIARILHDQLTGGQLPTLEQLRTQIVTGGYTDPVAFVLENGWGDIDDSPDTIEQMQDLLTSEGVDAVASEDEPVGIVAATRRWAVAEWLIHAGADAERFPREFRAETAGDHDLPELKSLLNNTTSASLLADRYLGEAIWPEVVADVDDPWELADCIVDAALERRLWEEWHASFDAGDYETCLERAEERYDALLGSEDFRGTYRGAYGPDSPWTQTWEQAAEIARLAHQLETWDESAPDDVVSLYADPDDGTWQIDNAVLNLVVAGEPESDLPDDHPATAALDDLRTQLQSEYVEYLEDLGDLVTETVEAGAPFVEEDHSYQFFTKESDGLESGQTVALFVIDALRLDLARRLADELRDYVATLPADAPEFAIDEDVWLGTLPSETEFGKAALTPGEIQMFDVSLVDGELQPLRNNRRVTTNRRESLLGGDGWTVTREEDDGWQSTRVAYFKNDIDDIGEKELSDLEAMLARRVDSLAEFIGTKLEQGEWDQAYVLTDHGFVLLPDNASPEKISRPAEASDSGRRWIAGENVDEDSPGVLLDSSSRLGYLDANVSVLASPLKRFRKQGLGDARFYHGGLLPQEFVLDFISITQG

SEQ ID NO: 1836 - protein, 730 aa, Halorhabdus utahensis
MQATQTLPDAAKDTIRRKFDRAESNDPIVLWWDDGNYLEDILQQACAELGVPLKTAEKTPLELRADPVDGEQVWYVPHVKEPADREGDYDWFRDVQHTGSEVEMSIEDLTVHVFGSEQLQAWELKNATQSDNPQQRREIARILHDQLTGGQLPTLEQLRTQIVTGGYTDPVAFVLENGWADIDDDPQTVDQMKDLLTSEGVDAVADESEPTTIETQTRRWAVAEWLIHAGADADRFPSKFRAETAGAHDLPELKSLLNNTTSPDLIADRYLGEAVWPDVVDTIDDPWELSSCIVDAALERRLWDEWHASFDVGDYEECLDRAEERYEALLGSEDIHGNYRGAYGPDSPWTQTWEQAAEVARLAHQLDTWDENVNDDVVSLYADEDDGTWQIDNAILNLVVSGEPETDLPGNHPATKTLDDLRTQLQSEYVDYLEDLGDLVTETIEAGAPFVDEDHAYQFFTKESDGLESGQTVALFVIDALRLDLARRLADELREYVATIPADAPEFAVEESVWLGTLPSETEFGKAALTPGEVQMFDISLVDGDLLPLRNNREVNTNRRNSLLDGDGWTVTREEDEGWQSTRVAYFKNDLDNMGEKELSDLEEMLAQRVDSLAEFIGTKVEQGEWDQAYVLTDHGFVLLPHDVTPGKISRPTESTDSGRRWVAGENVDEDSPGVLLDASTRLGYLDANVSAFASPLRRFSKQGVGDARFYHGGLLPQEFVLDFISITQG

SEQ ID NO: 1837 - protein, 730 aa, Halobacterium salinarum
MQAKQTLPDAAKDTIRSEFDRAESSDPIVLWWDDGNYLEDIIEQACDELGVHLKIAEETPLELRADPVDGEQVWYVPHVKEPEDTEGDYDWFRDVEHTGGEVEMSIEDLTVHAFERGQLDAWELKTATQADNPAKRREIARILHDQLTGGQLPTLEQLRTRIVTGGYTDPVAFVLENGWGDIDDSPDTIEQMQDLLTSEGVDAVASENEPVGIVAATRRWAVAEWLIHAGADLESFPREFRAETAGDHDLPELKSLLNNTTSVSLLADRYLGEAIWPDVVADVDDPWELADCIVDAALEHRLWEEWHASFDSGDYEECLERAEERYDALLGSEDFRGTYRGAFGPDSPWTQTWEQAAEIARLAHQLETWDENATDDVVSLYADLDDGTWQIDNAVLNLVVAGEPETDLPDDHPATAALDDLRTQLQSEYVEYLEDLGDLVTDTVEAGAPFVDEDHSYQFFTKESDGLESGQTVALFVIDALRLDLARRLADELRNYVATLPSHAPEFAVDEDVWLGTLPSETEFGKAALTPGKIQMFDVSLVDGELQPLRNNRRVTTNRRESLLGGDGWTVTRDEEDGWNQTRVAYFKNDIDNIGEKELSDLEAMLARRVDSLAEFIGTRLEQGEWDQAYVLTDHGFVLLPDNASPEKISRPTEVSDSGRRWIAGEDVDEDSPGVLLDSSSRLGYLDANVSVLASPLKRFRKQGLGDARFYHGGLLPQEFVLDFISITQG

SEQ ID NO: 1838 - protein, 732 aa, Halorubrum lacusprofundi
MPATKTLPQCAHDTIESAIDEAADDDPVILWWDDGGYLRDIVEHASTQLRCEFRAAEQTPLELRADAPRDRTVWYVPQPSSDDVDWFKDVEHTGGVVEQHIGKLAARCFENDRLQAATIRTAYEDAAEQSSASPHSHARGDADAREKVAQTLYEELDGEGGLPSLQGLQTKIVLNGHDDPVQFVLEHGTRNLPDGEGLLKIRDLLVDDGVTAVEGESDARTIVERTRRWAVAEWFVDEGLDKALLPQEYQPEPSTGFGVSRPELRSMLSKTERKGELANVYLDPDQRFWHDVLRSYDDPWELVDCPVDASLEHRLWDEWTQSFNAGEYETCASQATQRHDRLDATYGDVPWTQVWEQAIDVATLAAELETWEERGDTSDVVDLYGDVEDGTWQIDNAVFNLIISGEPEAGLPEEHPATATLDRLRSSLTESRYLEYLTDLGDLVVDQIEAGSPFVGEKHAHQFFAEEQEHLQSGQSVALFIVDALRFDLAHELADSIRRELPQLEVDESTWVGTLPSDTEFGKAALTPGSKFSFNIELQDGELVPERSDRKITNHRRQTLLENDGWSYIMQDAEDEVGWSNTRVAYYWNDIDETGEKELTDFEELFSDRIEAISRIICEKLRKGEWDRAYILSDHGFVSLPKHVDIDDLHPPDNAEQVTRRWVAGTGLDDDAPGVLLDEDTHLGYLDDDARVSILADPIQRFRNQGLPDARFYHGGILPQEFVLNFVTITQE

SEQ ID NO: 1839 - protein, 730 aa, Haloarcula hispanica
MQAKQTLPEAAKDTIRKKFDRAESADPIVLWWDDGNYLEDIIEQACDELGVHLKVAEETPLELRANPVDGEQVWYVPHVKEPEDAEGDFDWFRDVEHTGGDVEMSIEDLTVHAFERGQLDAWELKTATQADDPTKRREIARILHDQLTGGQLPTLEQLRTRIVTGGYTDPVAFVLENGWGDIDDSPGTIEQMQDLLTSEGVDAVASEDEPAGIVAATRRWAVAEWLIHAGVDAERFPTECRAETAGDHDLPELKSLLNNTTSAGLLADRYLGEATWPDVVAAVDDPWDLADCLVDAALERRLWEEWHASFDAGDYETCLERAAERYDALLGSEDFRGTYRGAYGPDSPWTQTWEQAAEVARLAHQLETWDERATDDVVSLYADPDDGTWQIDNAMLSLVVAGAPESDLPADHPAVDTLDDLRTQLQSEYVEYLEALGDRVTETVEAGAPFVDEDHSYQFFTKESAGLESGQTVALFVIDALRLDLARRLADELRDYVATLPADAPEFAVDEDVWLGTLPSETEFGKAALTPGEIQMFDVSLVDGELQPLRNNRKVNTNRRNSLLGGDGWTVTRDTEDGWQSTRVAYFKNDLDDIGEKELSDLEAMLARRVDSLAEFIGTKLEQGEWDQAYVLTDHGFVLLPDSASPEKISRPAEASDSGRRWIAGEDVDEDSPGVLLDSSSRLGYLDANVSVLASPLKRFKKQGLGDARFYHGGLLPQEFVLDFISITQG

SEQ ID NO: 1840 - protein, 754 aa, halophilic archaeon
MPATKTLPQCAEDAITTAIDEAADEDPVVLWWDDGGYLQDIVESVSKSIGCEFQTAEQTPLELRAKAARNRTVWYVPQAHSDDVDWFKDVENTGGVVEAHIGKLAARCFENDRIQAASIRTAYEDAAERSRSRAANSRSRDHERSPSDLSDDSASPHSHARGDADAREKVAQTLYEELDGEGGLPSLQGLQTKIVLNGHDDPVQFVLEHGTRNLPDGEGLLKIRDLLVDDGVTAVEGESDARTIVERTRRWAVAEWFVDEGLDKALLPQEYQPEPSTGFGVSRPELRSMLSKTERKGELANVYLDPDQRFWHDVLRSYDDPWEFVDCPVDASLEHRLWDEWTQSFNAGEYETCASQATQRHDRLASTYGDVPWTVVWEQAVDVATLAAELETWEESGDTSDVVDLYGDVEDGTWQIDNAVFNLIVSGEPETGLPEEHPATATLDDLRSSLTESRYLEYLTDLGDLVVDQIDAGSPFVGEKHAHQFFAEEQEHLQSGQSVALFIVDALRFDLAHELADSIRRELPRLEVDESRWVGTLPSDTEFGKAALTPGSKFSFNIELQDGELVPERSDRKITNHRRQTLLENDGWSYIMQDAEDEVGWSNTRVAYYWNDIDETGEKELTDFDELFSDRIEAISRIICEKLRKGEWDRAYILSDHGFVSLPKHVDIDDLHPPDNAEQVTRRWVAGTGLDDDAPGVLLDEDTHLGYLDDDARVSILADPIQRFRNQGLPDARFYHGGILPQEFVLNFVTITQE

SEQ ID NO: 1841 - protein, 721 aa, Natrinema pellirubrum
MPATKTLPQCAEDAIETAIDEAADEDPIVLWWDDGGYLRDVVESVSYSLGCEFHAAEQTPLELRTDAPRDRTVWYVPQAHSDDVDWFKDVENTGGVVEAHIGKLAARCFENDRIQAASIRTAYEDVREGDREQVAKTLFQELNGEGGLPTLQGLQTKIVLDGHEDPVQFVLEHGAENLPDETADLLQIRDLLVDNGVAAVDGVTDEDVLVTRTRRWAVAEWLVEEGLEKSLLDAEYRPESSSGLGISRPELQSLLSKVDPERAEELAHVYLDPDAQFWHDILRSYDDPWELADCPVDASLEHELWNEWLQAFHDGEYETCTTRAATRYQRLETTYGDVPWTSVWNQAVEVAKLAHELETWEERGDTTDVVDLYGDVDDGTWQIDNAVFNLIISGEPEHGLPEEHPARASLDDLRTSLTESRYLDYLSDLGDLVVDQIEAGSPFVGENYAHQFFDQEQEHLQSGQSVALFIVDALRFDLAHELAESVRRELPGLEVDETAWVGTLPSDTEFGKAALTPGSKFSFNIELDDGELVPERNGREITNYQREKMLKDDGWSYIMQSEDDESGWSNTRVAYYWNDLDKAGEKELTDFEALFSDRIEKISDIICEKLDQGEWDRAYILADHGFVSLPQSIDLDGIYPPDEAEQVTRRWIAGKDIDEDAPGVLLDENTHLGYLDDDTKISVLADPIQRFRNQGIPDARFYHGGVLPQEFVLNFVTITQE

SEQ ID NO: 1842 - protein, 971 aa, Planctomyces limnophilus
MSDLFGPVSRLLEAEVRDWVTKHNLVFWLDTGSHYVDLVNQLRALRKQGELKYDIYTFNGSFLEMLFELEEVMGGVDATRAVIHLPGFNEELVKATPLLELYKAGARYRKALETLVRDAAAGKVRPDQIDEFLQRGNLSLAGADMWLHDLQSTGAEGLASQLRNVSLNELVDDLLLNRSLAQRIATIDLRAGTISDGDPRAIRDRIVSLTGMPESWFDVSLQNSFSSGAEPTSVEAVAYAICSWAACVSYVHDLLVPPLSPLLEPVPRLPQLVRDTCHELVVHLQNGNERQRSFYRQMALETELRLTDDVGQIAATDLGRFDTFYFEEETILKASLQALQDRRWDAAQDWASRRSDPNSFWLVDDALRRNVWQLVAGAARLGVAIQTAGPALKATDSVANAAQEYVQLGAKVDQAQRHLEQDRQKLLRSQMPEFEQVRSVLDQMQIVWRDWANSWGQGFNAVCKTHGFLPDSSLQQRTLFDETVKPLTAGDGITAYFVVDALRYEMGQELLESIGDTAKTDVKLDWRLAELPTVTEVGMNVLAPVAKGSKLQPEISNGRIAGFSTGEFRVHDPDTRRRAVHDRAGGRTCPRIELEEVLRLEAITLRRKIAGARLVMVHSREIDNSGEAGFGPSVFETVLKDLRSAWHLLREAGVRHFVFTADHGFLLVDENSHTAQSYGRKIDPHRRYVIADRAANHSGEVRVALRDLGYDCDDLHLMFPESVAVFDTGKQRKGFAHGGNSFQERVIPVLKISHRVAVGGNSTVYNLSAARKPAVAGMHCLAVRVAHASGSLDFASIFELDLALRVLDSPDVRVELCEIRGGARLSSGTVIATVGEEFELFFRLAGGTDSRVSVELYHPSREASVEPCALKERFDVVRRIAIATSTRTDETPSQSEVWLADLPGAEIQRVFRHLAQHGTVTETEVAEMLGSTREFRKFSRQFEQHAARAPFTIRIDSVSGVKRYVREGATL

SEQ ID NO: 1843 - protein, 953 aa, Anaeromyxobacter dehalogenans
MTGGLTALALEQELLGELRRRGVVVWLDAHGTYTPFVDGLSARAKQGEFPFPVVAFRGSFLEIVLALEPYGSGLDNAPLLIHMPAFTEDSIRATPVLELYEPGFRFRKDPKTLVREVARGRVAPDALEQYLAGAGTVDLAAADAWLASQLTHTREGLAALLEQLGPTLVLDALVDVLERRESFLLQRVGSDAEREVLEAWLARQTGMDAAWLRFYGSDPKATPLASVAGALVGWLLSVEYVHDLNRPPFVAELVRLRDLSAPLVKASLALVDHIRGKHTDSYASLADEVELHLHEELPAIRPEDLGKIDTFRKEEQRVLQGAVDALRAGEWEKVRGWAEARNEERSYWLRRDPARRRAWELAREAAALGSMLTARPRPLEGVRSLDAAVERYAATAYEVDRAHRRFEQRQATLLDSQLPHFGDLKEIVRVLRSAYRGWADRLARDFAAACRAAGFLPDATLQQRAVFEQVVQPLATDERVALFLLDAFRYEMATELLAELKAPGTVVDLKARLAELPTITAVGMNALAPVSQGGRLQVSGTFGGFRTGEFTVRTPDDRARAIGLRTGAKQSVLLQLGEVCELEPEKLKRKIASARVVVVHGTEIDDAGEANLGPATFEIFLRQLRTAFAQLQKAGVKSFVFTADHGFLLLDETTQKVPYGSKRDPAQRYVLDEHPRAEQGMVNVSLSALGYDGLAGYLLFREDTAVFATGNAGATFVHGGNSPQERIIPVLTVRRERPLGRTLMAYRVDAERLPDAMGLRRVRVRLRAAHDDAGQLGFVAAPAVSVGMRAPGHPEVRATLKGVSGPGAVEDGTLRLAMDADWTEVFFALEGPSSEAVRLEVYHPDAVEKVAPKPLDGWFDVDWRRGSVEPVAPQPERVLDWSDALPAGGVRAVFEHLAVHGAITETEVTRMLGSPRAFRRFSLDFDEHVRKVPFRIRTEPGSDGKRYVKEGER

SEQ ID NO: 1844 - protein, 1016 aa, Haliangium ochraceum
MSADARAPGARAPGVRDSDDASRAQRLGLGPVSAALERDLRQFVRRHGLSVWLDPAGHYTELVDHLAQLPSAPEPGHLDYEVRAFRGSYLALMHELANLTSGVHPPRLLVHLPGLNDRSIRTTPLYELYKAGKCYSKSLDTAVSEAAAGRVPPDDLAALCARADLSLAAADAWLSERVSGGVGGGLRATLENISASALIGDLLRGEGVATRLRDPGDAAALWAHLEAALGLRADWARSTGAGEAADADADPGAQVGAQADTVRAEDVAFAMASWAQAVEYVGDLRRPPVSPLLAGVSALPAAVRTACGELAEHLRQAHADFYRRTADETEDRLADEVAAARAEDLGRIDTFRFEEDKILEAAIAALRAREFDRASEYVQVRAGLRSPWVALDAGRRAAWQLVAAATALGQAIADAGAKLAANDHDAALAAYCERGARVDRLHRELEQARFKLLGPQVPRFDAVRACLDDLRAAWRAWADAWAEGFTVLCERDGFLPRAELQQRHLFDDVVRAHAQAGTTALFLVDALRYEMATALLAAIVNIDGTAATSVRLDARFAELPTVTEVGMNALAPVSARGRLTPKIANGTFQGFSAGEFQVKDPETRRRAMGARVGGSTCPLLSLSEVLARDARSLKHSVAQARLVVVHSLEIDQAGEHGTGLAAFEDALHTLRNAWQLLRDAGIKRFVFTADHGFLLLDSGAGSGGAAAAQAHGRKIDPKRRHVISSVAADHSGEVRAPLSALGYDGSELHAMFPRTCAPFDTGARARDFVHGGNSLQERVIPVLSVVHRSDAGGTTLRYRVEVTDRDKPLGDLGGVHRLRAGVRVAGQSALDFGAAGEIELALRAREPADVSAELVSVSGGARIEGGRLLAKVGEDFELHFRLSGNTEARALVELHHPGRSAELEPGGPARRFSVTPAVKQRPADAEPTSAAAASEAARAPAASWLAQLPAGVREVFAHIEAHGVCVENEASALLGGARKLRRFSAEFEKHAALAPFGVRIDTVGGIKRYVKEGTRT

SEQ ID NO: 1845 - protein, 1016 aa, Haliangium ochraceum
MSADARAPGARAPGVRDSDDASRAQRLGLGPVSAALERDLRQFVRRHGLSVWLDPAGHYTELVDHLAQLPSAPEPGHLDYEVRAFRGSYLALMHELANLTSGVHPPRLLVHLPGLNDRSIRTTPLYELYKAGKCYSKSLDTAVSEAAAQRVAPGDLAALCARADLSLAAADAWLSERVSGGVGGGLRATLENISASALIGDLLRGEGVATRLRDPGDAAALWAHLEAALGLRADWARSTGAGEAADADADPGAQVGAQADTVRAEDVAFAMASWAQAVEYVGDLRRPPVSPLLAGVSALPAAVRTACGELAEHLRQAHADFYRRTADETEDRLADEVAAARAEDLGRIDTFRFEEDKILEAAIAALRAREFDRASEYVQVRAGLRSPWVALDAGRRAAWQLVAAATALGQAIADAGAKLAANDHDAALAAYCERGAKVDSRHRELEQARFKLLGPQVPRFDAVRACLDDLRAAWRAWADAWAEDFTALCERDGFLPRAELQQRHLFDDVVRAHAQAGTTALFLVDALRYEMATALRAAVVNIDGTAATSVRLDARFAELPTVTEVGMNALAPVSERGRLTPKIANGTFQGFSAGEFQVKDPETRRRAMGARVGGSTCPLLSLSEVLARDARSLKHSVAQARLVVVHSLEIDQAGEHGTGLAAFEDALHALRNAWQLLRDAGIKRFVFTADHGFLLLDSGAGSGGAPAAQAHGRKIDPKRRHVISSVAADHSGETRAPLSALGYDGSELHAMFPRTCAPFDTGARARDFVHGGNSLQERVIPVLSVVHRSDAGGTTLRYRVEVTDRDKPLGDLGGVHRLRAGVRVAGQSALDFGAAGEIELALRAREPADVSAELVSVSGGARIEGGRLLAKVGEDFELHFRLSGNTEARALVELHHPGRSAELEPGGPARRFSVTPAVKQRQADAEPTSAAAASEAARAPAASWLAQLPAGVREVFAHIEAHGVCVENEAIALLGGARKLRRFSAEFEKHAALAPFGVRIDTVGGIKRYVKEGTRT

SEQ ID NO: 1846 - protein, 613 aa, Acetohalobium arabaticum
MEYSWYNAILDKIKSIEADIILVIDSEELLKSQGLQEKLKDLYSTVELYQSELLLRRNLKQEQEAIIIFESGNDIPYFLLDKYPEVEVSYRDIFPQLAEEVLDWLEEKEIEELYLYYQTNDFFTQLDSRETLEFVIKTLYEVALNGNQIENIVAFLIKYFFVKSEITGAINELVGEKLVSSNYTVNINQIRERDDFFIWLEGKWKEFLINERAEIDFSDPKLRYLIDDCFEQGLMQPVDLSNEDIDLETVINEGRANYWVRSGIQNLNRLSVKQELKIEREKLEELLTGNLSIREWGIAAKIWGKISYLAYTEEMYESFISLQKRLDEKFINFVEEEYDRLVFDHRFQYAPLNNRILPHIVEEEPDKFALICFDGMSFKDWRVVKQYLTTNLDSVSLKEKFSLAMIPTVTSYSRQAIFSGELPRNNDDKYQEEKGLTQYLMNELDINKEEIYFDNCEVPTEINLLGYKAVGLIYRFIDKSAHNSLNPKLHYKSLTDILESSELAKVIMKLITNNFKIYFTSDHGNLFCKGNGVHPSRHLVDDRANRAAVYQHENLAKEIEVSNKLILNFPNIIGDDYIVTMRDRKKFGNKRPALTHGGPNIEEVIIPLIEVSK

SEQ ID NO: 1847 - protein, 677 aa, Acidothermus cellulolyticus
MGSWRDQILSEFTPQVARLTLVADPDGLLLEEGVLEGIRERGFELIPFEDHVAFRYAYESKFRSRWDRREETDLVVVLRSPSSDLDALPYDLLQAGRKLSFNLGDLFPNLSYPVVAVLDRADLDVLFDAQLRHAPGPLGDNATKEFVLRHVFEIAPELIKQPSDLLRVLLRRHYRGQRIPHILDERFIQVLRQNGLFEDWPLEAIIPDEQAFFAFLQERWPVFLDSLANSNDDAVYAGAAVYGFKSPGPALLPFDHDDVRVYLDNLFFEGLLQPVLHEQAQTLAQSWAVCGVRISPEEDRLRRVRGLLDFIEKTLPTVDSRYAEWLEFAPRWSELVALTLDSDLPTRDAQASATLPPGYGERLEALKAQIDVTFTEWIVKRYASLINLPPLPPVMLHHIPPFLARNLDNAHDAKVALLLMDGLALDQWVVLRRVLEESDATLRFRDNVVFAWIPTITSVSRQATFAGKPPIYFPTSILTTTKESELWTQFWVGEGLTKHEVGYMKGLGDGSLDGLAELLSRPRLRVVGLVINKVDRIMHGMELGSAGMHNQVRLWARQGFMCDLLRLLHDRGFQVYLTSDHGNIESEGIGEPSEGSVAKEAGERVRVYSDLKLRAQVKERFRGAVEWPPFGLPEDYLALIAPNRAAFVQRGKTRVAHGGISVEELLVPFVEIERQDR

SEQ ID NO: 1848 - protein, 664 aa, Anaerobaculum mobile
MASWRDIILSEFQPQIARLTLVADPDDLLLEEGIFEEMRARGFDLIPFDDNVAFRYIYESKFRSRWDNGEETGSMAVLRLTSNELDLLPYDLLQAGRRVSISLADIFPNLSYPVVATLDFIYLDALFQAQDKFSPGRLGDNVTKSFILRYVFEIIPEFIKEPKDLLLVLLRRHYLGMRIPPIVDEYLIQFLQQNEMFKDWPLDIIVSDRQAFFAFLQERWPIFLNTLALKGNEVCEDPSRYGLRFSGPALLPFDHEEIRVYIDDLFLEGLLHPVPCREAQLPKEHWMKFGVTIDPEESYYRRIVGLMDSVEENLKDNMRHEMWLHFAYKWAELLALEFTSDFGLPDTCKERMDALKSKIDGMFQDWILKRYASLINLSPASPVMLHHIPRFLARNLAGDKRTKIALLLIDGLALDQWITLRNVLKELDSRLQFRESAVFAWIPTLTSVSRQAAFAGKPPMFFPTNIRTTDRESNLWAQFWAEQGLSTNDTAYIRGLGNEISNKHYEVLKQDRLRIAGLVVDKIDRIMHGMELGTAGMHNQIWQWTKQGFMRDLLSILIDNDFKVYITSDHGNIEAKGIGCPNEGVTAELRGERVRIYSDLSLRTKCKMSFPDSLEWPSIGLPEDYYALIAPSRAAFIRKDDVIVSHGGISIEEVIAPFIEVERA

SEQ ID NO: 1849 - protein, 494 aa, Bacteroides vulgatus
MDSFIQRIIDSITSETHLISVVNNPDGFLSRPDTQEKILKESGLLLLPIESSIELRVRFELSDKNSGNKVCYIYDDVESILPDIMMHIYVAPTFKISKLLPACNEIVLLKAKNLTFNIASYIYKKKFTNTLTAQETIKLLEETDSIYGTDEETLKKELTRIPLKWEKVETIEKISYLLLSAIKNNLYDNIVSVLETINEDFQKFIDSKYASMINSSAIQRPKMVHKILPNILHQHSRTDKVALVVIDGMSYWQYLLLKRELSFLEIGTDDNQILSWIPSITKLSRQAIFRGESPVIEYNQSPKSESSLWIDFWTSSKQKAAKRLQTYEVGYIHGSLCLDNMQYRRIALVDTDLDEKMHSSSSNKELYLLTENWAHDTAKDIKELHENGYHIYITTDHGNVYTSPWRNLTSQEKTFLFEKESRGKRHLIYSKKEYLDRFISSNNDIENQLLSTEKWTNNSAVWRNLYSFNNNECITHGGSHFLEVVIPFITIKKK

SEQ ID NO: 1850 - protein, 623 aa, Caldicellulosiruptor kristjanssonii
MIEDAIWEKINSSLYDFLLVYDFDKLLFNFNVISKIFDEGYEVFIYKDIEEYRIFYETKIRDMNKKVVLIVTEKVYLPWDVKQDYHEVWIRLKDLFFNLDVDVIKQIDVEYFDVIYQKMKSLNRVLNYEETCNFILRYIYNIDISVINNLQDLIKQLLRLYFKGTELPQVLSDFIKNKLVFLPPEVSCILNSKGEFFKFFQTEFDKFVGKDKYDKMDGEDYIDFLDPEIRVYLDDLIMDNIIKLTKPTELNNSLPIKQLGLVFNLKSQEEEYKHLRNRLKKLLCEIKNYKDWFEVAEIFGRIINLCCILNDDEYETLSHEINVKFKDWLFKNYGKLPYLSYSNGPIMVHHIQPYIINLLKKENKNKVAFILVDGMSEFNWTIIKEYLENMDLRIEKKSCFAWIPTITSISRQSIFSAEPPLRFKTTMFSTNYDEKHFKRFFMNSGYKEKEIAYIRSIKTFEEENLRRALEEDCKVLCVVVDVIDEFVHGQIFNYKGLQNQINFYMSEGYLQKFLEELFKENYEVFIASDHGNVLTVGQGNVKEGVYIDTLSNRVKIYPKDIPIESPTGIKIIKWGGIGLPDEYNYVVSDDNLSFHDKGKTILTHGGISIEEIIVPFVRIMPSL

SEQ ID NO: 1851 - protein, 677 aa, Chloroflexus aggregans
MTHHAPPTPHTESSWRSLILREFTPKVARLTLVADPDGLLLEEGVLDGIRSQGFELIPFDDHIAFRYVYEAKFRSRWDRGEDTDLVVVLRSPSSDLTTLPYDLLQAGRKLSFNLGDLFPKLSYPVVAALDKTWFDTLFEAQAKYAQEQLGDTATKAFVLRHVFEIAPELIKQPSDLLHILLRRHYRRQRIPAILDEHLLQELRQTSLFADWPLEAIIPDAQAFFAFLQERWPVFLDRFAAEMPGEQMHVRERAPAYELPALHLPFDHPDVRIYIDNLFLEGILQPVAHDQSHELAKTWVKYGIKISPAEDRLRRVKGLLASCETSLPNEKANYREWIHFAQQWAQLNALITEGELQAETDAKIRQFTNGVDAQFLAWVKQHYGNLFNLPATDPVMLHHLPRYFAHSLPPKSKLAFLLVDGLSLDQWITLREVLHEQEPTLLFRERAVFAWIPTITSVSRQAAFAGQPPIYFSESIHTTHKEPELWTTFWEKQELSKAEVAYLKGLGNGQGDVQKIDELIAQPKLRVVGLVINKVDDIMHGMQLGSAGMHNQIRQWARQGFMRDLITLLLGKGFHIYLASDHGNIEASGVGRPSEGVVAEVRGERVRVYSDFRLRQQTEAVFPGSLAWGSVGLPANYFVLIAPNRAAFVPKNEIIVSHGGISVEELIVPFVQIERRSQ

SEQ ID NO: 1852 - protein, 664 aa, Desulfovibrio aespoeensis
MSSWRDAILNDFVPNVSKLTLVADPDCLLTEEKLALELRGRGFDLIEFSDPVEFRYAYESKYRSIWDRGEHTDLVVVLRLQNAELESLPYDLLQAGRKLSFNLGDLFPNLSYPVIEKLDRSLLDALFEAQRKSPPDRMGDNATKDFILRHVFGIAAELIANEVELLRALLRLHYGKLQIPLMLAERLIQVLKGHDGFKAWPLSEIVPDDEAFFAFLQERWPLFLSRLGSANQVREDSPEYGLKYPGPDRLPFDHQDIKVYIDNLFLEGKLTPVEAKGIEVDAGSWVRSGIATSGVDNDALRISHLFDLVEKELPTAEARYSDWTAFALKWAELSSLVHCGNSTEYQTRLREIGDALNTTFAGWLTDHYSSLINLPPTNPAMLHHVPRRLARDIEDSGSSRAALIVVDGLALDQWVTIRQLLQKQDANLVMRESATFAWIPTLTSVSRQSIFSGKPPLYFPSSINSTNSEEKLWKQFWEGHGLSRLDVAYQRGLGDGDAAGVLDSAIHPGKTKVVGLVVDKVDKIMHGMQLGSAGMHNQIKQWCQGGFLAALVGQLLEYGYEVWLTADHGNIQCEGKGRPSEGVIAETRGERVRVYPTPELRAQVAGALPFAHEWQPVGLPADYFPLVAGGRDAFVNPGDAIVGHGGVAIEEVIVPLVKFERRTR

SEQ ID NO: 1853 - protein, 666 aa, Dichelobacter nodosus
MSSWRDAILNDFVPNVSKLTLVADPDCLLTEEKLALELRGRGFDLIEFSDPVEFRYAYESKYLSIWDRGEHTDLVVVLRLQDAELESLPYDLLQAGRKLSFNLGDLFPNLSYPVIEKLDRSLLDSLFEAQRKSPSDRMGDNATKDFILRHVFGIAAELIGGEVELLRALLRLHYGKLQIPQMLAEQLIQVLKGHDGLKAWPLSEIVPDDEAFFAFLQERWPLFLSRLGSAHQVREDSPEYGLKYPGPDRLPFDHQDIKVYIDNLFLEGKLTPVEAKGIEVDAGSWVRSGITTSGVDDDELRISRLFGLIEKELPTAEARYSNSNWTAFALKWAELSSLVHCGNSTEYQTRLREIGDALNTIFAAWLADHYSSLINLPPTNPAMLHHVPRRLARDIEDSGSSRAALIVVDGLALDQWVTIRQLLQKQDANLVMRESATFAWIPTLTSVSRQSIFSGKPPLYFPSSINSTNSEEKLWKQFWEGHGLSRLDVAYQRGLGDGDAAGVLDSAIHPGKTKVVGLVVDKVDKIMHGMQLGSAGMHNQIKQWCHAGFLSAMVGQLLDYGYEVWLTADHGNIQCEGKGRPSEGVIAETRGERVRVYPTPELRAQVAGAFPFAHEWQPVGLPADYFPLVAGGRDAFVNPGDSIVGHGGVAIEEVIVPLVKFERRTR

SEQ ID NO: 1854 - protein, 451 aa, Methanocaldococcus sp.
MRLYLWVKDRLDPGRPNLILDPDFSVSYDIIDKLKNEGYIIEDLRDKPIQQQKKRIIEIYSKHSKFSGIILISSVKESKIYSIIKNSGRINTLSNFPTSTKINLNEIHSYIDKISSDINSVFRWIKLAKTIGNLKYQAKDIESRKSINLFLERVVDPKFFDFVFNSYNKLFTYGSKFLTINKAIDYIISLVKNNSTEKVLLVVIDCMAWDDYFSIKDFFEKTCDRAIFAMIPTLTFYSRISLCSGLIPRNFDNLTINDEKKLFYQKISNELGKELGIYIKNNIEELKNAISQDNHKMICFIYSKFDEVIHSEDVNKNHAYHKLQELFKRDLYDIIKTAKDLGWRVFITSDHGNIETFEKGFHLPKYLDYEGKRCGRVDDLNLIDESIKNQLIIVEGKKFRHLNNNDIFIFPKKRIPLSKESYSITHGGITIEELIIPFVEVLEVKKIVNRS

SEQ ID NO: 1855 - protein, 666 aa, Methanosalsum zhilinae
MSPCTWRDSILNEFVPNISKVIIVIDPDDLLTEEKLSLELKNRGFDLIDFKDSVEFRYAYESGYRTLWDQGQQTKQTVVIRVCNSQWDALPYDLLKAGRILKFTLGNIFPNLSYSIIEKLDSSFLDELFAAQNKYSPRKLGNNDTKDFVIQYVFGIVPYLITNDVELLRTLLRIHYNKLKLPPILSGRLVQILKGNSRFNDWPLEIIVSDDGAFFAFLQERWPPFLDVLAHGNHIIKETSAYNLKYGGPTTLPFDHEDIRVYIDNLFVEGKLIPVQKSGTNIETNPWIKSGVSETNDNDPNIRINGLLEIIENEIPVPESLYSEWIDFAMKWAELRALIHTTNQVNELERFKQISTLVNNKFTNWMLERYAGLINLPPTNPAMLHHVPRRMVRELESEKNMSLALVVVDGLSLDQWVTIKKVLHEQDPNLVMKESATFAWIPTLTSVSRQAVFSGRTPISYPKSINTTNNEGNLWRQFWEDNGVSRQKIAYQRSLGDGNVCEILDDSFNLNQTKVIGLVVDKVDKIMHGMQLGASGMHNQIKQWCEGGFLFSLIEYLLDNNYQVWLTSDHGNIECNGKGRSFEGSIAENRGERARIYPTLELRDSVAKTLPFAIKWNPIGLPPGYFPLVTEGDDAFVKEGETIVGHGGISMEEVIVPLVKFEKRSR

SEQ ID NO: 1856 - protein, 668 aa, Methylacidiphilum infernorum
MSSWRDQILSEFTPQVARLTLIADPDRLLLEEGILAGIRERGFELIPFEDHVAFRYAYESKFRSRWDRGEETDLVVVLRLESHDLNELPYDLLQAGRKLSFSLSDLFPTLDSSVVAALDRADLDALFDAQTKHAPGQLGVNATKDFVLRHVFGIAPELIKEPQDLLQVLLRRHYRGQRIPAILDERFIQVLRQNSLFEDWPLEDIIPEAKAFFAFLQERWPVFLDSYAKPKDDAVHEDAADYGFKFPGPPLLPFGHDDVRIYINNLFLEGLLQPVPHEQSQALAKTWVAYGIKVSPEENRRRRMEGLLDSIEKKIPTVEARHEEWLQFAYPWAELVSLEMQPDTTLQEEYRERLEGLRSRIDSALKDWVLKHYASLVNLPPVPPVMLHHIPRFLARRLADDRNSKIAFLLMDGLALDQWIALREVLKELDSKLLFDEKAVFAWIPTITSVSRQAAFAGKAPIYFPASIHTTEKEQELWTQFWIDQGLTQHEVTYAKGLGDGDLDKVSECLARPRLRVIGLVIGKVDRIMHGMELGAAGMHNQVRQWARQGFMWKLLGLLQTQGFQIYLASDHGNIESKGVGRPSEGAIADHRGVRVRIYSDPRLRDQVKERFPKSLEWSSVGLPEDYLALIAPNRAAFVPAGKTLVGHGGISVEELLVPFVQIYRRDG

SEQ ID NO: 1857 - protein, 512 aa, Moorella thermoacetica
MMSEKWYAKLVNKIKRSYHDVVVVVDHDRLGRLPELRAALADTFALHDYKGELPLRRFLREHTGQRMLIFKHPEHGHLPYDVETRSDVISWHLQEIFPKLHPAALEGLSEEDYQRVFEAYVQKENTFQVLGLEETKEVLAGWLGTSMVGGFVPDIVARPSQEGEGGIKCRCQALVREIEGLLSRRPVDWRAVAPLWGELSYCYCQARSKPPEIDALDQKISGAFTEYILTSYHELFYESYLTRPATVDKVLPFLAYQPAAKKVLICMDGMGFQEWCCLKQYLAGRGIDSFSVTAVFTLLPTLTRVSRRALFCGRPALGDRVEEERGFLQFVREKWLEGERRQAGVFMNIDGRWRHEYLDFDYLALACNLVDDLAHASVSVQDSKELMQKSLIMHLDGSGFAETMQRLLEEGYRVYLVADHGSVWCRGNGHQASKWLLEEKARRALLFPNKLLAEDFAAGKNLIVYENSSLFGDAVAVFPPGREMFGPKGETVISHGGIHIEEVIVPFIEVQA

SEQ ID NO: 1858 - protein, 664 aa, Nitrosococcus oceani
MSSWRDAILNDFVPNVSKLTLVADPDCLMTEEKLALELRGRGFDLIEFSDPVEFRYVYESKYRSIWDRGEHTDLVVVLRLQDAELESLPYDLLQVGRKLSFNLGELFPYLSYPVIEKLDRALLDVLFEAQRKTPSDRLGDNATKDFILRHVFGIAPELIVSEVELLRLLLRLHYGKVQLPRILSDRLVQVLKGQGAFPTWPLDEIVPDEEAFFAFIQERWPVFLSKLEPGNEVRERSLEEILNYPGPSVLPFDHQDIRVYMDNLFIEGKLTPIQKPEVAIDAGSWIRCGVIEASAGDDEMRISRLFGLVEKSLPTSESRYSDWITFALKWAELSALVHCGSNREDKARLLQTDNALNATFARWLSVHYASLINLPPNNPAMVHHVPRRLARDLENAKNSRVALLVVDGLALDQWATIRPILQERDRSLIMRESATFAWIPTLTSVSRQAIFSGKPPLYFPSSIKSTHKEEKLWKQFWEGHGLSRLDVAYQRGLGDGDAAGVLDSAIHPGKTKVVGLVVDKVDKIMHGMQLGSAGMHNQIKQWCRGGFLGLLIGYLLDHGYEVWMTSDHGNIECQGKGRPSEGVTAETRGERVRVYPTAELRAQVASKFSFAHEWLPVGLPSDYFPLVAGGSNAFATPDEAIVGHGGITLEEVIVPLVKFERKTR

SEQ ID NO: 1859 - protein, 664 aa, Nitrosococcus watsonii
MSSWRDAILNDFVPNVSKLTLVADPDCLLTEEKLALELRGRGFDLIEFSDPVEFRYAYESKYRSIWDRGEHTDLVVALRLQNAELESLPYDLLQAGRKLSFNLGNLFPDLSYPVIEKLDRSLLDSLFKAQRKSPPDRMGDNATKDFILRHVFGIAPELMVSEVELLRSLLRLHYGKVQLPRILSDRLVQVLKGQGAFLTWPLDEIMPDEEAFFAFLQERWPVFLSKLDAGNEVRERSLKEILNYPGPSVLPFDHQDIRVYMGNLFIEGKLTPIQKPEVAIDAGSWIRCGVIEASAGDDEMRISRLFGLVEKGLPTSESRYSDWITFALKWAELSALVHCGSNREDKARLLQTGNALNATFARWLSIHYASLINLPPNNPAMVHHVPRRLARDLENAKNSRVALLVVDGLALDQWATIRPILQERDRSLIMRESAAFAWIPTLTSVSRQAIFSGKPPLYFPSSIKSTHNEEKLWKQFWEGVGFSRLDIAYQRGLGDGDAAGVLDSAIHPGKTKVVGLVVDKVDKIMHGMQLGSAGMHNQIKQWCRGGFLGSLIGYLLDHGYEVWMTSDHGNIECQGKGRPSEGVTAETRGERVRVYPTAELRAQVASKFSFAHEWLPVGLPSDYFPLVAGGSNAFATPNEAIVGHGGIALEEVIVPLVKFERKTR

SEQ ID NO: 1860 - protein, 678 aa, Parvibaculum lavamentivorans
MSQWHQRILGSFTADLSRLWVACDPDGVLLDEKLLAELRARGFEVMGYDDPFGFRAEYEERYRAAWDGNEQPPSPALIVHLRHDNANDLPWDIVHNARPAVRLNLAELFPKLAYSAVRQVEPERLEILFDAHQTELQSARGESESKDFILEHVYQLTPRSIRAPVDFWREVLRLHFAGRALPEPFAEHVAAILRGRGLLVGHAVAEWLSSRSALLRVVQDAWYLYLEKLKLEGRRMSDPDPPPFGVGEIGTAIEIPFDHTDVRTIVDSLFLDGSLHPLAVSDVPTAVPGWIKAGIVEDVWSQFALAEKGIEALATAVPEADAPHKFWGDFARRYGEMLSRVHELPGKDAGERMVAIRERFKAIQALTDERLQAWIAAGHYADLILQPTIKGPVMVHHVPRFLRQRRSAGEAKVALLVFDGLAFDQWVQIREHLIANQQPLAFDESTAFAWLPTVTSVSRQALFSGLRPREFDDSIDHTNKEEALWKAFWQNEGGIASSEVIYQRALHQVEQLDALEADIASRKPKVLGLVIDEVDERLHKERSKEDVALWIGRWLGSGFVERLFSFLLSEGFSIYVTADHGNVDAVGIGRPNQGVIAETRGERVRVYRSDPLRAESAMAYPGTVALDIAGLPANFKPLFAGGRTAFVPNGDQVVVHGGVSVEELVVPFVRVSDVNGAG

SEQ ID NO: 1861 - protein, 678 aa, Parvibaculum lavamentivorans; identical to SEQ ID NO: 1860

SEQ ID NO: 1862 - protein, 649 aa, Planctomyces brasiliensis
MADWRDSILKEFKRDISRLTLVSDPDGLLTEERTLATIKERGFDLIPFEDSIAFRYAYESKYRTIWDEGKKTDLVVVLRSEGDLESLPSDLYHAGRPLEFSLHKLFPNLNYPVLRALDSSHLDALFEAYQQQQGSVLAENGTKEFILTHCFRIVPRLISTPVALLKELLSMHSRGASIPDMLIDHLLSSLEGKSEFKDWPLREIVSNREALHRFLQEQWPVYLKSLTGGPAGLVPFDHQDVRAYVDTLFLEGQLKPVAVKDSESLPTWAQIGVKHDPQADALKRLKGLIDLCEKSLPSTDAPHKDWQKFARTWAESVVLRWQLDASVSSTDQQSWSDLHESIEDRFAEWMLSRFASLHSLPYRPEPVMVHRIPDYLAWVRAENNLSKVALVVADGLALDQWLLLRRCLDEKQVSWRFVEETAIFAWVPTLTSVSRQSIFSGLIPHLYSDSLYDTSREPKHWEKFWEDEGVSRDAIEYAKMVESGQSENLDLCLQNPHLNVLGIVVNTVDKIMHGEHQGTVGMHDAILRWADDAISVVDRLLDEGFEVFLTADHGNVAAAGMGLPREGVLVEVGGKRARIYESANVREEAKSEYPESIEWPNIGLPPECHVLLPKGLRAFTPEGKRVVSHGGIALEEVVVPFVWIAKDEV

SEQ ID NO: 1863 - protein, 649 aa, Syntrophothermus lipocalidus
MNWRDHILKNLQPGVSRLTLAADPDGLLLEEDILSALGEMGFDVLVFSDPITFRYVYEVNYRSRWDRGEAAHLIVVVKGGPQELRRLPFDVWQRGHKLFFSLADIFPKLSYPVVAAVEKSDLDKLYSAYQNYNGPTLGEKATKDFILKHVFGIIPDLINSPVELMKILLSRHCNFVTVPSVLDEHLIHCLREKSVFKNWPLEDIIPRREAFFAFLQEKWRRFLESTAKGENFTEVPFEHYDIRVYIDNLFLEGSLRPVPVASTEGMPAWVLAGVLLDKQANERRRIKWLLEKIRQDLPGETASHRDWQRLAVLWAELLVLSRELNQDIEAESKLKIEELHDQLEERFASWMLVRYGSLANLPYTSRPVMVHHIPRYLAHLRLKEGAKKIALIVTDGLALDQWLVIRNFLRDRYPARRIEENQVFAWVPTLTSISRQALFAAEPPLYFKDTLTTTSKEEQHWHKFWEDSGVRRGNTYYHKGLGDESVSEIGEFLGSQFEIVGLVIDKVDRIMHGMELGTAGMHQQVRLWAEQGYLIQLIDYLLKNKFAVYLTSDHGNITARGIGRLPDGVLAETRGERARIYHYDVFRQQMMEEIENAICWPGFGLPQGYSVLLARGRSAFVSNGEEIVSHGGISLEEVVVPFVRIWEEH

SEQ ID NO: 1864 - protein, 639 aa, Tepidanaerobacter acetatoxydans
MKSAVIAKLKQSPIPFILLYDIDDITSSEDILTSITSQGFQLVNYDDSIAFRYFFEKNFREKPDCNVKLVLKVTGYHNYMPYDIESSFYNITLSLKELFPGLSYSILKELDSELYNRLYRVYKYMGQNLSQRETLDFILKNLFGIYPETINKFTDLIKALIDFYYENDSLPQVVSDYLADLLMCKEDFKEYPVKKLLEGADSFFDYLQGQWEIFVKGLTSTLPIKSAVDFSHKDIKIYLGSLFDEGYLTPVRSDNIDNVPLWVHRGILIDELGQLRAIYNNLLDRLYDTLDNITSYKDWLQAAKDWAEILVIYNDERIQGRLDEKAFISISDMLNSRFRTWLFDNYNLLPSLSYARAPVMVHHIPWYINYRMGKDATQKAALIVVDGMALDDWLIISRYLNRNSSCRFEEKFCFAWIPTITSISRQAIFSGQIPRYFGKTIFSTSEDERHWKKFWAERGIRPDAIYYMRGIKHFNENGLRDIVENPKSKMLGLVVNMIDDMVHGQQMLRAGLHQNLRLWMEKEGFKKFLQTLLERNFDVYITSDHGHVSSVGQGNLREGLAVDRAADRVRIYEQGKNYETALKRYKAYKWAGYGLPEEYNYIISDGCYSYGKDNEKNLTHGGISIEEVIVPFIHIRKEE

SEQ ID NO: 1865 - protein, 639 aa, Tepidanaerobacter acetatoxydans; identical to SEQ ID NO: 1864

SEQ ID NO: 1866 - protein, 668 aa, Thermanaerovibrio acidaminovorans
MGSWRDQILSEFTPQVARLTLVADPDGLLLEEGVLEGIRERGFELIPFEDHVAFRYAYESKFRSRWDRGEKTDLVVVLRSPSSDLDALPYDLLQAGRKLSFNLGDLFPNLSYPVVAALDRADLDALFDAQAKHAPGQLGDNATKEFVLRHVFEIAPELIKQPSDLLRVLLRRHYRGMRIPAILDERFIQVLRQNGLFEDWPLEVIIPDAQAFFAFLQERWPVFLDSLAKPKDDAVHEDAADYGFEFPGPTLLPFDHHDVRIYIDNLFLEGLLQPVPHEQSQALAKTWVAYGIKVSPVENRRRRMEGLLVAIEKTIPTVEARHGEWLHFAYRWAELVALELEPDTTLPEEYRERLEALRSRIDSALTDWVVKRYASLINLPPAPPVMLHHIPRFLARSLGDDRRTKIAFLLVDGLALDQWIALRDVLGELDSKLRFRENAVFAWIPTITSVSRQAAFAGKPPIYFPASIHTTDKEPGLWTQFWVDQGLTQHEVAYAKGLGDGDLDEVSELLSRPRLRVVGLVIDKVDRIMHGMELGAAGMHNQVRQWARQGFMRDLLGLLHDRGFQVYLASDHGNIEAKGVGRPAEGAVADLRGERVRVYSDPRLRAQIKERFPESLEWPSVGLPEDYLALIAPNRAAFVRAAETLVGHGGISVEELLVPLVQIDRRDR

SEQ ID NO: 1867 - protein, 640 aa, Thermoanaerobacter brockii
MIKDYIRDKLSLEGSNLILLEDKDDILNEESIIEMLHKDEYEVYNYQEPDSFRFYYELNYRKFYDSFVEPNKKFILKCKEINEIPYDIQTVFHHVSISLKEIFPKLDYAVLKELGTDFLGKIYEAYQLYDGNVLGENGTKDYVMKAVFGIIPEHINNLNELVKTFLRLYYKNMELPKVLSDYLEYKLKQKENLKDVPLNEILSGKDRFFRFVRVQWKNYINDLIEGTHNAKIDFSDYDIRAYLDNIFYEKYIEPIEVENIERLPKWTYVGILYDENERYLKEYRKMIEKIKELLSFSKSYRDWMNLSSLWAEVLNIFYSKKLALNENEFNEISKLIENSFMEWVVLNYSNLTSISYVNGPVMVHQIPWYLNYIMKKQKYDRIALLVFDGMSVDNWYLIRRYLNKNALWNIEEKKSFAWIPTLTSISRQAIFSGDIPLYFKDTIFSTNYEEKRWKKFWMNQGYKGDDVFYIKNVMEFNKREINDIINNRNAKIVGIVVNIIDELIHSAILSIEGLYQNIQLWLEKSRMEDFLKKLISKGYEIFIASDHGNIASIGKGKLNEGLLVEKAGERVRIYESGIDYGRSLYDDKSFKWIGFGLPKEYNFIICKENNAFGAQGEQMISHGGISIEEVIVPFVHISHI

SEQ ID NO: 1868 - protein, 640 aa, Thermoanaerobacter italicus
MIKDYIRDKLSLEGSNLILLEDKDDILNEESIIEMLHKDEYEVYNYQEPDSFRFYYELNYRKFYDSFVEPNKKFILKCKEINEIPYDIQTVFHHVSISLKEIFPKLDYAVLKELGTDFLGKIYEAYQLYDGNVLGENGTKDYVMKAVFGIIPEHINNLNELVKAFLRLYYKNMELPKVLSDYLEYKLRQKENLKDVPLNEILSGKDRFFRFVRVQWKNYINDLIEGTHNAKIDFSDYDIRAYLDNIFYEKYIEPIEMENIERLPKWTYVGILYDENERYLKEYRKIIEKIKELLSFSKSYKDWMNLSSLWAEVLNIFYSKKLALNENEFNEISKLIENSFMEWVVLYYSNLTSISYVNGPVMVHQIPWYLNYIMKKQKYNRIALLVFDGMSVDNWYLIRRYLNKNALWNIEEKKSFAWIPTLTSISRQAIFSGDIPLYFKDTIFSTNYEEKRWKKFWMNQGYKGDDVFYIKNVMEFNKREINDIINNRNAKIVGIVVNIIDELIHSAILSIEGLYQNIQLWLEKSRMEDFLKKLISKGFEIFIASDHGNVASIGKGKLNEGLLVEKAGERVRIYESGIDYGRSLYDDKSFKWIGFGLPKEYNFIICKENNAFGAQGEQMISHGGISIEEVIVPFVHISHI

SEQ ID NO: 1869 - protein, 640 aa, Thermoanaerobacter pseudethanolicus; identical to SEQ ID NO: 1867

SEQ ID NO: 1870 - protein, 646 aa, Thermoanaerobacterium saccharolyticum
MMINYIVSKLNRCDNNVILVFDEDNILSNSDIISMLKENGYDIYDFKDPDLFRYYFESKFKIAPSGKLKSGVKLLIRYDGKITIPYDIKMSSSNIAITLTELFPKLNYTVLKEMHPDILKKLYSIYSYYTGKQLSEAETKEYILKNIYGIVPEVINNYIDLIKTFVNIYYKGIELPEIIFDYFIEKLNSKDYFKKIKNKEVFYTKDNFFAYLGDEWKTYLNDLLNKTSNATIDFGNNDIKVYIDNLFYEKYIDPVVIHNIDALPKWTHAGIIYDENLRRKRELENILSSVKEKIDKAKSYRDWQNISELWGESLYIFYSGDRSNHEFQDVQKEIEDRFRKWLINEYSYLSSASYVNGPVMLHHVPWYINYKMKKDGFDKVALLVFDGMSLDDWHIIKDYLKEKGYWHIESTTSFAWIPTLTSISRQSIFAGEIPVYFKDTLMTTNYEERQWKRFWMNQGLYLDNVFYMRSVIDFKDSRLNDIINNRKAKILGFVVDIVDKLIHRQILSVDGLYQDLKLWLKNSDFNLFLDSLAKNGYEIFITSDHGNVYSIGNGRLNEGSIVEIAGERVRIYERGLNYDKALNNNNAFVWTGFGLPDDYSFILSNGNNAFVDNDRRIITHGGASIEEVIVPFIRVRKEEHNAKSGL

SEQ ID NO: 1871 - protein, 646 aa, Thermoanaerobacterium thermosaccharolyticum
MMINYIVSKLNRCDNNVILVFDEDNILSNSDIISMLKENGYDIYDFKDPDLFRYYFESKFKIAPSGKLKSGVKLLIRYDGKITIPYDIKMSSSNIAITLTELFPKLNYTVLKEMHPDILEKLYSIYSYYTGKQLSEAETKEYILKNIYGIVPEVINNYNDLIKTFVNIYYKGIELPEIIFDYFIERLNSKDYFKKIKNKEVFYTKDNFFAYLGDEWKTYLNDLLNKTSNAAIDFGNNDIKVYIDNLFYEKYIDPVVIDNIDALPKWTHAGIIYDENLRRKRELENILSSVKEKIDKAKSYRDWQNISELWGESLYIFYSGDRSNHEFQDVQKEIEDRFRKWLINEYSYLSSASYVNGPVMLHHVPWYINYKMKKDGFDKVALLVFDGMSLDDWHIIKDYLKEKGYWQIESTTSFAWIPTLTSISRQSIFSGEIPVYFKDTLMTTNYEERQWKRFWMNQGLYLDNVFYMRSVIDFKDSRLNDIINNRKAKILGFVVDIVDKLIHRQILSVEGLYQDLKLWLKNSDFNLFLDSLAKNGYEIFITSDHGNIYSIGNGRLNEGSIVEIAGERVRVYERGLNYDKALNNNNAFVWTGFGLPDDYSFILSNGNNAFVDNDRRIITHGGASIEEVIVPFIHVRKEEHNAKSGL

SEQ ID NO: 1872 - protein, 646 aa, Thermoanaerobacterium xylanolyticum
MMINYIVSKLNRCDNNVILVFDEDNILSNSDIISTLKENGYDIYDFKDPDLFRYYFESKFKIAPSGKLKSGVKLLIRYDGKITIPYDIKMSSSNIAITLTELFPKLNYTVLKEMHPDILEKLYSIYSYYTGKQLSEAETKEYILKNIYGIVPEVINNYIDLIKTFVSIYYKGIELPEIIFDYFIERLNSKDYFKKIKNKEVFYTKDNFFAYLGNEWKTYLNDLLNKTSNAAINFGNNDIKVYIDNLFYEKYIDPVVIDNIDALPKWTHAGIIYDENLRRKRELENILSSVKEKIDKAKSYRDWQNISELWGESLYIFYSGDCSNHEFQDVQKEIEDRFRKWLTNEYSYLSSASYVNGPVMLHHVPWYINYKMKKDGFDKVALLVFDGMSLDDWHIIKDYLKEKRYWQIESTTLFAWIPTLTSISRQSIFSGEIPVYFKDTLMTTNYEERQWKRFWMNQGFYLDNVFYMRSVIDFKDSRLNDIINNRKAKILGFVVDIVDKLIHRQILSVEGLYQDLKLWLKNSDFNLFLDSLAKNGYEIFITSDHGNIYSVGNGRLNEGSIVEIAGERVRVYERGLNYDKALNNNNAFVWTGFGLPDDYSFILSNGNNAFVDNDRRIITHGGASIEEVIVPFIHVRKEEHNAKSGL

SEQ ID NO: 1873 - protein, 738 aa, Burkholderia thailandensis
MKVPAHQISFQAKQAHEADPLARFILLRLPLDAFDGTAVDVNAASWPVSTCSSPLAVRDAMRRYAASTTPVVLLFAGDESELGSDVLARCTKRRAITHDLWQTVLALFRAAHIDPRLARHRWLAELLVRYMPAEGYAPVRSLVLDQDRAWKELFKVVLGFESYPPTELDLLRWAGDAQRREQIKTLEDPARQETVQCLRETLGDLVDFIFAAIDTGSADELVAIAMLCEALEDKAIGSESNRAKVAARLEVLFDGLTISSHTIHQLAGAADAWFDRASEVAKQQQVARYESLVTQLKAEPLAAQARYGITALREKTKAFAAALNDINLPEAISRFGRLMAHRGPVLSSHSELRCKMALRLVSWLRKTVSTFPSSLNALSERYRNEIGWVDWAQTVLLEGDDSPDLANAYGLLREKTRIQRDLFDQRFAESLAADKPDGTTLIAIEDALDKCVAPVVVAGRCLLIVVDGMSVPVFLELHHSLKEHGWVQFERSEGACSTLLTMLPSTTEASRTSLLCGIACAGSASTERAAFSAYPALVAPSVAGKPPAIFHKRDLLDASGVALSDDLRTALSDTRQRVVAVVINAVDDHLMKSDQLRLRWDIAQFKGLDALLAEARSSERAVVFTSDHGHVLDQDTVMLGASPNARWREPSLESYPGEIALTGNRVKAASGMDEVVLAWNSKLRYATKRNGYHGGCAPAEALVPIATYRYGAKAFDGWSIRDEVAPDWWQVDRGGFRE

SEQ ID NO: 1874 - protein, 949 aa, Candidatus Accumulibacter
MNVLLNPSARQIVAQVDAVLRHDRTAAVIAIRAQHNEDWPSTLAVGDREFSVAWCPSPIAVRERLLALADGAMADAGQVSSESPGKLPGLVVLTPLSDHVLGADVLARFSRGKVFSVEAWDMLRHAFQAKAIDSRLARWSWVAEALLENLPAGGYPPVAGGVLDVDAAWSQVLRCVLGMTTEHAGRPDLASVLRWTLSPEATRRYGDLHEKARQQVGEWLIEILGSCGRLVAQVLEAGYGGELLPIALVCGMVLKRPDDTPLAPELLAAAVRLERYTGGTPIPQREGLRLHAAAVQVTKAMDASTLMPVLDVADQLVASLHLMAFAERSSDLSSGFSARLSIFANAITEFLATGSEKKPAARSAATAAVLVVGGSVKEHRLAVHQAHGVRRVEMAMRLVRWLSNAEPGQHIGLDSLAKSYADEGAFADWARLALMGSDDLAVVTRAYSALREAARARRESSNRQFALALSAWNQGGCPKLDHVVPVEQIIADVLAPVATLAPVLLLVVDGLSFPIYRELLEDAQRQGWNEVLPSAQEKASVGLATIPSITEISRTSLFCGKLLQGQAANEKTGFAQHPALIPLVPSNRPGARPVLFHKGDLTSASDGVALSEVVRDAIGSRERKLVAVVFNGVDDHLSGSAQLNHRWALDDLRLIKPLLYEARNAGRLVLITADHGHVIDEATHALANPAQDKAVASYSDPATGDRWRTVAGAPVSAEEIMLSGGRVMTPHGQRQIFVPWSETLRYGSRKNGYHGGISLQEMLVPITLLTTGSVLPEGLRHAPSAAPAWWELAAETSPASPGSQAQAKALSRKSRPPTPIAAGQQSLFELPALGVVQATAVEQDWIAALLESTAFLSQKQWVARAGVTDEEIRALLEALSERGGKVSKQALAARLGMPLLRVSGFVSAARRLLNVDQAPVLSLDEAEGTVGLNRALLETQFGGRTGRAQ

SEQ ID NO: 1875 - protein, 860 aa, Corallococcus coralloides
MSAAQLLLRRLLEQSGGASETGYLLVIDGEGLENLPDQMPTPKGSYGVHRISSELGLRHLLWKAKGAPLIAVMPEDVARRIQNAPDLLRRARNQRVHALSVNDVLEVVLGVRVVGADAPYMQQLALENVERLGFAMSHRTLPTVVDRRLLTELLVDVSVGEQVRTRSPAQLLAAWVQEPPRWSPNISQLVRDAMPSLHGDEGRLLAWALAEPEKRLRDLVVYGAVLTVEAAELPKPAWGPLWRAATEPPLEMDRRILRRTVARLAEETLALLGDAAGDLLAGADRVGRESLTPTQLQTSRVLPLAFSDRCHELAQQAASGKAISAADITWLSNHRAARMHRGDLAVLESMARISRYLNQPFSPKLDLLEQVRDYQRGGAFVDLAMMQLRRALASSVHYHAEANKLLAACRERRDRENRHFAETLSGGYEAALHREGLTPLHRLWKRTVAPVWQHEPDARLFLVVLDGCSYPVFLELLYALAQDSSFPLGIKPDASGLVAGLPALSPLPTITSHARGAIFLGELPNDPLISETVFRDQDEAKTDKARFNQNAALGSRNRRLFLKGDLTDGGQELLSALEDESLSVVGVVFNAVDDQIGSSNTGATVKISPEDITAFKPALRVALKAKRRVLITADHGHSLFVDKSLRSGNGKTPRYTALGKHEPVPEGFIEINIAGLGGPPERRAFAWRSGAYLGGSQVGFHGGCGLEEVVVPLAWLERDGLHADEPAWWYGRGALAEVTTEVKPVQPPIVTPLPSDEVPAKPKAQLSLFNPADKADSLPIPKELLAKLSLDEKSILVLLRETGSARASELAERLKKNPGRLNGLMRSLRRTLHEGGHVLFSDEVLPSGETMYRYQPKEGR

SEQ ID NO: 1876 - protein, 951 aa, Corynebacterium variabile
MSARLRIRQRDIDDQIDYLTGKNYREAVLVLQTGQGWDGPATWTRRDGHVAVTAVRTPLALRHALVQAHQQKPPVPWTVFLTPLGDADLPADVRDRLRPYHDVRVVDPTRSLLSTFSATGVLPRVIATGDIAETLTFLDTCGGTVVPAPAGRLSTDHLAAQLLSSGLDLVGAGVDAFGQFSLADILRWSASPVAADRWARFTDGLPEAVQTTTLDWLGRALGPDAAAALRHLRKHGPADLLSRGLAAEVLVVDPQATEAESAARQVATIAFKVTARTGTPTAAELAGWSTAAVAAVRASRQGTDNTHVGGLDRTVRQAEEIISSPDQLDAGALLHRSSVCPGGFAARIDRLAAALSASLSPAATDPTAAYDALDYARAHLDASDAARNRDIAGAEAALRLSQFLRTTDATGPTGAAGQPTTGLANWLHLQRTSRSWADLCVNTAWQGSASPALQQVTRQMADRARQVLTTGDRVFAAEASVAGASRDLAGTTLLVEDVLDRVVAPLLVGDGGLHPVLLLVLDGLSTAAANHLLTSVHGVYYGRWHNMVTEDEDLATALAMYPTVTTNSRASLLSGRTATGGQDVETRGLAEWYAATTKGLPGAGTPVLMHKGDLTLGVSDDHSTDKVSQQVEDTTAHPLVAAVLNTVDDALDKSDPIDRQWSVSDITHLNVLLQAAARSGRTVVMVSDHGHVVDRGRSSRDPRGGNSARWRYAETPVPERGHVVDGEVTVSGDRVLTDDHRAVLAVDEDLRYTARKAGYHGGLTLAEASIPVTVLSQEPEQLIARTAATLPLVDLDDDLRYPGWWELRPDAVSATGATDVVPAAAAPTPEDLGMLFDTTVDIAAPAPTTTLFAGLEKNPGFIQGVADARVLPLDADGVAEVLRKVAANNNRMTQTELNPMLGVSRIRLGGALTDLKRIVNVDGVPVFDTDGRDVVLNAEQLIQQFGLGTGR

SEQ ID NO: 1877 - protein, 893 aa, Frankia sp.
MTVVAAPVLVRAKVAEVLRRDEKARVVALAAAPVWPHDERLELPGGRGVVVRPCVSTLAIRDELQQVDDLPAGEVLVLLTEYETGELGTSITARLAGQKILPLDRWQQLTSLFRAHGIDPALVDEQWAVNALLATPPPDGYPAARNGYLDRATALATLAETQAGLTPLDLDLAGLLRWSLDAEHLARWRALDPAVRTGMSGWLAGRGGRGDVVAAVLRCFAGPYGPDAVAVGLVLAALSHPEVRDTAQVPRTMLETRVVDGALAPSVAAEWGRAAEGLVQRLLGQEGRAVAGGILRRAEEILAGQGAAELSYPSAVLESGLTQRLRHIGSQVAAVLRKRRLRAEDLGPVEHEVARLNAHALAADHAERVSRAEMAVRLLRWLAQEAASARPPAPSLAEASRRQQDQDAWVDLARARVWEGDVDQVVAAAYRTLCTTVDARRREHERRFANLLADHTRTGSTLGELLPVEDVLDQIVVPLAGRCRLLLLVLDGMSTGVARELLADLSTRGWVEHTLTPARPVLATLPSVTRTSRTSLLCGRLVDGTQSQEKASFAERGWPLFHKGDLAAAGAGEVLEPRVADAIRGDAPVVGIVVNTVDDTLDKGGRTPWTASSVDRLLDLLATADGSGRAVLLVSDHGHVHERGSRLVSDDSGGARWRSSARPPDEDEVTLIGPRVLLGGGRIVAAWNERLRYTALRNGYHGGASAQEIVIPLALLRRVDLDLPGWTPLHHAAPPWWVEPMATGTTPATGTTPATGTTPATGTTPATGTTPAGHAGSAAQPDLGLFDESEVTPQPWVDRVLDTEVMRARLARMRRGAMPADRLGVLLRALDARGGAATRATVARALDVPDARIASHLAAAQRVLNIDGYEVLRIDGDTVRLNAALLATQAGLT

SEQ ID NO: 1878 - protein, 1043 aa, Frankia sp.
MTVLSPTTSPASAGVPRVTPAVVLGRVARLRRSAASNHSSQPQVLLVRAQPDWPAPVDLAVAGRPVRVVPCVSPLAVLEEVTRWAREPVEDGWLVLLTDADEERLGDTVLAQVYRQRVDVIEPWAAVLEDFGATQADPRLHAPEYRWVAQALLEARPPAGWPRRPSGLISREDALAELAVVRLGLTEFGLGAADLDIATLLRWTAVPGAIEAFRRLGDDERAGITGYLGDRTGRAGRALFTLVAAGNGEQALALGLVCDCLWPRRDPDGSPLPGTGDAAAVERAKVRVERYFGDARLDEAAMRAFADATREVVATALTQSRSGAGRLGLDSGATSFTLHPDDELPALLDTAERLLDELDGRAAGAVSDILRAGFQHRLSLLATTVRDFLAAAESGVDRALLATAARDVVTAVVSLRAHSLANVQRAEVERALMAARVVGWLAVQPTGSLGDSQVGAARAGGDRPGKPTTLPAALDAHLDDSAWVDVALSHLAGGELAPAIGTAYGDLYRVAARRRRALDASFARLLADWAAGPSRPDGPLLVEEVLDRVVAPVITARGGGRALLVVLDGMSAAVAAQLAAELRRDRWEECDPLGVDWGDTAGEPAGAARRRAAVAVLPTVTATSRTSLLVGQLVTGDKTKEKAAFDGHPRWGRRPARLFHHSDLDGAPGAPLDQDLTEALTSETPLVAVVINTVDDTLDKGRQRDDGGWSLADVGKLRAVLAYARTAGRVVILTSDHGHVVDHRATGLAADDAVSARHRVPAAGIVAAGDGEVVLAGPRVLAPGGQIVALWDPALHYLGRKGGYHGGASPAEVTVPVLAFLPFRLSTTSASRDLPVGWRPLADQRPRWWSLETPDLLAGLGGGDTAVVSPRSSGSAADLAEGTALLPRKRRRAADEQTGPALFDLPQQTDGAGGPVAAPGAPDSGTVAAHAAPTEGQEGTVDVIVAGLLRSELFRSQLEGLARKVPAEKVEAAVRALLNANGTLATSVVAERAGELPRRAGGFAVNLRRLFNIDNYPVLEELDDGYTLRLNLDLLRAQFELSA

SEQ ID NO: 1879 - protein, 869 aa, Haliangium ochraceum
MSFSEDVLTWMLKRVEQGRPLQPERCDLMLVRAHRALEPAPKRLAVRGREWRVAEVGGELGLRHLLLDATPLIALLADGFEPPLDLNDRAYRRQVLRVEAQDLVAAASRRYSARIRDETLARTILEAPEVLAQSSAAWTLGPSSTTVTEDEVKSVLLARAIGLDRKLERFTPASLLARWIAEGAPQTALGALLDAQLERVFGVEGRWLAQARQPRGLRALVAAGALAGSEAGRARAAAFEVDGLDDERAWSRLRGLVEEAMRSDDRRGAEASEGLRLAEEHYHALRATPDEAGRFPLLRGALETALSELARDAARGIAPGFGVLDSLRRNLHQGELAESLRAVELAGRLSAFVEAASDTQPDDVAGWLDVALHQTAWVDLALRRLRRCEGALSADIAGSVGRVMQATLAIRDRWNARFAAQLVAEEPAVYGERDVRAALPLPSLSRALLRPLVQAGHRVFLVVLDGCDLSTFLELMRSEDGEASVHLALPCAEGGFGKELEHLGALRVGLAPLPTLTVHARRSLFAGSLPKNPALHADEASAANASADRQAFANNTSLGDIPRRLLLKDEVGVDGAPVCAALDDASLKLVAAVYNGVDDALSSHEMTAIPEWNWANLGGGLRATLRHAFTRKWTVLLTADHGHTPFIAPARKVEKGRGKGGHRWRDAPFADAIELPVDNLRPAPLYALTRTGAWTGPQVRGFHGGVSLEEVAVPLAFLGPARVLHEPWPAPAWWSGGGETRARALAPASTDAPASPSAAAVVPASPPAVGGAAPAARVRVSASIRGTTLPAALRDELAAQDSALTLIEHIAGKRQIAMSALAGLAKLPAFMVRGRLSQAQARLHAAGLTVPFDEEERDGETWYLWKELD

SEQ ID NO: 1880 - protein, 912 aa, Microlunatus phosphovorus
MTTVARSSHATVVSPAMVHAMIDYVLGQRYGSRDGVLGIRGRLAGEDRLITEHRGRPVEVSYAESALAAREVLLGWRPDRWSVLVTDRGEDDLGAGVLAHLIGQRLRSPDPWQAVRQRFGAVAVDVRLTSIPAQQGIAQGLLELMPAQGWPAAPAGMLTRDHAFGSVARTVLGLDASALDLVSVLGWTTRADATRGLGELREAGGDALADAIVDWIADAAGEAAPAVRRLFRDGRPGDLVPLGLVVGFLHAETRHRHEAEVAVARLSGHLGGIGDGAVEQAMRLIGPQAETVTATLLTDDRTRPDADRTIAAADGLIRVAGAEGLAERSDLLRTGLQRRLHRLADGLRAPVAAAEEIEHAWQAVLGHVLARVDPRLPVFQASVRLARWLQVVESSDTSVNDTLAALSRRQADTDGWVDAAVNDAAGGVDDPALGTVLEGLLGLVRAVRDRHDLEFAQSLANGVRDEEGAEDGYLEHDGSRVYLLEHVLPEVVFPLARTELVLLLVLDGLSTGVATEVFTDLLDNPTAVWAERLDDGSPRRAAALAVLPSVTEVSRTSLLSGELVAGPQDRETRGYEELTRAHGLTGSPLFHKRDLEVARLGHSLADRVRHAIDDPGTRLVSAVLNTIDDALDRSDPAGTHWSVDAVKHLRPLLDRAREAGRTVVIASDHGHVVERRLGQQRAHPGSSTTRYRNAEEPVHADEVMIEGSRVLSADHRAVLAVSERLRYGPMKAGYHGGAAPAEVVIPVLIMVPIERAQDPGVRLAPSQQPAWWSEPVGAAHAPQSTGSPNVDPPTLFDDELADSSPLPRPDWVTRLLHSSAYRAQKQVVGRLAITDEQVSRVLTRLLTAPQHRLASQQCALVLEVAPARLPGALEQIRKLLNIEGYAVIAREPATGAVILDLELAVEQFGVTL

SEQ ID NO: 1881 - protein, 910 aa, Micromonospora aurantiaca
MSVPRAAVRPAAVRRKVESWLAEQDEADAIVLLARPQWNDEPVLTVAGRTVRVVPCPTPLAARAALADRPPHEKLVLLTDLTDNELGDGLLAHVSLQQGRSVDPWDLVSQTFGGQVRPDSTLVRTGRWVADALTELAPAVGWPPPTGTILTRDHALRHLAGTVLGLEPDGLDAAGLLQWSTDAPAQMRLGDLPVEWIDGIGTFLVDVAGPVAVPVLAAVRAGHGVDAIPLGLLAGVLWPRDSAQSSDVELAVARTRLEPRFAGTRLTETQAWAYTEAAEAWIYRALDDEAVRHDAHRILRRAEDIAEEIGVAGRLAASPLLPAGFTQRMRAFGAAVRFSLPVAGPAVPAGDLIERAQERLAEVEAHRSADRTRVETARMAVRLLRWLATPEQQPPATMLDAVHRQIREDGWVDRARLDVFDGDVDQMVGDAYRVLHQAVHARRSRHDRQFAELFQDATGAERDPGALLRVEDVLDRVIQPIIDNGRRVLLLVLDGMGAAAGIEIAESLVRSGAWTELTPHGGQRTGVLAALPTVTAVNRCSLLSGMISVGDRSDELKGFAARFPDGVLLHKADLRTPAGLAVDREVAAAIEDPAVPVVAAVINAIDDALDRSDPGTVEWSADTVKGLRDLLAIAQDRVVVMVSDHGHVVDRGSEAVVGKSESSENRWRPATGDPADGELLFRGTRVALADGELILPWQEELRYGPRKAGYHGGASPAEAVIPLLLFASGNDETVPGWSGAPVASPGWWREPLRQTAQADQPAAAAPRTVAARPSRRPRAVVQDESLFDLPAASIPPPLAGPPAPVDPASALVEALLASPVYADRRGSRAPIPDERVAAMITALLAGNGRATLETLATRAGVPVHRISATFTALRRLLQVEGYPVLSLDPDGRTAKLDIPLMIEQFVLAPS

SEQ ID NO: 1882 - protein, 886 aa, Mycobacterium gilvum
MAGMSPLTATEPIIRARLDKAAAKRYRRGVLGLRAEPHWAGDSFDHKGIPVTVVPCPSVLAIWEAIDTRDADGWTVVLTDVDDDELGDTVLAHLLDGRLITPDPWDALRGNFSATTIEPALYRGVGNDRAVAYGLLAVLSPDSYTPAPGGVLTRDHAMTTLARDVLEIVKDTGVEVDSLAILEWTRSADTPANLADLRTRGGGDLFDAAAGWLGSRAGLLAEPLEALLSAGRINELVPLGVVAGLFCQDDTTDPKALGMFLGHYGLTSLGSEALHAWYTSARGLVTTALKDPHTVLQAAASIANDLRIGTAAASSDLLPQGLNARINALADALTEALPQALPADLDAALITPAVQARIEARWAEVNRHFLAADSQTVDAFSGAVRLSRWLASPVSVATGLPEATTAYLTRDSWVDTALTKTRRGAEQPTAAAALRAVIDTVLARRARHDRVFAHALADAPKPRVPLVENVLRDAVVPIARQTPTLLVVVDALSVAAANDLVSAIQQDGWTEVSADGRRGCALAVLPTLTQRSRCSLLCGELREGADDVERRGFLALIRDAHLEATGGGPDPIFHKAALDAITPGASLATDVTNALADTDHRPLVAVVLNYVDDTLHHTDPGGTDWTIDTITHLRALLGAARSAGRAVVITSDHGHLIDYGTGAKVDRANTYGQRAHGDLANLDPEREVVVEGPRVLTDTHRVVLAVDPDIRYGARNAGYHGGAAPAEAIVPVLAFVAGQLPAWAHQVAAVEPTWWHAGTPAPIPAITKQGGAPSLFDVEEPVRVNPLPAKVIGSRIYAAQFKLAGRIVLTDAQIKTLLAELLATGARELTLAQAAAALGVATAGVNGALMQAKRVLDVEGYEVLAVGGGVVKLDEAALREQFGVTS

SEQ ID NO: 1883 - protein, 939 aa, Nocardia cyriacigeorgica
MTGTTVTTAMRLSRTTVAQYLSSHKRLAEVLGAPGDPVTLLLRGEPEWEGDPVLTLADGRRARVSVGTSPLSVHETVLAHAREIAPDPRVLVVLTSVEEHDLDPAILVRTHRGRVHTVDRWDIVRETFGATAVDPLLKRDGWACEALLDAAGAHGWPTALAGGVLSRVPALTALATRRLGIRAEVDRIDPLSLLEWSQRPGGPQLLLDLRAPERDGLIGFLSETEQSGATGAIITALVRAGHGPESVAYGLVCAALWQHAAPDNAVYQARGRVERWLGEHPPAVGQGLDRMLATFGRTCEDYIRDLLVKARSSTDLHDEADEAARHARKITDTVLAEADLLVRQFGAATAAEHSPLLPAGLEARFTAAGQALGGGVSDDIDKAVIRLREHDLAPDHRVRVGRVRMAQRLHRWLRTNPDPTGRSVAEALDQQMRDTAWADRAIDYLEAGGDDDPSLRIAYHTLVTRAREIRYEFDREFATNFAVWTESGSSPGEMLTVESFLHRVVRPLASDHRVLLLVVDGMSAAIATELAGELRGTFAEYDPLPGTGTPYRRCMAAALPSLTAVSRTSLFAGKLMKGDQKTEQRLFPQHRFWGAKRAQVFHKSDLRSTPGERFGADLGAALADPDCHVAIVLNTIDDRLAKEAKLDDSGWETREIGDLRALISVATAQGMVVLITSDHGHVIDRRGKSVEAENIESARHRLPLGEYDRLAETEIALHGPRVVWPESGASIVALWDNDSRYSAQKAGYHGGAALAEITIPVLAFLPFGAPPPSGWRELGDQRPAWWRDSAEALPQASAAAAAPTTRARVAGKAAEKLTAQITLDIPLPSAQPLSPPTSAADGLINGLLSSEIFATQLEQLARKPTTAKLEKAIRALFDGPQSTTALAQRVGDPPARAAGFAAILGQLLNVDGAQVLEVLPDGRTLKLNVALLRSQFGLR

SEQ ID NO: 1884 - protein, 908 aa, Polaromonas naphthalenivorans
MSVSVPQITAQLDAVLAREPGALAVAIRAASRQVWPDSVNQRGRRFTLRWCDSMLAIREALCEVEQADAADAGLVVLTPLGSHEITEDIAARLALRQVLQPKGWEMVRQLFGAKEIDARLGRFGWMPQALVDGAAQGAYAPVANGFLDLETAWKEVLQRFLQLNVPRPDAAGLLQWTQQPLSDASLKLLPANARADALRWLAESAGTAGRMVLACIEAGRTGDAMALGLVCGALYAAAGEGQAALGHAAIRLERFVGDTHVGVLEGRAWAQAAQQLVCEPGGAEVYRPALERADALLAELRVAEFAHLSEVLPLGLEQRLRAFAMLLSQHVQAPTDATLIAVEDAANRALAHELATTQPHRADRVEMARRLARWLVRPATGAATVADMVCWQADEGAFVDWARFRLLGGDELVEVSHAFEALRAAVMARRNALGQQFALALQRWNAQAPSVEARIVPLESVLDRVVTPLAALHPVLLLVVDGLSTSIFQELFARPERLGWSEWVPAGLARPLAGVAAFPTVTEVSRATLLCGKLTTGQSSLEKTGFSSHAALLAHSNANLPPKLFHKGDLSDATNLSSSVRAAIADPKQKVVGLVYNAVDDHLSGPDQLLQRWSLEDLRLLLPILREARAARRVVVITADHGHMLEEGSAHINGGESDRWRYGTEAAHSGEIVLSGGRVRTASGATSVACLWSESVRYAGRKNGYHGGVSLQEVTVPLSVLLPTGLTLSGWQPALPAQPEWWDLPNQPAMLQTTVRSPSARKPTARQPAAPASAQTPLFDASVTPVAAPSAAPSLGLAPASDWIDTLLQSQVYASQRSLAARVAPPDEQMRKLLSALSERGGKLSRAALAQRLSVPEVRLSGMLSAVRRILNVDQAVVLGVDEVAGTVELNRTLLLLQFRITSVGDGR

SEQ ID NO: 1885 - protein, 901 aa, Saccharomonospora viridis
MNTAPEVDRRMLEALVEHWLPQAKGRRLLLVHGRYVDGDREFGVTTKEHRCRVRVADQRSLLGVLEAWQDHQREYGADADTLLVVTTDVPDEQFGWDLLAYAVRGRVLSVDRVQIIAGRFGARDIDPRIRQEPWLIDALLDAEPAEGWPRTGSVLTRDRAIQALIRVRLGHAALGEDAMDIGTLLDFSLDTAATTRFAALPAAERDGLAEWLTHAVGDAAGLLLRLAAEGRAADAMPLGLVGTAAVGANASTAAALAFGGLLGGVRPEQLGAFTEAVEGALERWISQAESGSRHSDSAREKVLAVTRRAEELATQAGLTTYLADNRFLPSAFTARLHTVATALIAALDGSGELSAAEDALSAVRAHHLARLQSDRVRAVDMAMRLTRWLTLPVPEPTSVAEAIQRHNTEWAWVDRALTTLWAGDPAGDPVLGQAYQVVCRAVRERRTILDEAFAKHLVNWTKHASIDDPGGCLLIEQVLDRVAAPLVKQKVPLIVVLDGMSGAVAVELAEQLTERAWWEAAPEENRIAAVSAIPSVTRASRPSLLTGTLTTGDQTVEKDGFAAYWKRHSNGRHSGRLFHKADIGGDAGHRLSDQLLEAMADESVVVAVVLNTIDAALDHGREGDRTGWQPRDITYLPELLDAARNYGRPVILVSDHGHVLDRADGTPVPAEGVESARWRLGEPGTGELMLSGPRVLFGEGSVVVPWREDIRYTSRKAGYHGGAALSEMAVPVLVLLPSPKILPSGWELLGDRVAPAWWHQRAEQPTPPAPAERKPKANRRAAKERSDEMPLFTMDDSAERPSLGQRVVAGEVYAGQRVFIPKAPDKKVVAAVIDALVDSGNRLPLNTVAGIAGRARRPEFFATTLQRLLNVDGYPVLSVDGGRWLTLDVDTLCLQFGVTRD

SEQ ID NO: 1886 - protein, 890 aa, Saccharopolyspora erythraea
MTPPPTVDHRVIEALVKDQLQHHTNRRLLLVYARYADTVESFPLTGQRRRVHVADHHSVLGMSEAWQRHLADHPADDDLLVVTTSVPEEQLGWDLRAYAIKRSIRNVDRARIVAQRFGAVDVDARVRAEEWLIDGLLDAEPSTGWPRAGSVLTRDRAIRALIGARLGRTVPADGTLDAGTLLEWSRGAEAGRFSELSPAERDGLVRWLTDTVGPAAAVLLRLVEEGKATDAMPLGVVAAVAAGPNPPLEAGLALGGLLGSAHGSELRAFTDAVEGTLTRWAHEAEVSRNGEPARRRVWEVVRRSDEIAAQVRLTESLRGNGFLPSAFSARLQALATAVSGPRARLGDAERALESLRDHVVARLAPERVRVAEMAVRLVRWLQEARTDVASVADGIARYISDTAWVDRALQVLWHGDPGGDAVVGQAYRSVWEEIRSVRDRIDEAFAGRLESWAQHASSVESSGALLIEQVLGEIAAPVARKTAPLVIVLDGMNGAVAAGLGEQLAEWSETSREPGRRDAAVAAIPSVTQISRTSLLTGTVTEGGQTVEKDGFKKFWRTRRRQAQLFHKADIVGQAGSWLSDELFAALADPDIVVGAVLNTIDDALDHGQEGDRVEWRLDDITYLSTLLNEARNYGRPVVLVSDHGHVLDRGGQQTQADGVESARWRRGAPSTGEVALRGPRVVPGDLVAPWREDLRYTPRKAGYHGGASLAEMTVPVLVLLPSLELLPNGWHVLPRERTEPPWWSARTVHAETESAPVKAPSRRKKTPDPAVEALFPVDAAAVEPVTSLGDRVASGEVYEHQRKLVPRPPDNQAVAAVIDALAAQPDGMLTTSAVAAAAGRAARRPEFFMSVLGRLLNVDGYPVVSVVDGGARVKLSLENLRTQFGIDKP

SEQ ID NO: 1887 - protein, 875 aa, Saccharothrix espanaensis
MTPADLDSAVENAVVSRVSDIVDGLDKDPTAVGRRVVIGVRTRREPVWHGDRDGEIGGHPVRYVACPSVLSVLDALAAPPAGKSAYEVLVVLTDRDERELGEAVMARLHRAHLHDVSKYTLLQDLLKVRQLDPRLRGRENGWLVDALVDLARTGQLPNTTGLSFGREVALRHVVRARLSVDSTALDLTSLITAADVPGNRARWQALAPAERLGITAHLVERLGGAADVVLRLAAARDDVLAELLVADVLTGAPEDDLTAAHALGAFTHSRFGPDEPNRAAIATAATAAVEIATGTDSPDVWPRIRHADTLLAQLNGSAIAYVSRVLPSGFTSRLERAAKTLDDRDLAEVRAHHDATEQSAQVRRLHAAVRLRRWLDSRPSEITTTSDALRRHARDLAWVDSELIRVRHGSSSPEVAKAFERIASRVGKRRAELDIRFAGTLAEAAYTVPNGVLGVETVLPEMIAPLARRHKVLLIVVDGMSGAAAADITLSIAENPRLGWTEVVRSEDGGREAVLAAFPTETAYSRTSLLTASLSSGNADTERRAFPKHPFWPPRTRATVVHKAGVAGTSGLDLGAALDAEFAPRTEPQVLAVVLNTVDDALAKGRQSDDPGWHYRDVAYLPALLERAAENGWVVVLTSDHGHVLEHGSRHRPDPTGTARWRQPGDQVHEDEVVLAGPRVLVDGGTAVLAATESVRYGSRSHGYHGGASLAEVAIPLVVLLPPGTDELDGWAVHSQGQPDWWTGREPRKPTRPPRARREPAPAQPDLFTGDESRGARLVAGETFVNTHRGQPANRVLKAEVFRDVVDAVLAAGGRLPVAEALQAAGTPGRNPRGLVAALGRVLNIDQFPVVDLIDGGRTLVINEKLLDEQFPEGR

SEQ ID NO: 1888 - protein, 896 aa, Singulisphaera acidiphila
MSVGALSSQQLRSIVEEKWLRDEDALAVGLHVSVPWLGPTEVEFEFGKAQVVRADTVFQVRQALRNAERDQSRIILLTKLQQADLGHDVVARLARCRLFAIDHWASLCALFKAKELDRSICDPALAQALIEYAPPDGYPPVSAGILDGGTVWRAISRHVFDMGESEPDLVSLLLWATTKSGASRYLNASPELRTSLRDRLVASLGDAADSILKFIESGAGGDALALAVVCQVVYGDGKSSTLEAAAARMEQYHGNTPIPPSIGRCLGRLVTDAVADLDRRDDARSAHQHLQRADELLRQFRCDAHADRNRLTQLGFEQRLARFGAQVEATISSPSEETIQGCERLLGEINEHRVAKLGRRHDQISRVMMALRLVRWLARPLPTCGSFPEFTQTYRRDLAFVDWARELIGRGDEVVGLSRAYQVLDRAVLERREQFNRPFAESLADWTAVGSDSAGALGVEDVLGQVVARVVEPGNRVLLVVLDGMSWAICHELLDDIRQEHWSQATLDAAALPPLPVVAALPSVTQVSRASLLSGTLTSGDAAVETRNFELHPVLRHVCDKKYPPVLFHKKEVTEGARGAIGEDLSKAILSLNLRVVGVVINAIDDRLSSAQQIRDDWTIHRISPLGSLLKLARDTGRVVILASDHGHVWHRPDARNIPLQTGGRWRPKADDLAEDEVAITGDRVQAGASGSSIIVPWSERVHYGGPQNGYHGGATPQEMVCPLVLLTDQSSAYSGLYSCEYPKPDWWSPAPSKATAAVEETTTVILHSPKRPPTLFDNLRDEVDAPLPVTKRPGAWIDRLFSSQVYKDQKEQIRRHAPEDEVVRRTLIVLEAGGGLMTPAAFANAAEIPAARLDGLIARIQRLLNVDGYEILSLNRNENKIELNVVKLRRQFDLG

SEQ ID NO: 1889 - protein, 943 aa, Sorangium cellulosum
MSLDLPTLSTSDLQEELRQIHRHTRRSYTAAVACRGEPGRVSVDLDDKKVLFRVAPVRSELEMRRVLAEGGEDPVVLLVDFEQRLPADLAGRLAGGKVHPVDRGRQLARMFGATATSAELQACRPLCDALRARAVPSWRMQGSTVDLETAWRALLARDAGIPFEGALTEERVVDFCASSPVAPAFVKALADNGPLRAALLQHLGEASGPVAAIAWRAWERGEGRAVAALALVLEVAAKKLSGHAYLLGQVRTAMARLDPELRKLSPDAPLFARWGELGPVMARRLAPPVLDRALADADAILQDEPVADVLVESRWLPGAFELSAKALGDALVAATASPTPDAIERADEASKRLQNHRRARVDDSNEKRLAARAEMALKLVAYLGTRPQLEAELRELGDHDRMRSLAEHYAEHGAYVDAARAVARGEETAGALAQGIQAVLTAVDAARDLDDERFASGLASWVQAGSPGSSRVVPIERALDEFGVGFLKEKRHRKLLVVLLDGMAWANAVELLTSLEEAHVAPIRWKRGRLPPVLAALPTVTTVSRAALFKGKRLDPGEAEDTGKDPARFAGHKGLTKLLDQAPQLYLRPDVETTTGELSKKAAALVQSKDRVVAVVVNAIDDQLKGSRQMRVPCDLAHIKPLGPLLQEATDAGRAVLLIADHGHVLGARLASVSAPEAGAKRWRPLGVNDAPGPNEVCVSADSTWRPRGKAKVALLYRETEAYGGSAHVGEHGGASLAEAVSPAILVASDRLRQRIQIEEGEDDEALEVTPFQSPPWWDLRVRKPAVRTAPADAVVVAEPSPAPARQLSIPLIDVAAPKPIKERKDAARPAAAASGAPAAARKPGPSATLAKSKLLKERQRERGAEPRAVMMAWIDVLAAHQGRMAARLFTHEVGLLAHQAGGAVSEMGEWLNVDTYQVVSYDRVAQEVLLDLDLLQGLFGAD

SEQ ID NO: 1890 - protein, 974 aa, Streptomyces coelicolor
MTDTTVAVPGAVRLNTATVTQYLSSQSSLVASLTGDGGGRRRAVLLRSAPQWDGPAEPAWGEGRTAGIAVAPSPLAVHELVLDHLAARRPGPPVLVVLTDREQHELDPAILARVHKLRIDTVDGWDVVREAFGARQIDPRLKDVNWAAEALLDATPPGSWPAVPGGWLSRQYALTALAQRRLRLGRYDTEGGPRRPGDDRLDAQALLHWSTRPGAPERLLTLRGPERAGLTAFLGEEDQAGLAGRTLLALVDAERGEDAAAFGLVCAALWQHAEPAPETYRARGRAERYFGDRPPATGDQLDALVTVFGRATEEHVTTLLAAGHRTAGTDADQAREARRTTGTVLDRAAALARQFGAEEAVAASPVLRGGLEARFTAVGRALAAGDTTAVADAVRRLENHRLAAEPEESARIERARMGQRLARWLATDPPTDALTVADALRRHVAETGWADLALEHIEAGGDQGPVLKAAYDTLGTRVRDRRRQIDASFARSLAAWTQSGTQPGSMLTVETFLDRVVGPLVRRGEERRTLMLVLDGMSAAIANELGEELRRSWAEFDPLPEGDTPYRRAMAAALPTVTAVSRTSLFAGTLTKGTQADEKRLFPALKLWGGAPAAVFHKDDLRTETAGETFGPALTEALADGRTHVAVVLNAIDDRLAKEQKLGDGAWRIDDVPGLRDLLRVAATQGMAVVLTSDHGHVVDRHGTKVDPAAAPESARHRLIGGGPLAEREITLSGPRVIWPEPGASIVALWDADSRYTALKAGYHGGASLAEVTIPALAFLPFGAEPPKGWRELGDQRPVWWAPEETGKAPLPDEYTARPVAATASAPKKPTAKAKKDQAEVARMHHGALFDVALTTEGDDALLTPTVVSRTETLVTALLDSETYQAQLGGLARKPQQEQVHKALTTLLDSGGTLPVTALAQRVGMPVTRGVGFAAVLGQLLNYDGVQVLETLPDGRTLRLHAALLREQFALGAG

SEQ ID NO: 1891 - protein, 981 aa, Streptomyces griseus
MSVTSTSAIARLNVATITQYLSSQTSLASSLTGAGRRRAVLLRSTPQWDGPVEPVWGEGRTARISTAPSPLAVHELLLDHLGKPLGDEAKDTGTAGSTGPAVLVILTDREQSELDPAILARVHKKRIDTLDSWDVVREAFGAEQVDTRLRHANWAAEALLDATPPGGWPPLAGGVLSRRKALSALALRRLRLGRYDTEADGPVDRVRRTDDALDTHALLSWSLSPGGPGRLLDLRGPERAGLRQFLGEEDQAGLAGQALLALVEAEHGEEAVAFGLVCAALWQHAVPDAEVYQARGRAERWFGDRPPAAGEQLGHLASAFGRACEDYLGVLLTTAARTAGSESEETREARRISDTVLDRATSLVRQFGAESAARTSPLLPSGLESRFALVGQVLESGQTGALEEAFRQLETHRRAGAPEARTRIRRARMGGRLTQWLAGEPTSACDSTGTGIVRHLAETGWVDQALEHIEAGGDPDPSLRSAYDKLGARVRERRLDIDREFARSLATWTAAGTHPGSMLTVETFLDRVVKPIVRGADGRRVLLLVLDGMSAAIATELGQELRSTWAEFDPVKDGEPHRRAMAAALPTLTAVSRTSLFAGRLMKGTQADEKRLFPQQKLWGGAQAAVFHKDDLRTTSAGEVFGPGLGEALADGRTHVAVVLNAIDDRLAKEQKLGDGTWRASDIPGLVELLRVAAAQGMAVLITSDHGHVVDRRGTKVDSSLPESARHRLPGGTLSAAEVALNGPRVVWPEPGGSIVALWDADSRYTSLKAGYHGGASLAEFTIPVLAFLPFGATPPKDWRELGDQRPSWWFLDERAPAAPVPPSPALTPPVKKPVRQAPSKSQAELARTHDSLFDVVLVPAEEAGDALVTTELRTQTESLVHRLFGSAAFQDQVELLARKPRERELDKFRQAVQALVDAGGTLPVTALAQRVEFPVTRADGFAAVLRQLLNYDGVQVLETLPDGRTLRLHQGLLREQFELG

SEQ ID NO: 1892 - protein, 914 aa, Thermobifida fusca
MTTATTTVPPVTVDAVRGALRRALKRQQRRAERDPAAAHARAVALRAAPQWAGPDEITVDHDGRHVNARVVPAPTVLALLAELSRPRDAEYLVLLTPCTTQELGNTLLSRLVGQEVFTVNNWELVLDQLDLRHLDPRLYSREWAWLANALYDISLGTEWRKSSTILKLDDALHRVAAARFGYEDADRLDAAALLDWTRDPARITQYTSLPEEERVGLRHALEQHIGAVATVVFRLLDRQQISDTLPLGLVFRELLDPANSSLPGVTETRIRIEERFLGAPPPSLDELRRFADNCEAALLRLMDGAEHDTAISASRRAEEILAAVGADAVANNSQLLASGLHARLATLGEHISELLHPGKDDPQPRDLGHVEEAFTRVRDHRRCDPTAPEFVGALNAVRLLRWLATDPAPPTTVADGVASHMAVTAWVDRAASALYTSATDNPALSEAYQRLYTRVRERRARIDEAFARRVAAWTEVSSHTDELLLAENLLKRIAVPVAKQQAPLIILLDGMSAEVAVQLGEDIAASGQFIEVARSDRGREGALATLPSITTCSRASLLCGTLTTGGQSDERAGFAAFWRKAAAGARPSALFYQRELATGPGDRLPADVEAAIDDTEQVVAVVLNIVDDSLATGRESDTATWRVHRIGKLRTLLDTAHRAHRPVILVSDHGHVWDRDENRKTSDGEAARYRTGTPHDGEILVTGDRVLAGGGSIVVPWDERIRYTSRRAGYHGGISTAEMVIPVLVFLPDKELLPDRWETLRPTQHEPAWWNQSIATRLPDDTTPTPRRATRAPAVDDDNALISRAEVVRSLGQRIVDTAVFADVHQQIPKSPPKEEIAAVIDTLAEVGGDRPRLPVERVAEAAGKEPFRAARFLKMVAKVLNVEMFPVLVLTDADRAVELNIPLLKEQFPEGAS

SEQ ID NO: 1893 - protein, 941 aa, Thermobispora bispora
MTETRPMATDTASPATPSGPGLRLATLSAVRSIVAHQLKKGGSRRIIGIHALPEWHGEPSFTVEDAVVHVRPCPSALAVREALTEHALTKRDTKDYLVVLTDVDDADLGAGVRVHLAGGRLHVLRPWEMVKEAFSAHTIDPLLLDERWAADALINREPAGGWPPAPGGALTRDHALGNLASAVFGTDPAGQPYLTPEHLDAPGLLLWTLDPVAVARFTELPEEVRDGLTGWLGTVLGPAGRWTLRAVTAGHGGDAVPLALVAGLLWERGAGPSAAEARGLVRARLGGEALPAEEAQAWARAAQAALGRLDRPDALLDRAEELLREFNATEVIARSTLLPEAYAMRLREFARALRQALPGPGPSRRVPDVAALQQAEDAHARLLAHELAGHNPRTRTATMALRLLRWLATPKRPAATLAEAVHEQVRTGAYVDRALADVWTGDQDDEVAAAYRALLEVAAERRTERDRVLARHLAAAVEADSEPGTLVPIESALGTLVRPLGRSLLLVLDGMTAAVLAELADELIRDRWTELVDSSLGHRRALLPALPTVTEACRTSLLTGTLRIGGQHDEKAAFPGAVGDPQARLFHKDDLRAPAGHALHPDVKAAIDGPARVVGVVLNAIDDSLDKMDPGGTTWALDQVPYLRALTEAARAAGRRLILTSDHGHVVERGGTALTAHATGAARWRPAGGPVSEGEIEIRGRRVLLGGGAVVLPWREDLRYGAKRAGYHGGASAAEVAVPFAVFSTVAGDDIAGWAPAPVQEPTWWNAALTRAQLRETTRHAGAQPGAHRAAAARGTGTRSAKGRSPEVTGQTELALDAVAPEPAGEEPVSPVERYLDELLASDLFREQCARAGRVAPDVALVRNVLAALLEAGGRLHQSALSAQAKVPATRMTAALAAVRRVLSVDGYDPIGYDPDGETVVLSADVLAEQFGIPVPRQPDL

SEQ ID NO: 1894 - protein, 932 aa, Hahella chejuensis
MNYSTKVELSKNEADLSKLPSPLLTQIQAVLRRAPNADRIAIFWTDTLVPTEYTGRLEDTSIKLVYCVSELAMREALVEHDGNNCLVLVAPFGVTDLAQDVLARLWRNEPQRISPWRTLEQLTRVQSIDPRLPKRYGKWMAEALLSRYDRYEKSVHFGEVLDQETAWQALAVGYLGFNQQHSDLSSLFRWSISNASKHQPSNALPAEMQESIADWLSITLNGLAPVVGQLIVRQPVEDLLAIGLVCSVIYHPDAVKEGALSYEQQFAANIKLKERQLNGIACNTDSLAKFGEKAALFVKDLIVSEPDGYQKVKNSITKAEQLLASVDASDGAICSNVLPAGFRLRLITFGKALEQAIKKGDTQPAQLAFRELELHVLGALPGQRDQIERAKMALRLVHWLLDSQETTQKALEKNTNCSQLLKRYMDHGGFVDWARTQIWFGDAEDALSQVYQRLAEKIGDGREAENFEFGTSLESIAKGDQLPSRLLYVEQALEKIVAPIAEQSPVLLLVLDGMSQAVYRELIEDFANHNWVELQREDIGESQSLVSALPSITQVSRYALLSGELGSGLAQEEKKNFTNHPLLKRIASTKFPPKLFHKQDLQQSGSGSLNSEVRALIAGTEHKILAAVINAVDDQLSSSSQVAFKWQLDSIRPLKQVLEAARESGRVVIVTSDHGHTLEHETTYYSSSTESGERYHSDTKAIREKEVITKGIRVVGKDNTAVVPWSEKVRYSKSKNMGYHGGASLQEASIPLGVFSNSGAENKLSGWKEVPLYRPDWWTLNTISVVSETPTPEIKQEEKKAETKTASKRKATEERIDDLFAEPEATKKITSEDWVEQLFDSAVYKDAQSRLGRMAISKSELKEFLTLLSANGGQIMQAVVVRELKKPELRMRGFLSAAQRILNVDGYPILKVERDSQTIMLDVRALKTQFEL

SEQ ID NO: 1895 - protein, 795 aa, Aciduliprofundum sp.
MGVEDFHSLKELYARIKQDKNSKMPSDRRFPVRLIFLNSFEELREIIRFLVKNCNVESREITELLSDKNRWLTTDEIVNWIREISNNAVVVPLSEFLRFQSKEDFYITLKSLTEIEKQNNIRIYIPLVGLWERFEQEFWTNFYRKEEWASVWKLETSSQKTIIYQINFDLDYKNLLLENFVLVSTTEEWLSVWKRENVKGILSLSQSLSYFYKNFLPDQAFELKGISNQKEFLEEIFEIKVPVKFKDDEIEFWNELIKEVGRYNRKGLTIEGIFLRHFNFRSIEKLTPKEFLDCYLKTNDYYERWLIRNLFLALDKFKSSYLHKCFERLEELKEEDLIEKLWLEIFQLPSETPTKDVFSERKEFLNYIHKNLNFSARFVEEKLYNELDNIKSYPLKKKLEYLTNITFTERKYLISELKNVDIQEIQRLLPNLKDVYPELAYYLDWELIKPDNEVDNWILEYFKEYNYSKIRHSKSLKIEELINNKNRNKSTFSDWYYSLPKAKIEEEIKYVWIDGLGAEWFSLVVHLLNKYGKEKGKIVKNKLLTRVNLPSITECNRYEFEKVGNLDKHIHNQNPYKYPDDLIKEFELVEKIIKEIIEMQYEKIGILSDHGFSFLCLKDFGNFKRLDLPNTEHEGRCMWIDEVNYKEDEYFIVWNIDEGNCRGRKVLVALKHVSLNNTPYREVHGGATPEEVLVPYIVIETEKDKTEYEIELINSEVWITNPVVQFKIYPQPLYIPEAFLNERSLNVSYEKEDDIYKIDLRGLKVGEHTIVLKIGDKDYQIKVTIIGGFKERDLL

SEQ ID NO: 1896 - protein, 757 aa, Anaerobaculum mobile
MKCFRNINELISDIREEKSKSCRFATRFILVQGCRTWDELVAKLIHEVDRVVHLSEFCDGHDVFPDMTKLQYYLKEKILNCKDVLLIPLAECIRLDPESAIIIRSLAEWPAEKIRRLYIPLLSINESFLAEMDHVPRYEEGLLPDILSIEGEGDCEVVVAPFHIESEDFLIISGIKEYLSRWESSNVNKIWLQTDMAAWLPKLRLGGRCKVCIYPSPFDYVSRNANWEEVREEWGSSENWNWLATQMREEESLDSVASRILNVADYNSQQLFVMWKNLDERKRWLVWLWSKAKSNPDSYLYHVIEKSNSVSDFIDNVIMAIFSLPKSLSFSMERKELLKLLGVTVMPPEFWKQYDELSSPLERIAVLTDLSVTEREKLVSSAGELLSSHSTALWWDYLEVAFPKLTWYLGFPSTDDEFADAYFFAYNRCRLIDRADDSLHDLIDKWASEQLLWNYQGRSDIVAKQRSNGSKILWVDAMGAEWLGLLIKLLTMDGEVECEVMLARANIPTITDANKEWEEDEEVIRDLDDIAHHYAYTFPQSFLKEMELIDKLAIKVQELLSQFSVVVVTSDHGLSRFAAISKERVDPPQGTTVDSRGRFAALQDDVLSENYDANTLWVLVNNVICLLTHCRFKGCMASPGEVHGGAAPEECLSPVIAVRKAGVEAPLKFELIAETIKLNPKGEGVIAVRCNRAIRNLKLQVAGSSLKGQEAEALTWEFKLKGWKAGKYTGTLYSANRNVGEITFEAVKGFIQDDLGL

SEQ ID NO: 1897 - protein, 772 aa, Candidatus Desulforudis
MSLQLKSFCSTDSFIKELREDAKRAERFPVRIILVEGLGSWQKLVKRLQPEVDTVLRLSSFCGGEDTYPCGTSARHWLTERLREHSPSTILILPLAEWLRLEAGHEEQEAFELLVNLVQMEKVGDKRIYVPLLEAAEAVRRLEERVVRYHAQGELPPVWKIAGQGSVTVKVFPFVPKYDTSRVIQGIRAYLECWETGGAEQVVLVTKWAEWLKGCKATFTLEVLKNAYEVLAKRVASWPVDLREELGSKDDWFWLAQESRKGESFSHLAARLLNMKEYDSLGLMERWKGLEPRQRWLGWLWSKLEQAQTGYLGKVVTASTGVNDFERRLIWSVLEAWPTPKEAREKKSLLVNMGLEEIPRAFLEKVRELRDPLHRLACLTGFSEDDKELALLAVKELMESDASGDEWWEYLEVAYPELLWYLRVPPVTEVPEAQLQEYFWLYTRSRVRDEPDARLLELAQQIATDQILWKCRTRDQVLEELKCQGVMNILWVDGLGMEWLGVLLETLRTREDVSVTIEVARANLPTTTENNRGWDTEKAVVRTIDRDGHEVPYPWALIKQLSTVREVANRALSFLDTMEQVVITADHGLTRFAKTSGGIRLAGNVQVHKWGRCATVPSGFSLKPELQADCLLQGCTLILLTHEKFYGQSGTAYQVHGGATPEEWLVPVVRVRRIDRGYGVQAVRVLTPQVLFNVRGEGELRVELVGYKGKAVELRTSQYIFEGKQTPGGVWVFYLRGLKGGRYQGFLQGDAGELAEIEFDAVRGLVEEDLGL

SEQ ID NO: 1898 - protein, 769 aa, Coprothermobacter proteolyticus
MNVTGFDELAALVNQDKASNIPSATRYPVRFIFVKDVWTVKNIVEMLKQRSAMVVDVSNVFPLNFSSDGFPTASTLLQEISTQDGDLVVVSAGNLIRFWSDDEFGLLVSSLMEFENSLRTPNRRIYVILEGLAERFDAVFWDKRRRHIGIDPRWVLDSPRSTVRVNMLRFDYQINGRNVLPDVKSLAGLWQGPKQNEFICCSQTLRTKTCYCSDDVVSFIDLDTPPEFLQKVMHIDVSCIPYEKGEEGFWTELINEFRNTKLHSVRTLLEKKYNLNNAEEANWTDIFVSKSKNDYERWVIKNFVVRCTDDDALEFVRLTFGAMRGMSVEEFVEQCWMSPFQETLSKELLAQRFVVLRDIHTLLGKRVPIQIERELEEKLSTGDPSTLAPLVTGITFAERKWLVRNWELVNDLKDKYSALHYYLSDVNVVSDSPFTDKLLAYINEYKRCKLRNTITDELESLLEDLNKDESSFYDWYYSLPTAAKLIGGDICGSLHWVDGLGMEFASLVCKKLEEMGYEAEVHLARANLPSTTGSNMFQGIERIDALDSYIHGKTTYQYPDDLVKELELVADEILPPLASLKKDFCLVSDHGFTVFACNKFQKVHKFKFEKVRDEGRYAELDPGQKVPHDEDVVVYEDPESERKFVLALRHISVSQTPKRESHGGATPEEVLVPVIFARVAKKVEYEVELETPSISVRNRVLRFRLKPEPKAVPEVVIGSNRYEATRTKDWFEVSLKNLRSGDYVAKITVPGFEQEVQFKVKGGIEERGL

SEQ ID NO: 1899 - protein, 739 aa, Cyanobacterium stanieri
MTKIILDPTNLYPIEQNYIIISNEVEWLKYFTLKDDAYWIKNKIPCAWTKEWLKACNKTNLIIEIKENPRSLLASMLNPLSIPNQWNDQQVLGILNQLNTYPDNKIAHLLAEITNTELKLWECITPSEKHLAQWLCVNIPEEYQVFEQFWLENFISHNHDNKLIEYYRINNKLNLLKDWVGIRLNKIDNLGIFPLSLPVIIEKEFINFWEEKIVQTQGEIIENLILPQEYKKELIAEIAYNIFLEKTNWITRDRVAKISIYLNADKRQKLNQLIPPSPPKPLDINAKPDDCLQWVTNHYLPFRLWEINHNMSNNHEDKNQISSKLADNFVNWIVKNYPELKLDSVEKSWLNYSVTPQVEKLAKNNPILWVIVDGLGWLDHRELIFKLTEKNSLSIQQDIQPKFSILPTKTEYAKWSLFTQLLPNHNSWNNNAGDGFSLINNGHRYTDRNKPKLIEDLQQKKYQIYCWDTTQLDELYHHQNDWQTLYKLEREKVLDGIVKDILHFLQQYPEPEKLQIIIASDHGQIIGEVDKMNNYPNNLKPQGRMAIGTTDDSRFVVLSAQKFDLPHDISIVRSQDSLGSFNYTQNQKIIGNHGGLFPEEVVVGFSILSQQISRLPVLITCRGEGKAKDRGELEMIINNHNKLSLTNLCLYINEIGELKMGKILDIVIPPNQTINYKLEINKCPELLPDNSNNYYTLSGKLTFNFANTEVGEAELDAQSLLTIKQIFTSGFTGGLDEFF

SEQ ID NO: 1900 - protein, 749 aa, Denitrovibrio acetiphilus
MLSRAVGRFLKSTTYYPFFITVGDENYCDIKNKLSNLGLHFIKLSDYCKEDDKLPDLDALYEQLKTTNKMLGVNTIAILGLGEYLALCGKSEVNRVLTHLQAMNTSKTKVVLLLRGVSSYVNNLCSDIRFDSSRFFCAGSTDCNLSITVSKLSTSYGVLKGFKALLNELENGKRENIIVNTNIDLSQSLFTKRERSNAYDEILFILENFSLAETCGTNEYWSELLKVLTANDNSLEAVLEKYGLTVDLELNIHDKIFGREYRNWLFFIALKINIDRLSNSYLRLVLENTHDYKNLKLNLLNYIINISHTDKKHNTLYLERKDLIRDFPEPDIAEFIIRNRKNLSESIYKLTDNTIVEREEIIAWVSQNGIIEEIAEIYPVLNTYLKKFVFNCGDLSDLLTNYFSNYKEQKVSNKLNKEFIDQIEVLAENRIYNRLPTRNEIIDKLEKSDSHLYWLDALGVEYLSFFSEMAREYGLYISIKIARAELPTITSINRNFFDDWQGNSKEKDNKLDDIKHSDEGGYNYDNNVLPIHLAKELEIIETVIKKAATALKLRKFKRFLVVSDHGASRLAVLMKKEEKYETNTKGEHSGRCCKLFEPYDLPFAAEENGYLVLADYGRFKGSRAANVEVHGGAALEEVIVPIIELTLKDDSGVVVELDDSKLITVDYRTGTEIILFINYSQDEVSVIFNNKRYFAEQIDNNHYKVELTDMKRAGEYLVDVYSKDNLIATISFKAHGKSGKIIDEFNDLF

SEQ ID NO: 1901 - protein, 686 aa, Desulfitobacterium dichloroeliminans
MVYTLNEYCQFGDCKSARVVVYPNIDTAAYLLAHHKNEVKLSVSDCISDGAVLLPMPDTLFACLDNSIATQNGRVVITGIDAYLSLLSKQNIDAFFVALRHRIDEGNLNATYLLSSSYNIDRYFVNPKYEQSLDVVKIATVEMINSVEPPKVEVVSSKWFGSANNLNDYKTLLKRLGDSVSTGKHLLVLNDLRYKQAGLSENISFYVDVQQVAERFYSFNVVLKPSTMETLLLKAKEKNVSPEAWLEVQFGKENIGVRYALNRLIEMLDDELWMAYVWLLQKKLPMDTYLSKVLDAEPTHENLLRKYVVETAVTLLGDDDARRLAVERADALSPLMNTVEPLIVEFIGQTKNNVTAAEFLNCGTKAEMREIVRRAAKYDLILGLPDILKRICPVLSDYLSDYDYGDKDLTAYFKEYRRFKVNDTVTDVFAKKAFNLVLPTSLTARDSVLLKLSTDDDMALLVVDGMGAEYYPLLLAMAKRRNMNIESHAVVSVKLPTSTKYNPLKWANDRTLDEVKDIDNIAHYGEAKHEHCPPERNIAASLRVFESEVFPRISTGLEKYSRVVLTSDHGSSRLAVLARNNGLGATLPWNGNPLDWRYSVAPQHGNRPPEFESQYSASDGKTYWVVRGYNRLPKQGGKLNELHGGASLEERLVPIIVFSRVKTTEKPSQLGKKTMEQILDRMGFDI

SEQ ID NO: 1902 - protein, 700 aa, Geobacter sp.
MTLSEYCEYISNPLAEAKARVVIVPPGESWTALRRFCQDRGDIVMRLSDFVQEDAWLPMPDEVFGRVRNAMTAQEVRGTAVVLLGMSGYLALLTDENKRAAIVALREWVDGTSERHSVCFLRSDDGTDLLLKNVFANPRYRQGKQLIEISGDAAPRVAGRTEVMLVGDDLAPFVPDACDTFQKYLRYTEEQPSDSFIRRIVVTSEGRELAGLSAEVRQVVCLRDFARVFYGVEDLGLTEDALWWMCERGKEGAGKTLLDTLKALFFSGSGVTKCVLRVFDEQRGAEREALLWLVKHIAYKGSYLERVVRHEGVHVSNFRSAYVTGALEWLDESLVHAGERRDAIREADVSRSDADIRQFIARCAGESTSRVAPWLNCRTDAERAELLRRCSVDNIVSNVVKEVYPETAMYLSTDIVFGNVALEGYFKEYRELKMADRVTPTFYEKAREAVPPSSVKSRDAIVQRYASDNGCALLVVDAMGAEWLPMLVTIARQRNIGVDSIDVCKVHLPTSTRFNNIHWPNALRRLPDIKRFDNIAHNGAEAHEPRRVEENLAAALDVIGSEVLPRVAEGLTKFERVLVTADHGSSRLAVLAWQAEPRLARTLVCEAGTDVADWRYRERAAQGACPPELEETLDGRYWVMRGYDRLPKRGGGQGFELHGGAALEERLVPVVIFSQTGQFLAKAKTDGKRAQIVEKDDFDL

SEQ ID NO: 1903 - protein, 798 aa, Prevotella denticola
MDALKTYIEEDKQAKGIDAFTLDRYPIRFVLFDNFRDCYDFVDFLQTEQGIHVESVDHWIDSNYPDLLITHVELASRIAEHIKRKSPNDCVIAPFSELARFYDNEDKKSFDALIKTIKAIEATPKAQEKHQRVYIPLVGLEGKMDTFKNDSQINIWRLISETKDLTYKLILTKDTDFGVSGLNANYTIVNNIREWLNIWKDSKKQISPQIICKSKAIFANARFAQPDNAFSYQACSNAYQFLTVGLNLEFGAIEPLESDGDNWNKLAESIDVSNGFNFDKYVKQYFSINNIETYKEFIRLWFDNPYVFNRWLLTRFYISKANGEGYLCRCLNATSSYGTNELIEKIAGDITEIDAEMEVRKYCLTYAAQKNIQLSDAAENMMVKSLQTLPAKMGYSGTLRYFTGITQKEKELAVSWLAQGFIVPKDIATFFPDLYTYMNEGIGGATGVPDWVNPYIEQYKKAKITNRYTTEIEQLINKLNGSESSFDVWYNSFCSTYTLLQNRGDIEVFYWIDGLGIDWIPLIKSIIAERKDQQIFLNEIRIARSLLPTRTEINKKDLQRLLPQGVQLEKSGDLDTLAHRPDNISPFTIIKEIDVIRRSIEEILQKYIGKKIAIISDHGLTYLSQLLKGKNMPSVESDHHGRIAIREKADSTMDSSYFRLEDNKTLCALKHESLCAKVPSGQGAHGGCTPEEVLVPIFIISSTPMATNWSFNLLTCEISGSNPRIQFEIKNMPSAEVPYVLYSGVKYNVHHLSGDTYETDDIILNANILDFTLHIGGIVRPMKIKVTTGIQEEDPFDF

SEQ ID NO: 1904 - protein, 937 aa, Thermotoga petrophila
MKIENFYSLEKLYDRIKQDKNSKRISDRRFPIRLIFINSFEELQEIIRFLKDDCGAESKEITELLSSKDQWLTPNEIVNWIKGIYNNAVVTSLSEFLRFQNKENFYITLKKLTEIETQNNIRIYIPLVGLCERFKQEFWTNFYRKEEWAPIWKLESHSQKIIIYQINFELNYENLFLPENFEIVLTTEEWLNVWKKGNMKGILSLSKSLSCFYKNFLPDQVFELREISNQKEFLKDIFEINVPIEFKDDEKEFWNELIKEAVRYNQKGLTIENIFLSHFNLGSAEKLTSEEFLDRYLRTNEHYERWLIRNFLLSLGKFKSSYLYKCFERLGELKEKDLIEKLWLEIFNLPFETLTEDIFSERREFLNFIHKKLNISAQFIERKLDNALDNIKSYPLKKKLKYLTNITFIERRYIISELKNTNINIQEIIPDLKRVYPELAYYLDWDLIKPDNEVDNWILEYFKKYNCSKIRHTKSQKIEELISNKNKDKSTFSNWYYSLPKAEIAKDFKYVWIDGLGAEWFPLIVNLLNKYGKENGKIIKKKMLTRVNLPSITKCNRYEFERIEDLDNHIHNQKSYNYPDDLIKEIELIEEIVKKIMEMPDDRICIVSDHGFSFLCLKDFDNFKRFNFSNAEHEGRYMWIDKIDYKDDEYFIVWNVDEGNCRDRKVLVALKHVSLNNTPYREVHGGATPEEVLVPYIVIETEKNKDEIKYKIELTDPEVWITNPVVQFKIYPQPSYIPEAFFNEQLLNMSYEKENDIYKIDLKGLKAGTYTIMLKIGDMNYQINVTIRGGFKERDLLSPQEMLVPVLEFKMERGHMETKNAEIALVSIVHKITNLITSMDFIQPDAVSDTVKAAKYRIFFISEDNEKISNENSYVADSREENAQKRIFRMRFTFKNKKYDKDKQYYLVVYDEESGLEQWRQPVIMDIAFADDFGFGF

SEQ ID NO: 1905 - protein, 840 aa, Stomatobaculum longum
MAELNLKQIIDRLNAEFTGETRKLVFWYDDKADFAEDMETVELQNAKIYRLQPDNQFYTKYFLERIDQTTNYLIYAPFPKPDVRDNHLEDTCAYSRRFFADRASLLSLDLGIEEKYKSVIEKHIKFFANKERTQRFYDLEIENFNEETILVGLLSAVCKARTCSFEEVVRVVLTGNEPVDNVFLQEFEKYDLLSAFWKLCEQHFGYTDAKPGLERLLVTLFVTYTGRYVQAELPAAWKSFVSYKSGNIIAFLDSLMNSVLYRDQYDVLSAHVAKELNVLPAFAGMRADDLTECDTFLAVDQVLIKWLLDRLVSEDIGAVANGLTIPELCEKRAKMHFGRKTGKIYRMLSAAYSMVKGADYHAAEGFKPIIDRYLAADYRMDRQYRKFYYYYDRLESTESFEPLRELVENIYTNEYLASLLPAWNAGIRQDAAFSAIPLQREFYNTNLRYAKERTVVILSDAMRYEVGQELFARMQDDPKCTAKLSVQLSVLPSYTRLGMAALLPHKTLEMTDDFQVLADGILCDNLAGRQQVLQNYNPDSVCVQFDDIKNLKVAELRDVLTKRQLIYVYHNQIDARGDKANTEDEVFHACEEAVREIMDFIHRISVSGNTYHFIVTADHGFLYKRDKLTESDKISGKSAEKAFVNRRFIVSEAALEDDGIDHMSMGRVLGNADGKVVSYPVSSNVFKVAGGGANFVHGGSSPQEMLVPVLEIKMERGHMETKNAEIALVSIVRKITNLITSLDFIQSDAVSDTVKTAKYRIFFLSEDNEKISNENSYVADSREENAKKRIFRMRFTFKNKKYDKDKQYYLVVYDEQSGLEQWRQPVMMDIAFADDFGFGF

SEQ ID NO: 1906 - protein, 1716 aa, Stomatobaculum longum
MDAEKIIQDLNRRFTAPLPEFYKRRVIFWYDEDREFENQIDEISLNDAKLVKLNGSNCFAIKKLLLMDDTASNYLVYCPVSFEHPEDNWLLNIELYSGEPFRADLNTIWVDEMGLPASQMFRKQVKQYHKFFNSKDRRTKVAAMAGSISMSAQMHLAVMAVICGVKDISPNSIIRAVLKVGLDVENNAIYRGIVNYGAQAAFWALIAQATGYKNTEEQNLAQLATHILLTAATRTLRREYLNGLDSFISTPHQSFCYDFVSDWLHSDDLHDLYKVARIVETEARLYQRFSKLSVEDLRDTECFPCINEVILTKMMTEIKDQIIQVDVIAQTVEKRRTMVWYAFMSSYYEGLLQIAKMQAFFLEHSAGFHTAKAKDIWKEYTTDYYRMDSYYRAFHLCFQRSLKVSNDLLDDLFKHVVEKVEALYSGWYLNGLGSNWSDIAAEELKKHGYIEEVNRHTAFYLSNIQHCDTRVFVIISDALRYEVAASLSEQLRRETQSKVTLDSMCGIFPTITPYGMAALLPHKKLSVQARPNGGLAVLADGQSTESTNRGKLLRAANPASVALQYRNIIGLKRADRQALIKGMEVVYIYHDKIDEASHTSDSSVFPACDEAIEEIKNLVRIIVNEFSGTRILITADHGFLYTYSPLTEDDKVSKNSWNGKEVDYGRRYAIMEKDAQPEYLMPVQFLDGRTDYAAFAPRENVRIKMNGGGLNFVHGGISLQEMVVPLIDYHYIRTDSREYQRNRAKIDTKPVEVSLLSANRKISNMIFSLNFYQKDAVGDNREKANYLLYFADSAGKVVSDTARIIADKTSDTAQERTFRCTFNLKSLSFDNKEIYYLVITDESGLQLPQREEFQIDIASEVDEFKFFMSGIDASRLAEELNALLEHGRIVTWLDRNGEYAEDLDAVRELLDGATLITINANLFETKLRIFAEDTKSRYVLYCGGELPPLEEDLLADVRCGYPTFKADASTLLVRELGVDPGLAAVIDEYAPFFNSTARVADLKKHLGAISDADKRSDRRTFLAAMSAVLLKTQQRSFSVLFAKLASMTQDNPLDALKWGLDAYFWEGAHAIWGYDGEHSFDALMTWLFVMNANGWDHRHNSAQRDFSMWTRDVATRDDARRWARRVDEATGASAALRDAATDALLIDTTTPGVDRELISRLVRGIIDGSVGVAQVEEQRGRRREGLWFDDTEALWDAARAGARLLTHLRALPGIAFSDAAEGFARYTNPDSGLWAIDQEYRHYVRASRAVHVDDVLTDLDRHVENAYCDDYLRPLSRTWDDALRGMRTWDIAVPSSSGRIDSFHRLLVAGSHRRTVVIISDALRYEAGVELADHLRSLGRGAIALNPWYTMLPSITALGMAALLPHRELTLNVRGKDQVVVEADGRPTSGIDARRTILEGADGRAFTYQELASDSVKSMRSKFKGASAVYIYHDVIDAIGDHAASESDTPDAVNRAIAELSGLVGKLISADITRILVTADHGFLFQDSEPANDDTAKQDGVPRGRSVSVKKRRYVLGKDLGSTDDFVAFDATSVGLTDGPSIALPYGTRRIRTQGRGNRFVHGGASLQEITTPVIEVSVGSRGAEDVRDVGIALHYDDMSLKVNRFSPRVIQREPISPTRRPLTVTIGLESMLGEQLSSTRVLTLDAAERSEVSLKQSSELILFDGVLQRHSGEAVRIVAYKTVHGQVVGEAVATHELTLNDNGFGGFGGFGGFDL

SEQ ID NO: 1907 - protein, 885 aa, Vibrio cholerae
MQISELAQGVAAKLEQSRIVFWYDPEQSFTEELEHLANVLSIAKEVGDSAADITARVLPNDLTILNMGNESVLAVKKRIEVDEPEAKFLIYFPSAEPEPDRDWLLDVRLYSEQFFADHSSMLLNELGIPKMALRTHIRKRQSFFANKQRIAGLKKWVTENEDELSLDRKMMAVVVKADSASLSDILLGLLREYAAYIEDESLGQPLWSQLSKFDLETSLWAYLSEGFGYTVEEPTFSDFVLKLFCTEFWSQIEGVERDWLLNNVLKSASGRATALAFMVSWRDSRSFAAYYESISKVLSQQLEISTRAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYEKEVRTRLSLKQTKRVFVIISDALRFEIANELGAIINNEKRFKAEVSTQLGVLPSYTQLGMAALLPHKALSYQPEQGTAVYVDGISSQGLENRNSILQKVGGMAVSSKELMSWSNQEGRDKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSDTEFLLPKAAQRFHFVGGAKFVHGGAMLQEVCVPVLHVRELQKEQAAKHEKQPVGVVAATQPIKLVNNIDKVRFIQTDPVGDRFVARLLDVYIVDAQGNEVSSRETINFDSVSKVMDERTREARLKLIGSQFDRNAQYTLVLENAEMRTRYSQYAVTIDLAFQDDFF

SEQ ID NO: 1908 - protein, 899 aa, Vibrio harveyi
MNIDQISQGLLNKFEHSRLVFWQDTDKEFIDQLDELSIDGIEIIHLDDKSHFEVKTRVELLEPATRFVLYSNTETNKPERDWLYDIRLYSEDFYADSSSMILNEIGMRMEFRQVISHYRAFFTAKVRRERLKKLLPHSANKEELELALLAATLKVESPTFPAILNHLLLKLADGIDVNTIFSDLEKYNLVDTFWRFAFDVMGYQVEKFDDTEQIQPHLNDLVTKLLFTECYQSLLNSGINGNHEVFARFKQHLLPINLDESGKRDYTERRTFNSSKRATAISFIKGMRENRNLSNAYNTLAKQVEQEFEIKHILSMVKSPTHLHRVDTFEYAEQHFIILLAQQLSDLDQVEVDSLISHRLTTHWTHHQPNYAAILKAIRAAKQFYALKQQYIDGFNFSSAKEMYRAYETDLYKFDSAYRRFCEHALKVAHNGSDILKKTGLVSDIETLYVDWYLHDLAIAWGKLVDEESLLDNWKISGVPNQNEFYRRQVEGIFNTTQVKKVFVIVSDALRYEVAHAISDQINNEKRFHSEIKSQLGVVPSYTQLGMASLLPHNEISTHINSTVEYKVDGISARGTDNRNKILAKRNGIAFKASEVLNWTNEEGREKVHDARVIYIYHNEIDKVGDKGESEHQTFEACATAISEIKQLIERIINRLNGSRVLITADHGFIFKSSDVVDSDRTALTVKPKGAVEAKKRYIIGESLPNDSFYWHGKMTNTASLTVNSECSDGEFIVPRGSNRFNFVGGAKFIHGGIMPQEICVPVIQVKELTTNKLQSRYAKERVPVVPLSNPIRLVSMADKIELFQAAAVGEKYTARELEIWIADPNGQPVSHKQKVMFDATSEKQDDRKRNIVIMLNGTGFDRTVSYKLMMKDVSDPTKTQELQPHSVTIDIAIEDDFF

SEQ ID NO: 1909 - protein, 880 aa, Lachnospiraceae bacterium
MDTDKIIQDLNRRFAAPLPEFYQRRIIFWYDEDKEFEDKLDEVVLENAKVIALTENNAFSVKKLLSVDDLTTNYLVYSPCVYNCPDDNWLLDVELYSEEFRADLISIWMDEMGLISNPAMRKQVKNYRAYFNAKDRRLKVSTQNKVPETPAQLHMAVMAAICGLKDAQPNMILRSVFQAGLDLNNNTVYQDFVKYHADAAFWAMVRQGCGFVEEEPDLGRLAIHLLLTAATRTMRQEYLAGLDGFISMPHQAYCYDFIAEWLHSDNIQQLYDVARYVEDEARLHQRFEKLTVEALVGTECFPCINEVILTKLMTEISDHIIDVDTITNTVEKRRTCVWYEPFENFYDGILQVANMQSFFKEHSAGFHTAEAKSIWKEYTESYYQMDTYYRLFHLSFQKSLETSNILLDDLFKHVVDKVEGLYNHWFLGELGNNWSDVCADELATYGKVLEVPQQEDFYRSRIQTSDTKVFVIISDAMRYEVAATMADQLQRETQSKVSISSMQSIFPSTTKFGMAALLPHKELTVEVRNDILTVLADGQSTASTYRDKVLKTEDSASVALKYNDIIAMKRAERSALVKGMDVIYIYHDTIDEASHTSDTAVFAACDKAISELKNLVRIIVNEFGGTNILITADHGFLYTYSPLKEEDKVDKRGFFDVDVTNSDITKKESIKRCVEYGRRYAIMQKGVQPDYLMPVKFLGGNTEFDGFAPRESIRIKMNGGGMNFVHGGISLQEMVVPVIEYHYLRNDSMEYKRNKQKYDTKPVTVNLLSANRKISNMIFSLNFYQKDAVSTNREAATYQVYFTDEYGKQISDVQKIIADKTSDNGAERTFRCQFNLKSLKYSNTATYYLVIADEQGLQLPQREPFQIDIAFAVDEFDFFS

SEQ ID NO: 1910 - protein, 865 aa, Escherichia coli
MQNQDFIAGLKAKFAEHRIVFWHDPDKRFIEELEQLELENVTLINMTHASQLSVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHCLDSVLWEMLNHEMGYQAEEPSLENLLLKLFCTDLSAQADPQQRAWLEKNVLLTPSGRASALAFMVTWRADRRYKDAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 1911 - protein, 865 aa, Coprobacillus sp.
MDAEKIIQDLNRRFAAPLPEFYQRRIIFWYDEDKEFEDKLDEVVLENAKVVALTGSNTFSIKKLLSVDDLTTNYLVYDPLVYDQPDDNWLLDVELYSEEFRADLISIWMDEMGLASNQAMRKQVKNYRAYFNAKERRQKVSSQNKIPATPAQLHMAVMAAICGLKEAQPNKILRSVFRAGLDLNHNAVYQDFVKYHADSAFWAMVRQGCGFTEEEPDLGQLAIHLLLTAATRTMRQEYLAGLDKFISVPHQAYCYDFISEWLHGEDVQQLYDVARYVEEEARLHQRFEKLTVDDLAVTECFPCINEVILTKLMTEISDHIIDVDTIVSTVEKRRTCAWYEPFENFYNGILQVANMQSFFKEHSAGFHTAEAKGIWKEYTESYYRMDTYYRLFHLSFQKSLETSNILLDDLFKHVVDKVEGLYTHWFLGELGNNWSDVCAEELATYGKVLEVPQQENFYSSRIRTSENKVFVIVSDAMRYEVAAAMADQLQRETQSKVAISSMQSIFPSITKFGMAALLPHKKLTAELRNDILTVLADGQPTASGYRDKILKLEDSASVALKYNDIIAMKRAERSALVKGMDVVYIYHDTIDEASHTSDTAVFAACDKAISELKNLVRIIVNEFGGTNILITADHGFLYTYSPLTEDDKVDKSSFNGMDVEYGRRYAIMQKGAQPNYLLPVKFLGGNAEYDGFAPRESIRIKMNGGGLNFVHGGISLQEMVVPVIEYHYLRNDSMEYKRNKQKYDTKPVTVNLLSANRKISNMIFSLNFYQKDAVGANREAATYQVYFTDENGKQISDVQKIIADKTSDNGAERTFRCQFNLKSLKYSNTATYYLVIADEQGLQMPQREPFQIDIAFAVDEFDFFS

SEQ ID NO: 1912 - protein, 840 aa, Enterococcus faecium
MTDINTQQIEEKLNQRFPNYGCRKIIFWFDSNQDFLEEIDSLVIQNAKIYRLEKDAQFKTKRLLEYEDPETNYLIYAPFPRWDDKDEDNHLLSVLNYSEEFSADRLAIIMNELAIPLRFHQTVKQYRNFFNAKDRMRSFGEFSTHMTINKSETIELMIMAVLLKSKSIRLNDLLRVVLKSFTESRENPLRELDKYQLTAKFWEFIQMKFGFTDSQPTLEKLTMCLYLNYFYYQIDQEMPKKFKGFEILHLKANIITFMDQFMNDTRYMESFEQLSKKVYQAIDGDGLLDSIEIDDLIEADVFSEIHAKILMFYAERLKASDTTTKIAGQTIFDSLKQREKMHFASDYIYEYQLLKHAYYLVDKNRLCLPMNMDNLLTQYEKEMYWVDTHYRKFIWNSDHIEEKQKYGQLYRLVEANYSKFLDQSGQIWNQTFEFKNRPSIRKFYNQAVMKRSVKTVVIISDAFRYELGMNLERKLVREKKYSTNMASFLSVLPSVTEFGKAALLPNNQLTYNEGTEVLIDGKKTNGLSNRNAILQQRDANAVALNYDDVVKMNKAEVREVFNGKSVIYIYHDQVDRTGDHSNENRVFEACDLAISEISRLINRLHNDGSIYRFIVTADHGFIYKRSHVEEVDKIENPSRNEKDRVERRFILSEEEYEIIGTKNYSLGDSLGNDDTRNICVPITSSIFKKAGGGQSYVHGGSSIQEMLVPVLEITVAKGSNAKEPVAIELMTSNRRITGLSTTLEFYQKNAISDVYDPASFWLYFEDEYGERISNEEIYVADSKTEDANQRFTKFVFEFVNRRYTVEDTYYLVIKNQKNDLTERIKFIIDNPFAESFDFDI

SEQ ID NO: 1913 - protein, 767 aa, Vibrio cholerae; identical to SEQ ID NO: 1828

SEQ ID NO: 1914 - protein, 865 aa, Escherichia coli
MQNQDFIAGLKAKFAEHRIVFWHDPDKRFIEELEQLKLENVTLINMTHASQLAVKKRIEMDEPEQQFLLWFPHDAPPHEQDWLLDIRLYSSEFHADFAAITLNTLGIPQLGLREHIQRRKAFFSTKRTQALKNLVTEQEDETSLDKKMIAVIAGAKTAKTEDILFNLITQYVNQQTEDDSELENTQAMLKRHGLDPVLWEMLNHEMGYQAEEPSLENLLLKLFCTDLSAQADRQQRAWLEKNVLLTPSGRASALAFMVTWRADRRYKEAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEMVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGAHFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGASFNRRNEYWLILEDAQTETGYQKYPVIIDLAFQDDFF

SEQ ID NO: 1915 - protein, 836 aa, Lachnospiraceae oral
MAELNLKQIIDRLNEEFMGDTRKLVFWYDDKAEFVEDIQGIELINAKVYFLKPDNQFYTKYFLERKDLENNYLIYAPFKKPDVKDNHLEDTLLYSKKFFADRASLLTLDLGIDEKYKAVIEKHIKFFANKERSRRFYDLEIENFNEENIIIGILSSICHTKTSSFEEAVRVILTDGGLNDNKFISEIKKYDLINDFWKLAEKYFGYTDINPTLENFLNTLFVTYTAKHISSEIPKEWKTLLSYKSGNIIAFIDSMMNSVLYSEKYDELSDFVDAALGVKKIFTEYPPEALLNCDTFLCIDKILIDWIVDRLNVEDIGAKLCDLSIPEIADKREKMHFGSKTGCIYRMLKSAYHIVAVGKYSCPDNFSDILEQYLSTDYRIDQEYRNFYFEFDKLEDTHIFERLRELVENIYTNEYLNTLLPKWNGALREEEAFTKFPLQIDFYDSNIRNAKERTVVIISDAMRYEVGQELYKNLADDPKCRAKLDTQLSVLPSYTRLGMAALLPHKSITMTDGFQVLVDDILCDNLTGRQNVLQKHSPNSICIQFDDIKNLKKIELRDIFTGKQVVYVYHNQIDARGDKANTEDEVFVACKEAVEEIVDLIRRISVNANTYHFIITADHGFIYKRDKVTESDKISGVNDKNAFVNRRFIVAENALKEDGIMAISMGKILRNQDTKVVSFPISSNVFKVSGGGQNFVHGGSSPQEMLIPVLDVKMERGHIDTRNAGIVLISMVQKITRKTIMLDFIQSEPVSDTIKATKYKIFFISDDNEKISNEVSLFADSRETDANKRIFRMKFGFKDKKYDKDKRYYLVVVDENTGEEILRHSVIMDLVFGDEF

SEQ ID NO: 1916 - protein, 502 aa, Lachnospiraceae oral
MSELNLKQIIDRLNEEFMGDTRKLVFWYDDKGEFAEDVKDKHLEDTLLYSKRFFTDRVSLLSLDLGIDEKYKAVTAINYSCNDDFSSILEQYISFDYKIDQEYRNFYYKFDNLDDTYIFEGLRELVESIYTNEYLNKPIPKWNDTLQEEDVFTKLPLQIDFYDSNVQNAKERTVVIISDAMRYEVGQELYSNLADDPKCMAKLDKQLSVLPSYTRLGMAALLPHDNIIITDNYQVLVDDVLCDNLLGRQTVLQKHSPNSICVQFDDIKNLKKAELRDIFTGKQIIYIYHNQIDARGDKANTYHFIITADHGFIYKRDKVTESDKISGVNDKNAFVNRRFIVADNAVNEDGIASISIGRVLRNKNTKVVSFPISSNVFKVSGGGQNFVHGGSSPQEMLVPVLDVKMERGHMDTKNASIFYGKVKLCVEKFESKKDKEEYYRLKIYTKKKNGSWVYKSEVFRGKQEDIIQEDRVYEIAMFGHLDFTYSNSPKIKLETKDALLYR

SEQ ID NO: 1917 - protein, 867 aa, Salmonella enterica
MTLQNQEFIAGLKAKFAEHRIVFWHDPDKRFLEELDNLELENVTLLDMTDQSQLAVKKRIEIDEPEQQFLLWFPHDVPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLATPSGRASALAFMVTWRADRRYKDAYDYCAQQMQDALRPEDQYRLSSPYDLHECETTLSIEQTIIHALVTQLLEESTTLDREAFKKLLSERQSKYWCQTRQEYYAIYDALRQAERLLNLRNRHIDGFHYQDSATFWKAYCEELFRFDQAYRLFNEYALLVHSKGAMILKNLDDYIEALYSNWYLAELSRSWNKVLEAENRMQDWRIAGVPRQQNFYNEVVKPQFNNPQIKRVFVIISDALRYEVAEELGNQINTEKRFTAELRSQLGVLPSYTQLGMAALLPHDEICYQAGNGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDSSEFLIPKGIQRFHFSGGARFVHGGAMLQEVCVPVLQVKALQKTAAEKQPQRRPVDIVNYHPLIKLVNNIDKVSLLQTHPVGELYEPRTLNIFIIDNANNVVSGKERICFDSDNNTMEKRVRDVTLKLIGANFNRRNEYWLILEDAQTETGYQKYPVIIDLAFQDDFF

SEQ ID NO: 1918 - protein, 865 aa, Pectobacterium wasabiae
MQNKELVAGLTDKFLHHRIVFWHDPEQRFTDSLHELDLDNVTLLDMRGVSVFATKKRIEIDEPVQKFLLYFISEVPAREQDWLLDIRLYSTEFHADYAAITLNSLGIPQLGLREHIQLRKAFFTVKRTQILKGWVTERETESSLDKKMLAVVVGASTFETKEILFALIQQFIAARQHDDSALENTFAVLKKLGLDEVLWEILRLELGYQSESSSLDNMLLKLFCTDLWAQGDEAHRDWLSKNVLATAAGRASSLAFMGAWRNDRRYKAEYDYCAEDLQQTLQPKEHYNYSSPYTLAKCETFESIEQLIIRGLVTQLQEESTTLDRDAFKALVSERSAKYWSQTRPEYLAIWNAIRQAERLLNLRNLYTDGFNFPDTGTFWKAYCDEIYRFDQTYRLFNEYATPVHSKGAMILHELDKFIEELYSNWYLSELSRCWNKLLEAESRIQAWQFSGIPLQRNFYKDNVKRQFDTSQVKRIFVVISDALRYEVAEELGRHINHEKHFSAELRSQTGVLPSYTQLGMAALLPHESLSYLPDNSGVVYADGMSTSGFEKRAAILAKVNGVALKAKDLQNANNQEVNDQIRNASVVYIWHDTIDAMGDKASTEDKTFEACRSAITELKDLVSRLRSRFNASRIFVTADHGFLFQQQALVEQDKTKLDSKAANTIEAKKRYIVGHQLPESEFCWHGKLADTAGASDESEFLLPKGIQRFHFAGGARFVHGGAMLQEVCVPVLKIRALEKKAAEKQPQRQPVSIVARDQVIKLVNSIDKVGFIQTLAVNELNEPRTLNIFIVDENNQVVSGMETVCFDSDNEDMGKRTRDVTMKLMGTAFHRKNKYVLILENADSATEYGRYPITIDLAFQDDFF

SEQ ID NO: 1919 - protein, 865 aa, Escherichia coli
MQNQDFIAGLKAKFAEHRIVFWHDPDKRFIEELEQLELENVTLINMTHASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKDAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 1920 - protein, 862 aa, Ruminococcaceae bacterium
MSEERIQFDLIERFTAPLPEFYQRRIIFWQDEDREFESMLDELYIPDVTILKLTGTNNFAVKKLLLHDDLTDNYLIYNPFSYADPKDNWLLDIEKFSEEYRSDLISTRMNELNIEASPAMRKTVKLYAKFFDSKERIERLKRIGREYHTPLQLHIDIMAVLAGLNGGSAQDVFIAVLSAGQGEENNAVLSNIKKFGNIDAFWQLVRKYTGYIHEDEKALDLFAAHVLLTALAQTMNPSVLKGLERFISDSNKAYCYSIVHEWRNREDNGALWELCRSVEQELHLASRFEKQDIETLLTADIFPSIHEVILSRFFSEIADHVVKTELMLKTAENRRTSGWIERFENYYDSLYYVAKMQNFYQENAAGFHIVEPKAIWKLYTEKAYEMDSFYRHFHYAFGCTLKNSNVLLEDKLKHAADYVEGLYQNWFLKELTGCWTKAISDNLAALGYVSEIGKQRDFYSHYVKPLAGKNSRAFVIISDALRYEVAAELCDTITRTTKGTAKLDAVQAVFPSITKFGMAALLPGRKLSVNDGMDVLVDEMPTRSTDERGKILCAANMNSVAVQYMDVLNMKRAERRELVSGKEVVYIYHNTIDAIGDKAPTEKKVFDACEDAMQELSNILRIVINDMQGTDIFITADHGFLYTYSPLTESDKLGKDAISGKVYEIGRRYVLAEPSAAAEYLVPVQLDGEIVGTPVKGYTPFDSTRIRVSGGGENYVHGGISLQELVVPVISFKNLRSTSKKYVEVSNAELKLLSESRKVSNLLFSLDFYQRQPVGEKIQPCTYYIYMTDDEGVVISDRQTVIADRTSTNASERVFRVRLNLKAGAYDKNKIYRLVIANDTDVPEEAEFHIDIAFADDFGFDL

SEQ ID NO: 1921 - protein, 879 aa, Holophaga foetida
MAKPEQELKPILDALQRFYDQEGSRIVFWHDPAREFVNALAGCMLLDIGSHAVTVLDLTPPRSDLALKLRLEQEDPQGKFLLYAPFEEPDADRDWLLDIRLYSQTFRADRASIHLQELGLASQDLHGHLTQRAKFLDAKERVEKLRRLVNPGDGALDLDLKMMALVLKAEQPEPFVLLRTLFHAFLDGEAPDLDTPPSPWKDLVKFDLAPTFWGLMKQLFGYGDAQPSLQNLLLRLLVADFGHALREPLPQALRALDLPKDKVPNVVACLAQWRDSSRHAASYDALALQVESRLKLKDHLSGFEGEALAGVMTFPIVERAIASRLKDRVLTVVNAEHVQAIQAMAVRRQAGHWATPQIGSTPEVPRETFFAIYEALGAAASLFELRMQVQTGGFPTSSPEALYQAYEARLYRFDQLYRQFNEGAVKALELNLLKDLQKPVENVYLNGFLKPLAMAWDGCLESRLQDWRLSDVVGQPQFWDQYVAPRQDGRSRTFVIISDAFRYEAAQELTSELNGKYRVEADLSSCLGVLPSITSLGMASLLPHQVMTLTEEGQPLLDGQPAASLEQRAKILQAHGGMACKAEDLMAMKKDEGRAYVEGAKVVYVYHNLVDTTGETRGSEEDTFKAVRGTITFLARLANHIVNSLNGNHVVITADHGFIFTQSDPGETEKSKLGSEVQGAFPKKSKKRYVMGRKLPKVDFAFQGKVACAKGDAEFLVPRGIQRFHFVGGARFIHGGATLQEVVVPVVVIRHRRGSAAKGTEIRTVQVQVLGASHKITTAKHGFELIQTDAVSERVKPLTVKLAIYEGSDLTTPISDVQTLTFSNTSDSLEQRKQRVLLTLREGAYNRTTPYRLVLREAETSIELQSVPVTIDRAFTDDF

SEQ ID NO: 1922 - protein, 867 aa, Escherichia coli
MNLQNQDFIAGLKAKFAEHRIVFWHDPDKRFIEELEQLELENVTLINMTHASQLSVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHCLDSVLWEMLNHEMGYQAEEPSLENLLLKLFCTDLSAQADPQQRAWLEKNVLLTPSGRASALAFMVTWRADRRYKDAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 1923 - protein, 840 aa, Oribacterium sp.
MAELNLKQIIDRLNAEFTGDTRKLVFWYDDKAEFAEDIDAIELDNAKVYKLEPDNQFMTKRFLEREDTSTNYLIYAPFPKPDVKDNHLEDTLLYSKRFFADRASLLSVDLGIEEKYKPIIEKHIKFFANKERTQRFYDLEIENFNEENILVGLLSAICKTRTCTFEEVLRVVLTEGTLEENKSLLEMEKYDLQNSFWKLCEQQFGYTDEKPTLEKLVLTLFVTETARQLGNNVPQSWKAFISYKAGNSIAFLDSLMNSVLYSERFDQLSMHVSDSLNISATFKEMEAEELTEVDTFIAADQVLVKWIVERLIAEDTGAKLNQTGIPELCEKRMKMHFGSRTRKIYRLLLSAYHLLLAANYNCPDEFKEIIKQYREKDYKTDQEYRKFYYNFDQIEDTGAFESLRNLVENIYTNEYLGKIMPMWNEGIEENNAFHEIPLQRDFYNHYLKYAKERTVVIISDAMRYEVGEELFKRMIDDPKCIAKIEVQLSVLPSYTRLGMAALLPHQKLVMTDDFRVLVDDVLCNDLVGRQKVLQKHQEDSICVQFDEIKGLKKNELRDIFTGKQLVYVYHNQIDARGDKATTEDEVFVACEEAIAEIMELIRKISTNANTYRFVVTSDHGFIYKRDKLCESDKISTISDKQAFINRRFVVAKSALIAEGVKSLSMGRILDNDDTKVVSFPVSSNVFKVTGGGQNFVHGGSSPQEMLVPVLDIKMERGHMETRPAQIALVSIVQKITNLITTMDFIQSEAVTDMIKKTTYKLYFISEDNEKISNENTYIADNREVDAQKRIFRMRFTFKNKKYDKNKQYYLVVYDDATGIESFRHPVIMDLAFADDFGFSF

SEQ ID NO: 1924 - protein, 865 aa, Escherichia coli
MQNQDFIAGLKAKFAEHRIVFWHDPDKRFIEELEQLELENVTIINMTHASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKDAYDYCAQQMQAALHPEDHYRLSSPYDLHECETTLSIEQTIIHALVTQLLEESTTLDREAFKKLLSERQSKYWCQTQPEYCAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 1925 - protein, 873 aa, Acinetobacter johnsonii
MNLDQLQKGLEQAFYTENHRIVFWYDAEQSFSDEIQALKLKDVQILNMAEESSLAIKLKLELQDQQGKYLLYFPSAEPETEKDWLLDIKLYSRSFYADRFSIIFNELGLQQQSLREHLAKREEFLKAKARLSTLKRYIQPDADAQDLDMAMIAAVVKADSAELMHIVLALADEMVQQNLGLEVNPESFAELEKFQLVPALVTALQAEIGYPASVEELNGEAPFKLGTFFIRLMSTGFCESLGDIPLWAQELVMSSVSSRATARAFLSRWRDSSKYYPTFDKLSQSVANALRIQEKVGAFDLEQLLDVMTFEVIEQKIIVDLASQIPAATKAELEHFRTIISTRLDGYWASKHKDDATRRKYRTVYTALQAAIDLFSLRLQFDAGFYFDSSEALYKAYEQELYRFDMAYRHYSAASQRAHVDILKKLDEEVENCYSYWFIDHLARNWGERIEAEQRLNVWKVADIPNQQNFYDIHVRPLLSSATKRRIVVIISDAFRYEAAVELRDRINEKRYSEATLSSQLGVVPSYTTLGMASLLPHQTLEYKEAAGDDVLVDGQSSKGTAARSKILAAYNGLAVTAETVKGWSRDEGREALKDHELIYVYHNVIDARGDSASTESETFMAVEHAIEELTELSRKILMHFNISTLLITADHGFLFQHKLESADRSSLTEKPANTLKSKKRYVIGHGLPESKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDLKVSSEETLTFDSSTDSVADRVKQVRLSLSGTDFDRKKDYFLVLKDKDLNIEMQRYKVTIDLAFTDDFF

SEQ ID NO: 1926 - protein, 863 aa, Selenomonas sputigena; identical to SEQ ID NO: 1810

SEQ ID NO: 1927 - protein, 874 aa, Acinetobacter junii
MNLSQLQQGLEQAFYTEQHRIVFWYDAEQSFTEEIKALELNDVQILNMAEESSLAIKLKLELEDQQGKYLLYFPSAEPETEKDWLLDIKLYSRSFYADRFSIIFNELGLQQQSLREHLAKREEFLKAKARLSTLKRYIQSDADEQDLDMAMIAAVVKADSAELMHIVLALADEMVQQNLDLEVNPDSFAELEKFQLVPALVTALQAEIGYPASVEELNGEVPFKLGTFFIRLMTTGFCESLGDIPLWAQELVMSSVSSRATARAFLSRWRDSSKYYPTFDTLSQTVANALRIQEKVGAFDLEQLLDVMTFEVIEQKIIVDLASQIPAATKAELEHFRTIISTRLDGYWASKHKDDATRRKYRTVYTALQAAIELFSLRLQFDAGFYFDSSEALYKAYEQDLYRFDMAYRHYSAASQRAHVDILKKLDEEVENCYSYWFIDHLARNWGERVEAEQRLNVWKVADIPNQQNFYHTHVSPLLSSATKRRIVVIISDAFRYEAAVELRDRINEKRYSEATLSSQLGVVPSYTTLGMASLLPHQTLEYKEATGDDVWVDGQSSKGTAARSKILAAYNGLAVTAETVKGWSRDEGREALKDHELVYVYHNVIDARGDSASTESETFMAVEHAIEELTELSRKILMHFNISTLLITADHGFLFQQSKLESADRSSLTEKPTNALKSKKRYVIGHGLPESKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDLKVSSEETLTFDSSTDSVAERVKQVRLSLSGTDFDRKKDYFLVLKDKDLNIEMQRYKVTIDLAFTDDFF

SEQ ID NO: 1928 - protein, 921 aa, Shewanella baltica
MQISELAQGVAAKLEQSRIVFWYDPEQSFTEELEHLANALSSAKESIAKEALSKETNDKAADITARVLPNDLTILNMDNESVLAVKKRIEVDEREAKFLIYFPSAEPEPDRDWLLDVRLYSEQFFADHSSMLLNELGIPKMALRTHIRKRQGFFANKQRIAGLKKWVTENEDELTLDRKMMAVVVKADSASLSDILLGLLRAYSMAQDVPAAGVDGLSEDGSLGQPDVFQQVWSQLSKFALETSLWAYLSEGFGYTVEEPTFSDFVLKLFCTEFWSQIEGVERDWLLNNVLKSASGRATALAFMVSWRDSRSFAAYYESISNVLSQQLEIATRAGQYHPAELIECETFEAVEQAIIRGLVRDLLDSSKALDRVQFDTVLSRRLASHWTLPNSKNGKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYEKEVRTRLSLKQTKRVFVIISDALRFEIANELGAIINNEKRFKAEVSTQLGVLPSYTQLGMAALLPHKALSYQLLSSSGASGGTAVYVDGLSSQGLDNRNTILQKVGGMAVSSKELMNWSNQEGREKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSNTEFLLPKAAQRFHFVGGAKFVHGGAMLQEVCVPVLHVRELQKEQAAKHEKQPVGVVAATQPIKLVNNIDKVRFIQTDPVGERFVARLLDIYIVDVKGNEVSSREMINFDSVSKVMDERTREARLKLIGSQFDRNAQYTLVLENAETRTRYSQYAVTIDLAFQDDFF

SEQ ID NO: 1929 - protein, 767 aa, Vibrio cholerae; identical to SEQ ID NO: 1828

SEQ ID NO: 1930 - protein, 865 aa, Escherichia coli
MQNQDFIAGLKAKFAEHRIVFWHDPDKRFIEELEQLKLENVTLINMTHESQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKEAYDYCAQQMQTALHPEDHYRLSSPYDLHECETTLSIEQTIIHALVTQLLEESTTLDRETFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIVSDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVANTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 1931 - protein, 876 aa, Halomonas sp.
MDSKQLTQGLQHAFFTDHHRIVFWYDAPGHFAESLSELALEGVQVITMAGESTLGVKLRLELEEPDTPTLLYFPYAEPALEDDWLLDIKLYSGRFYADRVSMIFNELGLTRHVMREHLAQRQAFLASRKRIEGLKRLVTPSMSEDELDLAMLAVVVGAASVDVATLLFHLAEEAVTHELGLEANPAALVESEKYALVPAFVRVLQAEVGYPASREELSGETPLNFGQLMLRLLITGYCESISDIPDWARQVAIPSVNARASSRALLTRWRDSSRFYPAFDVISGWVADAQRIDDKLHNVPLEQLSNVATFEVVEKQIIVDLCQAIPTADVRDLRLFDSIIVERLDGYWASRHKNDARRERYRQLYAALTAAIALFSLRHQHAKGFHFESVEALYHAYQTDLYRFDTAYRHYAVASDATSVELLKNLDTAVERCYDEWFLGQLTRNWSERVEAEQRLTHWKLPNIPNQQNFYRDWVQPQLAASRQKRVVVVISDAFRYEAAEELRERINAKRYSEATLKSQLGVVPSYTTLGMASLLPHRELSYQPGSDTVLVNGQSTQGTVNRSKLLKEALGGEAMAVTADEVKGWSREEGREKIKGVQLMYVYHNVVDARGDSANTESETFAAVEDAIDELDQLTRKILMHLNTSTVLVTADHGFLFQRSALDATDRTALTDKPGSAFKSKKRYVLGESLPDNPSVWHGHTRDTAGTTCETQFWIPKGAHRFHFVGGARFVHGGIMPQEIVVPVLTIQQLRGEKAEKRSTRKVEVISPKASLKMVNNIQRFDLLQTEAVSERLRPVTLSVAIYEGSHVVSSEEVITFDSASDNMNERMKSVRLSLSGTSCDRKNDYFLVLRDKDLGTERERYRVVIDLAFTDDFF

SEQ ID NO: 1932 - protein, 881 aa, Bifidobacterium angulatum
MSENSQVTRLLARRFSQPGERGRIVFWRDDKKQYADVVETLVGERTTDEILREVELITPEIGDENDRRYIPFTVRYRMFHEQPNQKFLVYLTEPAPAVQDNWLLDLELAYGPTFTMDKLAVTLTETLPGASADTRNEWLEVMKRVPKFFDSEERAKRFAKRLNVHDDVTDFQAKMIATLLQLKDDRHSMQDIWAELLTQYSQGDDSGITAIERMGLSMFHWTGTRRIYRFDVDTDAGNEPTVKDFVLWLFQLAWNGFSDGRNAVSAYANIIRDWDDWYKNIDMRTVLQNLSENAVEELHLSTRIADMSVEELADRDLFRDVDEMIVNKLFERLGSQSITDDEVQRIINGRKQKLWYAEYTDQYECIAAASRLRAVLTECSGLISTISSPEQGMKLYAEKLYKADGAYRKYVLAWHRANPDAVSVDDDLQSAYEAYQQDLGQAWQKQVDTLSQWKFIDMDTQTNFYEREIAPVLKSGRKIAVIISDALRYEVAQELSERIDRESRFSTKLNMQYSVLPSYTQLGMAALLPHGSLEFDGKDRLYVLADGRSTKGIEARAAILSAVGGKAIRYDDLTKLKVSEIKELYKSCNVLYVYHNHIDATGDTEKTESETAEACEKTFKELGEVVKKLASGNVHNMIITADHGFLYQDRDLDSTEWLSEQPKGDAVWVRKRRFSIGANLAPGRAFVTFNAAQIGMDDPRNEGISIQVPNSIMRLRMQGAGVKYVHGGAALQEIVVPVLHVSKGRSAADDVRAVEFTILQRTDRLSSRQLTVEFFQNEPVGGKIRARTVLAGLWGRDTAGNNVLISNETPVAFDLLGQEKSERHVTATLMLTSDAERFNGTNIELRLREKTDGSNVLVMLDQKARYFFKQGVVADDAGFFD

SEQ ID NO: 1933 - protein, 767 aa, Vibrio cholerae; identical to SEQ ID NO: 1828

SEQ ID NO: 1934 - protein, 832 aa, Alcanivorax pacificus
MSDRISQALSRLFDKHRIVFWYDAKQELRGDFEAVSIPDVEKLEIANNEYGMKYRILRDSPEQKFLLYKEGPQPEDLDNWLLDVQLTHGEFRTDQVAIWLSELELGLEFAEVAQVHAEFFQANKRKDALKKLLKPDDTAGQLRLKMLAVCAGSEPRMDSVVETLLQQQAEERDDGIRLIERCGLDSFLGEQLARFYGYEASEPSLRDFVIELFKSCYAMGTDGEVKLTGDALVFLKRWKDSRQFEQGFETLSAECAEVLGIEQDLGKRDFRDLVELDYFRLIDQKIISDLVRAVVGRTVTSGDVALWVRQRRQGHWYGEFRHLYEAIEFAARFVQMLGEARLTMDSLSDGVQRYSRSWFQLDQLYRKFTYHVRMSGQASLMGELSEQVENLYSNNYLLKLGDGFQVHVDAAPRWEAYPVIQQKAFFEHWVRPYLRKDKRICVIISDAMRYEIGDELLGLIRQEDRYSAELEPALSTLPSYTQLGMAALLPNKSLAIADNDTGTVLVDGQSSQGTVNRTKILQAALDGRGQAVKAEDFMQLNREDSRELLKGNDVLYIYHNRIDHTGDKMHSEGQAFEAAEQTLDDLIRLIKKLTAANANNLLITADHGFIYQNRELDESDFLGDVVSGDDIRYRDRRFVLGKGLSASPAFHHFSSEQLGLDGDMEVQIPKSINRLRLKGSGSRFVHGGASLQEVVIPVLKVNKKRQSDVSAVEVDILRGSSSVITSGQLAVTLYQSGPVTEKVQPRYLRAGIYTQSGELISDSHELSFDLTSENPRERELQVRFVLSRKADEANGQEVFLKLEEQHAGTSHYKEYKSLRYLMRRSFTSDFDF

SEQ ID NO: 1935 - protein, 767 aa, Vibrio cholerae; identical to SEQ ID NO: 1828

SEQ ID NO: 1936 - protein, 767 aa, Vibrio cholerae; identical to SEQ ID NO: 1828

SEQ ID NO: 1937 - protein, 849 aa, gamma proteobacterium
MTQNRIQQNLARLFERQRIVFWYDDKKEFREAFESLEMEGVEKAEIQSNEFTLKHRILREEPKQNFLLYCEDKEPEYLNNWLLDVQLHSAVFRTDQSAIWLSEMNLPPDFADVVTEHEAFFDAGRAPKQAETRKQKLLDLLQPDDLKQHVRLKMLAVCADLHQLADVRLDVICENLFDELVEDTQPRFALIERCNLTGVLWEQIERHYGYVSETPSVKDFSIELFKSCYALSITNPKASDKAALNNDALVLFKRWKDSRKHEDVFESLSGSYAELLDIESDLNNRDLRDVIEMDYYRLIDQKIIVDLVKAVSQRTLSEGEVTKYCRERRQSHWYGAFKHLYTAIEVASQFLSALDTVQLNMSSTSDAVHGYVRHWYKIDQMYRKFIHALKSSGQMTLLNNLVDTVENLYTNRFLSPLATQWQGQVDAMDKWSVPDVIPQRQFYSNWVKRYSNRGSKICVIISDAFRYEAAEEMIGRINGEKRYQASLSHMLSSLPSYTQLGMASLLPSNGGEFTISDSDGSVSIGGVSTQGTANRDKLIKAALGDTACAQQAKSILDMTQSEGRELFKNHDVIYIYHNRIDHAGDKMQSEGEAFDATERTFDDLMILIKKLAAYNASNILITADHGFIYQNKPLDESDFLSADASGEVHYRDRRFLLGKGLSAPESIKVFSPEQLGLSGDVHAAIPKGIQRLRLSGSGSRFVHGGATLQEVIVPVISVNKSRQDDVAVVEVDLLRGGTNIISAGQLSVTLYQTEAVTDKLKPRQLRCGIYTSSGQLISDAHNVTMDLTSDNAREREMKLRFVLTQDADAANNQEVSLKLEEQVAGTNQYTEYKQLKYTIRRSFTSDFDF

SEQ ID NO: 1938 - protein, 865 aa, Escherichia coli; identical to SEQ ID NO: 1756

SEQ ID NO: 1939 - protein, 845 aa, Enterococcus faecalis
MSDLNLNQIQNRLNELFVTYGERKLIFWFDPKKEFEEDIINGKIELKDAKVFILEPNTQFMTKRFFEIEDTDNNYLIYAPFEKISDDDQDNHLLSILKYSSEFSADRISLVMTQLNIPNELHDAMVHYAKFFGARSRITAFNKLITTEIKSKQELEIAMMAVLTKANTAQFYSIIQSLLVEYAYESSSLYEQLVTFDLQNAFWKYVSLYYGFISETPTIQKLTVSFFVNAFYGQLGHQELPIQLKEYEVLEQTTAIISFMDGVMNDSRYTQAFDKLSGNTYRLISGEKLISLVPIEELIAADIFESVHNNIIKYYIGQLLSGDLTPIINGMTLSEVITLKQRAHFGAKYIHEYEVILNAQKLLNNTFSSNINQFSEVVKNYENISFNIDQSYRKFIWHFDKVLSPDLFTELKLRIEKQYKIFLNESARLWNDLLSLEERSSLLDFYDDFANNKTKTVVIISDALRYEIGKEIQEVLQYEKKFTTKMNTLFSVLPSVTEFGKAALLRSGHETYEYVEGTDIRVNGMKTQGTPARDKILKAKNSNSLAITYEEVMTKTNAKELREIFNGKEVIYLYHDQIDRTGDHGQESQVFDAAQKTVDEIKALIPFISNGANVYRFLITSDHGFIYTRSKVEEHEKIENPSEFSEDRVERRFIISENHYDEIGITSMKLGEILRNDDKRYVHYPETSAIFKKVGGGQSYVHGGSSPQEMLVPVLEVNVSRGSSQKEPVSVQLMTAKRKVIGLSISLEFYQTEALSDSITKAKYTLYFEDSKGNLITNQHTYYADSTSEQASERFTNFTFDFINRNYDTNEKIYLVVKNTETKIQVERIDFVIDNPFAGGFGFDI

SEQ ID NO: 1940 - protein, 875 aa, Pseudomonas syringae
MDSKQLTQGLHQAFFAENHRIVFWYDPEQNFADALNELDLPDVQVLNMQGKSTFGTKLQLELADTQGKYLLYFPCAEPDAEDDWLLDIKLFSRSFYADRVSMIFNELGLQQVSLREHLSRRESFLKSTARVSALKRLIQSNATAEELDQAMIAVLLGSAACDITTLLCTLADQVVRDDLGLESNPGVIDELYQHELMPALLQALRDEVGYPASAEEISGEKPFSFGHFLIRLLATGFCESISEIPDWASAIAIPSASARATSRALLSRWRDSSRFYKSYDVVSSWVGEALRISDKLGEFSLETLANIATFEAVERQIIIDLTQAIPSAAPSDLQVFSRIIGERLDNYWASRHKDDDIRRKYRLLYSALAAAIELFGLRLQFGAGFHYAGTEALYKAYEGELYRFDSAYRRYVAASQRARVELLKKLDEAVEHCYAYWYLDQLGRNWGDCVEAEQRLAHWNIAGVPSQQNFYERWVQPQFEKHRSKRVVVIISDAFRYEAAVELRERINEKRYSEATLSSQLGVLPSYTTLGMASLLPHQKLEYRESAADTVFVDGQSTAGTVQRDKILAQYQGIAVTADEVKAWSRDEGRERLKDKQLVYVYHNVIDDRSDSGGPSESDTFQHVEVAIEELTELTRKILMHFNTSTVVVTADHGFLFQQSKLEAANRTALVDKPDSAFKSKKRYVLGHTLPEAKDAWQGSTKQTAGTESDTRFWIPKGANRFHFVGGARFVHGGAMPQEIVVPVLTVNQLRGEKAGKRTRRKVGVISPKSVLKMVNSIQRFDLMQTEAVREQVLPVTVAVAIFEGGQMISSEEVVTFDCTTDSMNDRLKQVRLSLAGSDFDRKRDYFLVIRDKDLNTELERYRVTIDLAFTDDFL

SEQ ID NO: 1941 - protein, 865 aa, Escherichia coli; identical to SEQ ID NO: 1759

SEQ ID NO: 1942 - protein, 837 aa, Pseudanabaena biceps
MNERIAQALIKQFDRDRIIFWYDSKQELRDDFESLELDRVIKIELKNNEFAIKYRILREQPKQKFLIYHEGAQPADIDNWLLDVQLAYGQFRTDQVALLLADLELGLEFAEVIQAHTEFFQAIKRKDSLKRLLAANDTQGMIRLKMLAVCASADPRLDAIVEQLLAEHANDQDTKIKLINRCGLDGFLWEQMQRTYGYISAETSIKDFAIQLFKYCYFQNFANNSPLPTSHSSLSTDAIVFLKRWKDSRQFAESFEKLSDNCAEILNIEQDLYKRDLHQLIELDYFLIIDQKILSDLAIQLTARTISLSDITSTIYQRRTCHWYARFRDAYECINFAAQFIYTLAEANLSMDSIADGIQKYSQTWFRLDQYYRKVIYHSRSSNSKAISDLKDQIENLYTNNYLLKLSDRWQTFIDAAPKWEAIPIPSQKNFYERWVRPFLNRDNKICVIISDAMRYEIGDEFLSLIRQEDRYEATIEPALSMLPSYTQLGMAALLPNTSLAIADNETGHVLVDGQPSNGTANRDKILKQAGDRARAIAAEDLIALNRDESRELLKANDAIYIYHNRIDHTGDKLQSEGQAFEAAESTLKELIQLVKKLTAANANNILITADHGFIYQNQDLEQSDFLSQDVTGQTVLYRDRRFVLGKNLNRTDSVKFFDSNSLGLAGDIEVCIPKSINRLRLKGSGSRFVHGGATLQEITIPIIRINKKRQSDISSVEVEILRGSSSTITSGQLAVTFYQVQPTTDKVRSRHLRAGIYTQSGDLISDSHDLNFDIASENPRERELQIRFLLTKKADESNNQEVILRLEEKLSGTTHYQEYKSIRYLIRRSFTSDFDF

SEQ ID NO: 1943 - protein, 767 aa, Vibrio cholerae; identical to SEQ ID NO: 1828

SEQ ID NO: 1944 - protein, 767 aa, Vibrio cholerae; identical to SEQ ID NO: 1828

SEQ ID NO: 1945 - protein, 865 aa, Escherichia coli
MQNQDFIAGLKAKFAEHRIVFWHDPDKRFIEELEQLKLENVTLINMTHESQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEELSLENLLLKLFCTDLSAQADPQQRAWLEKNVLLTPSGRASALAFMVTWRADRRYKEAYDYCAQQMQTALHPEDHYRLSSPYDLHECETTLSIEQTIIHALVTQLLEESTTLDRETFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIVSDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVANTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 1946 - protein, 844 aa, Actinomyces sp.
MSGIDASALADGLRELLTRARLVTWLDQGREYTDQVDEVAALVPDAQLITVDHNEFATKLRVLRDQPKDAFILYRPGDLPPLDTDLLADIRCGYPAFSADASSMLARELDLDDDLTPILREYDGFFTRERIRRIKDRKIQINDKNKLLAVMSAVLLGIHDHSFSSIFVELANSDACEQAKIGKLKWGLADFFWEGARSIWKYQGDPELNNLMTWLFIEQRRGWDPALASAQRDFATWMGGVKNQDAVKVWATRISEDLGLAEELPSLDTADLERDLVTPGVDDQLIRRAVTSLIDGRSNAADVRTQRSRRASSLWKEESASAWEAAEAGGRFLHLVHTHRDAAFRTAGEGFALYTDAANGLWQVDQAYRHYVRASRAAGDPDVFGELDAAVETIYLHDFLRPLSAWWDAAVRALPTWRIPAHASSNPGRQSDFYDLMVRNAKKTAVIVSDALRYEAGAELAERLIARGGATVEITPWYTLLPSVTALGMAALLPNRSLSTGVRADALEVRADGEPTGGLAARDAVLRAASGDRITAHSYQTIAGMLRDDLRALGKGMAAIYVYHDHIDAVGDHAASESGTPEAVERALTDLAALVTRLRSADFHRILITADHGFLYQARPLPDDTTAKQGTAPRAEKILLKKRRYQLGDAMESSDDFAVFPAADVGLASGPDVALPFGMRRSRIQGRGDQFVHGGASLQEISVPVIEVNTTAGLKAHDVEVELSYSTSRISMTRITPKVIQKDPIAERIRPIEITVGIIDADTGKPLSNVERLTLDSVEATRLDRARTVELILLDGILQEYAGKTVLLAAHKVVNGMRASDAPVASLELEVRDTGFGGLGGFTL

SEQ ID NO: 1947 - protein, 708 aa, Fusobacterium necrophorum
MEKEKIKEMLEERFKVIPAYPRKRHILFWYDGQKAFQDIIEELQLDKVKIFRLQKGINRNGEEIDTNLFKIKYTLEILDTDSHYLIYSANPRPSKHENYLLDIESYSDFFEADKSAILVDDFGFDRKNHGIHDTIREYSEFFVSKERREKLRKLLENPLNTSEEKLKLSVLAVVVGTKIVDLQEILKNIIFDSSKLEQIKKWMGLSFLYEQILRKFHLSIESWEEFLKILVVVHFYREIQQKPSIHLESYYLGKTNELFIFTSSLFQNQNDSKHIQEIFYEVGKELNMKDRIEELEFEKMLLGNSFEYFEKRILQELVDRLQFGVVDYSQYISWIQERSHYSLWKEKYFYFYETLLSVAHLLKEKEQLEIQDRKTLSEILEDYTAHYYKIDQEYRNFYYSYDQIKSSELASIFDSFHSKISHFYEVEYLEVLLALWNEHLEERNSLVQQKDFYERYIKNSNTRVAVIISDALRYEVGEEITRQLEKEGNAKEIQISPLLTNLPSITSVGMTQLLPPGKDRSIDLFHNKMTVNGISTFSTENREKILKESCLESSAISYDTFKNKSRGEQEAYVKGKKVLYFYHDSIDAIGDKAKTEHRTFDACKMAMQDILSLTKILSSLGIVNIFISSDHGFLYERKEIEEYNKLELQEEYFLLGKRYAFSTKKVEEKGCITIPIEDFFGVFPQKIKESKWEEAVCNLYMEEVALRK

SEQ ID NO: 1948 - protein, 874 aa, Acinetobacter radioresistens
MNLSQLQQGLEQAFYTEQHRIVFWYDAEHSFTEEIKALKLNDVQILNMAEESSLAIKLKLELEDQQGKYLLYFPSAEPETEKDWLLDIKLYSRSFYADRFSIIFNELGLQQQSLREHLAKREEFLKAKARLSTLKRYIQSDADEQDLDMAMIAAVVKADSAELMHIVLALADEMVQQNLALEVNPESFAELEKFQLVPALVTALQAEIGYPASVEELNGEAPFKLGTFFIRLMTTGFCESLGDIPLWAQELVMSSVSSRATARAFLSRWRDSSKYYPTFDTLSQTVANALRIQEKVGAFDLEQLLDVMTFEVIEQKIIVDLASHIPAAAKAELEHFRTIISTRLDGYWASKHKDDATRRKYRTVYTALQAAIELFSLRLLFDAGFYFDSSEALYKAYEQELYRFDMAYRHYSAASQRAHVDILKKLDEEVENCYSYWFIDHLARNWGERVEAEQRLNVWKVADIPNQQNFYDTHVRPLLNSATKRRIVVIISDAFRYEAAVELRDRINEKRYSEATLSSQLGVVPSYTTLGMASLLPHQTLEYKEAAGDDVLVDGQSSKGTAARSKILAAYNGLAVTAEMVKGWSRDEGREALKDYELIYVYHNVIDARGDSASTESETFMAVEHAIEELTELSRKILMHFNISTLLITADHGFLFQQSKLESADRSSLTEKPTNTLKSKKRYVIGHGLPESKEAWKGSTQATAGTLSATDFWIPKGANRFHFVGGSRFVHGGIMPQEIVVPVLMVKQLRGEKAGQRTKRKVEVISTKSTLKMVNNIQKFDLMQTEAVSELVMPVTLSIAIYDGDLKVSSEETLTFDSTTDSVAERVKQVRLSLSGTDFDRKKDYFLVLKDKDLNIEVQRYKVTIDLAFTDDFF

SEQ ID NO: 1949 - protein, 767 aa, Vibrio cholerae; identical to SEQ ID NO: 1828

SEQ ID NO: 1950 - protein, 847 aa, Bifidobacterium bifidum
MDDVATLVGECATDEILREVELITPEIGDENDRRYIPFTVRYRMFHEQPNQKFLVYLTEPAPAVQDNWLLDLERAYGPTFTMDKLAVTLTETLPEASADTRKKWLEVMKRVPKFFDSEERAKRFAKRLNAHDDDTYFQAKMIATLLQLKEDRHSMQDIWAELLAQYSQGDESGIEEIEKMGLSQFHWNGTRRIYHFDVNTGTGAKPTVKDFVLWLFQLAWNGFSDGKNAVSTYANIIRDWDDWYKNIDMRMVLQNLSENAVEELHLSTRIADMSVEELAGRDLFRDVDEMIVNKLFERLGSQSITDNQVQRIINGRKQKLWYAEYTDQYECIAAASRLRAVLTECSGLISTISSPEQGMKLYAEKLYKADGAYRRYVLAWHRANPDAVSVDDDLQSAYEAYQQDLGQAWQKQVDTLSQWKFIDMDAQTNFYEREIAPILKAGRKIAVIISDALRYEVAQELSERIDRESRFSTKLNMQYSVLPSYTQLGMAALLPHGSLEFDSKDRLYVLADGRSTKGIEARDAILSAVGGKAIRYDDLTKLKVSEIKELYKSCNVLYVYHNHIDATGDAEKTESETVDACEKTFKELGEVVKKLASGNVHNMIITADHGFLYQDRDLDGTEWLSEQPKGDAVWVRKRRFSIGSNLAPGRAFVTFNAAQIGMDDARNEGISIQVPNSIMRLRMQGAGVKYVHGGAALQEIVVPVLHVSKGRSAADDVRPVEFTILQRTDRLSSRQLTVEFFQNEPVGGKIRARTVLAGLWGRDAAGNDVLISNETPVAFDLLGQEKSERHVTATLMLTSDAERFNGTNIELRLREKTDGSNVLVMLDQKARYFFKQGVVADDAGFFD

SEQ ID NO: 1951 - protein, 617 aa, Bacteroides ovatus
MKYNCITQLLDAMPGDSYKQYKISNSVILDQVNKIYEWGTHDRMLSEKFIQSMRILSSDIKEEEIINIYGIDANYFYFTEALCWPILKEILEKKLMADPEDVNDRMRELALKLPVDSYIQIVIRFIGQSALFYMQIRGLGTLKLNSTKEYVNKYITEFYQVDMFYRRTLEAYHELLTKENPIELVLNAAKRQLDLEYAKIANLLNLEWLTCVEEKGTWFTETGLKHQEDFYANESDPNVKQVVIISDALRYEVAMELMQRLAKEKHMATIEAYQAMLPTETKFCKPSLLPHHSLELFGTDMAVDGVVLTTTEQRTAHLNKYRDGGICVRYEDVMNGDQTSTRELFKRPLVYIFHETIDEASHSQSPFEVISACRKAIDQLAVLIKRLHASWNVTNVLLTADHGFLYNDMKFEDKDKHSITDISVEKKTRYYLTDSTAKVEGIVKFPLKKVSAIKSQTPLWVGVSVGTNRLAASGGYNFAHGGASLQEMIIPVIRSQQKRTNKTEKVGVTLMNHNLNMVSSRLKFQLIQSEAVSMTMMERKIVCCIYNGDEPVTQEKELTLNSTDATNLNNRVYEVTLNLNKSISASMLQLRIYATDDRLNPLIRETVKNNTMIEQDF

SEQ ID NO: 1952 - protein, 767 aa, Vibrio cholerae; identical to SEQ ID NO: 1828

SEQ ID NO: 1953 - protein, 846 aa, Parabacteroides sp.
MVQERIYNYFERNPQLHVLFIFDRMDIIQTELGEVKEWADGYIYKVFDGAWFNTKYAIENTWKDKRIVLLFPVETYPHSEEQQLQFPLLDMLKANMEYKEDDYASFMQQYNLPERFRSFIKKNIAEIMSSKIHNILNGHIDSSTFSEDLVCRAFISNYLGEKKLLDWETIIVKMVVLDVTSEGKKHADFWHKLSKNVDASKAINDKLTKLFGVSYNLNLPQKMKCVAECMKYNCITQLLDAMPGDSYKQYKISNSVILDQVNKIYEWGTHDRMLSEKFIQSMRILSSDIKEEEIINIYGIDANYFYFTEALCWPILKEILEKKLMADPEDVNDRMRELALKLPVDSYIQIVIRFIGQSALFYMQIRGLGTLKLNSTKEYVNKYITEFYQVDMFYRRTLEAYHELLTKENPIELVLNAAKRQLDLEYAKIANLLNLEWLTCVEEKGTWFTETGLKHQEDFYANESDPNVKQVVIISDALRYEVAMELMQRLAKEKHMATIEAYQAMLPTETKFCKPSLLPHHSLELFGTDMAVDGVVLTTTEQRTAHLNKYRDGGICVRYEDVMNGDQTSTRELFKRPLVYIFHETIDEASHSQSPFEVISACRKAIDQLAVLIKRLHASWNVTNVLLTADHGFLYNDMKFEDKDKHSITDISVEKKTRYYLTDSTAKVEGIVKFPLEKVSAIKSQTPLWVGVSVGTNRLAASGGYNFAHGGASLQEMIIPVIRSQQKRTNKTEKVGVTLMNHNLNMVSSRLKFQLIQSEAVSMTMMERKIVCCIYNGDEPVTQEKELTLNSTDATNLNNRVYEVTLNLNKSISASMLQLRIYATDDRLNPLIRETVKNNTMIEQDF

SEQ ID NO: 1954 - protein, 865 aa, Escherichia coli
MQFKELESGLRQKFTDNRIVFWHDPEQRFTDSINELDLDNVTLLDMRGVSVLATKKRLEIDEPEQKFLLYFTCEVPAREQDWLLDIRLYSTEFHADYAAITLNSLGIPQLGLREHIQLRKAFFTVKRTQILKGWVTERETENSLDKKMLAVVVGASTFETKEILFALVQQFVAARQQDDSALENTFAVLTKLGLDEVLWEILRLELGYQSESPSMENLLLKLFCTDLWAQGDEAHRDWLSKNVLATAAGRASSLAFMGAWRNDRRYKVEYDYCAEDLQQTLQPKEHYNYSSPYTLAKCETFEAIEQLIIRGLVTQLQEESTTLDRDAFKALVSERSAKYWSQTRPEYLSIWNAIRQAERLLNLRNRYTDGFNFPDTGAFWKAYCDEIYRFDQTYRLFNEYAAPVHSKGAMILHELDKFIEELYSNWYLTELSRGWNKLLEAENRMQAWQFSGIPLQRNFYKENVKRQFDTSQVKRVFVVISDALRYEVAEELGRHINYEKHFSAELRSQTGVLPSYTQLGMAALLPHESLSYLPDNSGVVYADGMSTSGFEKRAAILAKVNGVALKAKDLQNANNQEVNEQIRNASVVYIWHDTIDAMGDKAATEDKTFEACRSAITELKDLVSRLRSRFNASRIFVTADHGFLFQQQALVEQDKTKLESKAKDTIEANKRFIVGHQLPESEFCWHGKLADTAGASDESEFLLPKGVQRFHFVGGARFVHGGAMLQEVCVPVLKIRALEKKAAEKQPQRQPVPVVARDQVIKLVNSIDKIGFIQTSAVNDLNEPRTLNIFIVDENNQVVSGTETVCFDSDNEDMGKRTRDVTMKLMGTAFNRKNKYVLILENADSATEYGRYPITIDLAFQDDFF

SEQ ID NO: 1955 - protein, 880 aa, Lachnospiraceae bacterium; identical to SEQ ID NO: 1909

SEQ ID NO: 1956 - protein, 767 aa, Vibrio cholerae; identical to SEQ ID NO: 1828

SEQ ID NO: 1957 - protein, 846 aa, Bacteroides ovatus
MTQERIYSYFQRNPQLHVLFIFDKANIIMNDLADCSWGTEYIYKVFDGAWFNTKYNIEYAWKEKRVVLLFPLGTYPISEEQQLRFPLMDMLKANMEYKEEDYAAFMQQYKLPEKYRAFISRHIGELMSNKINAMLKDRFTPEAFSEDVVVRGFISSYLSEKRLLEWENIIIRMFILGLDSENKKRLDFYHKLERNKDAKTAVDERLTKIFGFSYKPNQEAKVKELVESLKYNSITQLLDVIADDPYKAYKIKSSIALEQMNRIYELGTRDREFVDKFMKVMKELGADIRERELTTIYGMDASFYYLTEELGWPILQEIAGSKLVTEPAGMQERLRLLSQKLPADSVLQQAISFLMQMAFYYEMVRGLGSLKLNTPEAYVQLYTNDLYRLDTFYRCALEEYHELLSKDVPILTCLNGLKQQFDGEYARMVNVFNLEWMTCVIEKGNYFNDLSLKKQEDFYANECVSNSKQVVIISDALRYEVAAELMQELAKEKHIAKLSAYRAMLPTETKYCKPALLPHTSLIWKNKEMLVDGEVLDTLESRSVQVAKYKESACCVDYETVIKADVKTARELFKRPLVYIFHDTIDAASHGAGAGDVIAACRKAIEQLAVLVRRLHASWNVTNVVLTADHGFLYNDVEFAEKDKHAVTVAGIIEKKTRYYVSDQVSAQEGVVTMPLDKVSGMKAETPIYIGVPMGTNRLAASGGYSFAHGGATLQEMLIPVIHSSQKRSDKTNKVGVALVDHNLVMVSSRLKFQLIQSEAVSMTVVERKVVCQVYQGDTPVTGKQTIMLDSADTINLNNRVYEVVLILNHSVHSGMLQLRVYDEEDCLNPLIREVVKNNTMIEQDF

SEQ ID NO: 1958 - protein, 840 aa, Enterococcus faecium; identical to SEQ ID NO: 1912

SEQ ID NO: 1959 - protein, 865 aa, Yersinia ruckeri
MQFKELESGLRQKFTDNRIVFWHDPELRFIDSLIELDLDNVTLLDMRGVSVLATKKRIEIDEPAQKFLLYFTSEVPAREQDWLLDIRLYSTEFHADYAAITLNSLGIPQLGLREHIQLRKAFFTVKRTQLLKGWVTERETEKSLDKKMLAVVAGASTFETKEILFALIQQFVATSQQDDSALENTFAVLKKLGLDKFLWEVLSLELGYQAEAPTLENLLLKLFCTDLWAQGDDAHREWLSKNVLTTAAGRASALAFMGAWRNDRRYKAEYDYCAADLQQTLQPKEHYNYSSPYALAKCDTFEAIEQLIIRGLVTQLQEESTTLDRDAFKALVSERSAKYWSQTQPVYLSIWNAIRQAERLLNLRNRYTDGFNFPDTGAFWKAYCDEIYRFDQTYRLFNEYAAPVHSKGAMILHELDKFIEELYSNWYLAELSRGWNKLLEAENCMQTWQISGVPLQRNFYKENVKRQFDTSQVKRVFVVISDALRYEVAEELGRHINHEKHFSAELRSQTGVLPSYTQLGMAALLPHESLSYQPDNSGVVYADGMSTSGFEKRAAILTKVNGVALKAKDLQNANNQEVNDQIRNASVVYIWHDTIDAIGDKAATEDKTFEACRSAITELKDLVSRLRNRFNASRIFVTADHGFLFQQQALVEQDKTKLESKAVNTIEANKRFIIGHQLPESEFCWHGKLADTAGASDESEFLLPKGVQRFHFVGGARFVHGGAMLQEVCVPVLKIRALEKKAAEKQPQRQPVSVVARDHVIKLVNSIDKIGFIQTTAVDEYNEPRNLNIYIIDENNQVVSGTETVCFDSDNDDMGKRTRDVTMKLMGTAFNRKNKYVLILENADSATEYGRYPITIDLAFQDDFF

SEQ ID NO: 1960 - protein, 865 aa, Pantoea sp.
MQSKELIAGLTDKFLHHRIVFWHDPEQRFIDSLNELDLDNFMLLDMRGVSVLATKKRIEIDEPTQKFLLYFTNDVPAREQDWLLDIRLYSTEFHADYAAITLNSLGIPQLGLREHIQLRKAFFTVKRTQLLKGWVTERETEKSLDKKMLAVVAGASTFETKEILFALIQQFVAASQQDDSTLENTFAVLKKLGLDKVLWEVLSLELGYQVEVTTLENLLLKLFCTDLWAQGDEAHREWLSKNVLTTAAGRASALAFMGAWRNDRRYKAEYDYCAADLQQTLQPKEHYNYSSPYALAKCDTFEAIEQLIIRGLVTQLQEESTTLDRDAFKALVSERSAKYWSQTRPEYLSIWNALRQAERLLNLRNHYTDGFNFPDTGAFWKAYCDEIYRFDQTYRLFNEYAAPVHSKGAMILHELDKFIEELYSNWYLAELSRGWNKLLEAENCMQNWQISGVPLQRNFYKENVKRQFDTSQVKRVFVVISDALRYEVAEELGRHINHEKHFSAELRSQAGVLPSYTQLGMAALLPHESLSYLPDNSGVVYADGMSTSGFEKRAAILAKVNGVALKAKDLQNANNQEVNDQIRNASVVYIWHDTIDAIGDKAATEDKTFEACRSAITELKDLVSRLRNRFNASRIFVTADHGFLFQQQALVEQDKTKLESKAVNTIEANKRFIIGHQLPKSEFCWHGKLADTAGASDESEFLLPKGVQRFHFVGGARFVHGGAMLQEVCVPVLKIRALEKKAAEKQPQRQPVSVVARDHVIKLVNSIDKIGFIQTTAVDDLNEPRTLNIFIVDENKQVVSGTETVCFDSDNDDMGKRTRDVTMKLMGTAFNRKNKYVLILENADSATEYGRYPITIDLAFQDDFF

SEQ ID NO: 1961 - protein, 865 aa, Escherichia coli
MQNQDFIAGLKAKFAEHRIVFWHDPDKRFIEELEQLKLESVTLINMTHESQLAVKKRIEIDEPEQQFLLWFPHDAPPHEQDWLLDIRLYSSEFHADFAAITLNTLGIPQLGLREHIQRRKAFFSTKRTQALKNLATEQEDEASLDKKMIAVIAGAKTAKTEDILFNLITQYVNQQIEDDSELENTQAMLKRHGLDSVLWEMLNHEMGYQAEEPSLENLFLKLFCTDLSAQADPQQRAWLEKNVLLTPSGRASALAFMVTWRADRRYKEAYDYCAQQMQAALHPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDIILKNYKGMAIKSKDLLELKNQEGRDLIRDYEVVYIWHNTIDATGDTASTEDKTFEACRTAVAELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 1962 - protein, 767 aa, Vibrio cholerae; identical to SEQ ID NO: 1828

SEQ ID NO: 1963 - protein, 865 aa, Escherichia coli; identical to SEQ ID NO: 1924

SEQ ID NO: 1964 - protein, 864 aa, Collinsella intestinalis
MKLSDIQQELRRLFDEQDAAAGAVVVWHDPDGAFAESLDALDLPGVDVMREEEHGLFSLKRTLNGDLAGQRILLYRPRPRRLEGDWLADIEARSASFAADYTSMQLRELNAADTREMREMLATHKAQLAKKTVLRKLTRLSPSYEQPQQLACGLMAIALDAPSLDAQAIVRAHLVAALAADGAEALARVERMGCTNEFQAAISAWIGYTGDASDFIALGRHVLLCALAGALPNDAASALPADVTSGTTALCQDIVRGWCQSAERDSLFELAQLVEEVTPVEQMLAQVPLETLGDIDVFPCIDALILRRLFHDVAASPESAPAALSLAQARHSTAWYREFSLCYDGLEAAARMQRFRNEHPVGIDALSAESVWGLYTDELYRLDTWYRQMHLALGRVLISAPYGLDEDFRACSDQIENLYKNWFFAGVSRRWEDAAENELTRNGYVDGIPRQLDFFMSSVEPIVRTGKRACVVVSDALRYEVAAELAETLEQNTKGTCELASMQAIFPSITSCGMASLLPCGNLTMDAGEPGRLRVLLDGSEVATTAARQEQLRRSDPHAVAITYDSLVNELSTSQRKDLVKDAQVVYIYHNAIDAMGDKAPTERKVFSACGDAIEEIFGLVQLICRERIASQVVVTADHGFLYTDEPLGVSEHTVAAEIDGDPLVIGRRYAIAGDGTRSDVLMPIALPYAEGGLKGFAPRRCTRISRAGAGENYVHGGISLQELCIPVLTFTNRRAGSKGYVESEQATLSLITTVDTISNSIFKLDLLQDKPVGGKVLPASYDVFVGSASHEPVTDVAHVAADRTQDSADERIIPITLNITPGVAVSEQEPYFLYARNCDTRAVDALRELRMRIAFAPSFDFGW

SEQ ID NO: 1965 - protein, 865 aa, Salmonella enterica; identical to SEQ ID NO: 1802

SEQ ID NO: 1966 - protein, 867 aa, Escherichia coli
MNLQNQDFIAGLKAKFAEHRIVFWHDPDKRFIEELEQLKLENVTLINMTHASQLAVKKRIEMDEPEQQFLLWFPHDAPPHEQDWLLDIRLYSSEFHADFAAITLNTLGIPQLGLREHIQRRKAFFSTKRTQALKNLVTEQEDETSLDKKMIAVIAGAKTAKTEDILFNLITQYVNQQTEDDSELENTQAMLKRHGLDPVLWEMLNHEMGYQAEEPSLENLLLKLFCTDLSAQADRQQRAWLEKNVLLTPSGRASALAFMVTWRADRRYKEAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEMVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGAHFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGASFNRRNEYWLILEDAQTETGYQKYPVIIDLAFQDDFF

SEQ ID NO: 1967 - protein, 835 aa, Nitratireductor indicus
MTDRITSGLMRLYEDQGHRIVFWYDAARDLRGAFDAVDLPGVTKVEIANNEFGLKYRMLRQEPKGRFLLYKDGPEPPMPENWLLDVQLASAVFRADQAAIWVADLGIPAKYEAAVRDHADFYRSGKRLDALRLMERERPSQSANDVRRKMLAVCAGADGDLDTVIEALLAELADGHDDALRLMDRAGLTDFFWKEVSARYGYTAAEPDFQDFAITLFSSAWARAMGEEGRLNSDAALMFRRWSASRRWGEAFETLSGNYQDVLKIRDDLASRDFRKLIPHDHFEEVDRRIVVALVEGLAQQSLAGTDVLKWVRDRRQSHWFGRYEDVYQAIGFATEFQQALAEADLTMTSVSDGVKRYSASWFRLDQLYRKFIYHMQKSGQSGLLSALYEAVENRYTTNFVLKLNDAWQDQVSRLTDWAVPGFPRQMDFYREQAAEFRRKDQKVVVIISDALRYEVAEEALREIRKLNRFDAELKPMVGALPSYTQLGMAALLPHRQLAIRDDNDLVLLDGESTMGAAAREKALAAGRAGDRVKVLAAKDFMNLGSSEGKDLFRDHDILYLYHNQIDAIGDKLATEENVPAAAETAIEDLVKLVRKLTSANFSNILITADHGFLWQHKALEESGFALSEPEGDIVTRNRRYVIGRGLSSSGGMKKFTATQLGLGGDQDILIPNSINRLRVKGSGSRFVHGGASLQEIVLPVLRVGKQRKEDVGQVSVQIIPPARAQITTGQIQVTFYQAEPVTEKQQPRQVHAAIFAADGTLISDEAELEFDFASENPREREQSHSFLLSRAADTYNNQTVFLKLQTRIGKTRHFEDHASQPLMLKRGISTDFDF

SEQ ID NO: 1968 - protein, 865 aa, Escherichia coli; identical to SEQ ID NO: 1961

SEQ ID NO: 1969 - protein, 874 aa, Acinetobacter baumannii
MNLNQLQQGLEQAFYTEQHRIVFWYDAEQSFSEEVKALNLGDVQILNMAEESSLAIKLKLELQDQQGKYLLYFPSAEPETEKDWLLDIKLYSRSFYADRFSIIFNELGLQQQSLREHLAKREEFLKAKARLSTLKRYIQPDADAQDLDMAMIAAVVKADSAELMHIVLALADEMVQQNLALEVNPESFAELEKFQLVPALVTALQAEIGYPASVEELNGEAPFKLGTFFIRLMSTGFCESLGDIPLWAQELVMSSVSSRATARAFLSRWRDSSKYYPTFDTLSQTVANALRIQERVGAFDLGQLLDVMTFEVIEQKIIADLASHIPAVTKAELEHFRTVISTRLDGYWASKHKDDATRRKYRTVYTALQAAIELFSLRLQFDSGFYFDSSEALYKAYEQELYRFDMAYRHYSAASQRAHVDILKKLNEEVENCYAYWFIDHLARNWGERIEGEQRLNVWKMADIPNQQNFYDTHVRPLLNSATKRRIVVIISDAFRYEAAVELRDRINEKRYSEATLSSQLGVVPSYTTLGMASLLPHQTLEYKEAAGDDVLVDGQSSKGTAARSKILAAYNGLAVTAEMVKGWSRDEGREALKDYELIYVYHNVIDARGDSASTESETFMAVEYAIEELTELSRKILMHFNISTLLITADHGFLFQQSKLESADRSSLTEKPTNALKSKKRYVIGHGLPESKEAWKGSTQATAGTLSATDFWIPKGANRFHFVGGSRFVHGGIMPQEIVVPVLMVKQLRGEKAGQRTKRKVEVISTKSTLKMVNNIQKFDLMQTEAVSELVMPVTLSIAIYDGDLKVSSEETLTFDSSTDSVADRVKQVRLSLSGTDFDRKKDYFLVLKDKDLNIEMQRYKVTIDLAFTDDFF

SEQ ID NO: 1970 - protein, 865 aa, Escherichia coli; identical to SEQ ID NO: 1961

SEQ ID NO: 1971 - protein, 840 aa, Enterococcus faecium; identical to SEQ ID NO: 1912

SEQ ID NO: 1972 - protein, 863 aa, Alcanivorax sp.
MAKLLQAGNRIVWWSDPDGEFADAVADLSLEEADVVSLGDTPALAVKRQIELESPASPFVLYEGQEAPDPEQDWLLDIRLYAEPFAADATSMLQQDLGLQHASLRHYLKDRARFFASKDRTARLASLLHADDMERDIDAKIWAVLSRSGSADPFTLLLDLLCDVAQLDEGVAFDDSPLWQNLVKYGLEPFAWALLERHFGYRDDAPSLARFIPRLLVTDLGRGLKKPLPTGLIKLALPQAKAGNVAVLLSQWRDSTARQKDYDALSARLASDLQLTHHLSNLTPADVANCATFVDLERIVANALRDQLLGNMASSVMADVRRTVNSRLASYWVSDRYPDTEVGKRSIWRGYYQALLSATDLFEAIETRAQHFGFTSPEQAYTAYTESLFEIDQFYRLFHEAADVVSARFPDAIAPLADQVEAAYLNRYLNKLATHWDGHLQNGLLEKWKLEGVVNQQNFYQKVVAPYLAKGDERRMFVIISDALRYEVADELKTQINGRERIDATLRSQLGVLPSYTKLGMASLLPHKTLTYNAKGSVDVDGRSSEGLDNRNKILGAVGGTAVKAETLANMGKQALREFVRPHRVIYIYHNTIDAVGDSASTESSTWIACRQAINELADLVSRLVNNASATAITVTADHGFLFRETPPDALEKSAMASKPAGTITAKKRYLVGNDLGEAEYAHHGKTAVTAGTGCETEFWLPRGVGRFHFVGGARFVHGGAALQEVAVPIIEIRQKYGKSAESARVSKVGVNVLGQQHRITTNFHVFTLLQTEPVSEKVLATRITIELVNQHGEGISSREILNLDSDATELGERQSKVSLSLAAQAVKPGNDHFLVLSDAESEIELQRIPVRIDLAIENDFDF

SEQ ID NO: 1973 - protein, 767 aa, Vibrio cholerae; identical to SEQ ID NO: 1828

SEQ ID NO: 1974 - protein, 767 aa, Vibrio cholerae; identical to SEQ ID NO: 1828

SEQ ID NO: 1975 - protein, 885 aa, Escherichia coli
MQISELAQGVAAKLEQSRIVFWYDPEQSFTEELEHLANALSISKEVGDSAADITARVLPNDLTILNMGNESVLAVKKRIEVDEREAKFLIYFPSAEPEPDRDWLLDVRLYSEQFFADHSSMLLNELGIPKMALRTHIRKHQSFFANKQRIAGLKRWVTENEDELSLDRKMMAVVVKADSASLSDILLGLLREYAAYIEDESLGQPLWSQLGKFDLETSLWAYLSEGFGYTVEEPTFSDFVLKLFCTEFWSQIEGVERDWLLNNVLKSASGRATALAFMVSWRDSRSFAAYYESISKVLSQQLEISTRAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYQKEVRTRLSLKQTKRVFVIISDALRFEIANELGATINNEKRFKAEVSTQLGVLPSYTQLGMAALLPHKALSYQPEQGTAVYVDGISSQGLDNRNAILQKVGGMAVSSKELMSWSNQEGRDKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSDTEFLLPKAAQRFHFVGGAKFVHGGAMLQEVCVPVLHARELQKEQAAKHEKQPVGVVAATQPIKLVNNIDKVRFIQTDPVGERFVARLLDVYIVDAQGNEVSSRETINFDSVSKVMDERTREARLKLIGSQFDRNAQYTLVLENAEMRTRYSQYAVTIDLAFQDDFF

SEQ ID NO: 1976 - protein, 881 aa, Bifidobacterium bifidum
MSEDSQVTRLLARRFSQPGERGRIVFWRDDKKQYADVVATLVGEHVTDEALREVELITPEIGDENDRRYIPFTVRYRMFHEQPNQKFLVYLTEPAPAVQDNWLLDLELAYGPTFTMDKLAVTLTETLPEASADTRNVWLEVMKRVPKFFDSEERAKRFAKRLNAHDDATDFQAKMIATLLQLKDDRHSMQDIWAELLTQYSQGDDSGITVIERMGLSTFHWTGTRRIYRFDVDADAGSEPTVKDFVLWLFQLAWNGFSDGRNAVSAYANIIRDWDDWYKNIDMRTVLQNLSENAVEELHLSTRIADMSVEELVDRDLFRDVDEMIVNKLFERLGSQSITDDQVQRIINGRKQKLWYAEYADQYECIAAASRLRAVLTECGELISTISSPEQGMKLYAEKLYKADGAYRKYVLAWHRANPDAVSVDDDLQSAYEAYQQDLGQAWQKQVDTLSQWKFIDMDAQTNFYEREIAPVLKSGRKIAVIISDALRYEVAQELSERIDRESRFSTKLNMQYSVLPSYTQLGMAALLPHDSLEFDSKDRLYVLADGRSTKGIEARDAILSAVGGKAIRYDDLTKLKVSEIKELYKSCNVLYVYHNHIDATGDTEKTELETVDACEKTFKELGEVVKKLASGNVHNMIITADHGFLYQDRDLDGTEWLSEQPKGDTVWVRKRRFSIGANLAPGRAFVTFNAAQIGMDDPRNEGTSIQVPNSIMRLRMQGAGVKYVHGGAALQEIVVPVLHVSKGRSAADDVRAVEFTILQRTDRLSSRQLTVEFFQNEPVGGKIRARTILAGLWGRDTAGNNVLISNETPVAFDLLGQEKSERHVTATLMLTSDAERFNGTNIELRLREKTDGSNVLVMLDQKARYFFKQGVVADDAGFFD

SEQ ID NO: 1977 - protein, 865 aa, Escherichia coli; identical to SEQ ID NO: 1954

SEQ ID NO: 1978 - protein, 867 aa, Salmonella enterica; identical to SEQ ID NO: 1803

SEQ ID NO: 1979 - protein, 885 aa, Vibrio cholerae; identical to SEQ ID NO: 1827

SEQ ID NO: 1980 - protein, 880 aa, gamma proteobacterium
MNLNQLREGLDQAFYKENHRLVFWYDPEQSFLDELPSLFEGKESLVDVQILNMANESALGTKLKLELEDKAGKYLLYFPFAEPDVEKDWLLDIKLYSRCFYADRFSIIFNELGLHQQSLREHLAKRDKFLASKARLTALQRYVQPDFDESDLDMAMIASVVKAESCDLPHVILALAEETVADDLGLEANPASLNELEKYDLIPALVAALQSEIGYPATVEELKGEAPFKLGHFFIRLLVTGFCESVGDVHGWAQELVMSSASSRATARALLSRWRDSSRYYKAFDAVSGWVAAALRIKDKMGIFDTDQLSDVVTFEAVEQKIIVDLAVSIPHAPKGELERFRTMIASRLDGYWASKHKDDTTRRKYRTVYTALQAAIDLFSLRIQHESGFHFETSEALYKAYEKDLYRFDMAYRHYCEASLRAHVEILKKLDDEVENCYAYWYIDNLAKNWGDRIEAEQRLSQWRFADVPKQQNFFEDQVMPLFSKGTKRRVVVIISDAFRYEAAVELRDRINDKRYSEATLSSQLGVVPSYTTLGMASLLPHKSLAYRESVSDDVFVDDLSTKGTAARSKVLAAHGGMAVTAETVKGWSRDEGREALRDQELIYVYHNIIDDRSDKGGPSEVDTFKHVEDAIEDLTELSRKILMHFNTSRILITADHGFLFQQSKLEAADRTSPAEKPANVLKNKKRYVVGFGLPDTKEAWKGSTQNTAGTTSETDFWVPKGANRFHFVGGSRFVHGGIMPQEIVVPVLTIKQLRGEKAEKRTKRKVGVISTKSNLKMVNNIQRFDLMQTEAVSDFVIPVTVSVAIYDGDSKISSEELATFDSATDSVAERVKQVRLSLSGTDFDRKKDYFLVLRDKDLNTEIERYKVTIDLAFTDDFF

SEQ ID NO: 1981 - protein, 840 aa, Pseudomonas psychrotolerans
MSIQTFIQQEIFAPRLAKRGVLVIYDPERRYRETCLGLADERCEIVDASESSILSREQAIMSLLSLGKGQADWLLVYVPAAQPLTEEAKQADPFAAVGVCGEVFPGGDSDSFFSLCLKAKPDQTMAIRQIFESDPNPSFAVIDAVGGGLGWPNLRALLKVESSRDILFALLAPNTQQEAALKGSDAWVSEARDLLKNSIGLSLKTKGKAWSSIATELWRFVLFSEFVFDLPDQLPAALVDIPRADTIARAVIEGLCDDLRNDRRTQGLYIDRAEEIEEELGLIGHCAQLADLGRRDTFPFEERTFLNRAISAILADDTDQVRRVLEQQQRSVWTGKGESRGQWDLLRSALDLIQSCDDLDRQLGDHTRSLETLLEFYVSSLREVDRLHREFEQAVSDFEWQDTDGVMTSVKHQARKQYGKLAEKVQLVFTRHLQNSGWPLPGYLANADVFDRLVAPRLQQNGRRIAYLMIDALRYELGVALERQLAEDGIVELKTALAQLPSVTPVGMASLLPGAGQQLFLRNADQSIVPMLGDQVVNTVAQRMEVIRKRYGQRFAEGRLEDFVRDRVDFDADIDLLVLRAVEIDSHFENHPDTAPAEITNALRRIRVAIHKLTQRGFHEIVIATDHGFFMNNHAGAGDVSSKPSGDWLVVHDRCALGDGSADSNHLIASAEKLGIRGDFAKFAGPQTLAAYRNGLLYYHGGASLQECVVPVITMQLKAQEQPSLNKAAINISYKNGAKRVTTRVPVIDVVVDAADIFSTESDFEILLEAHNSKGEVVGEAKAGGAVNPATGTLTLQAGQKVQVTLKMQMEFEGKFKVKALNPKTNAIYSQIELETDYAV

SEQ ID NO: 1982 - protein, 853 aa, Acetivibrio cellulolyticus
MNIEEIVKSLQNVFKEPLKDGQVRKIVFWLDRDKKFINTIDEIELEGVKKHKLENNNYFYIKYLLEEEDTYSDFLIYTNEDLKEDIDNWLIDCLLYSKRFFADNISLIMRDMGIDPSLRAVVKENEKFFDNKERYKKFKSFAIENYNEEVIEIAIISALCGLKSPDFEESLRVILIEGLNDEENKYLDRIDSFFSLNRFWGYVEKNYGYKLEEKTLEKLMMHLMITALSHTLDENDLENVKVYIGKASRSNCLIFIDRWMNHVKDSAAFDEYALMIEKEIGIEFICSKVEITDILETNVFPYVDRAIIVYITNAIEHKLEDYELYIKLIDARKSKHFYSKYEAIYEALYFTVKMFEFKKLYNMGIPMTGAEEIYKAYCNEYYKMDLYYRKFYVAYDSDNDSEIIKKLKDLVENIYTNWFVSELSYAWSKSIDDMDFEEVQIQSVKRQRSFYDQVIRHKVNSGDRVFVIVSDALRYEVATEILDRLNTETMGSAEITSMTGVLPSISKFGMPALLPSTSIELKDSGLVYVDGINSSSLEGRNKILNEYVSDSVALDAKELFAMNKPKRRDFFKGKKLIYIYHNSIDAFGDKYPTEIYAFKGTEEAINDICDLIRIIRDDLSGTNIYVTADHGFIYQRDALEESDKIEKEKLDFIESGRRYALSTKKRSIDGLLGFSMKPLLGNDSNISVYIPKANIRFKIQGPGLNFVHGGASLQEIVLPLISYKNIRRGQVGSKDIEKVEVKLTNAIRKITNSIFTLNFFQSEKVEGKRVEASYKVYMVDEADQMISNEEIIIANKKTDTPESRNISVKFVLKSMDYDKNKDYYLIINDVDTGITKEKIPFKISLGIVSDFDF

SEQ ID NO: 1983 - protein, 836 aa, Fusobacterium sp.
MEKEKIKEMLEERFQVIPVYPRKRHILFWYDEQKAFQDIIEELQLDKVKILRLQKGVNRNGEEIDTNLFKIKYTLEILDTDSHYLIYSANPRPCKHENYLLDIESYSDFFEADKSSMLVDDFGFDRKNSEIHNTIQEYSDFFASKERREKLKKLLENPFHTSEQELKLSILAVIVGAKTADFQEILKNIIFDSGKLEQIKKWMGLSFLYEQILRKFHLSIESWEEFLKTLVVVHFYREIQQKPSIHLESYYLGKTNELFIFTSSLFQNQNDSERIQEIFYEVGKELNMKGRIEELEFEKMLLGNSFEYFEKRILQELVERLQLGVVDYSQYISWIQARSHCSLWKEKYFYFYETLLAIACLLEEKEQLEIKNRKTLSEILEDYTAHYYKIDQAYRNFYYSYDQIKSSELASMFDSFHSKISHFYEVEYLEILLALWNEHLEERNSLVQQKDFYEKYIRRSDTRVAVIISDALRYEVGEEITRQLEKEGNAKEIKIFPLLTNLPSITSVGMTQLLPPGKERNIDLFHNKMTVNGISTFSTENREKILKESCLESSAISYDIFKNKNRSEQEAYVKGKKVLYFYHDSIDAIGDKAKTEHRTFDACKMAIQDILSLTKILSSLGVVNIFITSDHGFLYERKEIEEYNKLELQEEYFLLGKRYAFSTKKVKEKGCITISVGDFFGIFPEKNQRIKVGGSGLQFVHGGSSPQEMIIPCIHYRGGTNVKKAKKVGVCIKETGEKITSHFIKFAVYQLEPVNSQEKLIERTIVAALYDGNVRVSNEFKILLCAETENTEYPFSLTLSGEHEKVILRIIDVESKDILEQKEYQVKIGIASEFDF

SEQ ID NO: 1984 - protein, 840 aa, Enterococcus faecium; identical to SEQ ID NO: 1912

SEQ ID NO: 1985 - protein, 767 aa, Vibrio cholerae; identical to SEQ ID NO: 1828

SEQ ID NO: 1986 - protein, 865 aa, Salmonella enterica; identical to SEQ ID NO: 1802

SEQ ID NO: 1987 - protein, 767 aa, Vibrio cholerae; identical to SEQ ID NO: 1828

SEQ ID NO: 1988 - protein, 837 aa, Fusobacterium nucleatum
MEIDKIKEMLEYRFSLTTELPQKRHIIFWYDSKKEFKDLIDELNLTDVKIIKLTKSVDKKGEAIYTNIFKTKYTLEVIDTESNYLIYSEYPRAIDSENYLLDIEKYSEFFEADKSAMIVEELKLDRTNYRFGEIIREYSSFFANKERREKLIKLIENPESLDEEKFKLSILTTISGAKTVDILEILKNIILNRNKLEDIEKWMNLEFLFSEIKKKFDIEITSFEQFLKILMVTHFYFELGKKPHTNLENYFKGRKNELYIFTDSLLQNKQSSEIIRAEFYELAKDLNIKDRIDELELDYSIKGTAFEYFDKVIIKDIIEVFNSEIIDYDKYKKYIEIRLDNSLWREEYQHFYNVLLAVNDFFRIKDSLIIEDREELREIFKDYTKNYFLIDKLYRDFYYSYDKIKNSELAPLFDTLKSKIDKFYEIDYLEKLLALWSSKVYEREKLSQQKDFYKNNIVKTDVRTVVIISDALRYEVGYEISQKLRKEANIKEIKIEAMLTDLPSRTFLGMANLLPCKKERDIDLVSAKVLIDGIDSQGTENREKILKTSCEESSAISFDNFYKMNRAKQEEFIKGKKVIYIYHDSIDAIGDKGKTENNTFNACKDAVENIVSLSKLLSSLGVVNIYITSDHGFLYEKKEVEEYNKLELKNTKYKSIGKRYAIYEKEVEEKGCVTLKLDSLYGVFPEKNQRIKASGSGLQFVHGGASPQEMIIPLINYKSGANSKKISKVQVRIRESVAKITSNLTKFSIYQIEAVSIKDKFIERDVSVALYDGDVRVSDEKKLKLNSIEENTIHDFRLTLSGEHKKVTLKVIDIESGDILDSKEYDVSIGIASDFDF

SEQ ID NO: 1989 - protein, 837 aa, Fusobacterium sp.
MEIDKIKEMLEYRFSLTTELPQKRHIIFWYDSKKEFKDLIDELNLTDVKIIKLTKSVDKKGEAIYTNIFKTKYTLEVIDTKSNYLIYSEYPRAIDSENYLLDIEKYSEFFEADKSAMIVEELKLDRTNYRFGEIIREYSSFFANKERREKLIKLIENPESLDDEEFKLSILSTISGAKTVDILEILKNIILNRNKLQDIEKWMNLEFLFSEIKKKFDIEVTSFEQFLKILMVTHFYCELQKKVHTNLENYFKGRKNELYIFTDSLLQNKQSSEIIRAEFYELAKDLNIKDRIDELELDYSIKGTAFEYFDKIIIKDIVEIFNSEIIDYDKYKKYIEIRLDNSLWKEEYQHFYNALLAVNDFFRIKDSLIIEDREELREIFKDYTKNYFLIDKLYRDFYYSYDKIKNSELAPLFDTLKSKIDKFYEIDYLEKLLALWSSKVYEREKLPQQRDFYKNNIVKADVRTVVIISDALRYEVGYEISQKLRKEANVKEIKIEAMLTDLPSRTFLGMANLLPCKKERDIDLVSAKVLIDGIDSQGTENREKILKASCEESSAISFDNFYKMNRVKQEEFIKGKKVIYIYHDSIDAIGDKGKTENNTFNACKDAVENIVSLSKLLSSLGVVNIYITSDHGFLYEKKEVEEYNKLELKNTKYKSIGKRYAIYEKEVEEKGCVTLKLDSLYGVFPEKNQRIKASGSGLQFVHGGASPQEMIIPLINYKSGANSKKISKVQVRIRESVAKITSNLTKFSIYQIEAVSIKDKFIERDVSVALYDGDVRVSDEKKLKLNSIEENTIHDFRLTLSGEHKRVTLKVIDIESGDILDSKEYDVRIGIASDFDF

SEQ ID NO: 1990 - protein, 874 aa, Acinetobacter lwoffii
MNLSQLQQGLEQAFYIEQHRIVFWYDAEQSFSEEVKALKLKDVQILNMAEESSLAIKLKLELEDQQGKYLLYFPSPEPETEKDWLLDIKLYSRSFYADRFSIIFNELGLQQQSLREHLAKREEFLKAKARLSTLKRYIQPDADAQDLDMAMIAAVVKADSAELMHIVLALADEMVQQNLALEVNPESFAELEKFQLVPALVTALQAEIGYPASVEELNGEAPFKLGTFFIRLMSTGFCESLGDIPLWAQELVMSSVSSRATARAFLSRWRDSSKYYPTFDTLSQTVANALRIQEKVGAFDLEQLLDVMTFEVIEQKIIVDLASHIPAAAKAELEHFRTIISTRLDGYWASKHKDDATRRKYRTVYTALQAAIELFSLRLLFDAGFYFDSSEALYKAYEQELYRFDMAYRHYSAASQRAHVDILKKLDEEVENCYSYWFIDHLARNWGERVEAEQRLNVWKVADIPNQQNFYDTHVRPLLNSATKRRIVVIISDAFRYEAAVELRDRINEKRYSEATLSSQLGVVPSYTTLGMASLLPHQTLEYKEAAGDDVLVDGQSSKGTAARSKILAAYNGLAVTAETVKGWSRDEGREALKDHELIYVYHNVIDARGDSASTESETFMAVEHAIEELTELSRKILMHFNISTLLITADHGFLFQQSKLEAADRSSLTEKPANTLKSKKRYVIGHGLPESKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDLKVSSEETLTFDSSTDSVADRVKQVRLSLSGTDFDRKKDYFLVLKDKDLNIEMQRYKVTIDLAFTDDFF

SEQ ID NO: 1991 - protein, 832 aa, Lactobacillus casei
MAEVELKDVVTGIEKLFKGHTHFVFWYDKEGEFADNIDELGHQLTEPIVIMQPRTQLKTKIELLDIEKAGGKALVYAAFSEPDIHQNLLTDMILYSKKFTADMNVMLLHELGLPETELTFVQGQRKFFAAKTRIAKFKQRYQRGKNPEQVELAAIAKTNDLQLSNILIEVIKAPTLLDEFAKYQVLETFWSFVDRAYGYHGKHDLQELLATMMVNFAYYQMELDLPVMLRHYEVSYINNVVSFMLNWRNRNDTREVYKQAAAKVWRQLDGTQIFKNLKIADLLKADTFIEFDRHAVKWLISELLAGHLGEVINHMTLPAIAEKRGKMYFSPEYQLAYNMTVDAHNVLLPRENRNVDQFDDLIQAYITEDYLVDTAYRRYINALDQLPATQVDLFDNLSRNVESAYNNEHLVPMISDWCQDYVPNMIEPQRRERNFYSSTVGPNKDRTVVIISDAFRFEAAKELQQRLDKRDVFGTEMQYAVTGLPSVTYFGMPSLLPNHELAYQGNKELLVDGQKAINLEQRMHILQTIEPQSQAMRLTDFLSLSSTEQKKYVVDQKVIYFYHNTVDATGDKPASEVNVFRAVEDAIAELERGVDRLRTISIRNIYVTADHGFIYRRHLLDSTDKINLPSDVDFEQKNLRYAIGSTDFDEIGVDNVKLGDILGNDDQRFVFYPSNANVFSVPGAGQNYVHGGCSPQEMIIPVLHVTTESRKSQATYATLAVTDSSRRITSHEVIVNMVQNDPVDETHRAATYALYFVDGNGRQISGEQLVHADITSINVNDRLIRRHIPLIDQDFERGGQYQLVIKNVEANTSTLIDYQMDLTVGGGFDFDI

SEQ ID NO: 1992 - protein, 865 aa, Escherichia coli; identical to SEQ ID NO: 1961

SEQ ID NO: 1993 - protein, 874 aa, Acinetobacter sp.; identical to SEQ ID NO: 1718

SEQ ID NO: 1994 - protein, 767 aa, Vibrio cholerae; identical to SEQ ID NO: 1828

SEQ ID NO: 1995 - protein, 867 aa, Holdemania filiformis
MALLDSEQVSQDLNRRFAAPLPEFYYRRIIFWKDDDREFEDKLPEITLENATLVALNGTNNFAVKKLLTVDDTTGNYLVYCPEPLADEENWLLPLELYSEEYRADLVSMWMDEMGMDNTASLRKQVKAYRGFFKIKGHRTKVANLKKQVTTPVQLHLAVMAVLCGLKDFQPNGILRAVLTAGMNQDTNGIYQKFVDAGAKDAFWAMAAQVSGYREEECDISRLATHILLTAATRTMRPDHLAGLDGFISSPHQAYCYDFVSEWMHSDDNGHLFELARYVEEELRLPYRFSKLPVEELAETELFPCINECILINLMTEISNQIINVDTIIAMVEKRRTCAWFELVKDYYEGILQVANMQAFFLDHSAGFHTVEARGVWKEYTEDYYKMDTYYRQFHCSFARSLKTSNPLLDDLFKHVADKVEGLYDNWYLGQLGSNWTMAAADELAQYGRILEVPQQVDFYKDKIKNADTRMFVIISDALRYEVAATLAEQLRRETQAKVDLNSCSAIFPTVTKYGMAALLPHKDLTVEEKTNGLAVYADGTSTDAGYRDAILKKANPASIAVKYKDIVLMKRQERSELIKGNEVVYIYHDKIDETSHTDEALVFPSCEDAIDEIKNMVRIIVNDFGGVNIIITADHGFLYTYSPLSEDSKVDKTTVGEEDVEVDRRYLVTRKGAKPQYLLPVKFVADDAGYDAFSPRESIRIKKKGGGLNFVHGGISLQEIVVPMVEYHYLRNQTKEYQRNKKKYDTKPVSLNLLSANRKIGNLIFFLNFYQKEAVGDNREAATYLLYFVDSEGNQISDTQKIIADKQTENNQERTFRCSFNLKSLKFSNKETYYLVIADESGLQLLQREEFTIDIAFAVDEFDFFS

SEQ ID NO: 1996 - protein, 840 aa, Enterococcus faecium
MTDINTQQIEEKLNQRFPNYGRRKIIFWFDSNQDFLEEIDSLVIQNAKIYRLEKDAQFKTKRLLEYEDPETNYLIYAPFPRWDDKDEDNHLLSVLNYSEEFSADRLAIIMNELAIPLRFHQTVKQYRNFFNAKDRMRSFGEFSTHMTINKSETIELMIMAVLLKSKSIRLNDLLRVVLKSFTESRENPLKELDKYQLTAKFWEFIQIKFGFTDSQPTLEKLTMCLYLNYFYYQIDQEMPKKFKGFEILHLKANIITFMDQFMNDTRYVESFEQLSKKVYQTIDGDGLLDSIEIDDLIEADVFSEIHAKILMFYAERLKASDTTTKIAGQTIFDSLKQREKMHFASDYIYEYQLLKHAYYLVDKNRLCLPMNMDNLLTQYEKEMYWIDTHYRKFIWNSDHIEEKQKYDQLYRLVEANYSKFLDQSGQIWNQTFEFKNRPSIRKFYNQAVMKRSVKTVVIISDAFRYELGMNLERKLVREKKYSTNMASFLSVLPSVTEFGKAALLPNNQLTYNEGTEVLVDGKKTNGLSNRNAILQQRDANAVALNYDDVVKMNKAEVREVFNGKSVIYIYHDQVDRTGDHSNENRVFDACDLAISEISRLINRLHNDGSIYRFIVTADHGFIYKRSHVEEVDKIENPSRNEKDRVERRFILSEEEYEIIGTKNYSLGDSLGNDDTRNICVPVTSSIFKKAGGGQNYVHGGSSIQEMLVPVLEITVAKGSNAKEPVAIELMTSNRRITGLSTTLEFYQKNAISDVYDPASFWLYFEDEYGERISNEEIYVADSKAEDANQRFTKFVFEFVNRRYTVEDTYYLVIKNQKNDLTERIKFIIDNPFAESFDFDI

SEQ ID NO: 1997 - protein, 837 aa, Fusobacterium sp.
MEIDKIKEMLEYRFSLTTELPQKRHIIFWYDSKKEFKDLMDDLNLTDVKIIKLTKSVDKKGEAIYTNIFKTKYTLEVIDTESNYLIYSEYPRVIDSENYLLDIEKYSEFFEADKSAMIVEELKLDRTNYRFGEIIREYSSFFANKERREKLIKLIENPESLDDEKFKLSILTVISGAKTVDILEILKNIILNRNKLQDIEKWMNLEFLFSEIKKKFDIEVTSFEQFLKILMVTHFYFELGKKPHTNLENYFKGRKNELYIFADSLLQNKQTSEIIRKEFYELAKDLNIKDKIDELELDYSIKGTAFEYFDKIIIKDIIEIFNSEIIDYDKYKKYIEIRLDNSLWREEYQHFYNALLAVNDFFRIKDSLIIEDREELREIFKDYTKNYFLIDKLYRDFYYSYDKIKNSELAPLFDTLKSKINKFYEIDYLEKLLALWSSKVYEREKLPQQKDFYKNNIVKADVRTVVIISDALRYEVGYEISQKLRKEANVKEIKIEAMLTDLPSRTFLGMANLLPCKKERDIDLVSAKVLIDGIDSQGTENREKILKASREESSAISFDNFYKMNRAKQEEFIKGKKVIYIYHDSIDAIGDKGKTENNTFNACKDAVENIVSLSKLLSSLGVVNIYITSDHGFLYEKKEVEEYNKLELKNTKYKSIGKRYAIYEKEVEEKGCVTLKLDSLYGVFPEKNQRIKASGSGLQFVHGGASPQEMIIPLINYKSGANSKKISKVQVRIRESVAKITSNLTKFSIYQIEAVSIKDKFIERDVSVALYDGDVRVSDEKKLKLNSIEENTIHDFRLTLSGEHKRVTLKVIDIESGDILDSKEYDVSIGIASDFDF

SEQ ID NO: 1998 - protein, 848 aa, Clostridium butyricum
MNLQEIRNFLKELFSKPLGDGKTRHIVFWYDESEDFIEDIDTFDLEGIKVIKLTENNAFWAKYHIEKEDTTSNILVYSNMKKPIPQEDWLYDVFCYSEEFSTDRATVIMRELKVQDSSLKEEFNIYNTFFKNKERINNFKNLNIQCYTKEKVHLGVLSVLTKVKIMDIEEIIKAILKDYLDGSNKIYEDIKKFGSVDALWSLLQKYYGYNFEERSIERFMAMLLVTNMNETVKFELPKSYAPFISKKDTNCIVFINHFMNNEKDSEAYGKMQDLVAEKLKIAQLLEKHDSETFINCDEFEVMDRLILSRITNLLKDGVEEYDKYLNLLSSRRTLHYYKKYVSEYKAIKWAINLLNKKKELASTIKTENSYNMVKSYAKDYFYIDKAYRKFYYHYDNSDLKDELNELKDTIENVYNNWYLQELAIKWNDALLNQNTWRIDGLKYQDKFYRENIKYKGKDRVFVIISDGLRYESAEELNTLLTNERKGKAQLDYMQGVLPSYTKLGMASLLPNNKIEINDRYDVLVNGVNSSGTDNRNTILKMENEKSLAITYDTVMDMKDAEIRKAFTGLEVVYIYHNTIDARGDHASTEREVFKATSDAFKEILLLVNKLVNRVSAANIIITADHGYLYKRSAMEESNKLSGIKLEDGEDNRRFLLTSSKEDIEGTVTFSMDYLLGDESNKYVITPKGTSRFKVQGAGANYVHGGAMPQEIIVPVIKFKNDRSTSSVNDIRKVKISVTSITRKITNIITYLEFFQDEKIQDKVISQRIKCYFEDEEGNRISNENIIIGDSRSENPVERTYREKFVLKSMPYDKTKQYFLVMQDEEDANGFYERIPFNVDIAIVDEFGF

SEQ ID NO: 1999 - protein, 874 aa, Acinetobacter baumannii
MNLDQLQKGLEQAFYTEKHRIVFWYDAEQSFTEEIKALELNDVQILNMAEESSLAIKLKLELQDQQGKYLLYFPSAEPETEKDWLLDIKLYSRSFYADRFSIIFNELGLQQQSLREHLAKREEFLKAKARLSTLKRYIQPDADEQNLDMAMIAAVVKADSAELMHIVLALADEMVQQNLALEVNPESFAELEKFQLVPALVTALQAEIGYPASVEELNGETQFKLGTFFIRLMTTGFCESLGDVPVWAQELVMSSVSSRATARAFLSRWRDSSKYYPTFDTLSQTVANALRIQEKVGTFDLEQLLDVMTFEVIEQKIIVDLASHIPAVAKAELEHFRTIISTRLDGYWASKHKDDATRRKYRTVYTALQSAIELFSLRLQFDSGFYFDSSEALYKAYEQELYRFDMAYRHYSAASQRAHVDILKKLDEEIENCYSYWFIDHLARNWGERIEAEQRLNVWKMADIPNQQNFYDTHVRPLLNSPTKRRIVVIISDAFRYEAAVELCDRINEKRYSEATLSSQLGVVPSYTTLGMASLLPHQTLEYKESAGDDVLVDGQSSKGTAARSKILAAYNGLAVTAEMVKGWSRDEGREALKDHELIYVYHNVIDARGDSASTESETFMAVEHAIEELTELSRKILMHFNISTLLITADHGFLFQQSKLESVDRSSLTEKPTNTLKSKKRYVIGHGLPESKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDLKVSSEETLTFDSSTDSVADRVKQVRLSLSGTDFDRKKDYFLVLKDKDLNIEMQRYKVTIDLAFTDDFF

SEQ ID NO: 2000 - protein, 874 aa, Cellvibrio sp.
MNLDQLKQGLEQAFFKENHRIVFWYDPENDFEGELPSLDLPNVTVLNMKGESVLGVKLKLEREDTTGKYLLYFPQAEPEPENDWLLDIKLYSRSFYADRFSIIFNELGLHQQSLREHLSQRDKFLSSKARLNALKRYVQPTFNEAELDLAMIAAVVKAEACDLPHILFALAEEMVSAQSGLEEIPAAITELEKFGLIPAWVTALQLEVGYPATAGELAGEEPFNFGQFLVRLLATGFCESIGAVPAWAQSLVMASGSARATSRALLSRWCDSSRYYKAFDEVSTWVAAALRVNEKLKDLELSAISQAATFEQIEHQIIVEIAQAIPAADQATLGEFAAVIANRLDNYWASRHKDDDKRKKYRVSYKALSAAIDLFLLRHSHASGFHFNSVQAIYHAYETDLYQFDQAYRHYCEASNRAQVDILKKLDVAVEQCYANWYIDNLAKNWGDNVDAENRLTNWKLEGVENQQHFYRKQVAPIFAKAKQSRVVVIISDAFRYEAAVELRDRINEKRYCEANLTSQLGVVPSYTALGMASLLPHETIEYRENGGEDVFVDGKSTKGLNSRNKILTKHGGMAITAEDIKNWSRDDGREILKDLQLVYVYHNVVDARGDVAATEAETFLAVEQAIEELTELTRKILMHFNTSTVVVTADHGFIFQQSKLNESDKTALMEKPENAIKSKKRYVVGFNLPTPTGAWFGSTQHTAGTMSDTHFWVPKGANRFHFVGGARFVHGGIMPQEIVVPVLVVKQLRGQKAEQRTKRKVGVISPKPALKMVNNIQRFELMQTEAVSELVQPVTVSAAIYDAEVLVSSEEVVTFDSATDSIADRVKQVRLSLSGKEFDRKKDYFLILKDKDLNTEIERYRVTIDLAFTDDFF

SEQ ID NO: 2001 - protein, 840 aa, Faecalibacterium prausnitzii
MAELNLKQIIDRLNAEFTGETRKLVFWYDDKAEFAEDMETVELQNAKIYHLQPDNQFYTKYFLERVDKTTNYLIYAPFPKPDVRDNHLEDTMLYSRRFFADRASLLSVDLGIEEKYKPVIEKHIKFFANKERTQRFYDLEIENFNEENILVGLLSAVCKARTCSFEEVVRIVLTDGELVDNAFLQEFEKYDLLSAFWQLCEQHFGYTDTKPSLERLLVTLFVTYTGRYVQAELPAAWKSFVSYKSGNIIAFLDSLMNSVLYRDKYDALSTHVAKGLNVLSAFAGMRVDDLVECDTFLAVDQVLVKWLIGRLVSEDIGAIVNGFTIPELCEKRAKMHFGRKTGKTYQMLSSAYSMVKEADYHAADGLKPIIDRYLAADYNMDQQYRKFYYYYDQLESTESFESLRELVENIYTNEYLACLLPAWNAGIQQDAAFSAIPLQREFYNANLRYTKERTVVIISDAMRYEVGQELFARMQDDPKCTAKLSVQLSVLPSYTRLGMAALLPHKTLEMTDDFQVLVDGILCDNLAGRQQVLQSYNPDSVCVQFDDIKNLKVAELRDVLTKRQIIYVYHNQIDARGDKANTEDEVFHACEEAVQEIVDLIHRISVSGNTYHFIVTADHGFIYKRDKLTESDKISGKSADKAFVNRRFIVSKATLEDDGIDHMSMGRILGNEDSKVVSYPVSSNVFKVAGGGANYVHGGSSPQEMLVPVLEFKMERGHMETKNAEIALVSIVHKITNLITSMDFIQSDAVSDTVKAAKYRIFFLSEDNEKISNENSYVADSREENAQKRIFRMRFTFKNKKYDKDKQYYLVVYDEESGLEQWRQPVIMDIAFADDFGFGF

SEQ ID NO: 2002 - protein, 864 aa, Fulvimarina pelagi
MDTDRIQIALGRFLAENRVVFWSDPDKEFEDILPGLDVGDAAVIRTSKSPALETKLTIASGGAGSCFLVYEDQPRPMPADDWLLDIRLYAKSFAADRSTHVLEDLGLHSPALRDHIALRSKFFASQERLTRFKRLVSAKDNEVDIDRKIMASLLRLDNADFFGIVIKIFDEFPDQSDISRPPDVFGEFARYDVEQSFWSQVEAAFDFSDPRPTLGNLLIRLLVTDFTRKLNGKTPKALEHLKLRGQGASNTAVCLAQWQDSHARHASFDRLSDAVATAIRLGDQVGIVDPEYLEDTRTFALIERRLASGLRDRIIDTDTAVDVEEVVSLCRRRKDGYWANESLGGAAPRKAYARTYDALEHAARLFGLRGAYDSGFSFRTVEEFWQAYETDLYRFDQLYRHFCEAADHVESQGWDVLKVLRQKVEDVYGNGYVAKLATAWGPFAAKMIGSKWQIPGVPNQSRFYEKRIAPIVQEDDKRAIVIISDAFRYEAAKELADQLNSRDRMEAKLTTQLGVLPSFTALGMASLLPHEKLEFADGTIYVDGASSSGMKGRGNILAKHGGGVIRAEELHAMSRDEGRRFLKSHKVVYVYHNHIDKTADGADEEKAFDAVRRTIDDIASLAIRILGSLNGTNLFVTADHGFLYQESSPTNVDKNVVEEKPAGVVLAKKRYYIGTDLGSHAGAWSAPLSRTSKVTDDTEFWVPKGTSRFHFMGGARFLHGGAMLQEICVPVLRIAYSKDKDANDVKSRPVQITVLGSNNRITTAHRSFNLMQVEPVSDRVRPLSVTIAIVDADGRPVSDIQKVTFDSRTVAISEDWKKAVRFTLAGTTFDKSQEYSLVARNAETKVQELIYHVVIDLAFARDFD

SEQ ID NO: 2003 - protein, 865 aa, Escherichia coli; identical to SEQ ID NO: 1759

SEQ ID NO: 2004 - protein, 865 aa, delta proteobacterium
MGKLSDRVRSMIARQVKNRGIVVWYDPEKAYTGLVQNLKIPETKVLQYTDSFFRLRHELEPSLEFVTPVGKAKDGCGVAPNVVVYVPMDRNETSFALIEAETAGIVVEPGAEATERNSRLKVQTESFFLEIAPEKAGHLARQVDDGVLTLEDLDRISEEVGSITSGALKLVFGAASPIESIIEFASGSTKDAKISEKKALGELRNLVRSELGLDFGDTTSPAKARQVLRRIVLLAEFTAAIPETGRPSALGTVNLPGKPMQLDAVRHLCETWRNRVDFRDGYIQAARELEQAAGIAQMKLNVDDVAAVETFPCIDALLMASVQHSLLQGRLEGAMGMSESRKKSFWSREQPELFLKWSALELAGRFMTEAAKIRDQIRKLDASAGEMVKAYTLFTEPWMMADRFHRHWESRLLNLDPDGTEEDDFEKLRAKVRRKYTDLVDEMNRIFIARFQKAGFEAWEILPQMRIFHDRVSPSLAKEKKTVFFLVDALRYEMAAELLEGMDKDFDVTLEPAIGNLPSITSVGMAALLPGAETGLELIPTKGGMAVVLDSRQLRDRKSRLAYVGEKTSCGFMALRLADVLKIGVKRKKELQAAGLIVVTSQEIDRLGEDGEDYAETRRFMDDMLEQLRRSIRILAKLGVEHFIITADHGYLFADQIDPGMLMDSPGGITVELHPRVWIGKGGKDADGYVRVAASELEFGGDLEMAFPRGLSCFRVKGGVGGYFHGGISLQEMVIPVAVLKSKVSTAVDAGAGMKIRLEFGKPAITNRFFSMLATLELHGLFQTEDVRIRAMVLSNRKEVGFCAMAAYGYEEGSREITMRKNEPNALTFMLADDVGDGKVTVQIVDCHTQLELASLADVPVKLGI

SEQ ID NO: 2005 - protein, 840 aa, Enterococcus faecium
MTDINTQQIEEKLNQRFPNYGCRKIIFWFDSNQDFLEEIDSLVIQNAKIYRLEKDAQFKTKRLLEYEDPETNYLIYAPFPRWDDKDEDNHLLSVLNYSEEFSADRLAIIMNELAIPLRFHQTVKQYRNFFNAKDRMRSFGEFSTHMTINKSETIELMIMAVLLKSKSIRLNDLLRVVLKSFTESRENPLRELDKYQLTAKFWEFIQMKFGFTDSQPTLEKLTMCLYLNYFYYQIDQEMPKKFKGFEILHLKANIITFMDQFMNDTRYMESFEQLSKKVYQAIDGDGLLDSIEIDDLIEADVFSEIHAKILMFYAERLKASDTTTKIAGQTIFDSLKQREKMHFASDYIYEYQLLKHAYYLVDKNRLCLPMNMDNLLTQYEKEMYWVDTHYRKFIWNSDHIEEKQKYGQLYRLVEANYSKFLDQSGQIWNQTFEFKNRPSIRKFYNQAVMKRSVKTVVIISDAFRYELGMNLERKLVREKKYSTNMASFLSVLPSVTEFGKAALLPNNQLTYNEGTEVLIDGKKTNGLSNRNAILQQRDANAVALNYDDVVKMNKAEVREVFNGKSVIYIYHDQVDRTGDHSNENRVFESCDLAISEISRLINRLHNDGSIYRFIVTADHGFIYKRSHVEEVDKIENPSRNEKDRVERRFILSEEEYEIIGTKNYSLGDSLGNDDTRNICVPITSSIFKKAGGGQSYVHGGSSIQEMLVPVLEITVAKGSNAKEPVAIELMTSNRRITGLSTTLEFYQKNAISDVYDPASFWLYFEDEYGERISNEEIYVADSKTEDANQRFTKFVFEFVNRRYTVEDTYYLVIKNQKNDLTERIKFIIDNPFAESFDFDI

SEQ ID NO: 2006 - protein, 830 aa, Lactobacillus johnsonii
MATLTTDKIISELKNYFEDKYQYVFWYDDKAQFKDIIDQIASNLNEVKLYKAQANQQFKTKINLLSDSQHKYLIYAPYERPRIQENYLTDLEYYSKLFTADATQIILEELNLSVDKLSFVKQYHTFFGAKDRRKNFIKYWNVDFDTTPEKGIIAAITKTEKLDINELLMKIISAGKENNQYLFLFAKYNVLDYFWKLVGNYFGYDTIENANLDNLINNLFFTYLDTELDIKNSNKFQNLLLSNKDNVQIFIDRFADSNKYNKYYISESNRVWNELKLHDLLVQESLSDLTKVTVFEEVNSIVLTKIRDKFIDNQVTDYEQVLNIIDRMSNHTRNNFSNNKENEYKFLRYSAELFNLRIPLFENWQKELDGYINNEYQIDTIYRKLLLAYTRIGNNDLYSKIKKNIDLYYGNILLNSSVKQWNNTFDLSEVPSDIKQERFYHNHVAHVPERVVVIFSDALRFEVGKELEDELDNNDRLTLNMKYALTSLPSVTYMGMNVMLPHNSLRWDAEKHKVKVDDKNAENTSARNKILKTFNESNTAAQLKDILEMTSKEVKTFINGKNLIYLYHNQIDAKGHELKTTKELVDATEKAIEEIKKTIQALRTNGVSHIIVTADHGFIYQERPIYDTDKIDLANEDYLGNAHLRYLITPDKLSVRGVKSTTMGISLSNDDKTNIYYPTSPNEFIARSGSKNYVHGGSSIQEMLIPILDIKATSRKSAAQPAEIKLAATTFRINSLKMNLLFNQIASVSDRVLPTEYNVFFVDEDEKMISNKVVVEANRKGSAADRTLPVTITIQNTNYNLNKKYYLVIENQDTNYSQKIEYTMDIFSNN

SEQ ID NO: 2007 - protein, 866 aa, Thiothrix nivea
MNLDQLTQGILAKFANHRIVFWHDPEQSFQSDLPALALDGIALLDMQGRSLFETKKRIELDEPEQRFLLYFPYAEPEPEKDWLLDMRLYSEQFFADASSMLLHELGIPKMGLRTHIRARSGFFNKKNTAALKKLVTENEDELSLDRKMMAVLLKADSAELADILLSLLKDYAQVLEAGTDTARLPSMALLHKHGLPDSLWALLQAEFSYQAKEPSLTDFTLKLFCTELWSQMDSLDRDWLLQNVLKTAAGRSTALALLVNWRDSRSYSEHYQTIASVLERQLEISRRLENCTPDYLVSCKTFEAVEQIIIRGLVSALLEADKALDHAYFESVLSERRTSYWHRVRDGYYAHIYTALQQAERLFGLRHSHPDGFHYASARDMFIAYAQELFGFDQAYRQFKFAVRQVANQGGDILRRLDEAVENLYTNWYLYELGLAWDRHLASEERMANWVLSGVPSQQQFYERQIRSLLAGKQVKRVFVVISDALRYEVAEELASLINAEKRFKAEIASQLGVLPSYTQLGMAALLPHKQLTYASGQAVVQVDGQSSAGLENRNRILTAVNGMAVSSKDVMGWSKQEGRDQVRDKAVVYIYHNTIDDICDKQGGEDRTPEVCRDAIAELNHLVGRIVNNLNGSRIIITADHGFLFQQQALEQTGKTELSVKPVNTIETKKRYIVGRQLPTYDECWKGRIADTADGGDDTGFLLPKGAQRFHFVGGARFVHGGAMLQEICVPVVHIRELEKESIAQHEKQPVGVVAASQPIRLVNNIDKVRFIQTDPLGERYKARKLEVYVLDAMGNVVSSREPLSFDSTSSVMEERIREARLKLVGSGFDRRKQYKLVLEDMDTRTRYSDYAVTIDLAFGQDDFF

SEQ ID NO: 2008 - protein, 865 aa, Escherichia coli; identical to SEQ ID NO: 1756

SEQ ID NO: 2009 - protein, 831 aa, Brevibacterium mcbrellneri
MSSLSVVLPHLEQRFESQRLVFWHDADGEYAAEIDALDLSGVTTVRVENNEYAVKNRVLHDEPAGKFLLYRGAPVPAGTGNWLLDLELAYGIFTADRTALVRQDLGLSGSGIDEVVREHEKFFRAVKRVESLKSLLATSDDADRLRAKMSAVVLGQHEHSMLELMRALLIENARGAHTKYDALAEQGLDSFHWAGVAKIYGYEASEPSVDDFVLWMFRQAIKRFASDTPGALRNIELDFASLRNDRRSADALATLARRAAESLDYASTIEDAELAELVGNDLFEDVERKIISVLTQAIVERTMGTREVSEIIRSRQSSIWVDGYRELYAALAAASDLLSELATARFEIASFDDGLDRYCKRWFRIDQLYRQFHFAARTTEYTGALEALRVEVEKHYANRFLYELGNAWQQQVDAVTDWRSVVLRHQTRFFTDHVEPIIRRGNRKAVVIISDALRYEVADDLGSRIRQEDRFDAELHAMLGVLPSYTQLGMAALLPHTTLAHSHDGDLVLVDGQRSDGTANRNKVLAPVDGFAIQAEDVLAMPRGELRELYRAHQVLYVYHDRIDAAGDKARTERQVFEAANDALRELVVLIKQLTNANATNILVTADHGFLYQDTALAGASYLSTKPQGDELVVTNRRYVLGRGLKDDPAFRKFEPEQLGLSSDLEVQLPKSIHRLKLPGAGSRFVHGGAALQEIVVPVLTVNKKRKSDTRLVNVEVLPETDKITTGQLVVKLFQSEPVSEKVQARTLRGGLYVGETLISNQPELLFDQPSDDTRDRYQSARMLLSQDANEFNNRTVEFRLEEQIPNTTQWRVYQRAQYLLKRSFTSDFDF

SEQ ID NO: 2010 - protein, 865 aa, Escherichia coli; identical to SEQ ID NO: 1759

SEQ ID NO: 2011 - protein, 836 aa, Geobacillus thermoglucosidans
MDILEALRERIREEKEKKTRAIVFWYDAAGQESVESLQEALADERVIVRELTDTNFFKLKIEIEIDKPNESFVLYAPFARPRDEENYLLDILLYSTEFKADQIAVWAEQLSVKDIVLRPIVERYRQFFNSKERIQKLKRLLPLNAKDIDIEYGILAVLTGAPIANIAAITRYLLMDGLDEQNNEAYKRVTKYFSIERMWELLEQHFGLETRPANRTLRHLMETLLYAHFARDAEVNIEKLQTKYPSIRSNICALFIDDWMRGSAEETERLESYIREIESRFELRYYLQNVSVQNIEKVITFPLIDALLIEKVIDELQHKTSDLEAWQERISFRLTTYWGKKERIQALYRVLYEAVRLTEYKTYLKQYDSTIDLYNQYVHCLHYIDQAYRRFMQAYTKLEQREMIESLAKALTNWYENVYLTKLAQETNYYLEKEEQITKIPLQRSFFQQVVQPILEKETTRVFVIISDALRYEIGYELCERLNQRINGEASVSPLYASLPTYTQLGMASLLPHRTLTIDEKKIVYADGEPTNGLANRTKILQKAHPDSVAYRLDEFMDWSRTEAEENFKGKRLVYLYHDVIDATGDSRKSERDTYEAVEKAVYSLELAVDRLSRLQAKRIFITADHGFLFQHLKVEADVKVETVRGTVFDGNRRFAIGHSLTVPDGAVKLKSWQTPLQNVDVVIAKGLNRFMTGGGLQFIHGGAMPQELIIPLIDYRRTEQAKPVDVSVAMLDKVIINYRVPVQFYQEQSVSSDYLPRQLKMAFYQGNERISNEVILTFNLTGENHERTEQVVFTLAERYYPMGETCTLKMETIQDKKIDLYKEEIFTIRMYEALY

SEQ ID NO: 2012 - protein, 767 aa, Vibrio cholerae; identical to SEQ ID NO: 1828

SEQ ID NO: 2013 - protein, 840 aa, Enterococcus faecium; identical to SEQ ID NO: 1912

SEQ ID NO: 2014 - protein, 840 aa, Enterococcus faecium; identical to SEQ ID NO: 1912

SEQ ID NO: 2015 - protein, 885 aa, Vibrio cholerae; identical to SEQ ID NO: 1827

SEQ ID NO: 2016 - protein, 852 aa, Sporosarcina newyorkensis
MNMNQIVSALQDIYKEPLSDGEQRKIVFWVDKDEEFIEEIGQLALDGVRVLTLSENNQFYMKYLLEEEDPTSSYMIYTNLELSSEDNWLTDTVLYSKTFFADRISLILSELQIDPTLRAVIKKYEKFFNNKERFRKFQAFGIEAYSEETIELAIMSVLCNVKTTEFEAVLKAILMDTLEDNDNKYLSQLDKFFDIHVFWTYVANYYGYERKTKTLKTLFIHLAVTAFSHSVNEKYLTDVKDFIAVRNKANSLVFIDHWMHHKTDYEVFDDYAEMVEQEIQLSNILQSVPIDEFKQAETFSYIDRAVIIYIANSLLEKLEDYEEYTKLIKLRRAKHFYEKYTHIYDALYYTVKMQEFHKEYNQGIPSGQAIDIYEAYYKKYQVMDTYYRKFYVAYDEESNHELLLKLKGLVEYLYTNWYMGELSTNWSQAVKAEMTEQWSLPGVLSQQRFYSSIVAPHISKGERVFVIISDAMRYEVGLELAERLNAETMGTCDAQTMLSVIPSVTKLGMASLLPHKTIDFDASGRVLVNGKDSSGLDNRKAIIETAVEDSIAIHYQDIRDMNKAGRRETFKGKKLIYIYHDTIDAMGDKASTEIYTFTAVETALNQLYDLVKIILDDLSGTNVYITADHGFLYQRESLEESDKIEQEQMDKLEVKRRYILSKEKRDVPGQMAINLSSVIKNELELTAYVPNGTIRNRMQGTGVNFVHGGASLQEIVVPLLSFKNKRAGQKGVQAISKVDVKLTSTTRRITNSIFNLNFFQTEKVEEKMNPRTVVIYMADTEGNILSNEETIIGDRPFDNPAERTFKLQFVMKSIPYDRNKTYYLMIKDTETGVITEKVPFTINLGIVSDFDF

SEQ ID NO: 2017 - protein, 767 aa, Vibrio cholerae; identical to SEQ ID NO: 1828

SEQ ID NO: 2018 - protein, 767 aa, Vibrio cholerae; identical to SEQ ID NO: 1828

SEQ ID NO: 2019 - protein, 767 aa, Vibrio cholerae; identical to SEQ ID NO: 1828

SEQ ID NO: 2020 - protein, 767 aa, Vibrio cholerae; identical to SEQ ID NO: 1828

SEQ ID NO: 2021 - protein, 840 aa, Desulfotomaculum gibsoniae
MAELNLKQITDKLNAEFSGDTRKLVFWYDDKAEFAEDIDTLELVNAQVYHLEPDNQFYTKYFLERQDRTTNYLIYAPFPRPNVRDNHLEDTLLYSRQFFADRASLLTVDLGLDEQYKPVMQKYIKFFRAKNRTQRFYDLEIDHFTKETIEVGLMSVLCKTRTSSFEEVLRVVLMDDGFEDNKFLAEFEKYDLLPAFWSYCEEQFGYTDVQPTLEKLAVTMFVTYTERYLHDDLPPAWKSFVSYKSGNIIAFLDNLMNNVLYRDKYNEISAYVSKGLNATTVFETYQPEALIDCDTFAVLDNFIIHWVNDRLLNEDIGARLADLTIPAVCQERRKKHFGAGYQIQYWLLEHAYYLISAADYHSQDSFKGIVEQYLARDCLIDTHYRKFYYYYDQLSENILFEKLRDLVENIYSNEYLSEVISKWNSYLVREDILTVISLQRNFYNQHVLYSKDRVVVIISDALRYEVGRSLWLKLQDDEKCNAKLAAMLSVLPSNTRFGMAALLPHKTLAMTDDYQVLVDGMPCNDLKQREAILKSYSPNSRCVQFDDVKTMKKDELREIFTGMEVVYIYHNQIDARGDKSNTEDEVFTACEEAVEEIFALIKRLSVSANTNHFIVTADHGFIYKRDKLQESDKIAYVTGLEALINRRFIISGQAVVGDGIASLTVGSILNNSDSKVISFPVSSNVFKVAGGGQNYVHGGSSPQEMLVPVINVKTKKGHMETRPVLIMLVSVVPKITNLISTLDFMQAEPVSDVIKATSYRVFFISEDNEKISNECIYVADKRDVDPQKRIFRLRFNFKNKQYDKNKKYYLVAYDEKNDLEVFRHGVVMDIAFANDFGFNV

SEQ ID NO: 2022 - protein, 767 aa, Vibrio cholerae; identical to SEQ ID NO: 1828

SEQ ID NO: 2023 - protein, 840 aa, Enterococcus faecium; identical to SEQ ID NO: 1912

SEQ ID NO: 2024 - protein, 899 aa, Vibrio shilonii
MNIDQISQGLLNKFEHSRLVFWQDTDKEFIDQLDELSIDGIEIIHLDDKSHFEVKTRVELLEPATRFVLYSNTETNKPERDWLYDIRLYSEDFYADSSSMILNEIGMRMEFRQVISHYRAFFTAKVRRERLKKLLPHSANKEELELALLAATLKVESPTFPAILNHLLLKLADGIDVNTIFSDLEKYNLVDTFWRFAFDVMGYQVEKFDDTEQIQPHLNDLVTKLLFTECYQSLLNSGINGNHEVFARFKQHLLPINLDESGKRDYTERRTFNSSKRATAISFIKGMRENRNLSNAYNTLAKQVEQEFEIKHILSLVKSPTHLHRVDTFEYAEQHFIILLAQQLSDLDQVEVDSLISHRLTTHWTHHQPNYAAILKAIRAAKQFYALKQQYIDGFSFSSAKEMYRAYETDLYKFDSAYRRFCEHALKVAHNGSDILKKTGLVSDIETLYVDWYLHDLAIAWGKLVDEESLLDNWKISGVPNQNEFYRRQVEGIFNTTQVKKVFVIISDALRYEVAHAISDQINNEKRFHSEIKSQLGVVPSYTQLGMASLLPHNEISTHINSTVEYKVDGISARGTDNRNKILAKRNGIAFKASEVLNWTNEEGREKVHDARVIYIYHNEIDKVGDKGESEHQTFEACATAISEIKQLIERIINRLNGSRVLITADHGFIFKSSDVVDSDRTALTVKPKGAVEAKKRYIIGESLPNDSFYWHGKMTNTASLTVNSECSDGEFIVPRGSNRFNFVGGAKFIHGGIMPQEICVPVIQVKELTTNKLQSRYAKERVPVVPLSNPIRLVSMADKIELFQAAAVGEKYTARELKIWIADPNGQPVSHKQKVMFDATSEKQDDRKRNIVIMLNGTGFDRTVSYKLMMKDISDPTKTQELQPHSVTIDIAIEDDFF

SEQ ID NO: 2025 - protein, 830 aa, Brachybacterium paraconglomeratum
MTDLTSVQEALQSRLASQRIVFWHDPTGEYAADLDAFDLGPVNVIRVEDNEFGVKNTILADHITKHLIYRSGDIPRGTANWLLDLELACGVFTAAKTSMLQHELGLNDPTLLPVIEQHQKFFSVNSRKQALKKLLNDGDDAARLRAKMSQVLIKASGNKLTDIVRELLVENAAGKNAKFDDLVTFGLDQFFWDGLTSIYKYQSTTPTIDDFVLWMFSRAIEDFTSTAPDEFRNIRSDFNALRYDVRTRDAMMKLASRAAEALDVQSKIEHRGYRDLAKITIFEEIDRKVIVDLAAAVVTQSVTPREVADIVRQRQHSLWSAKYTKLYEAIQSASELLAATAALPHAIASAAVGLEKYQSDWFRIDQHYRWFTYAHQTADFQKPLEALKAEVDKQYANKYLYDFGGLWQQALEPLSEWKSAVLAPQAKFFDRHVAPVVKDGRTKVVVIISDGMRYEIAEELASKIRSEDRFDASLSAVLGSLPSYTQLGMASLLPQSNLELDPEGLPVLADGKPTNGTTNRDKILHAVKGHAITAAEVLAMPGSELRELYTKHQIFYVYHDRIDAAGDKAPTERTVFEAAEETLREVLQLVKKWTNANATNILITADHGFLYQDTPLEQAYYVSETPQGDAVTKTNRRYVLGRSLKPSPSFMTFTSVQAGLAGAIDIQIPKSIHRIPQPGAGTRYVHGGASLQEVVVPVISVNKKRKSDVRPVNVDLMPETDKITTGQLAVKLLQREAVTDKIHSRQVRLGLYVGDTLISDQPVLTFDSASDDQRARYQKAVLYLTQDADQYNNRPAELRLEEPIPNTTQWKPFSKGNYTIKRSFSTDFDF

SEQ ID NO: 2026 - protein, 865 aa, Salmonella enterica; identical to SEQ ID NO: 1802

SEQ ID NO: 2027 - protein, 841 aa, Eubacterium cellulosolvens
MDLQEIQDKLNVLFEGSDRKIVFWYDDDAAYEGDIDSLQLSAGIKVFKLTGSNNFEAKLLLEHRDVDSNCLVYAPYARPEDKENSLVDIFYYSEHFYSDKLIQLMGELNIPPECQDEVKLYKKFWAGNNLQKFKSLEIETYTNESIDLGILCVLAGVKTLNFEEMLRKTILAGLTDNSIMKKLETQKIDRVFWRFCEKQYGYKDSNPTIQKFLVTMLVTYMDAQMNGNEPKTWKTFVSGKKNDAVVFIKNLMNNEESKEFYDGFASKAVDELNVAGLITQIPLADVVSSDALKEFDDNIIDWIAAKLEDQMLDEKISGMTIPEICETRSKSGYHFSSVYKEKYQMLIAAYHVLKEVSLRRYQSTIKDAVEDYVGGTYLIDTYYRKFYYYLDRIGMDTNMEKIRDLVENMYTNKYLTDFSNKWNQLLTDEEYDAYTDTRQEEFYSQFVKKFMSEAGGGRVVVIISDGMRYECARELLDNLDLDEKCEAKIDHMLGVLPSETTLGMASLLPNNSIQVDGNLDIYVDELHCGNSTAERQKILQNIVPKSACYEFDSVMQAKQAELREMFQDKDLVYIYQNQIDQRGEGMRSDNEVFNACQEAIKEIQIMIHRLTGYVSNTRYLITADHGFIYKRDKLHESDKIKVEKISASYKNKRFLLSEEPISNDALVSRCMAYLGKLNKGFATTPIGADIIRMPGGGQNYVHGGSSLQEMVVPVLKVITFKGKQETGLVNVELSSFHHRVTNIEVKLDFMQMEAVTDTVKPRRLQAFFVDADGAKISFPVPITANIKSDDARDRLIQEKFTLKSGRYSRDQEYFLVIADQDDEKKELHRYKFEIDISDLAY

SEQ ID NO: 2028 - protein, 908 aa, Pseudoalteromonas luteoviolacea
MNLEQIKQGILAKFDKCRLVFWQDEEIEFQEQLPVIETEFESSGVELIKLDEYSHFEVKQRVELKEPNTQFLLYSNKALNEPTRDWLYDIRLYAEHFYADSSSMILNELGMRMEFRQDISRYKKFFGNQQRYSKLKKLLPEGADKQALELAMVAVVAKVESVSFTTILHQLISLFVESPNKCDEAIAELEKYDLTKIFWRHAVEEFGYIALGNWINDEDADMPVANVKDLITKLLVTDCYHGLQASGVSISKTDFATSLSAHVLPLTIDSESLDKLPKAIRELIGNAAAKRAAVVSFVSSWRESRTLSASYNDIVREVADELEIKHKLAEFKNPSNFINVETFIEVEQQLIKLIATDLQAYSANEISDWVSTKLYGHWCSVDKNYQYLFASLRAAKEFYDLRDKYFDGFYFDSAKVLYKAYESELYKFDHAYRIFFENFINLRKNNGGDLLQSLGLVDDIENLYVNWYLNDLAIAWGKLVDSESLLDNWKIVGVHNQQHFYQQEVRGLLRNTQAKRIFVIISDALRYEVAHDIYQRISDEGRLKPELKSQLGVVPSYTQLGMGSLLPHQKLTAHLGSKVEYKADGISVHGHDNRQKVLSKHNGVAFKADEVFKWTRQAAKQQIGEAEVVYIYHDMIDAIGDKQSTENQTFEAAQDTVVELIELIKRIFNRLNGSRVLLTADHGFLFKMTDLTDSDKTAHKSKPKGAIEDKKRYVIGSNLPSDDFYWTGKIANTAGIDPALGDDAEFIVPRGSNRFNFVGGAKFIHGGIMPQEICVPVLQVRELDTKAQTKLAKQKVGAVPLQNPIKIVSNIDRISFLQTDPVGDKFKARKLELWIEDPFGKQVSSKEEYTFDSVSEKLDERKRNIQIKLEGSGFDRTISYKLIMEDTESKTKTTHSVIIDLAFEDDFF

SEQ ID NO: 2029 - protein, 848 aa, Clostridium perfringens
MNLKEIKNFLNDIFSKPLGDGKVRHIVFWYDENEDFTEEIDEFDLEGVELIKLNDNNAFYTKYHIEKENVDGNILVYSNMKKPKPQEDWLYDILSYSEEFSTDRATVIMRELKVNNPYLKEAFTFYNTFFKNKDRLAAFRNLGIQDYTEEKVHIGVLAVLTKTKIMNFEEIVRALIKEKLEGNSKLYEDIDKFGSLDILWNLISKNYGYSFEERSLEKFMAVLLITNMNETIKFNLPKQYEDFVSKKSTDCIVFINHFMNSLKDSHYYDKMQRLIGEKIKISKLLEKTDSDKFLKCDVFEEMDKLILGRIINLLNDGIEEYDKYLNLMASRRTLHYYKKYESEYKALKWAIRLLSKKKELNSIIKTESSYEMVKSYARNYFEIDKAYRKFYYHFDNCELKEILNNLKDTVENLYNNWYLQELSIKWSEALAKQKTWRIEGINQQESFYNDNIKYGRKERVFVIISDALRYESAEELSTRLRNERKAKVELDYMQGVLPSYTKLGMAALLPNKKIEINSNYDVLVDGINSNGTENRDKILKVENDKSLAITYNKLMDLKEAEFRKVFSGLEVVYIYHNTIDAIGDHASTEREVFSATDTALNELINLVNKLVHRVSASSIIITSDHGYLYKRSHIEEYDKLSGVKLEDGEDNRRFFLTYKDIDIEGTMKFSMDYLLGEYSGISVITPKGIARFKVQGAGANYVHGGAMPQEVLVPIIRFKNDRSSSSENDIRKVKISLTSITRKITNIITYLEFFQDEKIQDKVITQRIKCYFEDEEGNRISNENTIIGDSKSENPIERSYREKFVLKSIPYDKRKRYYLVIEDEDDSSLQCEKIPFNIDIAIVDDFGF

SEQ ID NO: 2030 - protein, 840 aa, Enterococcus faecium; identical to SEQ ID NO: 1912

SEQ ID NO: 2031 - protein, 885 aa, Vibrio cholerae; identical to SEQ ID NO: 1827

SEQ ID NO: 2032 - protein, 865 aa, Escherichia coli; identical to SEQ ID NO: 1759

SEQ ID NO: 2033 - protein, 767 aa, Vibrio cholerae; identical to SEQ ID NO: 1828

SEQ ID NO: 2034 - protein, 767 aa, Vibrio cholerae; identical to SEQ ID NO: 1828

SEQ ID NO: 2035 - protein, 838 aa, Fusobacterium ulcerans
MEIEKIKEMLEYRFSLTPVYPKKRHIIFWYDNDRAFKDVMEELRLENIKIIILTKEMNKKGEMIDTNIFKTKYTLEIADIESNYLIYSEYPKPKDNENYLLDIEFYSEFFEADKSAMIIEELKLDRTDYKLSKIIKDHLEFFASKERKEKLKKVINDIDNMNENKLKMSILASISGSKSIEILEILKNLIINKNKLEIVEKWMGLKYLYNQIKKKFDIDVNNFKQFLKILLVVHFYRGIQQKPHINLEKYYIGKTNEIYLFVESLLQNNQINKMIKEEFYNLSLEINIKDRIDELELESSVQGIGIEYFDQIVIKDIVERLTLGFKEFDIYQKYIEIRLDNSLWREKYFYFYKALFAAINILRLKETVTVKERSNINEVFIDYTSEYYMIDKYYREFYYSYDNGKNNELYGILDELEDRIAYFYEKEYLEILLEIWSNHISEREKLPQQKNFYKEHITKADTRVAVIISDALRFEVGNEIAKKLMKEANTKEIILNSMITELPSITSIGMANLLPFGSQKKIDLIEKKIFIKNINTLNTENREKILKLSCGESVAITFDRFKNKSRGEQEEYIKGKKVIYIYHDNIDAIGDKGKTENRAFEACHITIEDITGLSKTLSSLGIVNIYITSDHGFLYERKEIAEYDKIELSNQEYFSIGKRYALYSNYVEEKGCITLNVNDLYGIFPIKNQRIKSLGNGLQFVHGGISPQEMIVPLIHYKSGVNSKKSSKVGVRIKESVWKITSNLTKFTIYQLEPVSIKGKIIERDIVAALYTELGIKVSDEFKVRLNATEENFQYNFRLTLSGEHKKVFLKISDIESGDILDSKEYNVNLGIASDFDF

SEQ ID NO: 2036 - protein, 833 aa, Roseobacter sp.
MTDRITASLERLFDEHRIVFWYDDARDMRGEFDAVDLAGVTKVEVANNQFGLKHRMLRQEPTAKFLVFHDGPEPGNAANWLLDLQLATAVFKADQAGIWLGELGLPPQFESVVRDHMEFYRSKARVAELKRLLHAADTQSQVRLRMLAVCAGAEGGLDTVVEALLSELAEGRDDAMRLIERSGLTEVFWKQVGNAYDYQPDQPDLEDFAIALFQSAYLRALGEDGKLNAEALLVFRRWKNNRHWEEAFETLAARYQGLLKIPEDLSKRDFRAVMAVDHFEEIDRHIIRQLVHAMSTQTVSASEVLKWVRERRQSHWYGSYTDIYQAIGFATEFQQALAEANLGMTSPAEGVKRYVSSWYKLDQLYRKFIYHMQRSGHASLLSELYEAVENRYTNSFLLKLNDAWQDQVAGLTDWTIPGYARQSAFYIEQAAEFRRRDQKVVVIISDALRFEVAEECLRRIRALNRFDAELKPMISALPSYTQLGMAALLPNRELSFASDGSGAILTCGESTQGLAAREKHLATGRVGDRAKALSARDVLDMRVDEGKELFRDNDVVYIYHNLIDAIGDKLQTEDQLPKAAEDAIEELTKLVRKLTSANFSNILITADHGFLYQHRALDESDFAVADPKGDEILLRNRRFVIGRGLEEAAGVKKFTSAELGLAGDLDVLIPNSINRLRVKGAGSRFVHGGASLQEIVIPVIRVGKQREADVNQVEVQIIVSGRSQITSGQTAVIFYQAQPVSEKMQARELVAGIYAADDTLISDEHVLQFDFTSENAREREMPRKFLLSREADKFNNQDVFLKLRERVGKTSHYQDYTSHRFQLKRGITTDFDF

SEQ ID NO: 2037 - protein, 865 aa, Escherichia coli; identical to SEQ ID NO: 1930

SEQ ID NO: 2038 - protein, 854 aa, Paenibacillus elgii
MNMDEVIKALQEAFQQPLNEGEQRKIIFWFDKDQEFAEYIHEVAIENVKVHTLSEGNSFYTKYLLEEEEDPTSNYLIYSNLDMDKDEDNWLLDTILYSKKFYADKTSFLMNELNIDPPLRSIVKKYEKFFGSKDRIRKFKGFEVSAFTEGTIELVMMSALCNLKTPDFEDVLKVVLMESLDDSQNKYLELIAKYVGVDVFWNTVAVRYGYEQNQKSLKTLFIHLTVTALSHVMNEGHLLLIKNYIAFRNKPNALVFIDHWMHHKTDYLVYDQCAEIVEKEIKLSDIVNQLPVEEFKAADTFPYFDKAIIIYIANSLEERLEDYEAYTKLINLRRAKHYYERFQSIYEALYYTVKMFEFHKKYSRGIPKTQAVDMYRAYVNDYHQMDMFYRKFYVAYDNESNSEILKKLKVMVENLYTNWYMSELSSHWSAAVHDELKSSWVLPGIQSQKDFYRSFVAPKIYNGDRVFVIISDALRYEIAAELTDKLNSETTGACDIQPLLGVLPSVTKMGMASLLPHKNLEIDLSGNVSVNGRSSSGIDNRIGILQSVLADSTAVHFQELKDMNKAGRRETFKGKKLVYIYHDSIDATGDKAATEVNTFTAAERAIDELYAIVKIIRDDLSGTNIFITADHGFVYQREALQESDKIEKEGIPAFEVKRRHLFTQEKGERSGLLDINMDNLITNEHQITTYVPKATIRFKIQGAGSNFVHGGASLQEIVVPLIQFKNIRSGQKNSLEIEKVDVKLTNTTRKITNSLFNLTFFQTERVEDKRVPRTVKIYMVDETDVVISNEEMLICDRTSDKPEERTFKLRFALKSMPYDKNASYYLITKDDETNVIVEKTPFSINLGIVSDFDF

SEQ ID NO: 2039 - protein, 865 aa, Escherichia coli; identical to SEQ ID NO: 1759

SEQ ID NO: 2040 - protein, 835 aa, Pseudomonas mandelii
MSNPKISQALSNLFDKQRIVFWYDTRLEFRADFETLELPDVEKIELANNEFGVKYRLLREQPEQKFLLYREGAEPPHLHNWLLDVQLASGNCFRTDQVALWLAELELGPDCYPLLEAHVAFFESAKRREALGKLLEPGDSQSLLQRKMLAVCAGNEPRLDVILENLLGDLAASKDVRIKLIESSCLNVYLWEQVKRAYGYSSEQPGLHDFVIELFKACFMLGIDPAYKARLSAEALVFLKRWKDSRSHEQSFEALSEQCAAVLQIDDKLQTLDWRSLLELDYFELIDRKILSELVRAVVARTVTAQEVEQWVRQRRQSHWFERFKDVYLALEHAAQFIQVLDITQLQMESLTDGVQKYASQWFRLDQRYRKFVYHLRESGQASLLGELAMQVENLYGNNYLSRLNDRWQQHVDAAQQWEAAPVVLQRNFFSRYVQPFVERKTKVCVLISDAFRYEVGEELQSLIRQEDRFEAELEPMLSMLPSYTQLGMAALLPNNNLQLADNDSGDAIVDGQSAQGSVNRGKILATRVPASQVVRAKDLLAMNQADSRALLRDNEVVYVYHNLIDKTGDTRDTEERVFSAAEETLSELIRLVKKLTNANASNLLITADHGFIYQNHPLQESDFLSGEPEGDEVLYRDRRFVLGRSLREGASFKTFNPVQLGLTGTLMVQIPKSINRLRLKGSGSRFVHGGATLQEVVIPVIRINKKRQSDVGRVEVEFIGGGGKTITTGQLAVVLYQTEAVTEKLQSRRLRAGLFTLDGELVSDQHELLFDFSSPNPRERELPVRFILSRKADEANNQQVELLLEETVDGTSHFTRYKAARYAIRRSFSSEFDF

SEQ ID NO: 2041 - protein, 885 aa, Vibrio cholerae; identical to SEQ ID NO: 1907

SEQ ID NO: 2042 - protein, 767 aa, Vibrio cholerae; identical to SEQ ID NO: 1828

SEQ ID NO: 2043 - protein, 767 aa, Vibrio cholerae; identical to SEQ ID NO: 1828

SEQ ID NO: 2044 - protein, 638 aa, Geobacillus sp.
MWELFEQHFGLHHLKEKDNLNDLLDNLLFQHFSRDALFEIEHLSNKYSSTRSNICALLIDDWMRGTNEEKEILESYIRTTESTWQLQHYLQEKTAEEIEKVTTFPIIDAILIEKVRNELLYKTTDLTAWKERITFRQKTYWGSKEKFSGLYTCLYHAVKLTEYKTNLKQYDSREDLYGQYIHSLHYIDQAYRQFMYSYSNLLQRDFIDSLEDKLTNWYENIYLRKLADETNYYLENEQKTRIPLQRRFFRTNVQPILEKEPTKVFVIISDALRYEAGYELCQQLNQLEYGEASISPLFASLPSYTQLGMASLLPFKQLAMDESKTIYADGISSLGIANRIKILQNAHKDAIAYRWDEFDQWTQTEADAHFKGKRLIYIYHDVIDAVGDSRKSERDTYGAVGKAIKELKMTVERLSRLQAKRIFITADHGFLFQYPKIEADVKIEPVKGTIYASNRRFAIGKNLSVPYGAIKLQEKDTPLKDVEVVIAKGLNRFTGGGGSQFVHGGAMPQEVIVPLIEYRRTEKAEPVEVSVAVLDKVITNYRFTVSFYQEQSISSDALPRQIKAAFYQGNERISNEVTISFDMVGANHERTKQVMFTLMEKYYAMGEFCTLRLETVNDKKTEPYKEETFIIKMYEALY

SEQ ID NO: 2045 - protein, 865 aa, Escherichia coli
MQFKELESGLRQKFTDNRIVFWHDPEQRFTDSLNELDLDNVTLLDMRGVSVLATKKRLEIDEPEQKFLLYFTCEVPAREQDWLLDIRLYSTEFHADYAAITLNSLGIPQLGLREHIQLRKAFFTVKRTQILKGWVTERETENSLDKKMLAVVVGASTFETKEILFALVQQFVAARQQDDSALENTFAVLTKLGLDEVLWEILRLELGYQSESPSMENLLLKLFCTDLWAQGDEAHRDWLSKNVLATAAGRASSLAFMGAWRNDRRYKAEYDYCAEDLQQTLQPKEHYNYSSPYTLAKCETFEAIEQIIIRGLVTQLQEESTTLDRDAFKALVSERSAKYWSQTRPEYLSIWNAIRQAERLLNLRNRYTDGFNFPDTGAFWKAYCDEIYRFDQTYRLFNEYAAPVHSKGAMILHELDKFIEELYSNWYLTELSRGWNKLLEAENRMQAWQFSGIPLQRNFYKENVKRQFDTSQVKRVFVVISDALRYEVAEELGRHINYEKHFSAELRSQTGVLPSYTQLGMAALLPHESLSYLPDNSGVVYADGMSTSGFEKRAAILAKVNGVALKAKDLQNANNQEVNEQIRNASVVYIWHDTIDAMGDKAATEDKTFEACRSAITELKDLVSRLRSRFNASRIFVTADHGFLFQQQALVEQDKTKLESKAKDTIEANKRFIVGHQLPESEFCWHGKLADTAGASDESEFLLPKGVQRFHFIGGARFVHGGAMLQEVCVPVLKIRALEKKAAEKQPQRQPVPVVARDQVIKLVNSIDKIGFIQTSAVNDLNQPRTLNIFIVDENNQVVSGTETVCFDSDNEDMGKRTRDVTMKLMGTAFNRKNKYVLILENADSATEYGRYPITIDLAFQDDFF

SEQ ID NO: 2046 - protein, 865 aa, Salmonella enterica; identical to SEQ ID NO: 1802

SEQ ID NO: 2047 - protein, 864 aa, Collinsella stercoris
MKLSDIQQELIRLFDEQDASAGTVVVWHDPDGAFAESLDALDLPGVDVMREEEHELFSLKRTLNGDLAGHRILLYRPRPRRLEGDWLADVEARSTSFAADYTSMQLRELNAVDTHEMREVLAAHKAQLAKKTVLRKLTRLSASFEQPQQLACGLMAIALDAPSPDAQAIVRAYLIAALASDGAEALAQVERMGCTDEFQAAISAWIGYTGDASDFIALGRHVLLCALAGALPNDAASVLPADVTSGSTALCQDIVRGWCQSAERDSLFELAQLVEEVAPVEQMLAQVPLENLGDIDVFPCIDALILRHLFHDVAASPENAPAALALAQARHSTAWYREFSLCYDGLEAAARMQRFRNEHPGGIDALSAERVWGLYTGELYRLDTWYRQMHLALGRALISAPYGLDEDFRACSDQIENLYKNWFFAGISRRWEDAAEDGLSRNGYVDGIPRQIDFFMSSVEPIVRAGKRACVIVSDALRYEVAAELAETLEQNTKGTCELASMQATFPSITSCGMASLLPCGHLTMDASEPGRLRVLLDGSEVATTAARQEQLRRSDPHAVAITYDSLVNEMSASQRKDLVKDAQVVYVYHNIIDAMGDKAPTERKVFSACDDTVKEIFGLVQLICRERIASQVVVTADHGFLYTDEPLSTSEHTVAAEIDGDTIVVGRRYAIAEGSARSDVLMPIALPHAEGKLKGFAPRRCTRIARAGAGENYVHGGISLQELCVPVLTFTNKRAGSKGYVESEQATLSLITTVDTISNSIFKLDLLQDKPVGGKVLPASYDVFVGNASREPVTDIAHVAADRTQDSADERVIPITLNIKPGVTVSEQEPYFLYARNCDIGTVDTLRELRMRIAFAPSFDFGW

SEQ ID NO: 2048 - protein, 865 aa, Glaciecola punicea
MTSRISTALERLFAKHRVVFWYDNKQELREDFDGLELDNVTKVELNNNEFTLKHKLLREEPKTNFLVYKQGKQPEPVKNWLYDVELSNAIFKTDQAAIWLSELELTSEFNEIVEKHTAFFEVDSNNKGSKSQATSDSDNRKATLKSLLEPDDTHSRIRLKMLAVSAGTKQKGDARLDVILELLMAENAEGKAYKLIERSKLNQFLWQQVTNHYGYRCDSPSLMDFVYELFKFSYLAELPTSLQGTSHVSGAANKEKMNNNALVFFKRWKDSRKHQKIFERLSEQCASVLNIESDLQHRSLNDVLELDYFRVIDLKVIHDLVNGVAKRTLSQGEVALWCRQRRQGHWYSEFELLYDAVDVASQFFALLDTLQFDMSSAQQAVERYTNQWFKLDQLYRKYVYALKVSSQHSLLSALTEQIENLYINNYVQPLTNAWQQYVDAMGKWQVPSVDPQNCFFKKYVEAKYLSKNKKVCVIISDAFRYEAGEDMVSRIRQEDRYDAKLNHALSAMPSYTQLGMASLLPQSTEYPLQLSDAKTGTVLMGNLSTQGTENRDKILKTIHGERASAVQAKNILEMTQVNSRELLKDNDVLYIYHNRIDHTGDKMQSEGEAFEATEHTFDDLIKLVKKLASANVSNVLITADHGFIYQNSKLDESDYLEKDVSGDILYNDRRFVLGKKLNCGKSLKLFSSEELGLAGDVHAVIPKGIQRLRLSGSGSRFVHGGASLQEVIIPIISINKKRASDTRLVTVELLRSGSSVITSGQISVTLYQAEAVTDKTQGRILRLGIYTESGKLISDSHTVEMDLTSDSPREREMKLRFLLNQEADAANNTEVILKLEEPVTGTNQFKEYKQLRYTIKRSFTSDFDF

SEQ ID NO: 2049 - protein, 845 aa, Enterococcus faecalis; identical to SEQ ID NO: 1939

SEQ ID NO: 2050 - protein, 860 aa, Pseudoalteromonas flavipulchra
MTSRISNALARLFTKHRIVFWYDDKQELRNDFETLELEDVKKVEIDNNEFSLKHTLLRDDYKSRFLVYKEGDQPEPVKNWLYDIELANTVFKTDQNAIWLNELELPSEFAEIVQQHAAFFEPEGKTKEAASQAEERRATLKNVIESDDTLSRIRLKMLAIATGTKQKGDVRLDVALERLIAEKAEGKTYKFIERCNLHHFLWEQVNNHYGYQSDSPSVMDFVFELFKYCYCAELPSGLQGVSQDSDAAKLQNMTNNALVFFKRWKDSRTHQETFEWLSEQCSNSMKIEDDLQHRSLKDVLDLDYFRVIDKKVIHELVNGVAKRTLSQGEVALWCRQRRQGHWYKDFELLYDAVDVASQFFALLDTTQLDMSSASEAVQSYTRQWFKLDQLYRKYIYALKASSQHSLLNSLTEQIENLYINNYVQPLTNSWQQHVNDMDKWQVSGVDPQSRFFKKYVETNYLNKNKKVCVIISDAFRYEAGEEMVSRIRQEDRYEAKLNHALSSLPSYTQLGMASLLPQSKEYPLRLADSKGTVFMGELSTQGTDNRDKVLKAIHGERASAIQAKELLEMNQINSRELLKANDILYIYHNRIDHAGDKMQSEGEAFEATERTFDDLIKLIKKLANANANNLVITADHGFIYQNSALDDSDYSAKDVEGEIVYNDRRFVLGKNLSAGRSFKTFTAEQLGLTGDVHAVIPKGIQRMRLSGSGSRFVHGGASLQETIIPIISINKKRSSDITMVEVEVLRSGYSVITSGQISVILYQVEAVTDKIQPRKLRLGIYTESGKLISDSHTVDVDLTSENAREREMKLRFLLNQEADSANHQEVILKLEEPVAGTNQWEEYKQLRYTIKRSFTSDFDF

SEQ ID NO: 2051 - protein, 865 aa, Escherichia coli
MQNQDFIAGLKAKFAEHRIVFWHDPDKRFIEELEQLELENVTLINMTHASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLESVLWEMLNHEMGYQAEEPSLENLLLKLFCTDLSAQADPQQRAWLEKNVLLTPSGRASALAFMVTWRADRRYKDAYDYCAQQMQAALHPEDHYRLSSPYDLHECETTLSIEQTIIHALVTQLQEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRNLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 2052 - protein, 840 aa, Johnsonella ignava
MAELNLKQIIDRLNAEFTGETRKLVFWYDDKAEFAEDMETVELQNAKIYHLQPDNQFYTKYFLERVDKTTNYLIYAPFPKPDVRDNHLEDTMLYSRRFFADRASLLSVDLGIEEKYKPVIEKHIKFFANKERTQRFYDLEIENFNEENILVGLLSAVCKARTCSFEEVVRIVLTDGELADNALLQEFEKYDLLSAFWQLCEQHFGYTDTKPSLERLLVTLFVTYTGRYVHAEFPAAWKSFVSYKSGNIIAFLDSLMNSVLYRDKYDALSEHVAKGLNVLPAFAGMRVDDLVECDTFLAVDQVLVKWLIGRLVSEDIGAIANGLTIPELCEKRVKMHFGRKTGKTYQMLSSACSMVKEADYHAADGLKPIIDRYLAADYNMDQQYRKFYYYYDQLESTESFEPLRELVENIYTNEYLACLLPAWNAGIQQDAAFSAIPLQREFYNANLRYTKERTVVIISDAMRYEVGQELFARMQDDPKCTAKLSVQLSVLPSYTRLGMAAVLPHKTLEMTDDFQVLADGILCDNLAGRQQVLQNYNPDSVCVQFDDIKNLKVAELRDVLTRRQIIYVYHNQIDARGDKANTEDEVFNACEEAVQEIMDLIHRVSVSGNTYHFIVTADHGFIYNRDKLTESDKISGKSAEKAFVNRRFIVSKAALEDDGIDHMSMGRVLGNKDSKVVSYPVSSNVFKVAGGGANYVHGGSSPQEMLVPVLEFKMERGHMETKSAEIALVSIVHKITNLITSMDFIQSDAVSDTVKTAKYRIFFLSEENEKISNENSYVADSREENAQNRIFRMRFTFKNKKYDKDKQYYLVVYDEESGLEQWRQPVIMDIAFADDFGFGF

SEQ ID NO: 2053 - protein, 767 aa, Vibrio cholerae; identical to SEQ ID NO: 1828

SEQ ID NO: 2054 - protein, 767 aa, Vibrio cholerae; identical to SEQ ID NO: 1828

SEQ ID NO: 2055 - protein, 865 aa, Enterobacter sp.
MQNQEFIAGLKAKFAEHRIVFWHDPDKRFLEELGNLKLENLTLLDMTDQSQLAVKKRIEIDEPEQQFLLWFPHDVPPKEFDWLLDIRLYSTEFHADFAAITLNTLGIPQLGLREHIQRRKAFFSTKRLSALKGLVTEQENEASLDKKMVAVIAGVKTAKTEEILFSLITQYVNQKKDDYSDLENTLAMLKRHDLEGVLWDTLNQEMGYQAEQPSLENLILKLFCTDLSAQADPQKREWLEKNVLTTPSGRASALAFMVTWRADRRYKEAYDYCAQQMQDALRPEDQYRLSSPYDLHECETTLSIEQTIIHALVTQLLEESTTLDREAFKKLLSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLEAENRMQEWRIAGVPRQQNFYNEVVKPQFNNPQIKRVFVIISDALRYEVAEELGNQINTEKRFTAELRSQLGVLPSYTQLGMAALLPHDEICYQPGSGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTSGVSDNSEFLIPKGIQRFHFSGGARFVHGGAMLQEVCVPVLQVKALQKTAAEKQPQRRPVDIVNYHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 2056 - protein, 840 aa, Enterococcus faecium; identical to SEQ ID NO: 1912

SEQ ID NO: 2057 - protein, 767 aa, Vibrio cholerae; identical to SEQ ID NO: 1828

SEQ ID NO: 2058 - protein, 854 aa, Bacillus cereus
MNTKEIDQVLQETFNKELIEGKKRHIVFWYDEAGEFIEDIDELNLEGVRIWKLTSHNMFATKLEVEKNDVNSNFLIYANMAKPSAREDWLLDVYKYSQEFSTDKMTVMIRDLGITNDAALRDVFKKYTKFFNSKERYALFKAFSVPEYTEEQIDLTVLASLCKCSIVNLDEVIKGLFREQLKETNKYWENIQKFGDEETFWSLVEKAYGYNLQDKSIDSLLIFFLLTNVSETLGGDIPKTWQPYISAMPMNAIVFMNQFMNHSADEIIYNELANTVEKRVKVTEHLQSKEIKDYITSDTFSCFDTNIITYITKQLVDAIHDYTSYIEIIAARRTLHWFSVFLNEYEALYQAIQLFQKIYEIDNVIAESQPFDLFKAYESKYYTIDTAYRKFYVAFDQIEDKDGFRDLRDKVENIYTNVFMNELAIKWSNALEGEQEEYWPIAGLESQHTFYRSFVQPFVNKEERVFVIISDALRYEVAKELSNVLNVERKASTDIVAMQGVLPSYTDLGMATLLPYKSITFNENAEVYVNDYKASSTENRATILSNHYKDSTAIQYKDLAAMNRQQFRDVFSGKKVSYIYHNVIDARGDHAATEHEVFHAVEQTLKDIRSLVNQLINTVSASNIVITADHGFIYNRDTLQASDKVKKDLLNTDIEKRRFIISSESDSFEGTMNFSMDYVLGEGSGKYVKVPRGANRFAVQGTGANYVHGGAMLQEVVVPVIKFKNDRSKSSKNDVKKVEVKLTSLTRKITNSITYLEFFQTEKIEDKKTPLRLKVYFTDEEGNRISNENIIIADSQSSKPEDRTFKEKFVLKSMTYDKTKKYYLVLEDEEETVENIYEIVAFTIDIAITNDFGF

SEQ ID NO: 2059 - protein, 840 aa, Enterococcus faecium; identical to SEQ ID NO: 1912

SEQ ID NO: 2060 - protein, 867 aa, Salmonella enterica; identical to SEQ ID NO: 1803

SEQ ID NO: 2061 - protein, 767 aa, Vibrio cholerae; identical to SEQ ID NO: 1828

SEQ ID NO: 2062 - protein, 767 aa, Vibrio cholerae; identical to SEQ ID NO: 1828

SEQ ID NO: 2063 - protein, 609 aa, Escherichia coli
MVTWRADRRYKDAYDYCAQQMQAALHPEDHYRLSSPYDLHECETTLSIEQTIIHALVTQLLEESTTLDREAFKKLLSERQSKYWCQTQPEYCAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 2064 - protein, 865 aa, Salmonella enterica; identical to SEQ ID NO: 1802

SEQ ID NO: 2065 - protein, 848 aa, Bacillus cereus
MNIIEELLRLFHQQQEEHNSTNRSLVFWYDAQSEGRDVTEIEEALKRENIQLHYLDEHNAFRTKVLLEKEDTNNSYLIYAPFPKPEDRENFLLDILLYSGSYGEFQADEVAIRMKELRLDHLAIRPFLEEHTKFFENKQRIAKFQKLLPNKSTVEQVKQTMLAVLCNAKSITPQDILKSVVAGGSLSDTNELLEQVAKYLDTEVFYTFIEEYFGMSKEDNNRLAQIIETIVFQHYAAYLDEKLLAFKYESTVPNICKVFVEDWLKSEERNVLEGILDILEQKWNVTQSVDQYTYQAFLRCDTFAVVERKILDVLHELLLNETIVVTEWKSILTERSKSYWYKTRFHKEYELLEKALRLYEWKDVFERNDIPKNEEEWVTIYTDKYYNIDQAYRHFQVHYVNEPNLDEYSELLERLTFWYENRYLVELGRYTDEIVEAKLKENWPITDVMQQKNFYRYMIRPLVEGSRERIFVIISDALRYEIGQELTNSFSQRLNTEVRLIPMQASLPTYTQLGMAALLPGKISNIASDGTVYVDEVSTKGLQNRNKILQSREPDSIALKMEDFIGLSKEDGLGFIKGKRVVYLYHDNIDAIGDSGKTEGYTYEAVESTMERVKIAVRKLTGTYEAGRIFITSDHGFLYQSSQVEKHQKTESIKGDVFDSNRRFAIGKDLIEPEGTVKISLKYLGLEQEAVIAKGLNRFTAGGGLRFVHGGAMPQESIVPLIEYRQLKGKARKTEKELVDVRVTSIQKVITSYQFIVPFFQEEKVSNELYPRTLRAAFYRNNERISNELTILFDSKGEVVERQTDAVFHLLEDRYKTGDVCVLRLEDVSGRTTEVYKEEEFELKLYSI

SEQ ID NO: 2066 - protein, 832 aa, Lactobacillus rhamnosus
MAEVEMKDVVTGIEKLFKSGTHFVFWYDKNGEFAENIDDLAQKLNEPVVVMAARTQLQTKLKLIKIEEAGEKALVYANFAEPDIHQNLLTDMILYSKKFTADMNVMLLHELGLPETELSFVEDQRKFFGAKPRIARFKQRYQHGKNPEQVELAAIAKTSDLQLSNILIEVIKNPSLLNGFDKYQLLSTFWSFVDRAYGYHGKHELQDLLATMMINFAYYQMELDLPASLQSYEVSYINNVVSFMLNWRNRRDTRAVYKKIATDVWQHLDGYQLFKSLKISERLKTDTFIQFDQQVVEWLVEQLLQGHLGEVIDQMSLPEIAGKRCRMYFAEENQLAYSMIVQAHRILTKRELHDTGKLDDLIHAYITDGYLIDTAYRKYTNASDQLPTSQVEVFEKLSQKVEAAYNNDYLAPAIHDWCQDYVPNVVEPRTLERNFYSSVVAPNKDRVVVIISDAFRFEAAKELQERLDSRDVFGTDMHYAITGVPSVTYFGMPSLLPNQKLTYQGDKELLVDGKKAVNLEQRLEILQSLEPQSRAMHLKDFISMSLADQKKYIVNQKVIYFYHDTVDATGDKPASEANVFRAVDDAIEELTRAIDRLRNISIRNIYVTADHGFIYRRHLLDSTDKISLPAEVDFEQKNLRYAIGSQDFDEIGVGRVKLGDILNNDDERMVFYPSNANVFSVPGAGQNYVHGGCSPQEMIVPVLHVLTESRKSQATYVTLSVTDSTRRITSHEVIVNMLQNDPVDETHRPATYALYFVDGSGRHISGEQVVQADSTSVNVNDRLIRKHIPLIDQDFDRAGHYQLIIQNVEANTTTSIDYQMDLTVEGGFDFDI

SEQ ID NO: 2067 - protein, 808 aa, Haloarcula japonica
MGDLADSIITELRQKFDRHPVWVWYDAQEKYKGVLNQVEAELDDVTLARYDGSYFELKLRLRNEDPDYEKNWLFYIPESRNDAEWFRDVHALGRQYRVGQDIDDTPVTQFLVEHDEEIPDAYEDWGQNREYQRLAFFCVLFETVGPAIDEWVRDYLTDPEEYREDIEDNAMADAWDAQLREEYGIDAGLDPKELATQLLFGEVTSRAPAAQYDNLAANDAQAAAKFCDDWQQYAPADFTRYSREIEADYDLTEAVIESDQTRWNATAFKGIDTGLIRLVMDRLAEETYADLPEIAAELNRTVTKRRDSFWSNEDLVDWSVPALAVETLRQIGTVDVDDAKAMGSMELAGQYTSDDGWWQVDAAYRRYINATQKATFPYPKEATVKRQVTNHYMAFLQGVNRPLAEILSDDPTLGTPQTSFYEEFAEVEDGTAIIICDGLRYELAEAIRENLGRRTDFEQDLSAVSAALPSITEVGMAAHLPGELGLSLDDDELVVTSGGEEMAGKAERVERLSAAGFDVVDMDEVGDISLEELTESDPVPRVVYSGTIDKLGESLDDDAAFSQVASHVDDVERTVQRLKQAGYTRFVITSDHGFLYTDRLNDDHKVEAPDLAPVVKRRFAATDRETPLVDTDEFVEIGHEALSKLGIDGSEIKLLFPRSVACFKSRGGNMRYFHGGISLQELLVPCLTVTTGEIEESASISYDVSIPDPITNSILTVEIEAKSGQVAFDPAPILEVRATIDGEPVADPVTMEISPGDNSTRVRLKQGAISGEDMVQFEVVDTDTRETITRQTVSLDLLFGDDDMGFDV

SEQ ID NO: 2068 - protein, 832 aa, Lactobacillus rhamnosus; identical to SEQ ID NO: 2066

SEQ ID NO: 2069 - protein, 865 aa, Salmonella enterica; identical to SEQ ID NO: 1802

SEQ ID NO: 2070 - protein, 874 aa, Vibrio tubiashii
MNLNQLREGLEQAFYKENHRLVFWYDPEQSFVDELPSLSLVDVQILNMANESALGTKLKLELEDKAGKYLLYFPFAEPDVEKDWLLDIKLYSRCFYADRFSIIFNELGLHQQSLREHLAKRDKFLANKARLTALQRYVQPDFDESDLDMAMIASVVKAESCDLPHVILALAEETVSDDLGLEANPASINELEKYDLIPALVAALQSEIGYPATVEELKGEAQFKLGHFFIRLLVTGFCESVGDVPGWAQELVMSSASSRATARALLSRWRDSSRYYKAFDAVSGWVAIALRIKDKMGIFDTDQLSDVVTFEAVEQKIIVDLAVAIPHAPKGELERFRAMIASRLDGYWASKHKDDTTRRKYRTVYTALQAAIDLFSLRIQHDSGFHFESSEALYKAYERDLYRFDMAYRHYCEASQRAHVEILKKLDDEVENCYAYWYIDNLAKNWGDRVEVEQRLSQWRFPGIPNQQDFFQGLVKPLFSKATKRRVVVIISDAFRYEAAVELRDRINDKRYSEATLSSQLGVVPSYTTLGMASLLPHKTLEYRETASDDVFVDGQSSKGTAARTKILAAHGGLAVTAETVKAWSRDEGREALKDQELVYVYHNVVDARGDSSSTESETFMAVEHAIEELTELSRKILMHFNTSTVLITADHGFLFQQSKLEAADRSSLAEKPTNALKNKKRYVVGFGLPDTKEAWKGSTKSTAGTASDTDFWVPKGANRFHFVGGSRFVHGGVMPQEIVVPVLTVKQLRGEKAEKRTKRKVGVISTKSTLKMVNNIQKFDLMQTEVVSDLVTPVTVSVAIYDGDSKISSEETVTFDCATDSVAERVKQVRLSLSGTDFDRKKDYFLVLKDKDLNTEMERYKVTIDLAFTDDFF

SEQ ID NO: 2071 - protein, 767 aa, Vibrio cholerae; identical to SEQ ID NO: 1828

SEQ ID NO: 2072 - protein, 767 aa, Vibrio cholerae; identical to SEQ ID NO: 1828

SEQ ID NO: 2073 - protein, 865 aa, Salmonella enterica; identical to SEQ ID NO: 1802

SEQ ID NO: 2074 - protein, 865 aa, Escherichia coli; identical to SEQ ID NO: 1930

SEQ ID NO: 2075 - protein, 835 aa, Lactobacillus reuteri; identical to SEQ ID NO: 1776

SEQ ID NO: 2076 - protein, 767 aa, Vibrio cholerae; identical to SEQ ID NO: 1828

SEQ ID NO: 2077 - protein, 767 aa, Vibrio cholerae; identical to SEQ ID NO: 1828

SEQ ID NO: 2078 - protein, 865 aa, Escherichia coli; identical to SEQ ID NO: 1756

SEQ ID NO: 2079 - protein, 840 aa, Enterococcus faecium
MTDINTQQIEEKLNQRFPNYGCRKIIFWFDSNQDFLEEIDSLVIQNAKIYRLEKDAQFKTKRLLEYEDPETNYLIYAPFPRWDDKDEDNHLLSVLNYSEEFSADRLAIIMNELAIPLRFHQTVKQYRNFFNAKDRMRSFGEFSTHMTINKSETIELMIMAVLLKSKSIRLNDLLRVVLKSFTESRENPLRELDKYQLTAKFWEFIQMKFGFTDSQPTLEKLTMCLYLNYFYYQIDQEMPKKFKGFEILHLKANIITFMDQFMNDTRYMESFEQLSKKVYQAIDGDGLLDSIEIDDLIEADVFSEIHAKILMFYAERLKASDTTTKIAGQTIFDSLKQREKMHFASDYTYEYQLLKHAYYLVDKNRLCLPMNMDNLLTQYEKEMYWVDTHYRKFIWNSDHIEEKQKYGQLYRLVEANYSKFLDQSGQIWNQTFEFKNRPSIRKFYNQAVMKRSVKTVVIISDAFRYELGMNLERKLVREKKYSTNMASFLSVLPSVTEFGKAALLPNNQLTYNEGTEVLIDGKKTNGLSNRNAILQQRDANAVALNYDDVVKMNKAEVREVFNGKSVIYIYHDQVDRTGDHSNENRVFEACDLAISEISRLINRLHNDGSIYRFIVTADHGFIYKRSHVEEVDKIENPSRNEKDRVERRFILSEEEYEIIGTKNYSLGDSLGNDDTRNICVPITSSIFKKAGGGQSYVHGGSSIQEMLVPVLEITVAKGSNAKEPVAIELMTSNRRITGLSTTLEFYQKNAISDVYDPASFWLYFEDEYGERISNEEIYVADSKTEDANQRFTKFVFEFVNRRYTVEDTYYLVIKNQKNDLTERIKFIIDNPFAESFDFDI

SEQ ID NO: 2080 - protein, 767 aa, Vibrio cholerae; identical to SEQ ID NO: 1828

SEQ ID NO: 2081 - protein, 867 aa, Escherichia coli
MNLQNQDFIAGLKAKFAEHRIVFWHDPDKRFIEELEQLKLENVTLINMTHESQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKHHGLDSVLWEMLNHEMGYQAEEPSLENLLLKLFCTDLSAQADPQQRAWLEKNVLLTPSGRASALAFMVTWRADRRYKEAYDYCAQQMQTALHPEDHYRLSSPYDLHECETTLSIEQTIIHALVTQLLEESTTLDRETFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIVSDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVANTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 2082 - protein, 833 aa, Sphingobium indicum
MNDRIAKGLEAAFDRHRIVFWTDAARELRETFETLELPGVEKIQLANNEFAVKHRILREVPQGRFLIYREGPEPAQIHNWLLDVQLAHGTFKADQAALWLSELGLGLGLEDVVRAHAEFFRSARRLEQLKRLARNDDTASALRLKMLSVCAGGEGGFDSVVERLLADLAVDTDEAIRLIERAGLGAFLWDQMGRHYGYTAVQPSVEDFAVSLFKACYAMGLGEAGGLSPEALVFFRRWKNNRHAAQAFEALSSSYASVLGVRTDLETRDFRHLIELDYFEDIDRAIIVALVRGVSACTLAAGDVASWIRQRRQSYWYDRFRDLYEAIGFAAEFHAAMAQVNLGMTSLAEGVSRYAGNWFRIDQLYRKFIYHMQKSGQASLMAELYEQVENHYVNSYLLRLNDSWQVHVDAAPTWDAAPVPAQRTFYATQVVPYRQKDQKICVIISDAMRYEVAEELLARVRGLDRYDAEIEPMLGSLPTYTQLGMASLLPNRDIRIADNDTSAVIVDGQSSQGSENRRKILAQGREGDRTTALLADDLLKMQRDDYRALFRDHDVIYVYHNLIDATGDKPATEDRVFEAAEKTLDELVQLVKKLAAANANNLLITADHGFIYQHRPIDESDFSGSEVVGDTILFRNRRFVLGRGLKPQQGLRLYKSGEARLQGDVEILIPKSINRLRLKGSGSRFVHGGATLQEAVVPVVRINKKRQSDTSIVDVEIIGSTNQVITASQISVRFYQSVPATEKTQARRLRAGIFSQSGELISDSHELVFDFRSENPREREHPVRFLLSRKADDCNGQEVVLRLEEQHGDTSHYSEYRSARYILRRSFTNDFDF

SEQ ID NO: 2083 - protein, 767 aa, Vibrio cholerae; identical to SEQ ID NO: 1828

SEQ ID NO: 2084 - protein, 767 aa, Vibrio cholerae; identical to SEQ ID NO: 1828

SEQ ID NO: 2085 - protein, 865 aa, Escherichia coli; identical to SEQ ID NO: 1919

SEQ ID NO: 2086 - protein, 854 aa, Sporolactobacillus vineae
MKLKEVQRVLNETFHKPLRWGQKRHLVFWYDPAGEFKEDIHDLQLDQVHIWELTPDNFFATKYELEKKDPESSFLIYAPMAKPAPQEDWLYDQLKMGVEFSTDKTTAIMRELGVSDDGLRKVFHRYMKFFNNKQRFAAFQAFGIQNYDPEKIDVAVLAVLTHNAINKLDEVVEVLMRETAAGGNRSWEMIGKFGDIDAFWHLVEKAYGYTRGEKSLPDLITFFMLTYLVSTAPDLNLPEDWKAYLAVRPMNVVVLMSQFMNQPQDRAAFQKLSGMVAKTIHLESHLKAWEVQNYLKADAFKEFDQSLIQYIITQLTSGVGQFDTYQSMLDARRTLHWYPDYVDAYEAVGQAICLFQLDAEQQHFIPESSAGQMFQKYTDDYYRFDQAYRKFYMTYDRWQQDDSLIPLRRQVEHAYTSGYLRELSAKWTQSLNRRAPDQWAITGVPQQTRFYTECVQPYVTRGERVFVIISDAFRYEAGQELTDRLNQEKKGLAELSAMQSTLPSYTALGMPALLPHHSLSYQGNSQKEPEILLDQMTTIGTYARNLILQKRVKESLAIQAQDLRDMRQQEMRQKFQSLKVVYIYHNRIDASGDHPASETEVFAATEQAIDELIALVNKLVNNVSASAVIVTADHGYLYQRDPVKPSGKLPKADGMVLALNRRFMLSEEKTDAEGTLQFSTEGELANDPPLMITIPNGDERFMVQGGGANYVHGGAMLQEIAVPVVAFRSRRNDVLRQVNVKLMSSTRKITNIITFLEFYQTEPMAEKVHPRRLNLFFTDSDKEKMSNEVHLLADRSSEKPADRVFREKFVFKNRSYDRHATYYLVLEDEDQTVEKIYERIPFTIDIAFADDFGF

SEQ ID NO: 2087 - protein, 767 aa, Vibrio cholerae; identical to SEQ ID NO: 1828

SEQ ID NO: 2088 - protein, 740 aa, Streptomyces sp.
MFTADRASLVQQELGLAADDVGEVVQAHEKFFQAAKRVRVLKGLLHADDDTLVLQAKMVAVLLGQREHSLLEITRALLAENADGADDKYGVLVEYGLDDFHWQGVASIYGYTSQSPSIDDFVLWMFRQAAAGFMSERPGGLRNIQLDFASLRYDVRSQQAMTTLATRVARDLDYASTIEDTGFRDLLGNDLFEEVDQKIISDLASAVADRTVAAREVTEVIRSRQNSFWIDGYRKLYSAIGSASDLLTALSALDLSMQSFDEGLDRYRNDWFRIDQLYRQFAYAARTAEHAGPLERLREQVESFYANKFLYTLGAAWQQHVDGVDRWRSAVLRPQTSFFADHVKPITRDGRRKAVVIISDALRYEVADELGSRIRQEDRFDATLDAVLGVLPSYTQLGMAALLPHTTIGHSGKGDRVAVDGQQSAGTDNRSKILAGVRGTAVPAENLLGMTRDEIRELYRQHQVLYVYHNRIDATGDKQGTERQVFEAAEKTLEELVDLVKRLASADATNIFVTADHGFLFQESALDEAGYLSVAPQGDSIAVQARRYVLGTGLKPDPAFKTYTSAQLGLDSDYEVQIPKSIHRLRLKGSGARFVHGGAALQEIVVPVLAINKKRKSDTRLVNVEILPESDKITTGQLVVKLFQTEPVSEKIQPRALRAGLYFGETLISNHAPLVFDQESADRRDRYQSAVMLLSQDANDYNNRAVEFRLEELIPNTTQWRVYGKAMYTLKRSFASDFDF

SEQ ID NO: 2089 - protein, 865 aa, Salmonella enterica; identical to SEQ ID NO: 1802

SEQ ID NO: 2090 - protein, 840 aa, Enterococcus faecium; identical to SEQ ID NO: 1912

SEQ ID NO: 2091 - protein, 865 aa, Escherichia coli; identical to SEQ ID NO: 1759

SEQ ID NO: 2092 - protein, 818 aa, Bacteroides xylanisolvens
MDIQGYILDHWQAKMKPETPVIIIYDKEGVYYDLLPIAIEKGFKVIDTTKGALHARLSASRFWCNDLSIDKNVQMIIYRQRPMPTNNRSWVEEPFSCFMKSACIFPYGPQDTYENICRTFLPSKQQDLDKLFANGSTSFNMINALLDGAAYPELEQLTGGKSISEITVGLLALDECTNMNWQKEWRILAEVQFPRLDCTGVSLNEVQNKLWTYLLFSEFVFDLPGALPENLKSVPMAPVEMKEKVYMICDKLRNQINLRETYVRIANKVSEQLKLSEVFVKAKHLGERVTFNFENSVEYNRFIDYIKAGDIQEATRLISKNESGVWYQEEQEVSNYWKLAQHIVDLMQCINNGIETDGTLADLIEWYTNVGCVADNAFRKFHTDKLGMLHLPKQADELTNLINKHYREFTERGVKAYQQLIIDIKDYPKLRNQGYIQFVKPAIKNGKRVVFVMVDAFRYEMGKTFAKSIERNFMERVECLSRISYLPSITRFGMASHMGDISVRNIQGKLQPFIGEQMVSTPEDRITWLKADTNIEVQDFRLEEFNSAKVNDRTRLLVVRSVSIDSAGENDKLNGLATMEREQIRLAKLLDDCKRLKFDEAIIVADHGFMIQPSFNVGDLINKPKGSDISIEESRVIAGNLNDSNDTLSLTTTQLGNDMEVMKLSYAKDYTVFTRGEIYYHEGLSLQENVVPIIRVKLQEEKKRQSFQVSLSYKGKNGGTIFSRRPLIDINTTFANLFADDVIMKLKVTGDNDCEIGEAEDRFYDSVTGLIRIPSGATSVRQLINIRDEYHGNTVTITALDTETNATLSTLRLNFEND

SEQ ID NO: 2093 - protein, 865 aa, Escherichia coli
MQNQDFIAGLKAKFAEHRIVFWHDPDKRFIEELEQLKLENVTLINMTLASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKEAYDYCAQQMQAALQPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 2094 - protein, 865 aa, Salmonella enterica; identical to SEQ ID NO: 1802

SEQ ID NO: 2095 - protein, 818 aa, Bacteroides sp.; identical to SEQ ID NO: 2092

SEQ ID NO: 2096 - protein, 853 aa, Opitutaceae bacterium
MLASAFFAQIQQRFSHEKRARVCVWFDPQEEFRRLLPVFHAHLAKSAPQTVHLLAYNPKAKHGQIWLKHQVWLLSQTDPAAKFVLYLPLPKERWNGPDERGKHHLELLTEYRITGTDWKVGGKRPSLFSFLKAAGAALPTDQTEQRKLTDGGPDSPLAKYAAKFATKAPLFWEESLTAELAQSRLVGDVDQQLLDLAVEPETEWTALQEKGVLDEFLAALTERLGSVPQTDNPVLWVKSLVERLALTEAFVGYGEPGDFPFADRLPPSRDREAHVALLRRWLRDTNCRPAWDRWIAEIEQHVNLTAWAKGKTGAAYGFSHLVSLRWQDAVKSVVTAATKAEGFGDYLAEEAPSLRSEADFSRASTTSECDWDHLLGVTEFVASCRKLQSLIPEVGSAAECVRLYTDFAERVDGQHLRLKAEAAELGLADIGQLLDRTYGQAANSLNQRFFGFYTATDSNDIPGLPFVASHLDAHLWSGHGRRAVVIVDALRFDVSYQLKAQLTGFNVSIDPLRAMLPTRTPVGMSALLPAKFTPTSLKTTGGELHPIYAAKNLSIRENRLALLKEFGADTREITEVENARKPGKLPTLLVVYGHEEVDSMGHGDGETLIRHVQKELERLARVVRKLHQWGYAEVHVVTDHGFVLLDEEHLPPEVPFNKDWGSVIKERFAIIPAGVDVPIKSKPFAWDLSVRVALPPGLAYFKNEKSFSHGGAALQEIVIPHLISRQQTKQQKIGVEALIGGAGVNLSTAAVKIVIRPVNVGESGEMSSLVALPRNLEINVLRAAATTTGSVLPRGEAKKATLKPDAEVPVTLFFDSKFTFKQGDTLRLEIRDADTGEQFPGPEGIVFHVARDL

SEQ ID NO: 2097 - protein, 767 aa, Glaciecola polaris
MIDTWFKEDLARILEPHPVAVFIDESGEADFLLKSLKSDCDVYRTNGELDELEAKYRIEKALQEHPESEHKYVIYTQLSKEDLTFVREYCETNGCIEIRYLQNYIKDKVHRTLNLNINLPKDELIAAAKVSVGKDRTYWMDLSHKGASEIFDLDKELLPFVHDPENYVTEKYDAQLRETFYRKVNELLGQEYIDKPASTLASEVVSAMLKGLADNDCDKTLLSVYNSWLDSVSYRNSFGSYLAKHKLDSAFINSSAIWQINPDHPFRQVDEAWLKELGNKLANKSLTKGESAQLVARLKQRHQSKQAQALGIVFWNDIITLLDFDPKDMAYLSSFAECVEFYKKHFCPLDTAIRNLYTEFMQQRDSLEPFQELYKEYVTLFLDKWFQYFSQYREDQTGILQSIIDRDIQIDRPGKNSKIAVIVGDGVAYEIAEQVAIKVKQLGSHSTLTRRHILADCPSETENNMSHIYMANGVIDAVQNKREKYLAAQNSHIDIDYIRLDEVSDQPLSGQVLICTYKDIDDMGDKLNHKALKYFPESIDFFAEKINQLLNIGYGKVYLITDHGFVLTGLLSEADKIVVKPSGQNYIDERFIWTSDKQESLIPQFIEVAKAYKDYNYLYFARSMNPFKTPGTYGFAHGGLAPQELVTPYFCWEQKSDVMGELPVTIANKHDLVSVTGELYQLKLRAESGEGNMFTLDRKVMLLFFANKTQVNKSDVITVQSNGHVTKEYTFDGHEELEVQLVDAITKQQLDRVLIKKNNDRDLGGLF

SEQ ID NO: 2098 - protein, 826 aa, Bacteroides coprophilus
MDIQGHIIDVWIGKTSKEHPIITIYDPEGKYYSLLPLVAERGVQVIDTTQELIHHREMACDYWMNELVQNEDARLLIYRKSAVPKEKERVYDPYIGMTQIGARFPIGPNDSYINLCKHFLHGKTEAIDELFKNGTASFANINALQEGVNYPELETLTGGKSMVEITLNLLALTEIGSTAWMSEWKSFGENHLPGLDTNGTTLKEVKQKLWQYLLFSEFVHDLPAALPAELNTVAKCPKENMESINNLCQSIRNRTDLRDDYVEQAQAITSRLHLDSLFAEAIDLGKIVTFAFENKVEFNIYLDHLYKGEYAEATLLVNKNKKSVWYQADAGVALFWNLTDQCERMMQCIRQPLGDLYSLKDLVLWYSEEGYKVDYAFRRFQAILTGSDFDTPQINELAQFTYRNYRSFTEQIQSRYQKLIHEEGYPIAGINRNIQAWNKEIAPLLTARKRVAIIFADAFRFEMGKELAQSLENSYTVSLQPSAAYVPTVTRFGMAALLPEAESKLELAVEDGKLQPYLEGKKVELPTDRINYIESKVPAHVKLMDVRSEDFLSANIAPDVNLLIIRSQSIDAAGENLTSVGYAEMESEMRLFTKCIRACKNLGFDQVVILADHGYMIQPKYQAGDNMSKPVGTSVMNERRSQAGDLNGNENSWLFTSEHIGVRSPIYRFAFAKQYGIYEKNKIYFHEGLSLQENIVPILTVQLTEERTKEAFRLELTYKGKNSGIIRVNRPLIELNFSGVESLFRPELCIVKMVVTDATGKEAGRVVESAFYNETTDLIAIPSECDKCKQPIEINEGVEGDIIVMALDPDTNVTLASIQLQTEFDF

SEQ ID NO: 2099 - protein, 848 aa, Bacteroides sp.
MIQNKIYNYFERNEKLKVLFIFDPMDAIASELHAVSWRDGFRFIEFDGAWFKTKYALENEWKEDKVILIFKQASPFTSTISMLKFPLLDVLCANMEYKSDDYAAFIQQHHIPQSCHDFIRKHIDELQLEKFNRILSPYYNTENFDKSLACRGLISGYLGENQLLDWDSIIIRMFLLSSPGEEKKKITFYRSIERNVDIYATLQNVLESYFGGSYNPNSEEKIKEIAESFKYNAITQTLAVDANDNYKRYKINSSLVLDRINKLLEKAIHQSKVKSDLFFATFHALAAGIKVEEIIKTYGIDANYFYIPTELCWEILKKIFAKQLTETPEAACDKLRDLFLKQESNTAIQKTINYGIEVANYYSKATSLGSLKLNTPDEYVRKYISEAHLLDMFYRKSLENYHQLSDSTPIISAIEKVKKQLDIDYAQLCNILNLEWLTCLQEKGSSFNTISLTKQQDFYEQEKNNQTKQVIIISDALRYEVAAELMQYLGREKHIATLDAALAMLPTETKFCKPALLPHRSIWLYKNDTEMDLAVDDKILNTLEKRSAHVALYRESAVCTDYVTVVNGTKDVNRELFKKPLVYIFHNTIDEIGHSNNPMEVVSACRRTIEQLAKLIRSLHASYNVTNVTLTSDHGFLYNDMAFEEKDKITVSEETMEKKSRYYITKSDTPIQGVIKFPLSEVSGMNDNVFVAVPEGTNRFAAQGGGYNFAHGGASLQELIIPVIHSKNKKNNVKQKVNVALITRNLSIVSSRLKFKIMQSEPVDMDTLERNIVCAVYANDTLVTTEKRLCLNSSDIDNYNNRIFDVELTLNQSTSTSIMQLRIFDVEDMLNPLIKETVTNNTLIEQDF

SEQ ID NO: 2100 - protein, 865 aa, Escherichia coli; identical to SEQ ID NO: 2093

SEQ ID NO: 2101 - protein, 865 aa, Escherichia coli
MQNQDFIAGLKAKFAEHRIVFWHDPDKRFIEELEQLKLENVTLINMTLASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKEAYDYCAQQMQAALQPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVAETAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 2102 - protein, 867 aa, Escherichia coli
MNLQNQDFIAGLKAKFAEHRIVFWHDPDKRFIEELEQLELENVTLINMTHASQLAVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHGLDSVLWEMLNHEMGYQAEEPSLENLLLKLFCTDLSAQADPQQRAWLEKNVLLTPSGRASALAFMVTWRADRRYKDAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 2103 - protein, 846 aa, Thiorhodovibrio sp.
MSITEFISQEVLLPRLAKHQVLAVYDPERRYRDLCLALASEQREVVDASESSIDSRLAALNALGRLGNQEIHELLVYVPTPKPLNEEDQQHDPFALYAACGAVFPEGDGDDYQALCLKAKPDDATQVRAVFAENANPSFAVIDAIGAGGLGWPNLRALLNRESSRDILFDLLAPSPKQQTRLKDNEAWVKEARDLLKSSFGLRLKTKGKTWSSIADEFWRFLLFSEFAFDLPESLPAALEGVPRASDASRLLVEDLCDRLRSDLRTQARYIEQAERVEQELDLAQLCAQLCAQPTDLGTRDTFAFEERAFLRQAMAALLADDSDQARAILAQHRGSVWTGKGESQAQWDLLQATATLVDTCADLDRVLGDHSAGLETLVDFYVRQLREMDRLHREFEQAVSGYAWQDAEGLMQPVIDQGRQVYGQLASLVQQRFTQHLQHTGWPLTGRLSNTEVFDTLVAPPLQQSGQRVAYLLIDALRYELGVALERQLAEDGQVELRAAMAPLPSITPVGMASLLPAAQAGLRLVKTDGEITPTLHDQAVTTVTQRMDVIRKRYGQRFQQGRLDDFVLKKLKLDPDADLLVLRSVEIDSQFENHPDSAPGELTNALKRIRVAVTMLKAQGFREVIIATDHGFFMNTHAGPGDSCTKPVGDWLCVHDRCLLGQGAEDRHHFNLPTEKLGVRGDFARLAGPLSLAAYRSGLTYFHGGASLQELVVPVIRLQLTAADQPKLQQAKVALSYKQGMSRHITTRVPVFEVAVESQDLFSEDGEFEILLEAQDKKGNVVGEAKPGGLVDPASGTITLKPGDQVKITLKMSMEYEGKFKVLALNPNTMGLFAQLDLETDYTV

SEQ ID NO: 2104 - protein, 840 aa, Cylindrospermopsis raciborskii
MINRINQSLTKLFEKHRIVFWYDAKPELVREFLGGVEKIELTNNQFAVKYRILHQEPKSKFLLYQETPQPPDLENWLLDVQLAHTEFRADQTALWLAELELGREFTHLVQGHIAFFPSSERRESLKRLITSHDTITQIQLKMLAVCTGCGSDSRLEAILEQLLGELSSDLAQYKKGQIGDKYRLMVRCELEQYFWEQMKNCYGYSCAKPSMKDFALQLFSYCYFENFASTPKGTQNLSSDAVVFLKRWKDSIKCQHSFETLSSWCAKDLGIEHDLGEREIGELLDVDYFRLIDQRILSELVRGVEQRTLLGSDVAQWIWRRKQSHWYEEFQHYYECVGAAAKFIQELDRACFTIESLAEGVEKYAKSWFRIDQLYRKTIYHLGRVPDCSFMGGLVDLIENLYANNYLLKLNDHWQSWVDQTTSWSAPYIYLQNKFFHHWVLPFLNTDKKIFVIISDALRFEIGNELISLIRQEDRYEATLELAMAMLPSYTQLGMAALLPHSTLAIANDGSVLVDSQSSMGTENRKKQIKRGHSKRATAITAEDLRELSSDDRRTLFRDHDLVYVYHNHIDAIGDKRESESRVFDAVEETLDELVKLIKTLTSANASNILVTADHGFIYQNRAIEESDFASDEPQGEQILFKNRRFVLGKGLKETPSLRKFTSNQLGLQGELEVQIPKSINRLRLKGSGSRYVHGGASLQEVVIPIVKIHKKRTSDITMVEVEILRGASSIITATQLTVVIYQTQAVTEKVHPRFLQAGIYTQTEELISDSHDLTFDLESENPRDREISVTFTLTRKADEANGKEVYLRLDEKLPGTFQHKKYKHLSYTMRRSFTSDFDF

SEQ ID NO: 2105 - protein, 832 aa, Microcystis aeruginosa
MNQQIKQALTKLFERHRIVFWYDTEKELRSDFERLELENIEKIEIKNNEFGLKYRILKEQPQQKFLLYHEGKEPEYLDNWLLDVELAQGKFSSDQVSLWLNELELGPEFADVLAPHREFFLSNKRRESLKQLLQPHDTKTNIRLKMLAVCTAAPPRLDSIVEQLLKEHAEQQDEKFKLCDRTGLTKFLWQQMEQVYGYRSSELSIKDFVIQLFKSCYNYALEGQETLTQDALIFFNRWKDSRQFEKSFESLSDHCAEILNIKEKLNQRRYQELISIDYFSLIDLKIIHDLIQAVSNRTIATHEVINIVRQRQQGYWYRKFKHLYEVVNYASQFIQVLDEANLSIESLKDGLEKYCQSWFKIDQLYRKFIYHLVAAAQPTLTEKLSQEIENRYVNSYLLNLNSSWQVFVDSVTQWNKIEFSSQRSFFSKWVEPFLKKDKKVCVIISDALRYEIGDELVSLIRQEDRYEATLEAAITLLPSYTALGMAALLPNQTLEIIDDSVYVDQQDSQGTENRRKIIQKAFQKIQKKATVIQAKELLELNQDRSRSLFRDHDVVYVYHNQIDQIGDKLATEKQVFQVVENTFSELDKLIKKLTGANASNLLITADHGFIYQHSDVENSDFSTVEVLGDKIIKKNRRFLIGKALEDSDRLKKFKAQQIGLTGELEIQIPKSISRLRIQGSGSRFVHGGASLQEIIIPIVKVNKKRRGDLSTVEVEIIRNSTSTITSGQLAVTFYQQKPVTDKVQPRRLKAGIYTPMGELISDLHELTFDSPSENPREREFPVRFILTSQGNNINNQEVLLRLEEKLTNTSHFTEYKSVSYPIRRSFTGDFDF

SEQ ID NO: 2106 - protein, 767 aa, Vibrio cholerae; identical to SEQ ID NO: 1828

SEQ ID NO: 2107 - protein, 767 aa, Vibrio cholerae; identical to SEQ ID NO: 1828

SEQ ID NO: 2108 - protein, 865 aa, Enterobacter hormaechei
MQFKELESGLRQKFNDNRIVFWHDPEQRFTDSLNELDLDNVTLLDMGGVSVLATKKRIEIDEPTQKFLLYFTSEVPAHEQDWLLDIRLYSTEFHADYAAITLNSLGIPQLGLREHIQLRKAFFTVKRTQLLKGWVTERETEKSLDKKMLAVVAGASTFETKEILFALIQQFVAASHQDDSALENTFAVLKKLGLDKVLWEILNLELGYQAEAPTLENLLLKLFCTDLWAQGDDAHREWLSKNVLTTAAGRASALAFMGAWRNDRRYKTEYDYCAADLQQTLQPKEHYNYSSPYALAKCDTFEAIEQLIIRGLVTQLQEESTTLDRDAFKALVSERSAKYWSQTRPEYLSIWNALRQAERLLNLRNHYTDGFNFPDTGTFWKAYCGEIYRFDQTYRLFNEYAAPVHSKGAMILHELDKFIEELYSNWYLAELSRGWNKLLEAENRMQTWQISGVPLQRNFYKENVKRQFDTSQVKRVFVVISDALRYEVAEELGRHINHEKHFSAELRSQTGVLPSYTQLGMAALLPHESLSYLPDNSGVVYADGMSTSGFEKRASILAKVNGVALSAKELQSANNQDVNDQIRNASVVYIWHDTIDAIGDKAATEDKTFEACRSAITELKDLVSRLRNRFNASRIFVTADHGFLFQQQALVEQDKTKLESKAVNAIEAKKRYIVGHQLPVNEFCWHGKLSDTAGTNDESEFLLPKGVQRFHFAGGARFVHGGAMLQEVCVPVLKIRALEKKAAEKQPQRQPVSVVARDHVIKLVNSIDKVGFIQTTAVDDLNEPRTLNIFIVDENNQVVSGMETVCFDSDNDDMGKRTRDVTMKLMGTAFNRKNKYVLILENADSATEYGRYPITIDLAFQDDFF

SEQ ID NO: 2109 - protein, 832 aa, Marinobacter sp.
MSNRISQALTKLFDRHRIVFWYDTKHELRSDFESVSLPDVEKLEIANNQYGLKYRVLREAPTQKFLLYKEGPQPAELDNWLLDVQLAHGEFRTDQVAIWLSELELGLEFSEIAQAHAEFFQAEKRKDALKKWLKPDDTAGQLRLKMLAVCAGSEPRMDSVVETLLQQLADDRVDGMRLVERCGLDTFLWEQLTRFYGYEFTEPGLRDFVIALFKSCYAMSTDGEFKMTGDALVFLKRWKDSRQFESGFEVLSAECADVLGIEQDLGKRDFRNLIELDYFRLIDQKIISDLVRAVVERTVTSGDVALWVRQRRQGHWYEEFRDLYEAIEFGARFIQMLGEANLTMDSLADGVQRYSRAWFQLDQLYRKFTYHVRLSGQPSLMGALSEQVENLYSNSYLLKLGDAFQIHVDSSARWEAYPVVQQNTFFEHWVRPFLRKDKRVCVIISDAMRYEIGDELLSLIRQEDRYSAELEPALSMLPSYTQLGMAALLPNKTLAIADNDTGTTLVDGQSSQGTANRTKILQAALEGRGKAIRAEEFMQLNRDDSRDVLKGNDVLYIYHNRIDHTGDKMHSEGQAFEAAEQTLDDLIRLIKKLTAANANNLLVTADHGFIYQNRELDESDFLSVPANGDTILYRDRRFVLGKGLAPSPAFHHFSSEQLGLDGDMEVQVPKSINRLRLKGSGSRFVHGGASLQEVVIPVLKVNKKRQSDVSAVEVDILRGASSVITSGQLAVTLYQSGPVTEKIQPRLLRAGIYTEAGELISDSHELVFDLTSENPRERELQVRFLLSRKADEANGQEVSLRLDEQHAGTSHYKEYKSLNYMMRRSFTSDFDF

SEQ ID NO: 2110 - protein, 865 aa, Escherichia coli
MQNQDFIAGLKAKFAEHRIVFWHDPDKRFIEELEQLELENVTLINMTHASQLSVKKRIEIDEPEQQFLLWFPHDAPPHEQDWLLDIRLYSSEFHADFAAITLNTLGIPQLGLREHIQRRKAFFSTKRTQALKNLVTEQEDEASLDKKMIAVIAGAKTAKTEDILFNLITQYVNQQTEDDSELENTQAMLKRHCLDSVLWEMLNHEMGYQAEEPSLENLLLKLFCTDLSAQADPQQRAWLEKNVLLTPSGRASALAFMVTWRADRRYKDAYDYCAQQMQAALRPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDIILKNYKGMAIKSKDLLELKNQEGRDLIRDYEVVYIWHNTIDATGDTASTEDKTFEACRTAVTELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNSTMEKRVREVTLKLIGANFNRRNEYWLILEDAQTETGYQKYPVIIDLAFQDDFF

SEQ ID NO: 2111 - protein, 865 aa, Salmonella enterica
MQNQEFIAGLKAKFTEHRIVFWHDPDKRFLEELDNLELENVTLLDMTDQSQLAVKKRIEIDEPEQQFLLWFPHDAPPKEFDWLLDIRLYSTEFHADFAAITLNTLGIPQLGLREHIQRRKAFFSTKRLSALKGLVTEQENEATLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLTTPSGRASALAFMVTWRADRRYKEAYDYCAQQMQDALRPEDQYRLSSPYDLHECETTLSIEQTIIHALVTQLLEESTTLDREAFKKLLSERQSKYWCQTRQEYYAIYDALRQAERLLNLRNRHIDGFHYQDSATFWKAYCEELFRFDQAYRLFNEYALLVHSKGAMILKSLDDYIEALYSNWYLAELSRSWNKVLEAENRMQEWRIAGVPRQQNFYNEAVKPQFNNPQIKRVFVIISDALRYEVAEELGNQINTEKRFTAELRSQLGVLPSYTQLGMAALLPHDEICYQAGNGDIVYADGLSTSGTPNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDNSEFLIPKGIQRFHFSGGARFVHGGAMLQEVCVPVLQVKALQKTAAEKQPQRRPVDIVKHHPLIKLVNNIDKVSLLQTDPVGELFEPRTLNIFIVDNANNVVSGKERICFDSDNDAMEKRIRDVTLKLIGANFNRRNEYWLILEDAQTETGYQKYPVIIDLAFQDDFF

SEQ ID NO: 2112 - protein, 844 aa, Lactobacillus casei
MAELDTKKIVAGIEKLFADNDHFVFWYDAQGEFADNIADITEQLREPVVIMGKNEQFKTKLTLVAMEQQGQSALVYSPAPKPDLTENFMTDMLYYSREYTANALVMLRQELRVPDEDAATFQEQKRFFASKDRQAKFQRLYQPGKDLQMAIMAALAGASDHTMTMVLRAVLQAGIGDTNPVLAEFEKYGLLTRFWENVRNAYGFNGATNSLLDFTTALYLNFAYYQMEKDLPRSIDNYKLTSANNAVTFLSLARNDQTFADTYRQLAEAVWQHLESFSGVSRQLQQLDIVDLLKTDVFANFDRQILAWVVERLQADDFHAVAGTTPLADVLTQREKMYFGKTYHDAYALLQAALVILTYRRREVKNLATAKEQYITTDYAVDTAYRHFVQRYDRIAIDLTDLLEGIADKVDNTYVNEFLTPTVTAWTTVYDPRDIEPNSWQRSFYRSFISSAKERIVVIISDAFRFEAAAELKRKLDDQDVYSTELDTVYSELPSVTYFGMPALLPHQTLTYQPDKTVLVDGLKADTLGKRRQILQNRDPQSNADHVMTFLKDWDTPQRKQLLAGQKVVYLYHNEVDATGDDAKTEKQIFNATEEAINTIARTIGFLRNLSVAHIIVTADHGYLYKRSGLDSADKIDISGHDLDVLGQRYAISSETIEQPGVRSQRLGALLDNDDQRRVYYPATDSIFKSAGAGQNYVHGGASPEEMIVPVLHVRTQSGRSKATPVSIKVTEGAHRITSRSVMVPISQEEPVTDKTTAATYVLYFVDSQDRPISNEQRYVADSREDDPQSPSRRQSFYLTLQDRDFDNSGAYYLIIQNAETKEEIQRIQYQMDLTIKGDFGFDI

SEQ ID NO: 2113 - protein, 840 aa, Enterococcus faecium; identical to SEQ ID NO: 1912

SEQ ID NO: 2114 - protein, 767 aa, Glaciecola lipolytica
MIDTWFKEDLARILEPHPVAVFIDESGEAEFLIKGLKGQCEVYFTNGELDELEAKYRIEKAIQEHPESEHKYVIYTQLSKEDLTFAREYCETNGCIEIRYLQNYIKDKVHRTLNLNINLPKDELIAAAKVSVGKDRTYWMDLSHKGASEIFDLDKELLPFVHDPENYATEKYDAQLRETFYRKVNELLGQEYIDKPASTLATEVVSAMLKGLADNDCDKTLLSVYNSWLDSVSYRNSFGSYLAKHKLDSAFINSSAIWQINPDHPFRQVDEAWLKELGNKLANKSLAKGESAQLVARLKQRHQSKQAQALGIVFWNDIITLLDFDPKDMAYLSSFAECVEFYKRHFCPLDTAIRNLYTEFMQQRDSLEPFQELYKEYVTLFLDKWFQYFSQYREDQTGILQAIIDRDIQIDRPGKNSKIAVIVGDGVAYEIAEQVAIKVKQLGNHSTLTRRHILADCPSETENNMSHIYMANGVVEAVQNKREKYLSEQNTSINIDYIRLDEVSDQALSGQVLICTYKDIDDMGDKLNHKALKYFPESIDFFAEKINQLLNIGYTKVYLITDHGFVLTGLLSEADKIVVKPSGQNYIDERFIWTSDKQESLIPQFIEVAKVYKDYNYLYFARSMNPFKTPGTYGFAHGGLAPQELVTPYFCWEQESDVMGELPVTIANKHDLVSVTGELYQLKLRAEPGEGNMFTLDRKVMLLFFANKTQVNKSDVITVQSNGQVTKEYTFDGHEELEVQLVDAISKQQLDRVLIKKNNDRDLGGLF

SEQ ID NO: 2115 - protein, 840 aa, Oribacterium sp.
MAELNLKQIIDRLNEELTGDTRKLVFWYDDKGEFAEDMQNVELENAKVYFLQPDNQFYTKYFLERVDLTTNYLIYAPFPKPDVKDNHLEDTMLYSKRFFADRASLLSVDLGIDEKYKPIIEKHIKFFSNKERTQRFYDLEIENFNEENILIGLLSSICKTRTCSFEEVIRVILTDGELQDNKFLIEIQKYDLLDAFWKLCEQHFGYIDVKPTLERFVVTLFVTYTAKYISSELPKAWKSFVSYKSGNVIAFMDNLMNSVLYREKYDELSDFVATGLGAVNTFKDYLPEELLNCDTFLCIDQILVKWIVDRLLAEDTGAKLDGSFIPEIAAKREKMHFGARIGRTYRLLTSAYYLVVTGTFNCPDGFAAILAQYRAEDYKIDQEYRNFYYEYDQLEDTAAFERIRDLVENIYTNEYLDKLLPKWNAGLQEEDSLTKLPVQIDFYARNIRNVRERTVVIISDAMRYEVGQELFRLLSDDPKCTAKLETQLSVLPSYTRLGMAALLPHKQITMTDYYQVLVDDVLCDNLAGRQNVLQKYLPNSICVQFDDIKGLKKNELRDIFTGKQAIYVYHNQIDARGDKANTEDEVFVACKEAVAEIIDLIRRISTNANTYHFIVTADHGFIYKRDKLTESDKIGGINDKKAFVNRRFIVAPEAVQEDGIAHMSMGIVLRNQDMKMVSFPISSNVFKVAGGGQNFVHGGSSPQEMLVPLVEVKMERGHMETKNAEIALVSMVQKITNKITMMDFIQSEPVSDTVKVTTYKIFFISEDNEKISNENSYIADSREPNAQKRIFRMKFQFKDKKYDKDKQYFLVVYDENTGLESFRHPIIMDLAFADDFGFGF

SEQ ID NO: 2116 - protein, 767 aa, Vibrio cholerae; identical to SEQ ID NO: 1828

SEQ ID NO: 2117 - protein, 865 aa, Escherichia coli; identical to SEQ ID NO: 1930

SEQ ID NO: 2118 - protein, 865 aa, Escherichia coli; identical to SEQ ID NO: 1924

SEQ ID NO: 2119 - protein, 771 aa, Vibrio cholerae
MIDTWFKEDLARILEQHPVAIFIDESGEAEFLLKSLKRDCDVYRTNGELDELEAKYRVEKALQEHPKSEHKYVIYTQLSKEDLTFVREYCETNGCIEIRYLQNYIKDKVHRTLNLNINLPKDELIAAAKVSVGKDRTYWMDLSHKGASEIFDLDKELLPFVHDPENYVTEKYDAQLRETFYRKVNDLLGQEYIDKPASTLASEVVSAMLKGLADNDCDKTLLSVYNSWLDSVSYRNSFGSYLTKHKLDSAFISSSAIWQVNPDHPFRQVDEAWLKELGNKLANKSLSKVESAQLVARLKQRHQSKQAQALGIAFWNDIIALLDFDPKDMSYLSSFAECVEFYKKHFCPLDTAIRNLYTEFLQQRDSLEPFQELYKEYVTLFLDKWFQYFSQYREDQTGILQAIIDRDIQIDRPGKNSKIAVIVGDGVAYEIAEQVAIKVKQLGNHSTLTRRHILADCPSETENNMSHIYMANGVVEAVQNKREKYLSAQNSHIDIDYIRLDEVSDKPLSGQVLICTYKDIDDMGDKLNHKALKYFPESIDFFAEKINQLLNIGYTKVYLITDHGFVLTGLLSEADKIVVKPSGQNYIDERFIWTSDKQESLIPQFIEVAKAYKDYNYLYFARSMNPFKTPGTYGFAHGGLAPQELVTPYFCWEQESDVMGELPVTIANKHDLVSVTGELYQLKLRAENMAESGEGNLFTQERKVMLLFFANKTQVNKSDVITVQSNGHVTKEYTFDGHEELEVQLVDAMTKQQLDRVLIKKNNDRDLGGLF

SEQ ID NO: 2120 - protein, 873 aa, Methanoplanus limicola
MPIFSLEKTTDAILEKFSRPSDYGIRRIVFWYDRDTTAGEKDLEYITEALRQKKIKLHILKNNFYETKKLLEHDDLKSDFLIYSPQAERPYKENWLLDIQLYSGRFENSRISDLKTEIGIEGYRHDSFLEEQKKFFANKRRVAAFKKFYRNTWNEEDFISGIFAVLTGSNVIDENENIRTLLMNSLNEDENTVWQEILRYNLSDKFWERTGRHYGYYSEHPTLKKLFLSFLITHIDLNTELPLKTLKNYINHNRQSNECEIFISGWMNNSKDSWRFDEYCTNLLREDNSRLEAALTSELKKSKTESYISAESPDIIDKTIIRNIVGTITEGGRDYSRYLSWIEERKTKHYYQKFHDIYSALKYGIMLLSLSEETEKKGIHQENLNGLFTEYRKNYYLHDLYYRKFYLHYDRDSDKEILRNGIREIIEREYRRINEKILMKWSDLTESEMNGKWGIELIDNQSDFFTDHVSKIISRNERDKAAVIISDALRYEVAAELKEVLNTSTNGTIEMSAMAGCLPSYTKLGMASLLPHSNLEYRDELIFADGINTDGLSNREKILLAEERESIAFSFRDLWKLKTDEAREQLRGKRIIYIYHNSIDETGDKHSSQDDVFTAAESAINDIDAMVNRLSRNLNINNIIITADHGFIYSRDSLESADIVNTDTFDRDKWITSNKRFIISSEKTDLPNTHRFSLTINSGHEKPLYIYTPYADLRFRLSGGGRNFVHGGAALQEIVIPVLLYNHNKSLSDLDRKGIEYGTVGITVIEQNRKITGNPFRIRLFQTENVTDKREPLTCRIGLYDNSGNRVSDEKTVIADKSSDEPNERISEVILTMSSSTENGIYHLKAFKEDKNELYGDVFDIPVEVDLLITDDF

SEQ ID NO: 2121 - protein, 785 aa, Methanoplanus limicola
MPGKFIEEVKKAILSAASDYDRERLSAPVALIWTDHNREWEPVVEKLVKDHGMPIATFGSYDPEEFKGPAIYIRCLISHNLNGGSFGVADVSPDSGVSDESGVPEFPKEGTPVIYLPGYSKDVLRNPENCPEELLQLFELQYRGIVWSQKNNRDWTIPAFIKNILDIDIIMDKETRQAAINAVGALCDEDVTLIKNRAPLNASYFNSLIHPDTKKQLLLWMNSPKEEKERMGPEQWRPFCSICKSEYEFDPEKDTPVTAAEKLGSLKNNWSNVWERYCENPDKYVNIPTLLRNSKMPPLVVYQDSWPQNNDKLEKKVKEELLHLQELNRNDAVKKVLTLEKNHKIRRDWVWAKIGESPYACTLKYLAKLAEIVRENRFSGTIQEQAERYTEEYFTADDAILKAIREAGKDKECLRITSAAIAAISKSWFSSLAESFQKEWTNNPPEISKSGYKPEKGTVYLFVDGLRFDLANELKEIISKDHPETDLNFSYAALPTLTSTAKPAVMPIAGELIAGSEFTPFTKTEAAANITALRRIMEEHSIQVLDDNRTGDPDGSAWTDCGNIDHEGHDKQIELPLIIPAELERISKRVQELINAGWSEIKIVTDHGWVFMPGEMDKTELLPALTEVKKSRCARLRPDAKTIFPTSKWHWDRNATVVFSPGITCFDSGKVYEHGGLSPQEVIIPQMTVKGREKAKTGLVKITEMTWRGLRLKGKTEGCEGLSADIRTQPGDENSSLIDSVKEISDEKLSLLVLDDSLEGSEAFLVLIDSDKTVCYQKEITIGEE

SEQ ID NO: 2122 - protein, 767 aa, Vibrio cholerae; identical to SEQ ID NO: 1828

SEQ ID NO: 2123 - protein, 865 aa, Escherichia coli; identical to SEQ ID NO: 1759

SEQ ID NO: 2124 - protein, 767 aa, Vibrio cholera
MIDTWFKEDLARILEQHPVAIFIDESGEAEFLLKSLKRDCDVYRTNGELEELEAKYRVEKALQEHPKSEHKYVIYTQLSKEDLTFVREYCETNGCIEIRYLQNYIKDKVHRTLNLNINLPKDELIAAAKVSVGKDRTYWMDLSHKGASEIFDLDKELLPFVHDPENYVTEKYDAQLRETFYRKVNELLGQEYIDKPASTLASEVVSAMLKGLADNDCDKTLLSVYNSWLDSVSYRNSFGSYLTKHKLDSAFINSSAIWQVNPDHPFRQVDEAWLKELGNKLANKSLSKVESAQLVARLKQRHQSKQAQALGIVFWNDIIALLEFDPKDMSYLSSFAECVEFYKKHFCPLDTAIRNLYTEFMQQRDSLEPFQELYKEYVTLFLDKWFQYFSQYREDQTGILQAIIDRDIQIDRPGKNSKIAVIVGDGVAYEIAEQVAIKVKQLSNHSTLTRRHILADCPSETENNMSHIYMANGVVEPVQNKREKYLSAPNSHIDIDYIRLDEVSDQPLSGQVLICTYKDIDDMGDKLNHKALKYFPESIDFFAEKINQLLNIGYGKVYLITDHGFVLTGLLSEADKIVVKPSGQNYIDERFIWTSDKQESLIPQFIEVAKSYKDYNYLYFARSMNPFKTPGTYGFAHGGLAPQELVTPYFCWEQESDVMGELPVTIANKHDLVSVTGELYQLKLRAESGEGNMFTLDRKVMLLFFANKAQVNKSDVITVQSNGQVTKEYTFDGHNEIEVQLVDAMTKQQLDRVLIKKNNDRDLGGLF

SEQ ID NO: 2125 - protein, 767 aa, Vibrio cholerae; identical to SEQ ID NO: 1828

SEQ ID NO: 2126 - protein, 854 aa, Bacillus cereus
MNTKEINRVLQDTFNKELTEGKKRHIVFWYDEAGEFIEDIDELNLEGVRIWKLTPHNMFATKLEVEKNDVNSNFLIYANMAKPSAREDWLLDVYKYSQEFATDKMTVMMRELGITNDAALRDVFKKYTKFFKSKEREALFKSFSVPEYTEEQIDLVVLASLCKCNIVNLDEVIKALFREQLKETNKYWENIRKFGNEETFWNLVEKTYGYNLQDKSINSLLIFFLLTNVSETLSGDIPKTWQPYISAIPMNAIVFMNQFMNHSADEVIYNELANTVEKQVKVTEHLQSKEIKDYITSDTFCCFDTNIITYITKQLMNAIHDYTSYIEIIAARRKLHWFSVFRNEYEALYQAIQLFQQIYEMGNAITESQPFDLFKAYESKYHNIDTAYRKFYVAFDQIEDKDGFRALRDKVENIYTNVYINDLAIKWSDALEGEQEEYWPIAGLESQHTFYRSFVQPFVNKEERVFVIISDALRYEVAKELSNMLNVERKASTDIVAMQGVLPSYTDLGMATLLPYKSITFNENAEVYVNDYKASSTENRATILSKHYKDSTAIQYKDLAAMNRQQFRDVFSGKKVSYIYHNVIDARGDHAATEHEVFHAVEQTLKDIRSLVDQLINTVSASNIVITADHGFIYNRDTLQASDKVKKDFLNTDIEKRRFIISSESNSIEGTMNFSMDYVLGEGSGKYVKVPRGANRFAVQGTGANYVHGGAMLQEIVVPVIKFKNDRSKSSKNDVRKVEVKLTSLTRKITNSITYLEFFQTEKIEGKKTPLRLKVYFTDEEGNRISNENIIIADSQSSKPEDRTFKEKFVLKSMTYDKTKKYYLVLEDEEEAVENIYEKVAFPIDIAITNDFGF

SEQ ID NO: 2127 - protein, 767 aa, Vibrio cholerae; identical to SEQ ID NO: 1828

SEQ ID NO: 2128 - protein, 867 aa, Salmonella enterica
MDITQLQTGLNNKFTADRIVFWHDPEQSFTAQLTELAILWNGLPVTVLNMAEQSQLQTRKRIEIDEPMQGFLLYWPSSEPSPAKDWLLDIRRYSTTFYADAASILLNDLGLANMALRDHIASRKSFFANKERTAAFKRRLDGRGGIEDPLSLDMKMISVVLTCHAQIAEIMKSIGDRLLENAETALVPLEQHGLLPAFWHLMNREYGYHIAEGTEPSLRELIRKLLVSECYEQLDSKERPVWLQSQLLATPTGRANAMALLSGWRDSNQYSSHFAEISAQVAEQLELASRLTTQDIWLWGEVEGFEAVEQGLIRELISGLNNGDLSLNRVEFTQLISRRRHGFWARTVPKYAYIYHALQQAELLLELRRSKPDGFHYSSAQEMYLAYEAELFQFDAAYRLFNEALLHLQGQSVEVLAVLASKIEDLYVNWYLYQLGLTWDGLLAKEQLLDNWQLGLPSQHRFYDTVIKQRFTQSGVKRQFVIISDALRYEVAHELQGQINEAKRFSAQLKSQLGVLPSYTQLGMAALLPHQQLDYAATSSTVLVDGQSSSGLENRSTILSKVGGIAISAKSLLSWTRAEANEAVGDAKVIYVYHDVIDAQSESQKSELKTFIHARQAIDELNGLINKIINGFGVTRVVITADHGFLFQQASVENGVKSPLKHEPSGTLEASKRYLLARNLPTNEDVWHGQLRNIVGGNSDVEFWLPKGVSRFHFVGGARFVHGGAMLQEVCVPILEVQELRGKKQTLHEKTKVDIVPAYQPIKLVNVIDKIRFLQTDAVDERHKSRMVRFSVVDSSEQTVSAIEKLLFDATSSNLDQRQQDVRLKLTGAQFDRKAQYQLLLVDDEDGIEMARYPVTIDLAIQDEFGF

SEQ ID NO: 2129 - protein, 771 aa, Vibrio cholerae; identical to SEQ ID NO: 2119

SEQ ID NO: 2130 - protein, 902 aa, Collinsella aerofaciens
MPKIDVEEQLKLRFLQPLSSCAPRRVVVWHDADGEFAPEFERLAAEGFDGVGADAGVMSAHGDFERPVRFVEACEGRMFAVKKLINRDDLASDILLYRRCPRGRLEGDWLADVELYADQFQADYLSLLADQLGIENIDAVRESLREHKTFFDAKTRCAKFAACVPHASGASDIELGILTVIFGGKEPGDARPAFVLRGCMTMLLHEGPEALAELADKYCVRDALSAFIVRCYGFDGPLYERDSLLMLASHVLLTAASTALPEGALKGLESYVAPAYGPYCLEAVRTWDQAADTQASSEDLFEICRLVEDARGLFARFETLPIDALASLDVFPCVNEAVLSQLFSSFAQGADRVEDARAFVARRCDLSWYRRVESYFDLLAAVADMCAFRQAHAGGFHLAQPQQVWDAYTSDWYAMDAAYRHMCTAYLRARSVECDALEEPARSVADWAENLYSNWFLADANACWAAAAQGEWADCGYIEGPSRQDEFYWHMLPTFVGSAKTTVVIVSDALRYEVARDVAALLERERGGNVKVSSMQAVFPSITEVGMPALLPHQALELAADGPFVLADGMPTATTPQREAVLAHVEPTARALRSSAYLNMAGTERKVLLKDSRLVYLYHNKIDATGEKAATQDDVFDACADTVEELATLARRVCTDAPGARVVITADHGFIYTRRELNECQMLGKPDLPVLDAPVMHGKRHLVVPNEAVLKLSDEACGVFVNVDMGRLGAGFEGFAPRENVHFKRPGGTNNYVHGGMSLQELCVPVIGFWRARSGSKDFVDTRAATLRVLSEGRRVTNSLFSVNLIQEEPVQGKVLPCEYELVFTDASGNEVSDTVKAHANKTSVNSQERVVHAKFALHAADGFSAKGPYYLVCRERETGKIVWRETYTIAVSFAPVADFGF

SEQ ID NO: 2131 - protein, 840 aa, Enterococcus faecium; identical to SEQ ID NO: 1912

SEQ ID NO: 2132 - protein, 767 aa, Vibrio cholerae; identical to SEQ ID NO: 1828

SEQ ID NO: 2133 - protein, 846 aa, Bacteroides sp.; identical to SEQ ID NO: 1953

SEQ ID NO: 2134 - protein, 889 aa, Vibrio cholerae
MQISELAQGVAAKLEQSRIVFWYDPEQSFTEELEHLANSLSLAKESGDKAADITARGLPDDLTILNMGNESVLAVKKRIEVDEREAKFLIYFPSAEPEPDRDWLLDVRLYSEQFFADHSSMLLNELGIPKMALRTHIRKRQSFFANKQRIAGLKKWVTENEDELSLDRKMMAVVVKADSASLSDILLGLLREYAAYIEDESLGQPLWSQLGKFDLETSLWAYLSEGFGYTVEEPTFSDFVLKLFCTEFWSQIEGVERDWLLNNVLKSASGRATALAFMVSWRDSRSFAAYYESISKVLSQQLEISTRAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYDFYEKEVRTRLSLKQTKRVFVIISDAQRFEIANELGAIINNEKRFKAEVSTQLGVLPSYTQLGMAALLPHKALSYQPEQGTAVYVDGISSQGLDNRNSILQKVGGMAVSSKELMSWSNQEGRDKVRDVEVVYIYHDTIDAIGDKAATEEKTFEACRSAIEELKDLVGRVINRLNGSRVVITADHGFLFQQKALVAADKTSLKTKPAGAIEAKKRYIVGNNLPSDEACWKGSINDTAHGSSGSSYQAEFLLPKAAQRFHFVGGAKFVHGGAMLQEVCVPVLHVRELQKEQAAKHEKQPVGVVAATQPIKLVNNIDKVRFIQTDPVGDRFVARLLDVYIVDAQGNEVSSRETINFDSVSKVMDERTREARLKLIGSQFDRNAQYTLVLENAEMRTRYSQYAVTIDLAFQDDFF

SEQ ID NO: 2135 - protein, 885 aa, Vibrio cholerae; identical to SEQ ID NO: 1907

SEQ ID NO: 2136 - protein, 767 aa, Vibrio cholerae; identical to SEQ ID NO: 1828

SEQ ID NO: 2137 - protein, 840 aa, Enterococcus faecium; identical to SEQ ID NO: 1912

SEQ ID NO: 2138 - protein, 837 aa, Fusobacterium sp.
MEIDKIKELLEYRFSLTTELPQKRHIIFWYDSKKEFKDLIDELNLTDVKIIKLTKSLDKKGESIYTNIFKTKYTLEVIDTESNYLIYSEHPRSIDSENYLLDIEKYSEFFEADKSAMIVEELKLDRTNYKLGEIIKDYPSFFANKERREKLAKLIEQPESIDEEEFKLSILTVISGAKTVDILEIIKNIILNKSKLQDIEKWLNLDFLFFEIKKKFDVEVTSFEQFLKILMVTHFYFQLQKKAHTNLEKYFTGRKNELYIFAESLLQNKQISEIIREEFYDLAKDLNIKDRIDELELDYSISGTAFEYFDKVIIKDIIDIFNSEVIDYEKYKKYIEIRLDNSLWIEKYQYFYKALLALNDFFRLKDSLIIEDRKVLKDIFKDYTEHYFLIDKLYRDFYFYHDKIKNDELAPLFDILKAKIDKFYEVDYLEKLLALWSSKVYERENLAQQRDFYKNNIANADVRTVVIISDALRYEVGYEISQQLRKEANVKEIKLDAMLTDLPSRTFLGMANLLPCKIERNIDLVSAKVIVDGIDSQGTENREKILKLSCEESSAISYDNFNKMNRGKQEEYIKGKKVIYIYHDSIDAIGDKAKTESNTFNACKDAVEDIVGLSKLLSSLGVVNVYITSDHGFLYEKKEVEEYNKLELKNTKYEAIGKRYAIYKKEAEEKACITLKLDSLYGVFPEKNQRIKASGSGLQFVHGGASPQEMIIPLINYKSGANSKKISKVDLRIRESVGKITSNLTKFSIYQIEAVSIKDKFIERDVSVALYDENVRVSDEKKLKLNSTEENTIHDFRLTLSGEHKKVTLKVIDIESGDILDSKEYIVSIGIASDFDF

SEQ ID NO: 2139 - protein, 771 aa, Vibrio cholerae; identical to SEQ ID NO: 2119

SEQ ID NO: 2140 - protein, 864 aa, Aurantimonas manganoxydans
MDTDRIQVALSRFLAENKVVFWSDPEREFEDVLSSLDVGGATVIRVSRSPALEAKLAIAAGAADSRFLVYEDQSRPEPADDWLLDIRLYAKGFAADRSTHILEDLGLHTPALRDHIAQRAKFFASRERLTRFKRFVSPKDNEVDIDRKIMANLLRLDNADFFGIVIAIFDAFPDQSDISRPPEVFSEFAKYDVEESFWRQVDAVFGFADPRPSLGNLLIRLLVTDFTRKLNGKTPKALEHLKLRGQGTSNTAVCVAQWQDSHARHSSFDRLSDAVSNAIKLGDHVGSVDPEYLEDTRTFSLIERRLASGLRNRIIDTDTAVDVEEVASLCRRRKDGYWANESLGDTAPRKAYARTYDALEYAARLFSLRGAYASGFSFETVEEFWQAYETDLYRFDQLYRHFCEAADQVERQGWDILKTLRQKVEDVYGNGYVAKLATAWGPFAAEMISSKWQISGVPRQSRFYEKRIAPIVQEDDKRAIVIISDAFRFEAAKELADQINSRDRMEAKLTTQLGVLPSFTALGMASLLPHKDLAFSGGVVTVDGKSSSGMKNRGEILAKHGGGVIGAEELHAMSVDEGRRFLRSNKVVYVYHNHIDKTADGGDEEKAFDAVRRTINDITSLAIRILGSLNGTNLFVTADHGFLYQESPPTSVDKNAVEDKPEGVVLAKKRYYVGAKLGSHPGAWSAPLSRTSDVRDDTEFWVPKGTSRFHFMGGARFLHGGAMLQEICVPVLRIAYSKDKDANDVKSRPVQITVLGANNRITTPRRSFDLMQTEPVSDRVRPMSVTVAIVGSDGRPVSDIQKVTFDSKTPTMSEDWKQTVRLTLAGTAFDKSQRFFLVVRNAETKVQELSQHVIIDLAIARDFD

SEQ ID NO: 2141 - protein, 833 aa, Sinorhizobium meliloti
MQDRIAKGLEAQFDNHRIVFWYDPAHEFRQAFDALTLDGVEKIEVANTEFAVKHRILREEPKRCFLLYRDGPRPADIDNWLLDIELAHGVFKSDQVAIWLADLGLPISFEDVVREHQEFFRAGRRMEKLKAALRGDDTKAKLRLRMLGVCAGADGDFDTVIEALLGEQAAGKEDCLRLIDRVGLSGFLWDQMERIFGYRANKPSIGDFAIALFKSCYQSAVGGEAKLAPEALVFFRRWKNNRNAEEAFATLSTEYAEALSVTQDLTKRDFRTLIEVDFFEEVDRAIIRALVHEVGNQTVAQGEVLNWIRQRRQSHWYGAYRDLYEAIGFAAEFQQAIAQVTLGMTSLAEGVERYAKSWFRIDQLYRKFIWRMQKSGQATLMRELFEQVENHYVNSYLLRLNEAWQTHVDGAQTWSASPIPAQRTFYREQVSEFRRRDQKVCVIISDALRYEVAEELRGRILSLDRYEAGIDPMFGCLPSYTQLGMAALLPNGELQIADNDSGTVLVNGQSSQGIENRKKILATGRKGDRTTAVKAEDLMALDKDEARALVRDHDVVYVYHNLIDAIGDKRDSEERVFEAAEDTIEEIVRVVKKLNGANANNMIVTSDHGFIYQHRPIEESDFSSAQVEGDVILFRDRRFILGHSLKGNHGLRRFAPEQAGLEGSVEFLIPKSINRLRRQGSGSRFVHGGATLQEIVVPVVKINKKRQSDTTAVEVEIIGSSNQLITSSQISVRFYQVEAVTEKTQARTLKAGIYAQSGELISDSHELVFDFRSENAREREVPVRFLLLRQADEFNGQEVILKLEERHGDTSHFREYRTARYTLRRSFSSDFDF

SEQ ID NO: 2142 - protein, 835 aa, Sphingobium yanoikuyae
MTDRITAGLMRLYEDQGHRIVFWYDAARDLRTAFDAVDLPGVTKLEIANNEFGLKYRMLRQEPTARFLLYKDGPEPPMPENWLLDVQLASAVFRADQAAIWVADLGIPAKYEAAVRDHAEFYRSSKRLEALRAIERERPSQSANDVRRKMLAVCAGADGDLDTVIEALLAELAEGRDEALKLVDRAGLAEFFWKDVAARYGYAADAPDFQDFAITLFSSAWARAMGEAAPLNTDAALMFRRWSASRRWGEAFEKLSGDYQDVLKIRDDLASRDFRTLMPHDHFEEVDRRIVVAIVEGLARQSLPATDVLKWVRDRRQSHWYSRYADVYQAIGYATEFQQALAEADLTMTSLSDGVKRYSASWFRLDQLYRKFIYHMQKSGQSGLLSALYEAVENRYTTNFVLKLNDAWQDQVARLTDWAVPGFPRQVDFYRGQAAEYRRKDQKVVVIISDALRYEVAEEALREIRKLNRFDAELKPMIGVLPSYTQLGMAALLPHRQLAIRDDNDLVLLDGESTMGAAAREKALAAGRAGDRVKVLAAKDFMNLGSSEGKDLFRDHDVLYLYHNQIDAIGDKLTTEENVPAAAEAAIEDLVKLVRKLTSANFSNILITADHGFLWQHKALEESGFALSEPEGEIVTRNRRFVIGRGLNSSGGMKKFSAAQLGLEGEQDILIPNSINRLRVKGSGSRFVHGGASLQEIVLPVLRVGKQRKEDVGQVSVQIIPPPRAQITTGQIQVTFYQAEPVTDKQQPRQVHAAIFADDKTLISDEAELEFDFTSENPRERELSRSFLLSKAADAYNNQTVFLKLRTRIGKTSHFEDHASQPLLLKRGISTDFDF

SEQ ID NO: 2143 - protein, 874 aa, Pseudomonas fragi
MDTQQLNQGLRQAFFKESHRIVFWYDPEQGFTDELGQLDLPGVQVLNMQGHSTFGTKLKLELEDTEGKYLLYFPCAEPDANDDWLLDIKLYSRSFYADKVSLIFHDLGLHQQLLREHLANRERFLSSKTRLASLKRLIQPTDTEHELDLAMIAVVLCASGSDVMTLLCTLADVVVRDDLGLEQNPAVIDELYKFGLMPALLQALRKEVGYQASIEEISGDKPFNFGHFLIRLLATGFCESIGDIPSWASAIAIPSASARATSRALLSRWRDSSRFYQAYDEISGWVGDALHITQKIGEISLEVLANVATFQAVERQIIIDLTKAIPEADPRDLGLFSKIISERLDNYWATRHKDDETRHKYRLLYTALSAAIDLFTQRHQYAAGFHFASTEALYKAYESELYRFDTAYRHYFAASHRAHVELLKKLDEAVEQCYAYWYLDQLGRSWGDRVEAEQRLEHWKIPGVPNQHNFYERWVAPLLEGHRSKRVVVIISDAFRYEAAVELCQRINEKRYSKASLNSQLGVLPSYTTLGMASLLPHQTLEYREGSDGVFVNGLNTGNTIARDKVLAQHGGMAVTALQVKEWSRDAGREALKDQQLVYVYHNVIDDRSDKGGGSEVDTFHHVEFAIEELTELTRKILMHFNTSTVLITADHGFLFQQSKLEAADRTSLAEMPDSAIKSKKRYVIGHTLPVAKDVWQGSTKQTAGTTSDTQFWIPKGANRFHFVGGARFVHGGAMPQEIVVPVLTVNQLRGEKAEKRTKRKVGVISPKSALKMVTNIQRFDLIQTESVSEQVLPVTVAVSIYEGEQPVSSEEVVTFDCATDSMSERLKQVRLSLSGSDFDRQKDYFLVIRDKDLNTELERYRVTIDLAFTDDFF

SEQ ID NO: 2144 - protein, 828 aa, Lactobacillus helveticus
MPTLTTDKIIAKLNSYFTDNQYVFWYDDKQEFKDIIDSIAQHLSPVKLYKAQANQQFKSKIDLLNDSEHKYLIYAPYKRPAIQENYLTDMEHYSKLFTADATQIILEELQLPENQLLFVKKYNSYFGAKTRRADFVKYWSDTFDKTPEKGIIAAITKTEKLDMNELLMKVIAAGYVNNHYIFTFSKYDVLDIFWKLVMNYFGGEADSEVDLKYLVERIFITYLANELNDKLPDRFKNYYFKQQDNVQIFIDRFADSNKYQQYYDNCSSTVWRDLNLNTVLKHEPAMILTKISIFEEINHLILAKLVAKFDGKRITDYEQLLEIIDQMLDHTRNNFNGGTEPEYKFLRYAAELLNLKVPMVDDWQDELNDYLYNSYKIDTIYRKSLLAYTNIIDTDNYIDIKKTIDRYYGNMLLDSSVKQWNETFDLKEVPVKLKQERFYHNYVRDVRERVVVIFSDALRYEVAKELEEELNSDDRLTMKMNHAITVLPSVTYMGMNVMLPHETLEWDNKTSKVKVNGENAENTDSRDKLLKSYDENNLAFQLKNVLEMSSKEIKQMITGKNVIYLYHNQIDAKGHELKTTKELVEATEKAIDEIKQAVQVLRTNGIAHIIITADHGFIYQEKPIEDKDKIDLQGQNYEGNTHLRYLITPSQINVMGVKNTTMGVSLNNDDPTNVYYPVSPNEFVARSGSKNYVHGGSSIQEMLIPVLDIKATSRRSIAQPAEIKLAATTFRINNLKMNLLFNQTAPISDTVLPAEYHAYFTDEDGNLISNNVTIEANRTGSAADRTIAITITMQDMQYDLDKKYYLVIDREGSTEEPKRFEYSMDLIN

SEQ ID NO: 2145 - protein, 767 aa, Vibrio cholerae; identical to SEQ ID NO: 1828

SEQ ID NO: 2146 - protein, 865 aa, Faecalibacterium prausnitzii
METDKIVLDLNRRFAVPLPEFYERRIIFWHDEEKEYADKLDEIRLENAKLVALTGSNTFAVKKMLSVDDLTSNYVVYCPISYERQEDDWLLDIELYSESYRTDAVSNWMQELDILDNPSMRKLVKHYRKFFGAQARRAKIMAQDKIPATPAQLHMAVMAALCGIKKAQPNEILLNVLRGGLDKAQNPIYQSFVDYSAEEAFWAMVRQGCGYAEEEPDLGQLAIHLLLTASTRTLRPEFLAGLEKFLSIPHQAYCYELVSEWLHSDDLQQLYDVARYVEDEAHLPQRLEKLTVDNLATTECFPCINEIILSKLMTEISDHIIDVDVITKTVEKRRTCVWYEYFRNFYEGLLQVANMQEFFKEHSAGFHTPDAKQVWKEYAEDYYRMDTYYRLFHLSFQRSLETSNIKLDDLFKHVVDKVEGLYSYWFLGGLGKNWSDVCADEMAEHGRVLEIPQQSDFYNEYIRPADSRVFVIISDAMRYEVAASLADELRRETQSNVKLGSMQGIFPSITKFGMAALLPHKALTAELKNEVLNVLADGQSTASTNRDKVLKGVNPASVALQYKNIIGMKRAERAALVKGMDVVYIYHDTIDEASHTSDTSVFPACDRAISELKNMVRIIVNDFGGANILITADHGFLYTYSPLTEDDKVDKTSFHDMEVEYGRRYAIMQKEANPQYLLPVKFLDGKTEYTGFAPREGIRIKMNGGGLNFVHGGISLQEMTVPVIEYHYLRNGSMEYRRNKQKYDTLPVTVSLLSSSRKISNMIFSLDFYQKDAVSANREAATYLVWFTDEYGKPVSDTQKIIADKTSENGADRTFHCNFNLKSMKFSNTATYYLVIADEQGQQMQQREQFQIDIAFAIDEFDFFN

SEQ ID NO: 2147 - protein, 874 aa, Acinetobacter sp.; identical to SEQ ID NO: 1948

SEQ ID NO: 2148 - protein, 846 aa, Bacteroides sp.
MTQERIYSYFQRNPQLHVLFIFDKANIIMNDLADCSWETEYIYKVFDGAWFNTKYNIEYAWKEKRVVLLFPLGTYPMSEEQQLRFPLMDMLKANMEYKEEDYAAFMQQYKLPEKYRAFISRHIGELMSNKINAMLKDRFMPEAFSEDVVVRGFISSYLGEKRLLEWENIIIRMFILGLDSENKKRLDFYHKLERNKDAKTAVDERLTKIFGFSYKPNQEAKVKELVESLKYNSITQLLDVIADDSYKAYKIKSSIALEQMNRIYELGTRDREFADKFTKVMKELGADIREKELTTIYGMDASFYYLTEELGWPILQEIAGSKFVTEPAEMQERLRLLSQKLPADSVLQQAISFLMQMAFYYEMVRGLGSLKLNTPEAYVQLYTNDLYRLDTFYRCALEEYHELLSKDVPILTCLNGLKQQFDGEYARMVNVFNLEWMICVIEKGNYFNDLSLKKQEDFYANECVSNSKQVVIISDALRYEVAAELMQELAKEKHIAKLSAYRAMLPTETKYCKPALLPHTSLIWKNKEMLVDGEVLDTLESRSAQVAKYKESACCVDYETVIKADVKTARALFKSPLVYIFHDTIDAASHGAGAGDVIAACRKAIEQLAVLVRRLHASWNVTNVVLTADHGFLYNDVEFAEKDKHAVTVAGIIEKKTRYYVSDQVSAQEGVVTMPLDKVSGMKAETPIYIGVPMGTNRLAASGGYSFAHGGATLQEMLIPVIHSSQKRSDKTNKVGVALVDHNLVMVSSRLKFQLIQSEAVSMTVVERKVVCQVYQGDTPVTGKQTITLDSADTINLNNRVYEVVLILNHSVHSGMLQLRVYDEEDCLNPLIREVVKNNTMIEQDF

SEQ ID NO: 2149 - protein, 889 aa, Proteus mirabilis
MQISELAQGVAAKLEQSRIVFWYDPEQSFTEELEHLANSLSLAKESGDKAADITARVLPNDLTILNMGNESVLAVKKRIEVDEREAKFLIYFPSAEPEPDRDWLLDVRLYSEQFFADHSSMLLNELGIPKMALRTYIRKRQSFFANKQRIAGLKKWVTENEDELSLDRKMMAVVVKADSASLSDILLGLLREYAAYIEDESLGQPLWSQLSKFDLETSLWAYLSEGFGYTVEEPTFSDFVLKLFCTEFWSQIEGVERDWLLNNVLKSASGRATALAFMVSWRDSRSFAAYYESISKVLSQQLEISARAGQYHPVELIECETFEAVEQAIIRGLVRDLLDSSKALDRVQFDTVLSRRLASHWTLSRKEYFAIYEAIRNAEELMHLRNRYVDGFHFDNAKAMYDAYTTDIYRFDQAYRLFNEHVHSVLSKGADILRQLDDEVESIYTNWYLYELGLAWDRHLANEKLLEKWQISGVPHQYNFYEKEVRTRLSLKQTKRVFVIISDALRFEIANELGAIINNEKRFKAEVSTQLGVLPSYTQLGMAALLPHKALSYQPEQGTAVYVDGISSQGLDNRNAILQKVGGMAVSSKELMSWSNQEGRDKVRDVEVVYIYHDTIDAIGDKAATEEKTFEACRSAIEELKDLVGRVINRLNGSRVVITADHGFLFQQKALAAADKTSLKTKPAGAIEAKKRYIVGNNLPSDEACWKGSINDTAHGSSGSSYQAEFLLPKAAQRFHFVGGAKFVHGGAMLQEVCVPVLHVRELQKEQAAKHEKQPVGVVAATQPIKLVNNIDKVRFIQTDPVGERFVARLLDVYIVDAQGNEVSSRETINFDSVSKVMDERTREARLKLIGSQFDRNAQYTLVLENAEMRTRYSQYAVTIDLAFQDDFF

SEQ ID NO: 2150 - protein, 731 aa, Bacteroides sp.
MIDKWFQNDINKVLAVHDRVVVTDALGEGRLLLDYLPSDVVVINIGNEEIDEIEARYQAEKDCIGKKVVFYKRNAPDSLCFLLEYAETYGCIVLDDMEAYIRKHLFEGIKENTELGKQELLMAAKLSKGKDLNWWHGVSKGIIKPLDTDGLVIDLLHHPKKTKKSIDRDVWKIFESEVYSLISKPQTEQPVEILAQSVADTIFDGLIHNNISDRLLKIYYKCVDSNSMREPLLNYIEKYKIPQGMSVLDTHPDHCLMELDRQYFKQLSVALENNEYIIGFQQYVHNRTKSKKVEAYKAEWLKDVKVLLDFKNEKLYEINTVSQLANYYQSHFAPLDSAIRHLYVAWLQEEKLLRPYQYRYEQYNKELLDCWFGLTEEYKPTQRNFIADKLSGTGRIAVIVCDGLRLEIAESIADKIKVKGKKDVAFAELPSVTENGMSSLFGCAEVEDVAQTRYNNLKTLIHDVEVIQLEKLNSGVTANKLVLMFGDIDQVGEKKQLAGLKDINAYESFVSEKINELFSMGYSKVYLTADHGFVITGILDEADKIPVPDGDIIKSEERFCLANDTLDNENIIVRSQKYKESQYQYYAKSDKPFVSKGAYGYAHGGFTPQECIIPAYEFANENQESLGVSIANKQALQNVTGTYFTVKLKAESVENSLFKAERKVVIQIYGNGTLLSTSSVYRMTPSSVQEAEFALAETGNVKVVVVDIQTQQQVDFCDVKKSVSRDLDDLF

SEQ ID NO: 2151 - protein, 865 aa, Salmonella enterica; identical to SEQ ID NO: 1802

SEQ ID NO: 2152 - protein, 875 aa, Pseudomonas fuscovaginae
MDTQQLTQGLRQAFFAENHRIVFWYDPEQSFVSELEQLDLPDVQVLNMQGESTFGIKLKLELEDAKGKYLLYFPCAEPNANDDWLLDIKLYSRSFYADKVSLIFNDLGLQQQSLREHLAARERFLSNKSRLVGLKRLIQPSDTEQALDLAMIAVVLGANASDIMVLLCTMAVTVVNDDLGLEHNPPVIDELYKFGLMPALLQALRDEVGYPASVEETNGEKPFSFGHFLIRLLATGFCESVGDIPDWASAITIPSANARATSRALLSRWRDSSRYYKAYDEISSWVAEALHIGQKIGETPLETLANVATFEAVERQIIVDLSKAIPESDPRDLGLFSKIISERLDNYWASRHKDDEVRRKYRLLYSALSAAIDLFNLRQQYAAGFHFASTEAIYKAYENGLYRFDRAYRQYFAASQRAHVELLKKLDEAVEQCYAYWYLDQLGRSWGDKVEAEQRLEHWKIAGVPSQQSFFNHWVQPQFVKNRSKRLVVIISDAFRYEAAVELRDRINEKRYSEAILASQLGVLPSYTTLGMASLLPHNTLEYREGAGDTVFANGQSTAGTVQRDKILAQHNGMAVTADQVKAWSRDEGREALKDQQLIYVYHNVIDDRSDSGGPSESDTFHHVEVAIEELTELTRKVLMHFNTSTVLITADHGFLFQQSKLEVADRTALAEKPENAIKSKKRYVIGHTLPAAKDVWQGSTKQTAGTTSDTQFWIPKGANRFHFVGGARFVHGGAMPQEIVVPVLTVNQLRGEKAEKRTKRKVGVISPKSVLKMVTSIQRFDLIQTESVSEQVLPITVAVAIFEGEQPISSEEVVTFDCSTDSMSERMKQVRLSLLGSDFDRKKDYFLIIRDKDLHTELERYRVTIDLAFTDDFF

SEQ ID NO: 2153 - protein, 66 aa, Lachnospiraceae bacterium
MAELNLKQINARLNEEFRGEKRKLVFWYDDKAEFAEDIKDIELDNAKVYFLQPDNQFYKVLFGAKG

SEQ ID NO: 2154 - protein, 772 aa, Lachnospiraceae bacterium
MERKDNENNYLIYAPFPKPDVRENHLEDTLLYSKRFFADRASLLMADLGVDEKYKNIIEKHIKFFANKERTQRFYDLEIEQFNGENIIVGMLCSICRTQTCSFEEVLRAVLSDGEYEDNKFIDTFKKYDLLVEFWKLCERDFGYIDNIPSLTNFVLTLFVTYAAKSVMGELPESLKSMVSHKSGNIITFMDNLKNSVLYKDRYNELSEFVSNELNIVKMFENLLPEELLYCDTFVCIDKIIIRWIKERLLAEDTGAMLDNHSIKEVVSIRSKMHFSESMGKIYHMLGSAYDIVVSAKYVCPDSFSDILEKYKTSDYKIDQNYRYFYYDYDSLDDSEDFERLRELVENIYTNEYLDKLLQKWNSGILEQDAFGKLPLQIDFYDSNIGGLKDRTVVIISDALRYEVGYELYTTLADDPKSNIRIDTSLSVLPSYTRLGMTALLPHKSITMSDDYTVLVDGMSCDNLLTRQNILQRYCDNSICVQFDDIKNMKKSELRDIFTGKQLIYVYHNQIDARGDKANTEDEVFVACKEAVNEIADLIRRISSNANTHHFIVTADHGFIYKRDKLNESDKINVRDKNAFVNRRFIVSTEAIYEDGIENISMGKILRNDDGKVVSFPISSNVFKVSGGGQNFVHGGSSPQEMLIPVLNIKMERGHIDTGNAQIALVSMVQKITSNVTVLEFIQSEAVSDTIKATTYKLYFISDDNEKISNEATLFADSRELDARKRIFRMNFRFKDKKYDKNRNYYLAAYDEGSGEEIWRHHVVMDLVGESF

SEQ ID NO: 2155 - protein, 767 aa, Vibrio cholerae; identical to SEQ ID NO: 1828

SEQ ID NO: 2156 - protein, 840 aa, Roseburia inulinivorans; identical to SEQ ID NO: 2001

SEQ ID NO: 2157 - protein, 865 aa, Salmonella enterica
MQNQEFIAGLKAKFAEHRIVFWHDPDKRFLEELGNLELENVTLLDMTDQSQLAVKKRIEIDEPEQQFLLWFPHDVPPKESDWLLDIRLYSTEFHADFAAITLNTLGIPQLGLREHIQRRKAFFSTKRLAALKGLVTEQENEASLDKKMVAVIAGVKTAKTEEILFSLITQYVNQQKDDDSDLENTLAMLKRHDLEGVLWDILNQEMGYQAEHPTLENLILKLFCTDLSAQADPQKREWLEKNVLTTPSGRASALAFMVTWRADRRYKEAYDYCAQQMQDALRPEDQYRLSSPYDLHECETTLSIEQTVIHALVTQLLEESTTLDREAFKKLLSERQSKYWCQTRQEYYAIYDALRQAERLLNLRNRHIDGFHYQDSAAFWKAYCEELFRFDQAYRLFNEYALLVHSKGAMILKSLDDYIEALYSNWYLAELSRSWNKVLEAENRMQEWRIAGVPRQQNFYNEVVKPQFNNPQIKRVFVIISDALRYEVAEELGNQINTEKRFTAELRSQLGVLPSYTQLGMAALLPHDEICYQPGNGDIVYADGLSTSGTLNRDTILKKYKGMAVKSDDLLKWKNQQGRDLIRDYEVVYIWHNTIDAMGDSASTEEKTFEACRNAVVELKDLVTRVINRLHGTRIIVTADHGFLFQQQPLSGQDKTTLQIKPDNTIKNHKRFIIGHQLPADDFCWKGKVADTAGVSDSSEFLIPKGIQRFHFSGGARFVHGGAMLQEVCVPVLQVKALQKTAAEKQPQRRPVDIVNYHPLIKLVNNIDKVSLLQTHPVGELYEPRTLNIFIVDNANNVVSGKERICFDSDNNTMEKRVRDVTLKLIGANFNRRNEYWLILEDAQTETGYQKYPVIIDLAFQDDFF

SEQ ID NO: 2158 - protein, 868 aa, Acidovorax sp.
MSSQRISDSLSTLFASYPVVFWHDVEAEFSSTVGSLPPEGVQLVRLDETPSLRVKIDIERAPGQRWLIYSTQPEPEPAQDWLLDVRLRSKSFRADTTSILLEDLGLTTQALRHHLKERAKFLRAKDRVERLKRLVLPGDGAPDLDRKMLAVLTRADQPELFAMLQRLFAALVVDGEADLAAQPKAWQDIAANDLAPAFWALVRSQLGYADAEPNLRDLLVRVLVTDLCRSLDGAPPRQLAHFVLPDRALAANASVFAARWRSDLAFFSSYNVLARALAQELNLAQLLASYTAEQLAECMAFEEVELRVVQDLKQRIVAGAGANMDVVHGLIARRRDGHWANPLLASASERTRALAACYDALTAAADFFSLKASHAAGFSFAGAATAFGQYREYLYRFDQLYRHFHTAADAVEPSGWAVLHELRTSIENVYSGWFVPQLGAAWAKVVEGDQGLLQRWAIPDVTPQQAFYEREVQPLYSGGAKRVFVVISDALRYEVAQELVQFTNGKNRFKASLGAMLGVLPSYTALGMAALLPHQTLAYKESANLDVLADGHLVATLEQRNEHLKGVGGMAIKAEDLMALGKEKGRDLVRDRQLIYIYHDRIDMTGDKQASESKTFEAAAQTVQELSQLLGFIINSLNGSTVLVTSDHGFIYQESPLDGADKSTLEDKPVGTLKAKKRYLIGRNLGTTAKAWAGNTAVTAGTTLEGSLDFWVPKGASRFHFAGGARFVHGSAMPQEVVVPVITVRESEADHAKTRPVNISVLGNVGKMVTSSQRFEFIQTDAVSERVLARTVVVSLREGDAPISDEQTLTFDSTSQLLDERKRSVFLTVLAGAHDPHRRYDLVMRDAITKVEVLRLPIKVDLAFGSDF

SEQ ID NO: 2159 - protein, 790 aa, Desulfonatronospira thiodismutans
MRVIDHILRSIRDAALYNPEVQAAPSCILWPDWDRQWEPAVNRLLQEMPELFVLGKYSPEQRTGPAIWLRCVILFSSANVEQVCDAPVSESLNSQFPVVHSGATPVIYLPGVSRQDLRAVESCPDSLKPLAELQYRGVIWSQVNAKDWTILAFLKSDQGGLGLDVARDSETKRAIRTALMPLLDEDVDLLECKRLDKDYFHNLLSGGDPVRDLLQWISAPDDFRNRLDKNHWEAFVQVCKSQFGFDPQKQGVLTAAHNLAQQKNQWRSVWSRYREAPHRYPGIPGQIRKCRPPAGSLMWYVGGEFPGWPQWNEQQEKNLRENLSGLKELPAHNARQEIIELEKIHASRRNYVWAELGLSPLAMSLKHLAVMAEVTRNTLAAGTLSDLAAGYSDWGWEADDALLRALACVHRQEDFEALSSALRTVYLPWSQESSRHLQRLWLKEHSVSHVQEEQEVYFECCLFVDGLRFDCARRLQTLLEEKGISVSRQLGWAALPSVTATGKPAASPVAGHISAAQASQENFEPCTAHHFKKLLQENQWTVCRQNDPLPRISELEVKKLWVEFGDIDHEGHEWGWKLSAHVDRLLREVRDRIEDLIQAGWTAIRVVTDHGWLLLPGGLPKIELPRALTQTKWSRCAVIKSGADTDENLYPWYWNPDRHFALADGISCFRRNDEYSHGGLSLQECLLLKLTVFAGPAARAEESLQLMDVVWKGLRCTVVVEGWTQDLWLDVRTSPGEASSSLVLKLKLLKKDGSASVVVEDEQFEGQEAHIVLINAEGQLISQTSTIIGG

SEQ ID NO: 2160 - protein, 840 aa, Oribacterium sp.; identical to SEQ ID NO: 1923

SEQ ID NO: 2161 - protein, 861 aa, Magnetospirillum sp.
MNEVQISEAVSQLFADGNRIVFWNDPDREFEETLATLALDSVTLLRADQVPGLEAKIRIEREQPDSRFLVYSTAEVPLPSEDWLLDIRLYSRTFRADRASIIHGELGLNEQSLRTHLGTRAKFLGSKDRLARLKKFVQPTDTARDLDRKMLAVLTKVDQSEFFGILTALYHGIPDAHLEAVPAAWDDIEKFDLAAAFWSLVQENFGYAEDAPTLKNLLIRLMVSDLAHSTTANLPAALTHLMLPKLFLSSASVCLAQWRDSNSRSDSYDWLSDAVAVALKIESQLPGLDIEPLLDNKTFLIIEKYIAAKLRDRVVATASTINAAAIKGIAKHRQNGYWADRNRGAIGATREALHAVYDALIAAADLFGLRGEFSTGFEYNSAQAMFEGYATALHQFDRLYRHFIEAADAATAQGWDILKALRDSVEDCYTNWFLTNLSLKWGKFVEDELLANWRVDGVMNQPWFFQKVAAALMESDRRVFVIISDALRYEAAKELVDDLNGTYRVQAEIQPMLSVLPSYTALGMAALLPHSKLSYSDKGDVLVDGQSSAAGNRSNILAAKKGVAVKADELRDMKKDAGREFVKPYEVIYVYHNTIDAIGDSGSTEGKTFEAVRTALTEIADLIRMIMNNLNGTYIYVTADHGFLFQETALDATDKSALVDKPAGALTAKKRFLIGRNLPDSDKAYHGSTAVTAGADGDMEFWVPKGNNRFHFVGGSRFVHGGAMLQEIMVPLIRVRQIKGDAKSKTSVKKVGVMVVTQSPKITTNRYRFELMQTEKVTDRVKPATLDIAVYEDGQPITNVERVTFDSTQDNLDSWKKSVWLSLQKRSYDKKGCYHLILRDTDDLEQGRVEVSISIAFMDDF

SEQ ID NO: 2162 - protein, 865 aa, Escherichia coli; identical to SEQ ID NO: 1930

SEQ ID NO: 2163 - protein, 767 aa, Vibrio cholerae; identical to SEQ ID NO: 1828

SEQ ID NO: 2164 - protein, 874 aa, Acinetobacter baumannii
MNLGQLQQGLEQAFYTEQHRIVFWYDAEQSFSEEVKALNLGDVQILNMAEESSLAIKLKLELQDQQGKYLLYFPSPEPETEKDWLLDIKLYSRSFYADRFSIIFNELGLQQQSLREHLAKREEFLKAKARLSTLKRYIQPDADAQDLDMAMIAAVVKADSAELMHIVLALADEMVQHNLELEVNPDSFAELEKFQLVPALVTALQAEIGYPASVEELNGETQFKLGTFFIRLMTTGFCESLGDVPVWAQELVMSSVSSRATARAFLSRWRDSSKYYPTFDKLSQSVANALRIQEKVGAFDLEQLLDVMTFEVIEQKIIVDLASHIPAATKAELEHFRTIISTRLDGYWASKHKDDATRRKYRTVYTALQAAIELFSLRLQFDSGFYFDSSEALYKAYEQELYRFDMAYRHYSAASQRAHVDILKKLDEEIENCYAYWFIDHLARNWGERIEAEQRLNVWKMADIPNQQNFYDTHVRPLLGSATKRRIVVIISDAFRYEAAVELRDRINEKRYSEATLSSQLGVVPSYTTLGMASLLPHQTLEYKEAAGDDVLVDGQSSKGTAARSKILAAYNGLAVTAEMVKGWSREEGREALKDHELIYVYHNVIDARGDSASTESETFMAVEHAIEELTELSRKILMHFNISTLLITADHGFLFQQSKLESADRSSLTEKPTNTLKSKKRYVIGHGLPESKEAWKGSTQATAGTLSATDFWIPKGANRFHFVGGSRFVHGGIMPQEIVVPVLTVKQLRGEKAGQRTKRKVEVISTKSTLKMVNNIQKFDLMQTEAVSELVMPVTLSIAIYDGDLKVSSEETLTFDSSTDSVADRVKQVRLSLSGTDFDRKKDYFLVLKDKDLNIEMQRYKVTIDLAFTDDFF

SEQ ID NO: 2165 - protein, 874 aa, Acinetobacter baumannii; identical to SEQ ID NO: 1718

SEQ ID NO: 2166 - protein, 862 aa, Magnetospirillum sp.
MNEDQISEALLSLYGDGNRIVFWNDPDREFEESLASLDLDGVTLLRADQMPGLEAKIRMEREQAHNRFLVYSATHVPLPSEDWLLDIRLYSRTFRADRASIILGELGLQEQSLHSHIQARAKFLGSKDRLTRLKKLVQPTDSIRDLDRKMLAVVTKVDQPEFLGILTALYHAIPDSDLDALPPAWDEIEKYDLLESFWSMVQGQFGYSENSPTLKNLLIRLMVSDFAHSITAELPAALAHLMLPRLFLSSASVCLSQWRDSNSRSDSYDRLSKMVGDALKIDSLLPGMQIEPLLDNKTFLVIEKFIAVSLRDRVTATTATINAEAVKAIAKHRQNGYWADRNRGAIGATREALHAVYDALIAAADLFGLRGEFSTGFDYNSAQAMFDGYATTLHQFDRLYRHFIEAADAATAQGWEILKSLRDGVEDCYTNWFLTNVSLKWGKFVEDELLKEWRVEGVTPQPWFFHKVEAALMESDRRVFVIISDALRYEAAKELVDVLNGTYRIQAEIQPMLGVLPSYTALGMAALLPHSKISYSDKGDVLVDGQSSAAGNRSNILAPKKGVAVKADDLKDMKKDAGREFVKPYEVVYVYHNTIDAIGDSGSTEGKTFEAVRQALTELSDLIRMIMNNLNGTYIYVTADHGFLFQETALDASDKNALTDKPAGALTAKKRYLLGRNLPDSTKAYHGSTAITAGADGDMEFWVPKGNNRFHFVGGSRFVHGGAMLQEITVPLIRVRQIKGDAKSKTSVKNVGVMVMTQSPKITTNRYRFELMQTEKATDRVKPATLDIAVYEDGQAITNIERVTFDSTQDNLDSWKKSVWLSLQKRGYDKKGCYHLILRNAEDGIEVQRVEVSISIAFMDDF

SEQ ID NO: 2167 - protein, 867 aa, Escherichia coli; identical to SEQ ID NO: 2081

SEQ ID NO: 2168 - protein, 767 aa, Vibrio cholerae; identical to SEQ ID NO: 1828

SEQ ID NO: 2169 - protein, 818 aa, Bacteroides sp.; identical to SEQ ID NO: 2092

SEQ ID NO: 2170 - protein, 767 aa, Vibrio cholerae; identical to SEQ ID NO: 1828

SEQ ID NO: 2171 - protein, 865 aa, Escherichia coli; identical to SEQ ID NO: 1930

SEQ ID NO: 2172 - protein, 771 aa, Vibrio cholerae; identical to SEQ ID NO: 2119

SEQ ID NO: 2173 - protein, 833 aa, Methylophaga aminisulfidivorans
MSNRISQALTNLFDKHRIVFWYDAKHELRDDFEALELSGIEKLEIANNEFTLKHHILREEPKKKFLLFHDGPQPDDLNNWLLDVQLAHGEFRTDQIAIWLSELSLGLEFADLVQSHAEFFQAAKRKDGLKKLLNADDTPGVIQLKMLAVCAGTDEPRIEVVVQSLLQELAEGDDEKVKLIRRCELESFLWEQMARHYGYQSATPSIRDFVIELFKSCFAMGTDGEFTLRGDALVFLKRWKDSRQYEQCFEKLSEECAEVLAIEQDLSSRDFRDLIELDYFQLIDRKIISDLVRELSERTISSGDVALWVRQRRQGHWYQEYQHLYEAIDYAALFIQTIGEVKLQIESLADGVQRYCQTWYLLDQYYRKFIYHTRRAAHPSMTAALSEQIENLYSNNYLLKLGDAFQALVDGVEKWDASPVPLQKNFFELWVRPFLNRDNRVCVIISDAMRYEIGDELLSLIRQEDRYSAELEPALSMLPSYTQLGMAALLPNQELAIADNDTGTVHVDSQSSMGTANRDKILKAAIDGRGKAITAEDFMSLSRDDSREMLKASDVVYIYHNRIDHTGDKIHSEGRAFEAAEEALDDLIRLIKKLTAANASNILVTADHGFIYQHRAIDESDFSSVDVSGDSILYSDRRFVLGKGLSDSNSLHSFTSSQLGLSGDVEIRVPKSINRLRKSGSGSRFVHGGATLQETVIPIIKINKKRKSDVSAVEVEILRGGSTVITSGQVAVAFYQVAPVTDKLQPRQLKAGIYTQSGKLISDTHELTFDLSSDNPRDRELPMRFVLTREADDANGEEVILKLEERHAGTSHFKEYKSLRYTMRRSFTSDFDF

SEQ ID NO: 2174 - protein, 865 aa, Escherichia coli; identical to SEQ ID NO: 1759

SEQ ID NO: 2175 - protein, 767 aa, Vibrio cholerae; identical to SEQ ID NO: 1828

SEQ ID NO: 2176 - protein, 861 aa, Photobacterium sp.
MTSRISVALKRLFAKHRIVFWYDDKQELRADYEALELENIEKIEIDNNEFSIKHRLLRGAPKTNFLLYKEGKQPEPLNNWLYDVELANVTFRTDQVAIWLSELELPSEFSELIENHTAFFEPQGKEQDALSEAESRKQTLKGLLEPDDTLSRARLKMLAISVGLKQKGDTRLDVILELLMADMAVGKLYSFIERCNLQQFLWQQVTNSYGYQTDSPSVKDFVLELFKFCYLAELSTGLQGTRIDSDASQKHNMTNNALVFFKRWKDSRAHQRTFEWLSEQCSNFMDIERDLQHRSIREVLDLDYFSVIDRKVIHDLVHGVADRTLSQGEVALWCRQRRHGHWYSEYRLLYSAVDVACQFFALLDVVKLDMPSATQAVHRYTSQWFKLDQLYRQYVYALKVSSQHTLLSILTEQIENLYVNSFVQPLTNAWQHHVDGMGSWQVPDVISQNKFFENYVVGQYLAKKKKVCVIISDAFRYEAGEEMVSRIRQEDRYEASLNHALSAMPSYTQLGMASLLPQSKDYPLQLADNKTGTVLMGGLSTQGKDSRDKILKTIHGERASAVLAKDLIEMNQANTRELVKANDVLYVYHNRIDHTGDKMQSEGEAFEAAEKTFDDLTKLVKKLTNGNASNILITADHGFIYQNSTLDESDYLAKDIEGDILYNDRRFVLGKGLSCGKSLKAFSSIELGISGDVHAVVPKGIQRLRLSGSGSRFVHGGASLQEVIVPVISINKKRSSDTKMVDVDVLRSGSSVITSGQISVTLYQAEAVTDKTHARTLRLGIYTESGTLISDSHTVELDLTSEHPREREMKLRFLLNQEAESANNEEVLLKLEEPVIGTNQFQDYKQLRYTIRRSFTSDFDF

SEQ ID NO: 2177 - protein, 767 aa, Vibrio cholerae; identical to SEQ ID NO: 1828

SEQ ID NO: 2178 - protein, 837 aa, Fusobacterium sp.; identical to SEQ ID NO: 1997

SEQ ID NO: 2179 - protein, 848 aa, Clostridium perfringens
MNLKEIKNFLNDIFSKPLSDGKVRHIVFWYDENEDFTEEIDEFDLDGVELIKLNENNAFYTKYHIEKENVDGNILVYSNMKKPKPQEDWLYDILSYSEEFSTDRATVIMRELKVNNPYLKEAFTFYNTFFKNKDRLAAFRNLGIQDYTEEKVHIGVLAVLTKTKIMNFEEITRALIKEKLDGNSKLYEDIDKFGSLDILWNLISKNYGYSFEERSLEKFMAVLLITNMNETIKFNLPKQYEDFVSKKSTDCIVFINHFMNSLKDSHYYDKMQRLIGEKIKISKLLEKTDSDKFLKCDVFEEMDKLILGRIVNLLNDGIEEYDKYLNIMASRRTLHYYKKYESEYKALKWGIRLLAKKKELDSIIKTESSYDMVKSYARNYFEIDKAYRKFYYHFDNCELKEILNNLKDTVENLYNNWYLQELSIKWNEALAKQKTWRIEGVNQQESFYNDNIKYGRKERVFVIISDALRYESAEELSIRLRNERKAKVELDYMQGVLPSYTKLGMAALLPNKKIEINSNYDVLVDGINSNGTENRDKILKVENEKSLAITYNKLMDLKESEFRKVFSGLEVVYIYHNTIDAVGDHASTEREVFSATDTALNELINLVNKLVHRVSASSIIITSDHGYLYKRSNIEEYDKLSGIKLEDGEDNRRFLLTSQNKDIEGTMRFSMDYLLGADSGMNVITPKGIARFKVQGAGANYVHGGAMPQEVLIPIIRFKNDRSSSSENDIRKVKISLTSITRKITNIITYLEFFQDEKIQDKVITQRIKCYFEDEEGNRISNENAIIGDSKSENPIERSYREKFVLKSIPYDKRKKYYLVIEDEDDSSLQCEKIPFNIDIAIVDDFGF

SEQ ID NO: 2180 - protein, 845 aa, Actinomyces neuii
MSGTNLDQLAGALRDKLIYSRIVSWLDLAGEYAEIIEQMETLLGVPIIVVDGNEFSVKIRVLADHPKEKFVLYRKGELPPVEDDWLADIRLGYATFRADSITLQATELGLTADELVATMRAHAGFFNSRDRVTKLRSRLRDSVDSKTLLAMMTSTLLGTADHSFSHLFAELASSAAPPAGEEPAEGKFPLLKYGLDDFFWDGAAKIWNYDGQKDLPALVLWLFLQEQNNWPESANANARADFRSWFNALPNQQAVQAWAAYAAEKLSSLQQLSARPAGELLQNKTVPGVDELLVRQLADELVAGSTNAEAVRKVAAERQNTIWYERSRNTWKALLSGAECLTLIRTMGKPLFADAADGFFQYTDRWWKIDQAYRQFLYFAAGTGGDSPIAVLKQQVETAYIYDYQQPLAHEWDGAIRQLGGWKIPARGSESAPSRQDRFVALNARSGRRTIVIISDALRFEVGKELEEKLNRQGRFTAQTEPWYTLLPSVTKLGMAALLPHGQLEFTEKSEVRLDGASAEGTERRDQILADAFAGRAGALTFEDARSMNRDQIRDYVRERDVVYIYHNEIDAIGDSGSSEMDTPGACQRTLEALCRLCTQWANYANTARIIITADHGFLYQERALEDNDTVLQGQVPAGKQMVGKMKRRYALGKNLQTDDNWTAFTAEQIGLAGGLDVAVPRGLRRHRVSGKGRQFVHGGASLQEITIPVITVTVGRQNKTEDARIELHYSQTAITTPAISARLVQKDPVGGKTAPFTAQIGLYAQDGALLSDLVTVEVNSPSQSQEQRNRNVQLALTAEANAHNNQDVYIRAHKLVNGNQVAAVAEHKVRLLRSGFNAFGGFDI

SEQ ID NO: 2181 - protein, 840 aa, Enterococcus faecium; identical to SEQ ID NO: 1912

SEQ ID NO: 2182 - protein, 867 aa, Escherichia coli
MNLQNQDFIAGLKAKFAEHRIVFWHDPDKRFIEELEQLKLESVTLINMTHESQLAVKKRIEIDEPEQQFLLWFPHDAPPHEQDWLLDIRLYSSEFHADFAAITLNTLGIPQLGLREHIQRRKAFFSTKRTQALKNLATEQEDEASLDKKMIAVIAGAKTAKTEDILFNLITQYVNQQIEDDSELENTQAMLKRHGLDSVLWEMLNHEMGYQAEEPSLENLLLKLFCTDLSAQADPQQRAWLEKNVLLTPSGRASALAFMVTWRADRRYKEAYDYCAQQMQAALHPEDHYRLSSPYDLHECETTLSIEQTIIHALVTQLLEESTTLDREAFKKLLSERQSKYWCQTQPEYYAIYDALRQAERLLNLRNRHIDGFHYQDSATFWKAYCEELFRFDQAYRLFNEYALLVHSKGAMILKSLDDYIEALYSNWYLAELSRNWNEVLEAENRMQAWQIPGVPRQQNFFNEVVKPQFQNPQIKRVFVIISDALRYEVAEELGNQINTEKRFTAELRSQLGVLPSYTQLGMAALLPHEQLCYQPGNGDIVYADGLSTSGIPNRDTILKNYKGMAIKSKDLLELKNQEGRDLIRDYEVVYIWHNTIDATGDTASTEDKTFEACRTAVAELKDLVTKVINRLHGTRIFVTADHGFLFQQQALSVQDKTTLQIKPENTIKNHKRFIIGHQLPADDFCWKGKVADTAGVSDNSEFLIPKGIQRFHFSGGARFVHGGTMLQEVCVPVLQIKALQKTAAEKQPQRRPVDIVAYHPMIKLVNNIDKVSLLQTHPVGELYEPRILNIYIVDNANNVVSGKERISFDSDNNTMEKRVREVTLKLIGANFNRRNEYWLILEDAQTETGYQKYPVIIDLAFQDDFF

SEQ ID NO: 2183 - protein, 767 aa, Vibrio cholerae; identical to SEQ ID NO: 1828

SEQ ID NO: 2184 - protein, 767 aa, Vibrio cholerae; identical to SEQ ID NO: 1828

SEQ ID NO: 2185 - protein, 836 aa, Fusobacterium necrophorum
MEKEKIKEMLEERFQVIPAYPRKRHILFWYDGQKAFQDIIEELQLDKVKILRLQKGVNRNGEEIDTNLFKIKYTLEILDTDSHYLIYSANPRPSKHENYLLDIESYSDFFEADKSAILVDDFGFDRKNHGIHDTIREYSEFFASKERREKLRKLLENPLHTSEEKLKLSVLAVIVGAKTAELQEILKNIIFDSSKLEQIKKWMGLSFLYEQILRKFHLSIESWEEFLKILVVVHFYREVQQKPSIHLESYYLGKTNELFIFTSSLFQNQNDSKHIQEIFYEVGKELNMKDRIEELEFEKMLLGNSFEYFEKRILQELVDRLQLGVVDYSQYISWIQERSHYSFWKEKYFYFYETLLSVAHLLKEKEQLEIQDRKTLSKILEDYTAHYYKIDQAYRNFYYSYDQIKSSELASIFDSFHSKISHFYEVEYLEVLLALWNEHLEERNSLAQQKDFYERYIKNSNTRVAVIISDALRYEVGEEITRQLEKEGNAKEIRIFPLLTNLPSITSVGMTQLLPPGKDRSIDLFHNKMTVNGISTFSTENREKILKESCLESSAISYDTFKNKSRGEQEAYVKGKKVLYFYHDSIDAIGDKAKTEHRTFDACKMAMQDILSLTKILSSLGIVNIFISSDHGFLYERKEIEEYNKLELQEEYFLLGKRYAFSTKKVEEKGCITIPIEDFFGVFPQKNQRIKVGGSGLQFVHGGSSPQEMIIPCIHYRGGAKVKKAKKVGVRIKEMGEKITSHFRKFAIYQLEPVNPQEKLLERTVVAALYDGNICISNEFKILLCAETENTEYSFSLTLSGEHEKVILRVTDAESKDILDQKEYQVKIGIASEFDF

SEQ ID NO: 2186 - protein, 767 aa, Vibrio cholerae; identical to SEQ ID NO: 1828

SEQ ID NO: 2187 - protein, 781 aa, Xanthomonas vesicatoria
MRVIEHLVKTLRDSAIFNPEVQVAPSCILWPDKDRQWEAVIPRLQSELAELLVLGDYTPENRTGPAIWLRCVIAGKAPDVTLPADRVPVFYLPGVSRQDLRAIEDCPDLLKPLAELQYRGVIWSQANAKDWTIMAFLKSDQGGMGLDMAQDNDAKNAMQLALYRLLDEERELLKGKRLDKDYFNTLLTGGDPVRDLLQWLDLGEAFQTTRGANEWAAFVEVCKSQLAFNPQAEGVLAGASKLAMREGPWHSVWERYSEAPQRYPHIPNRIRQCKPPQLGIFDAPGEKLSGWPQWNEEQEKSLQHDLLALNHLPAHEARKRVLEIEKAHGPRRELVWAELGESPLALAVKHLALVAEVTKTSLAAGSVSDMQLGYASQGWRADDAMLLALACVDKAVDVEAVTSAIRAIYLPWLEESARYLQQVISGSVYPGGRIAEAPAFYRVDGECVLFVDGLRFDAARRLSATLEASGYQVAEAMTWAALPSVTATGKAAVSPVRSKISGSDHCDDFEPGVAATGQSLKGGYHLKKLLSADNWKVLDRTDNGDGHGNAWCEFGDIDSEGHVRGWKLAKHIDPLLGEIAERIAALLAAGWTRIKVVTDHGWLLMPGKLPTIQMSKDLTDNKWGRCASIKSGASTNERLYPWFWNPNQQFALADGVGCYGKSVDYNHGGLSLQECLTLELIVTRGANASVRQAAQVTDIAWRGLRCTVAADGQYASLLLDIRTRAGDPTTSVVVSIKPLKDNGAASVVVENEELQGFEAFLVLLSASGELVAEANTVIGGA

SEQ ID NO: 2188 - protein, 839 aa, Lactobacillus zeae
MAEVGLQDVVAGIEKLFNDMTHFVFWYDANGDFTDNLDELREKIREPIVVLNHREQVKTKLHLIDLEKAGKRALVYSPYSKPEISLDFLTDMELYNQEFTADAAAMLQKELGLPDSQREFVRDQAKFFNNKERVARFKQLNQPGKNPYQVAMAALAKTTDIQLTSILLAVIAAQTDNQNVLLDEFDKYDLQEEFWQFISAAYGYTGKHQLNQLLAAMFLNFAYFQLDTDLPKNFANYKLANLTNVSSFMLNWRQRADLQEKYAWAAEMVWQKLNGDRIFGQIDPTRLIKVDAFPQIDKRILQWLNKELVAGNTGEMLGQLSLNDIAQKRTTMHFGKQYQVADDMIGDACLILSEQFTPDTEPASVLEQLSQYTENGYKIDMAYRRYNKARNDLPVDLQPMFDKLSDQVERVYNNNRLVPIISNWTKVYEPRLVPPQYQQRDFYSNFVSNQKDRIVVIISDAFRFEAAKELQRRLDQQDLYTPSMQSAITGLPSVTYFGMPQLLPNHQLRYTTGQELLVDEKPATNLKLRRAILQQAEPASDAEGLDTFLSWSSEAQKQFIAGKKVIYFYHNTIDAVGDKPASEAKVFRAVSDAISELQRGIDRLRNISVAHIIVTADHGFIYRRKPLDSTDKINLPTDMVFEVKNLRYAIGQGELNEIGVGQAKLGDILDTDDTRSVFYPENGNVFTVPGAGQNYVHGGCSPQEMIIPVLDVRARRGRSQASYAELTLVTPVRRITTREVIVNFVQKDAISDLVKPATFKMFFEDDKGNHISGEIQVVADYKEKNIEERRITGRIPLMDKEFDRSQEYFLVVENVDSGEIDRIQYQMDLTVGGGFDFDI

SEQ ID NO: 2189 - protein, 804 aa, Bacteroides ovatus
MKPETPVIIIYDKEGVYYDLLPIAIEKGFKVIDTTKGALHARLSASRFWCNDLSIDKNVQMIIYRQRPMPTNNRSWVEEPFSCFMKSACIFPYGPQDTYENICRTFLPSKQQDLDKLFANGSTSFNMINALLDGAAYPELEQLTGGKSISEITVGLLALDECTNMNWQKEWRILAEVQFPRLDCTGVSLNEVQNKLWTYLLFSEFVFDLPGALPENLKSVPMAPVEMKEKVYMICDKLRNQINLRETYVRIANKVSEQLKLSEVFVKAKHLGERVTFNFENSVEYNRFIDYIKAGDIQEATRLISKNESGVWYQEEQEVSNYWKLAQHIVDLMQCINNGIETDGTLADLIEWYTNVGCVADNAFRKFHTDKLGMLHLPKQADELTNLINKHYREFTERGVKAYQQLIIDIKDYPKLRNQGYIQFVKPAIKNGKRVVFVMVDAFRYEMGKTFAKSIERNFMERVECLSRISYLPSITRFGMASHMGDISVRNIQGKLQPFIGEQMVSTPEDRITWLKADTNIEVQDFRLEEFNSAKVNDRTRLLVVRSVSIDSAGENDKLNGLATMEREQIRLAKLLDDCKRLKFDEAIIVADHGFMIQPSFNVGDLINKPKGSDISIEESRVIAGNLNDSNDTLSLTTTQLGNDMEVMKLSYAKDYTVFTRGEIYYHEGLSLQENVVPIIRVKLQEEKKRQSFQVSLSYKGKNGGTIFSRRPLIDINTTFANLFADDVIMKLKVTGDNDCEIGEAEDRFYDSVTGLIRIPSGATSVRQLINIRDEYHGNTVTITALDTETNATLSTLRLNFEND

SEQ ID NO: 2190 - protein, 865 aa, Escherichia coli; identical to SEQ ID NO: 2093

SEQ ID NO: 2191 - protein, 865 aa, Escherichia coli; identical to SEQ ID NO: 2101

SEQ ID NO: 2192 - protein, 863 aa, Coprobacillus sp.
MALEDIKKNLDKRFSEPLPEFYDRKIIFWNDEEKEFIDEIEQLELDNAKVLVLKDNNNFEIKKILSYDDLSSNYLVYNPFDINMEDDWLLDIKLYSEEFRADQVSMWMQEMNIAPIPAVRNKIKLYKGFLNASSRRKLVSQFGSEIDTPSKLHLAVLASISKVRSMSPKDIIKAVMANGDDLSNDLKMSMLSYNASDTYWHLVNKTTGYVSDDVGNIDDMNIHIVLSAMTKTMQERCLTGLENRYNSFYSGFCYELIYEWLHSDRKEELVDVLRYIERKLKLIDRFSQLEISDIVDTEILPCIDEIILNKLMEKVVQHTINADEVIAIIEKRRTMVWYKENEFYYTGLMQVANMQKFHDNHINGFHHTVAKDMWNSYVSDYYLMDTYYRNFHVAFGQSLNLSHPLLDDNFRFVVDEVEKLYKNWYLDQLATNWTNVIEEDLKDVGQINGINQQTSFYQRDISSFDNKVFVIISDALRYEVASSISETLKIETKSNVELESQQSIFPSVTKFGMAALLPHRKLSLIKQSDTIKVLVDGNNSDSSNREAILKNANENSVVVKYKDFILMKKDEQRELIKGQEVIYIYHDTIDSTSHHDEMGVFSACEKASTEIVNLVKMITGGLNGLNVVITSDHGFLYTYQPLNEDDKMNRTSFKDSIIEQGRRYVITDLGSEPDFLMPVKGFYEEDGYNAFAPRENIRIKGAGGVNFVHGGISLQELVVPVIKYKYLRSGYKGYEKNKDKYDSKPVTISLLSSNRKISNMIFNISFYQKEPVKDNYVACTYHVFLTDTQGNIVSDVQKIIADRASVSNVDREYRCTFNLKQQKYDNKEIYYLVIQDEAGVQVPIKEEMQIDISMTFEEFDFFN

SEQ ID NO: 2193 - protein, 708 aa, Natronorubrum tibetense
MKSQPTTTLEDQAKAHLEDEFTDDYATAVRVVWWDDGGHLREVVRAAADRIGVGFSEAEQFPLELRRNAIDEPETPHVWYIPQAKENRDWFRDIRETGGEIELTIEQLTAELYEVNPWDIYDVERGTESDRETAANVIKTQFASGGIPRYGDLIGEIITKGEGQILEHLLEGGWPEIDKDDETIARVQKSLKDRHVAPADNAETPEEIEDVVWKWAVARWLVAEGKDVDAFPEGYGNVGSTLGDINPLKRIVDSRQSKRLAERYLSESYWGDVIESSDDAWEFAACPVDGALDAALWDAWLESLEEGRYTECIERANERQEALGVYPDDIPWTTLWEQAEQVAELELRFAAWEERSQSFDPFDQYADQEDGTWKIDYGVLELEITGEPEQERLLNSHPATESLPEIRAELLETRYMNYLEEMSEAVVSSFRTGSPLAGKDAAYEWWTDNEQDLATGETVALFLIDALRLDLARELANRLREDYSIAEETRVSTLPSETKFGMAALTPGRAHRFRVKLRNGKLSVERGGQRLDNKGNRVKVLEREGWDVPDDRDSGWQHHQIAYYDKDIDDIGENELDNPESHFTSYIDELYDLITEKLENENWDRIYVVTDHGFVLLPKGTTMESISSYDGDGEVKYRRIAGDDIEDAGTGVRVTGQTPGTEYLKTSVRLLAKPRQYNSKSGLTDARYYHGGILPQECMLNFLRVEKE

SEQ ID NO: 2194 - protein, 730 aa, Haloarcula argentinensis
MQATQTLPEAAKDTIRSEFDRAESADPIVLWWDDGNYLEDIIKQACDELGVHLKVAEGTPLELRAAPVDGEQVWYVPHVKEPEDTEGDFDWFRDVEHTGGEVEMSIEDLTIHAFERGQLDAWELKTTTRSDDPAKRREIARILHDQLTGGQLPTLEQLRTRIVTGGYTDPVAFVLENGWGDIDDSPDTIEQMQDLLTSEGVDAVASEDEPAGIVAATRRWGVAEWLIHAGVDAERFPTAFRAETAGDHDLPELKSLLNNTTSAGLIADRYLGEATWPDIVADVDEPWELADCLVDAALERRLWEAWHASFDAGDYEACLTRAEERYDALLGSEDFRGTYRGAYGPDSPWTQTWEQAAEVARLAHQLETWDERATDDVVSLYADPDDGTWQIDNAVLNLVVAGAPESDLPSDHPAVDTLDDLRTHLQSEYVEYLEALGDRVTETVEAGAPFVDEDHSYQFFTKESDGLESGQTVALFVIDALRLDLARRLADELRDYVATLPADAPEFAVDEDVWLGTLPSETEFGKAALTPGEIQMFDVSLVDGELQPLRNNRKVNTNRRNSLLHGDGWTVTRDTEDGWQSTRVAYFKNDLDDIGEKELSDLEAMLARRVDSLAEFIGTKLEQGEWDQAYVLTDHGFVLLPDSASPEKISRPMEASDSGRRWIAGEDVDADSPGVLLDSSSRLGYLDANVSVLASPLKRFKKQGLGDARFYHGGLLPQEFVLDFISITQG

SEQ ID NO: 2195 - protein, 716 aa, Halosimplex carlsbadense
MPATKTLPQCAHDAIESAIDEAADEDPVVLWWDDGGYLRDIVRDTSSQLGCEFRAAEQTPLELRTEAPRDRTVWYVPQASSDDVDWFKDVEHTGDVIEQHIGKLAARCFENDRLQAATIRTAYEDADDRENVAKTLYEELNDEGGLPSLQGLQTKIVLDGHDDPVQFVLEHGAENLPSDEDLIEIRDLLVDNGVDAVDGVSDAQTIVERTRRWAVAEWLVDEGLDKSLLPQEYQPESSSGFGVSRPELRSVLSKTERKQELARVYLDPNQRFWHDVLRTHDDPWELVDCPVDASLEHRLWDEWTQSFHAGDYEECATQAEQRHERLDATYGDVPWTQLWDQAIDIATLANELETWEESGDTGDVVELYGDVEDGTWQIDNAVFNLIVSGEPETALPEEHPATAKLEDLRSSLVESRYLEYLTDLGDLVGDQIEAGSPFVGENHAHQFFAEEQEHLQSGQSVALFIVDALRFDLAHELAESIRSELPQLEVDESKWVGTLPSDTEFGKAALTPGSKFSFNIELQDGELVPERNGREITNHRRQTLLENDGWSYIMQDAEDEVGWSNTRVAYYWNDIDETGEKELTDFEELFSDRIDAISRIICEKLRKGEWDRAYILSDHGFVSLPQHVDIDDLHPPSNAEKVTRRWIAGADLDDDTPGVLLDEDTHLGYLDDDTKISILTDPIQRFRNQGLPDARFYHGGVLPQEFVLNFVTITQE

SEQ ID NO: 2196 - protein, 990 aa, Rhodopirellula sp.
MTDTITPARRHGPVSKALESELRALIGQHDIVIWLDAGSIYTDFVDSLARMQADGKLPYAVHAFRGSHLQLLFDLRMVSSSPSRHPMVIHMPGFNRDSVKQTPILELYLAGRSFEKRFSTLVTDAATGNVTPEQIKAFLSDGETSIAAADEWLTDMLRSGGNSIAAQLHSLSAESLLDDLLSSSPMPDSVADRVDDGADLKPLWNRLGATLGLPGDWRTDLLRESQRDESQIGPKDIAFVAAAWAMAVEYVDDLDRDPVDPRLNDASTLATPLKQACRSLACYLRTNHVKFYLRTSNDAENFLEVEKIAARAEDLGKVDTFEFEEQKIFEGTLEAIKEEKWDVARTWADRRLSGDSFWLQEDPQRESSWRLLLSAAVLGESIEKAGATLGEFHSLTEAIDIYIAKGAAVDRAHRQMEQQRRSLLFPSLPRYYDVRQPLDAMRLLWRDWADAWAIEFNQFCQTHGFLPKPEYRQRDFFDDVVVPLCKDGDAVAVFAVDAFRFEMATELMDEFESAKATTVHLNGRLAELPTVTSVGMNALAPVNQKGKMKPDVKNGSVRSFHSGQFQVKDPASRKRAMHEKVGGRTCPMLTLQEISGLDGKQLRRKIAGAKLIYVHSQEIDDAGEKDLGPVVFDYAMQSIRAAWQLLREAGVKQFVLTADHGFLLRDGLSEVQSHGRKVDPRRRHVLRPPSADHEGEARVPLSDLGYEGCDQHLFFPMGTAAFDIGNKSLNYLHGGNSLQERLIPVITISHRAAVGGQNERYEFTDVKREEAVAEMHCVTATLTHVSEQASLGFSEGLKLAAALRPLGADDVSLELVQVRGGGAKLKSGTIVATAGTPFEVFFRLKGKSDGRVRVELYHPAADADVTPLLLPDRFTVTVVGGVEAKSEPEIEKTPAKPIVDEIEASSWLHELENDEVRQFFNHLEKHGTVTADEAETLLGGPRQARRFSSKFEAFAAKAPFAARIDVIGGVKRYVREHETEYKIIKDSESS

SEQ ID NO: 2197 - protein, 880 aa, Pseudanabaena biceps
MSAIASYLENDIKETIRRQGIVLWLDADSRYTEFVDRLITRHQTGDFDFPVVGFRGSYLEILLQLENYGNGLDPEPLLIHLPNHNTNTVKQTPLLELYRAGKRYEKALNTLVREAVTGKVAPDAIADLLKTPDLTLAGAETWLDQELNRHNSHNSKTGNIRSYLAGLDHQWILDGLLDHNSNLRTKIHSASELNILIEHLYIHTGMDITFLQFFLKDDPVDIDRLELAFVAWLMCVEYTNDLTRSPYLPQLQPLRSLPKPLQAQCQNLINHLRDRYPIRYMAISEEVEAKIKPEFDQISPNDLGKIDTFATEDRVMLNASIQALLTQNWQQASIWGRSRINAPSLWIQQDSQKRRLWGWVLIAAQFGQIIAQQNHVLNGVETLREALDIYTQKAWIVDYYHRRFEQLRLQMSNSNLPQFASMVTVTNFLRQLYRDWADDLARGFAKLCDQVGFLPEEELQQRYIFERYCLPLITTPEKDGAKRHPSLGQVEQGDRVAIFLVDAFRYEMAMELMNKLNKEDFQTNLIGCYAELPTITAMGMNAIAPVSSDGKIRLPDGKDFSKGIKAGEYTVKDPDSRARVIGDRTFSSSRDRHSLSSLSLQQVAQSTSETLGSLSKNAALLVIHSREIDDAGEANMGLIAFTTWIQQLKAAINNLQKIGIHTCILTADHGFMLLDHTVKEVEYATATRRYVRLDDYRREADCVSVPLRSLNYEGQEGYLLFRNDTAIFKGRTKLSNASFAHGGNSLQERVIPVLTVTKQSVTKRSSVKTKRVKSQTQIQDSLQDPSTITEAIAIDMVIIEPVASLSTSDRWQDNFDDPAIIKVFEHLEKHGAIVETELVQMLGSSRKARSFSLKFEEFVKQIPFGVQVENVASGKRYIKR

SEQ ID NO: 2198 - protein, 693 aa, planctomycete KSU-1
MDSWRDYVLKEFTPQVVRLTLVADPDGLLTEEGIVMALRERGFEILEFDDSIAFRFSYESKYRSLWDKGELTDLVVILRSPTDDLSFLPYDLLRVGRKLSFNLGDLFPNLSYPVIEGLDRSNLDTLYQAQIRYKPEKLGDNTTKDFVLRHVFEIVPELIKQPHDLLRVLLRLHYKELHIPPILNERFIYILRQNKCFDAWPLEKIVSDREAFFEFLQERWPIFLEGMTSGKAEIVSEKGLTDDLKYSGPPNIPFDHHDIRIYIDNLFLEGMLHPVQHPKSDILSKTWVVSGIKVDPELDTLRRLQKLMKSIEGSIPDAEGRHQDWLIFAHRWAEVIVLFHQTGKHVELASSQLDFNKNWQDAGSTDHLKSASISELHANQFQMLQERIDKAFLLWIQKRYGGLYNQPPVPPVMVHHIPRAMERYMRSMGKEKVALILIDGMAFDSWLVVKEEFMKQRPHLSIRERAIFGWIPTITPVSRQAAFAGKPPMCFPNSINTLEREPVLWSQFWIDHGFTQSEISYVKGVNETKTHVIDEITLDQRIRILGLVVDTVDKIMHGMELGLAGMHNQVRQWAKEGFLGKLIDLLLERNYKIFLTSDHGSIEAKGCGRPAEGSIADVRGERVRIYPNQVLRKTIKTRFPEAMEWPQIGLPQDYLPLLAPGRSAFIHTDEQIIAHGGISLEESVVPFVQIERS

SEQ ID NO: 2199 - protein, 644 aa, Bacillus cereus
MGSWRDGILKKFQYQNSKMILVHDQDFLLNDELLLNHLKEEGYEVIRFEDSISFRYLYELQYRESVKSDKLLVYTNDDIMFPYEYIRGNFSMKIDISTIFPKFSAPILRSMNREDLDALFTVHAQYQGSSSNKDTLEYIVKHLYKISYEIIDSEVELYKLLLFLHYRKKEIPQVVQEFLIEKLNQCKGFHKLPMEKLISSAGFFYVFLEDQWAYFVSEYTKCESEKILEPSSLYRTHPFTNDDVWRLMVNLFMEGTISKVKKGPNLQMPKWMKIGIEEESKLETLHEKLNHISKIVNEKLTRIKLYKDWIELIDLVAEYKYTALESNDTVYVEEANTLMMKVNQDFQDWMLKQYHTLISLPPIPKPKMVHHVPHVLHAQRRENEKVALLVLDGMSFIQWKQVKKHLKENGFSFEENGIFAWVPTLTSVSRQAIFSGSIPFTFSKTIKTTAAEERYWKTFWEKQGMLKQYVAYQKGLGKEDYSRENILALKRNSVKIYGAVIDVIDKFTHHAVLGEKSLVSNLEIWLQTNYLVNLLADLIKEKYTIYLTADHGNTIAKGIGRISEGVLVDQKGERVRIYSDTILYEDSASKIDTVGWNNAGLPENYNVLLSQYGQAFVQKGEEIVTHGGISIEEVVVPFIKVQQN

SEQ ID NO: 2200 - protein, 481 aa, Clostridium thermocellum
MIEKRVAELFSIEYEKRLLIFDTDRFCDAFDYIGFLISRDFEVIRYEDIEAFRLRYELDIRNSEHKYAVVVFSDIYVPYDIRKQFFEVHISFKNIFPKLHEDTVQRYVKDIDLISFAYEQLYFSCDTREKTEEFISNTVFSKENVKNYCELMTKKLLPSGDKSGITAKEWIEIARKKALIDYYAARANISVDTSFVDVYFEKFIFNGYQKLSGETKKDAPAILPKVIDFIAHGKTALVVVDGMSLFDFEVISRYFEGIEYEYYCTFALIPTTTAISRQSLLTGKYPRELKHPFTLSDEEKGFIETAQNAGYTKQQILYAKGFNPPVNHFTKFMAVIINDIDDLVHGQKQGRVGMYNDISLWAKSGKLQMLIKDLYAQGFDVYITSDHGNTPCIGAGTIRGVGVEVETKSKRMFVLKDFAELRNFFGDKVVAYPGYYLDNDYKYYVCKSGVSFDNMNEEVMTHGGISIDEVIVPFIKVRTVI

SEQ ID NO: 2201 - protein, 484 aa, Lachnospiraceae bacterium
MFGDYVLKQAAAEYNNRILLIDDEGLEELTHYSADFQAHGFEVVHYTDDLTFRIEYEDKLKNTANKLLVLAHSGSYIPYDLQRRLRVYLLSMDRLFPKLNMEALKARRNLDLELLCLAYKKNFDDLRQRKQTEEFLHQKVDCSENVAAYLKQRYSELLQSLTTAKSYRDWFALAETKAKIDTLSTEYRLNFDTSEVNRAFRDYVLKEFGKLSTEMNKETPVLVSRAMEYMNDHSNKFVIIVMDGMSKFDWSIIAKSFHDLQYEQSAAFAMIPSTTSISRQCLLSNKTPGQLMEPWKQSKEKQEFVACARSMGYTDNQIGYERGYDAQFGSFVKCGAVIINDVDDMVHAQHQGRLGMLNDIGVLSDQHKLADMTKRFLSEGFDVYITADHGNTPCTGLGKLMGTGVETETKSRRMIVLQNFADKDGLMQKYGLIEYPKYYMNKAFDYLICDVGDSFDAKGEEVMTHGGITIDEVIVPFIKIKAVN

SEQ ID NO: 2202 - protein, 511 aa, Enterococcus faecium
MMKMNWINEVTDKFPQKKIYLVRDDDGLLMIDNVKVELSELDVSVITYGDPVHFRYTYETKFGIKFDGTLLIRLVDTGFQEIPWDVYQKAFRESIGIADIFPFLDSKAVKELDIEKWEQLYNAQQSLTARQNYVSSMKFIERVIYHEAEEHISMILDPYVEDLTLFNKKAPVLREWGEIARLIGEHRLYRRMDEEFELLVDDANKKFQEYLKKEYDRNLSLPPAKQPNYVNQILNYLYRMQGISNRKLALIVMDGMSFTQWSVIEKWLVNKSFVFRTRATMAMIPTITPVSRQAIFSGKRPNEFPETIIRTSSEPIQWRKFWKGKGFLENSIKYQKGLGHTNYEDTVLEFRYAGTDIYGCVIDVVDEFMHGAKQGLETVQSELRIWLKKGFLESMLSDLMNLDYDVYITSDHGNVEATGIGRIQEGILATGKGQRARIYDSEVLRSNTHDLYTESTIEWESVTLPNKGYFSVIAKEKFAFVPEGEIIMTHGGMHVEEVIVPFVKVLKRDDR

SEQ ID NO: 2203 - protein, 621 aa, Caloramator australicus
MNINDILLRKIPLNLYEHILIFDFDNLISNELIIEKILKEGYEIFEFKDIEYYRIYFEAECRNSSKKLILIVNDNVYIPYDIKEDYFLVDISLNDIFKNIDVRVLKYIARENYGIIYEKAKNIKRILSYEETCDFLLKNVYYIDIQLINTFNDLIKIILRLYYKGIELPSILVEHLYERLNLDYDLLNEILMGKDKFFNFLQNQWEMFVNSFINPSIKSIVDFNDTDIKVYIDNLFSEGYLHSVDIQINDNIPEFAKIGIILDRNSVLNNEYGMMINKLKKKTDSISDYKDWIELAKIFGEIVRISCILNKEEYKSLSLSLNDKFKNWLYMNYGKLPYLSYFNGPVMIHQIQHYIINTIKKEKKKKVILIVFDCMSQFNWSIIKHYLNKKGYLIEDKACFAWIPTITSVSRQALFSGEIPINFKETLFTSNYDEKHFKNFFINHGYNEKNIMFFRNVKTFEEEGLQNALEKNVDVIGIVVDLIDRFVHNQMFDYKGLYNNIEFYLNEGYLDKFFTNILEYGYEIFITSDHGNISAIGQGNVKEGVLLETLSSRIAVYENDLKNIYLNDKKIIEWIGTGLPNEYNYIICDNNYSFYKDGESILSHGGISFEEVIVPFARIKH

SEQ ID NO: 2204 - protein, 655 aa, Pseudoalteromonas marina
MAWQSELLSKLDFTAKQCFIISDPENLCFEPFIDAQFEESKIELIDYSDPVSLRLVYENWLEEQNSKALIIRCAEIDENYIPFDISLNAQSVNFHINEIIPELENETLRSLSPIYFQPIKEAISNYRPGKLGRIASLDFLLRHIYKIAPEIIQSEVDLVRLLIQKHYLSGDMPEVIEQRLIALLELNSAFNGWDFDRLLPNKAEFFEFLQAQWGLYLQTLVPVQEIKEPSWPQGKLIVPFEDQDIQVYVDNLFSDGLLKPIDLKGVPQEHWASIGVASDEGFSELKRFSHLLSRLNKVFSNVEVNEQNADFWGEHAFELGMLNALSHKIEKLLPSDLTSLKRLNDKVDNTFEQWLLDKFGSLISLPSIRHPNMLHKIPDWLNRKVQDEQKVCLLVMDGMGFQQWALFRESLNSCSRVTMEEHYSFAWVPTITSISRQSMFSGKKPYFYADSLLTTSKEGKLWQAYWEDHGLTSKEVLYAKKVEDRATNESFNDLISDRHIMAAGLVINFVDEQMHGMKNGMSGLNAVVSNWIKTWRFAEKINILLDAGYEVIVTADHGNQEAIGCGALREGVKAETKGERVRIYDSENAATSSNDLLDGKVLKWPGKKYGLPEGRFPLVSKGTHAFVKEGNKIVGHGGISLHEVVVPLAVIKRKL

SEQ ID NO: 2205 - protein, 658 aa, Desulfotomaculum nigrificans
MTPLSTWRDVVLLDFQEPVPALSLAADPDHLLLDEVLLSSLKDRQVEFIQYNDPVSFRYLFESRYRQAIAEKNIKLLVQVRDVPLEQLPYDLLQMGRQLTYRLQTIFPKLSPQVVKQLTAQDLDALYAVYGQYQGSTSTAETCAFILHRVYKVAYELIDDETELIKFLLSKHYRQIQYPEIIESYLIEQLQKQKNLTKLPLAEMVKSATFFYQTLQSQWVAYLKTLQEQPAGWKENGQPRGFYSQEKVHPFDHEDVYRLLDNLFIEGYLKPVAGFNSQKLPGWTHVGLVIDPASDDKHRLSSLVANLKEKLPGIGNYRDWLQVMPLYAEVKDLILSIGFNQKDAILMEAQAVESEMDAIFETWLMRNYSSLQNLPYLPKPVMLHQVPHYLASRHHQRVALVVLDGMSYVQWVQIRKYLQGQNFAFTEQGVFAWVPTITSISRQALFTGEMPLYFPHTLGTTRKEEAAWKLFWENHDVFKNYTGYHKSFGQGEGGYQSHAILQQPSIKVIGLVIGTIDNLVHTALQGQRGMYGELKLWLESGYLTGLLNELLDKGFAVYLTSDHGNKESRGIGRIAEGVLAETRGERVRIYRDKMLRDKAAASHSAIPWPGTGLPEDVYVLLAKSGEAFLPAGEVVVSHGGISLEEVVVPFIHVTRQNK

SEQ ID NO: 2206 - protein, 664 aa, Dethiosulfovibrio peptidovorans
MSSWRSTILENFVPNVAKLTLVSDPDCLLTEEKLAMGLRDRGFDLIEFNDPMEFRYAYESKYRSIWDWGEYTDLVVVLRLQNAELESLPYDLLQAGRKLSFNLGDLFPNLSYPVIEKLDRGLLDLLYEAQRKSPPDRMGDNTTKDFILRHVFGVAPELISTEVELLRFLLRLHYGNLAIPSMLADRLVDVFESSGSFKGWSLSQIIPDAEQFFVFIQERWPIFLENLNQANQVKEDSEAYGLKFQGPVILPFDHQDIRVYIDNLFVEGKLTPVDLPGMDIAKDSWVLSGISAAKSDGEGLRLSRLFEIVDAADLSMDSRYTDWIAFAMKWAEISALIHTTSNARYKKRYSETGQKLNGLFADWLEAHYASLTNLPPSTPAMLHHVPRHLARSIEDQTSKKVVLVVIDGLSLDQWVTVRNIIQKQNSDLVLRESATFAWIPTLTSVSRQAIFSGKPPIYFPSSINSTNSEEKLWKQFWQGHDVSKLDIVYKRSLGDGDAEATMDSLINPAQTKVVGLVIDKVDKIMHGMQLGAAGMHNQIDQWCRGEYLISLLNYLSNHNYEVWITSDHGNVESIGKGRPTEGSIAESRGERVRIYPTPELRSQVSSRFPFAREWPPSGLPDDYFPLVATGNDAFVNEGDSIVGHGGVAIEEVIVPLIKVERRTQ

SEQ ID NO: 2207 - protein, 671 aa, Kingella denitrificans
MSQWSERILSHFTADLTRLWVACDPDDVLLDEKLLSELRGRGFEVMLYEDPFAFRAEYEERYRAAWDCGEPGPAPSLVLHLRSADANALPWDIVHHGRVVRLSLAELFPRLAYSAVQQVEPEHFAGLFHAHQTELQSARSENESKDFILEHVYQLTPRSIRNSVDFWRELLRMHFANRSLPPLFAQHAAGIIQGKGLFVDQPVATWLASKSALLRVVQDAWYRYLKNLGLDGTRTGEPPPPDYVAKIEIPFDHSDVQVLVDSMFLDGSLSPLAAHSVPAGMPSWIKAGIVQDPAALQALVLKGIDGLIETTPTAASSHKDWNEFAKRYGEILARTHSLPGTEGSEHLPVIRERIKTLQAQSDEHLQAWVAAKHYADLILQPVTKGPVMVHHVPRFLRHRRSAGETKVALLVFDGLAFDQWVQIRERLIATTKRFAFDEGTAFAWLPTVTSVSRQALFSGLKPREFDDSIDRTDKEESLWKTFWQNEGVNANEVMYRRALRQTHQLDALEVDLNDRRPKVVGLVIDEVDDRLHKERSKKDVAMWIGNWLTTGFVDRLFSLLLDKGYHIYLTADHGNVESTGVGRPNQGVIAETRGERVRVYRSEPLLADSAAAYPTTVRLDIAGLPANFMPLFAGGRTAFVPEGEQVVVHGGVSVEELIVPFVKVSYVIGTE

SEQ ID NO: 2208 - protein, 666 aa, Alcanivorax hongdengensis
MTNTAWVNRIVEDLPSDVSRLWIVSDPDGVLLDEHVLASLRERGFETLLFEDSVAFRAEYEERYRAAWDQGEAAPSDALILHLREHQTSELPWDYLRHGRSLNLSLSTLLPKLSYSVLRQLDNEMLPALFEAQSQHAQQVLGEAATKEFVLTHIFELGPHLIKKPEQFWRELLRLHYRESTLPLVLAQYVEQVLGSQTTFKDIPLAELFSNRSHTLRVVQEAWYDFLEMHGLTGNRIREPSPPESSNKLNIPFDHPDVWLIVDSMFLDGTLHPLEVSGTSAALPEWAKVGIVQTPLDMRTLVSSGIKTLQDEIPSTDSSYRDWAHFARRLGEIISRFNGLDASRAEGLRNDLLTLQMLADSQLQAWLVKHYSDLPSLPAVKGPIMLHHVPRFLSIRRDHGEQKIALLLFDGLAIDQWVQIRESITKSMSQLIFDEQACFAWLPTLTSVSRQALFSGLRPREFADSIETTSKEPGLWDRFWRDHGLTSREVFYRKAIKRNDDLTGLEADLSNPAVKVAGIVVDTVDEMIHGAVLGKSGVAAQITKWCESGFVEKLFQMLLSNGFSIYLTADHGNVEAVGIGRPNQGLAPELRGERVRTYRSEALLAEALATNPDAFNLSIGGLPTDFMPLFAGGRGAFVPKDDQIVVHGGPSVEELIVPFVKVSRVV

SEQ ID NO: 2209 - protein, 632 aa, Bacillus cereus
MNWADKLAAYFTSKGALYIVSDEYGLFHHQAVQHVISQNGAMIHTYQDPVVFRLQYETAFRHEKRENRPTWIVTIETNEFNQLPFDILSDANRLSVSWENIFSSLDPTVIQYCPEETLQLLLDASITQFKPLNYNESIDFILTAVYQLDAALFSHEINIVKAAIRYYDQFSEGLPSLFFHRLKQNLQKVDPFTSTDLLSIFESKGTLTHLLNKQWQHYIHNFLKQCHEQIAETSPNYGFSYFDDPMIRRRLAHFITPIKVPNHVQFDEWMEPGLVREVSPSIDVEVLFNQDFTKLSRQEWSNLASKIGRMQYNYLNNGALPTNWGIQMQKINHHFENWMVHEYTNLRTLPVVPKPKMVHQIPHYLARKIDSKVALIVMDGMNFTQWYIIKQHLANNAWSFEEDAVFAWVPSVTSVSRQAIFSGLEPRQFADTIQSTRKEKTYWFNFWEQVGFTKQNIAYEKSLGLKVYNQSTLAYMQFPSVRIYGAVVDVIDQFMHGATQGHQTMFSELSTWLSTNYLEQLLTDLVQQGFDVYLTADHGNVECYGIGRIQEGVTVDSKGERARIYQSENIRNQTHLDHSLTTIPWDHPGLPDGYNVLLAKNNHAFVAKDDKIVTHGGIHLEEVIVPFVKVNR

SEQ ID NO: 2210 - protein, 664 aa, Nitrosococcus oceani; identical to SEQ ID NO: 1858

SEQ ID NO: 2211 - protein, 671 aa, Methyloversatilis universalis
MSQWSERILSHFTADLTRLWVACDPDDVLLDEKLLSELRSRGFEVMLYEDPFAFRAEYEERYRAAWDRGEAGPAPSLVLHLRSADANALPWDIVHHGRVVRLSLADLFPKLAYSAVQQVEPEHLAGLFHAHQTELQNARGENESKDFILEHVYQLAPRSIRNPVDFWRELLRLHFANRSLPPLFAQHAAGIIHGKGLFTDQPVATWLASKSALLRVVQDAWYRYLKTLGLDGTRTGEPPPPDYAAKIEIPFDHSDVQVLVDSMFLDGSLHPLAVHSVPAGMPSWIKAGIVQDPAALQALVLKGIDGLIETTPTAASSHKDWSEFAKRYGEILARTHGLPDTEGSEHLPVIRERIKTLQAQSDEGLRVWVAAKHYADLILQPVTKGPVMVHHVPRFLRHRRSAGETKVALLVFDGLAFDQWVQIRERLIATTKRFAFDEGTAFAWLPTVTSVSRQALFSGLKPREFDDSIDRTDKEESLWKTFWQNEGVNSNEVMYRRALRQIDQLDVLEADLNDRRPKVVGLVIDEVDDRLHKERSKKDVAMWIGNWLSTGFVDRLFSLLLDKGYHIYLTADHGNVESTGVGRPSQGVIAETRGERVRIYRSEPLLADSAAAYPSTVRLDIAGLPANFMPLFAGGRTAFVPEGEQVVVHGGVSIEELIVPFVKVSYVIGTE

SEQ ID NO: 2212 - protein, 510 aa, Thermoplasmatales archaeon
MINMEKKWFEKIINSILELKTNIVFVIDPDNILSIPEIRDILQEHNKNITEFKNEINLRILLKQIEKNTIVTFKNKQEIPYDLLSTQATINIDIGEIFSLLDKTELLQLPFENYQILFEKHETLKEENYDRLSKEKTQKFIKEIPAKYISTDTKRILELKTDLTKISKDFISDSNTWGEIGRKFGELMYHLHKNEIEINKEILEAESILNYKFMAYILKYYEDLLYHSNPLINSNLLKIIFEDSQQKNAIICFDCMGYEEWYAIKNYLEQLQSFQFIEKHSFSMLPSETNYSSSALFAGMTPKEIKNQSFINSINWRNEEKLFRNALKKKDIDDSQIFFQRCIEPKDINIPDIESFSDYHSIGIIFSFIDRFIHTDFLNDKNLVIQNIEKYLQKTKISNFILSLLNQDFKVFITSDHGNILSSGNNIQVKRDLVDSKAKRYLIQERRELLEEYKVEKESVIMQLKNMNGDEYLLLQTGNKMFGRKNEKELTHGGISLSEVIIPFIEVKKA

SEQ ID NO: 2213 - protein, 666 aa, Pseudomonas sp.
MNPWIESILKEFPADMVRLWVAADPDDVLLDEQVLAELRERGFDLLPFEDSVVFRAEFEARYREDWDRGGRGPAKALILHLARADSSELPWDYLNQARVVRLSLAELFPQLSYSVVRQLAPEHRQNLFAAQDKFAKQMHGERLTKEFLLTHIYKINPHLLSKAEDLWGNLLRLHYDETELPQDLVRHMVHILAEEQAFRHLPLAELFSSRSYFLRVLQEAWYCYLHGLGVIRQGVAEPHVQYERIIDVPFDRPQIRAVIDSLFLDGALHPLEISGGASGIPAWARVGVVEDPFAMRNLIVEGMKSLETTLPALDASYRDWSQFARRFGELLARFHRLEIERANGIHNQIVALQQLIDERLLAWVKQHYADLPSLPAVKGPVMVHHVPHYLARCRNNGEVRVALLVFDGLSVDQWVHIREHLTKYAPALSYDESTTFAWLPTLTSVSRQALFSGLRPREFEGSIEHTSKEPVLWSAFWQGENLRANEVMYHKSIKRVDDLPGLADKLSNSAIKVAGLVIDTVDEIVHGAVLGKRGIASLITSWCETGFVEQLFELLLSHGYHVYLTADHGNVEAVGAGRINEGALPDLRGERARAYRNEILRDQALVTCPTAVELKIPGLPESFLPVFAAERTAFVTQGEQLVVHGGISVEELIVPFVKISRTSWAP

SEQ ID NO: 2214 - protein, 644 aa, Bacillus cereus
MGNWRDGVLKKFQYQNSKMILVHDQDFLLNDELLLNRLKEDGYEVIRFEDSVSFRYLYEQQYRESVKSDKLLVYTNDDITFPYEYIKRNFSMKIDISTIFPKFSAPILRSMNREDLDALFTVHAQYQGSSSNKNTLEYIVKHLYKISYEIIDSEVELYKLLLFLHYRKKEIPQVVQDFLIEKLKQCRVFHKLPIEKLISSAGSFYAFLEDQWAYFVSEYTKCESEKILEPSSLYGTHPFTNDDVWRLMVNLFMEGTISKVKKGPTLQIPKWMKIGIEEESKLETLHEKLNHISEMVNEKLARIKLYKDWIELIDLVAEYKYTALESNDAVYVGEANALMMKVNQNFQDWMLKQYHTLISLPPIPKPKMVHHVPHVLHAQRRENEKVALLVLDGMSFIQWKQVKKHLKENGFSFEESGIFAWVPTLTSVSRQAIFSGSIPFTFSKTIKTTAAEERYWKAFWEKQGMLKQYVAYQKGLGKEDYSRENILALKRNSVKIYGAVIDVIDKFTHHAVLGEKSLVSNLEIWLQSNYLVNLLADLIKEKYTIYLTADHGNTIAKGMGRISEGVLVDQKGERVRIYSDPILYKDSASKIGAMSWNNAGLPENYKVLLSQYGQAFVQRGEEIVTHGGISIEEVVVPFIKVQQN

SEQ ID NO: 2215 - protein, 480 aa, Treponema primitia
MFFTRLKEIFDKLYVPHVIFYDCYDFSKYCDYLVILESLGYNIVEYKNVEMFRIEYENIIKNSENKYAIIINNNIYVPYDIIKNCEIITLSLKLIFPYLNNAYLEKYKHDLDLISFAYKECYSDLSDEKETEKFITNIVFSDEMIYQYIIEILIKKLYEICQNAPSYFEWLKAGQIKAKIDYYGSKINTIIDTDFLLDPFYNYIMTGYGKLSLESNNAFPVILSKVLPFIAKNKFALIVMDGMSLFDFEILSRYFVEIQYEYFNSFALIPTMTSISRQCLLSGKYPIKLSEPFNLSKEEKEFIQAMSELGYKQNTIQYSRGYNPEVSPLTKALCIIINDIDDIVHGQQQGRQGMLREIDLLGKKGKLQSLIKELFENGFSVYITSDHGNTPCTGIGAMRGLGIEVETKSKRMLVLKDFAKLNKTVQENTIEYPGYYLDKKYKYLICKDGISFDNIDDEVMTHGGISIDEVIVPFIKIRSV

SEQ ID NO: 2216 - protein, 650 aa, Bacillus methanolicus
MKTWRDEIVQKFVNQPYSLLLVNDPDFLLNDEEILQRLRENEYEVIHFNDSIFIRYLYESQFREKVEQNQLKLLFFSNDENYTYFPYDFLQHGYHIELKISELFPKFSPGIVKQLDKEDFDVLYTAHKQYQGSSSDKETLEYIVKHVYKIVHELIDSEVELYKLLLSVHYAKKQLPSIVQQFLIEKLSGKNVFEGIPIKRLLTSSSYFFQYIEKQWTTFVHQLLDLQEGSVLEETPLYLAHPFSNPDVRRLMNDLFAEGYIRKIKTNVSYSFPTWMKYGVEVDEDGSLQEKIRHLHEKIMEQITSASRYKDWINIMELMAEYKCTVLDTNKQEYEREVSALFRKVNEMFEKWMMEGYRSLTSLPPVPKPKMVHHIVQFLASKRGQNEKIALLVLDGMSYVQWKKIKYYLTNKGFSFEENGVFSWVPTLTSVSRQAIFAGNFPSAFSQSIGTTAKEENYWKTFWENSGLLKQYVSYQKGLGKEAYKKEGIAAFKRPNVKVYGAVIDIIDQFIHGAVQGEKSLMSELQLWLNTDYLMQLLTDLHREKFTIYITSDHGNTESVGIGRISEGVLVEQKGERVRVYTDTILFKDAAEKIDGIPWTGVGLPEDYHALLAQYGQAFVNKNERIVSHGSISIEEVIVPFVKVIPSLGG

SEQ ID NO: 2217 - protein, 659 aa, Vibrio scophthalmi
MNWQEKLTSQMALTEPVHYIVNDPDNLCFEPAIADLIEQAGAVLFADADPLALRLCFEEWLGSDECRALLIRVVDEQPSIPYDIEFSAKRVDFDISEVIPELDASVLRALLPKDYEQLQSAVKSYGADKLNRNASLDFVLRHIYKIAPEIVQSETDLVRLLIRKHYLGIEMPLVFEERLIETLQVREQFSRWDFSRVVPDRTEFFAFLQQQWLLHLQRKAQRHEIKESSWPDDELVVPFDDQDIKVFVDNLFADGILQAVDFDGLGKDDWEWVGVIADDESRDLLRVRQLFNKLSDQFIVQDLPLPEDSEKWEEIARELGVLNSLSHSLKGSDIYALSAEIANLNSKVDEYFETWLQTNFGKLINTPTTRFPKMLHKIPDWLNLKVCKGQKVCLLVMDGMGFQQWNYVKEHIIDIPHVRVEERGVFSWVPTITSIARQALFSGKQPRSFPDSWHTTAKEKALWHAFWEDKGLSKTEVAYEVTLEKHKDLESFKDRFHSPKLKVAGFVINYIDKQMHGIEGGMPLLNVAVSKWLELWQFSSKIEALLDSGFEVVITADHGNQEAIGQSWPNEGVKAETKGERVRLYKHTVEYSNDKADVLEWPAKKFGLPSDLYPLVSRGRHAFIQKGKQIVGHGGISLHEVVVPLAIVTREQHVKESQL

SEQ ID NO: 2218 - protein, 680 aa, Thiorhodovibrio sp.
MPSWRDQILKEFVPNLSKLTLVADPDALLTEERLAVALRQRGFELIEFTDPVEFRYVYESGYRSVWDRGEQTDLVVILRAADDNLESLPFDLLQAGRTLAFDLGSIFPQLSYPVIETLDRGLLDALFAAQQQGPSDRLGDNATRDFILRHVFGVAAELVTTDADLLRALLRLHYSNLSSSASPRLPSALAERLIAVFKAQARFSDWPLEHLLPDAEAFFAFMQERWPVFVAGLAQGDEVAEPRLVPVASQGGFQYPGPDHLPFDHHDIRVYIDNLFLEGRLTPILTNNIELPSDSWVRSGLVRAAVDDEAIRMARLFDRVAQECPPADARHSDWISFALLWAELSAKVHASTQTEPRRQWQTIATTINSRFVDWLADHYASLINLPPTEPAMLHQMPRRLAREMEQAPQTPGGQRVALIVVDGLALDQWVGLRPLLHQQIPALVMRESATFAWIPTLTSVSRQAIFAGKPPRAFPDSIHSTHREEKLWTQFWESQGLSRLDLAFQRGLGDGDARSVLGDLIHPRKTRAVGLVVDKVDKIMHGMQLGAAGMHQQIQQWCQTGFLAGLIDQLLDWGFAVWLTADHGNLECQGQGRPNEGVVAETRGERVRVYPSPVLRSPVTQAYSFAREWPPIGLPEHYYPLLAGDRHAFVTQGETIVGHGGAAIEEVIVPLIRFERRMAG

SEQ ID NO: 2219 - protein, 664 aa, Ectothiorhodospira sp.
MTYLSRDNVAHRSTLLADRILKEFPSDLARLWIVADPDNVLLDEQVLAGLRERGFEVLPFEDSIAFRAEYEERYRAAWEAEEANAPSALVIQVRDSSTAELPWDYLRQARKVSLSLAELFPKLSYAVLRQLGSEILPSLFEVQARHATQAMGEAATKEFVLTHIYRVSPHLITRPEDLWRELLRLHYRETLLPQTLAGHIHQVLADRLVFASSPIAELFSNRSFALRVVQDAWYRYLNKLGLIGRRTAEPVAPDYIPQLDIPFEHHDIRVIVDSMFLDGTLHPLAIQGVPVSLPEWAKAGVVQDPAAMRNLVLEGIKSLSEELPGATSSHRDWTHFARRLGEVISRFHSLDAVRAEGLKADMKDLVARADSELQTWVQAHYADLPSLPAAKGPVMVHQVPRYLAMRRANGEEKIALVVFDGLAVDQWTQIRENLIQHAPRLMFDENACFAWLPTLTSISRQALFSGLRPREFAEHIETTSKEPQHWTRFWQDQGLRANEILYRKAIKRTDELPELQELLSNPALKVAGLVVDTVDEIIHGAVLGKRGVAAQINSWCESGFVDRLFAMLLNQGFHIYLTADHGNAEAVGIGRPNQGVASELRGERVRTYRSETIIAETATAIPDSFRLDIAGLPANFMPLFAGERGAFVPKGDQVVVHGGIWGIP

SEQ ID NO: 2220 - protein, 646 aa, Clostridium papyrosolvens
MINEIILEKLYLKENEFILVFDPDNLLGAEAIVEHVNQAGFSIVNYEDPEVFRYYYEENIRSFLDRGKPLDNKVLIRYTVEQSIPYDIRAKCFFVEVTLRELFPKLSYTVIKELYSEVFDKLYKVYSRYSGPILGDKGTKDFILKNAYGVIPEVIADFQELVKTFIPLYYRGEELPRLIADYAAEAISSNGQLKQYPVKTIVSGKVSCFHFIQEQWELYIRKTNGEAVETVIDFGNYEIRAYIDNLFQENYLTPVKQLKLREYPTWMQSGVVYDIAGNIERKFDNYIDKIINNVQSVKSYKDWFGIAALWAEVLTLKYDQSKSYSLDNKKFKDTGSLLKECFKDWLLANYNMLASLSYAKAPVMVHKIPWHINHRFPKQENKKVALLVIDGMSLDDWFVIKEAINENNKYIFEETLCFAWIPTMTSVSRQAIFSGEIPTNYADTLLSTNHDDKQWKKFWRNIGYNNNSVAFKRNIKEFREDGLDDILNDNGLRVLGLVVNMVDDIMHGQQLSIEGMHQDIRLWANKGSLVRFIDRLYSKDFEVFITSDHGNIGAVGQGTLQEGLAVESPGERVRFYNSDINCDTIMSKYKALKWEASGLPKKYNYVVSEENLAFVKEGKKIVAHGGLAIEEVIVPFIHMRKENQNA

SEQ ID NO: 2221 - protein, 640 aa, Thermoanaerobacter ethanolicus
MIKDYIRDKLSLEGSNLILLEDKDDILNEESIIEMLHKDEYEVYNYQEPDSFRFYYELNYRKFYDSFVEPNKKFILKCKEINEIPYDIQTVFHHVSISLKEIFPKLDYAVLKELGTDFLGKIYEAYQLYDGNVLGENGTKDYVMKAVFGIIPEHINNLNELVKAFLRLYYKNIELPKVLSDYLEYKLRQKENLKDVPLNEILSGKDRFFRFVRVQWKNYINDLIEGTHNAKIDFSDYDIRAYLDNIFYEKYIEPIEVENIERLPKWTYVGILYDENERYLKEYRKMIEKIKELLSFSKSYKDWMNLSSLWAEVLNIFYSKKLALNENEFNEISKLIENSFMEWVVLNYSNLTSISYVNGPVMVHQIPWYLNYIMKKQKYDRVALLVFDGMSVDNWYLIKRYLNKNALWNIEEKKSFAWIPTLTSISRQAIFSGDIPLYFKDTIFSTNYEEKRWKRFWMNQGYKGDDVFYIRNVMEFNKREINDIINNRNAKIVGIVVNIIDELIHSAILSVEGLYQNIQLWLEKSRVEDFLKKLISKGYEIFIASDHGNIASIGKGKLNEGLLVEKAGERVRIYESGIDYGRSLYDDKSFKWIGFGLPKEYNFIICKENNAFGAQGEQMISHGGISIEEVIVPFVHISHI

SEQ ID NO: 2222 - protein, 640 aa, Thermoanaerobacter ethanolicus
MIKDYIRDKLSLEGSNLILLEDKDDILNEESIIEMLHKDEYEVYNYQEPDSFRFYYELNYRKFYDSFVEPNKKFILKCKEINEIPYDIQTVFHHVSISLKEIFPKLDYAVLKELGTDFLGKIYEAYQLYDGNVLGENGTKDYVMKAVFGIIPEHINNLNELVKAFLRLYYKNMELPKVLSDYLEYKLRQKENLKDVPLNEILSGKDRFFRFVRVQWKNYINDLIEGTHNAKIDFSDYDIRAYLDNIFYEKYIEPIEMENIERLPEWTYVGILYDENERYLKEYKKIIEKIKELLSFSKSYKDWMNLSSLWAEVLNIFYSKKLALNENEFNEISKLIENSFMEWVVLNYSNLTSVSYVNGPVMVHQIPWYLNYIMKKQKYDRIALLVFDSMSVDNWYLIRRYLNKNALWNIEEKKSFAWIPTLTSISRQAIFSGDIPLYFKDTIFSTNYEEKRWKRFWMNQGYKGDDVFYIRNVMEFNKREINDIINNRNAKIVGIVVNIIDELIHSAILSVEGLYQNIQLWIEKSRVEDFLKKLISKGYEIFIASDHGNIASIGKGKLNEGLLVEKAGERVRIYESGIDYGRSLYDDKSFKWIGFGLPKEYNFIICKENNAFGAQGEQMISHGGISIEEVIVPFVHISHI

SEQ ID NO: 2223 - protein, 664 aa, Nitrococcus mobilis
MTAWVGRILKEFPADLARLWIIADPDDVLLDEQVLSGLRERGFEVLPFEDSVAFRTEYEGRYRAAWDQGQPAPSPALVLHLRSTNVSDLPWDYLRQARRLSLSLAELFPKLSYGVVRQLGGEMLEPLFEAQARHAHQALGEAATKEFMLTHIFRLSPHLITRPEDLWRELLRLHYREAALPPLLALHVGQVVGEHSAFKSLPISELFSQKSLTLRVVQDAWYRYLAKLGLTGTRTGEPASPDYVPQIDIPFDHHDVRVIVDSMFLDGKLHPLAVAGESAALPEWARTGVVQDPASMRNLVIEGIKNLAAEMPAIESPHRDWTHFSRRLGEVISRSHRLDSARAESVKEALLDLVVSADGRLREWVGKHFADLPSLPAAKGPVMVHHVPRFLAMRRDSGEERLALLVFDGLAVDQWTQIRESVINQSKRLMFEENACFAWLPTLTSVSRQALFSGLRPREFADSIETTSREPSLWARFWQDHGLRANEVLYRKSIKRTDDLPALEAALTNPAVKVVGLVIDTVDEIIHGAVLGKRGISAQIASWCESGFVDRLFALLLDNGFHVYLTADHGNVEAVGIGRPNQGVASELRGERVRTYRSEALVADAAAANPEAFRLDVAGLPANFMPLFAGARGAFVPKDEQVVVHGGVSVEELLVPFVKVSYVN

SEQ ID NO: 2224 - protein, 920 aa, Saccharomonospora glauca
MSAPPEVDRRMLEALVEHWLPEANGRRLLLVHGRYADGGDREFGIRTKECRCRVHVADRHSLLGVLEAWQDHQREHGSETDTADTLLVVTTGVEDHQFGWDLLAYAVQRRVLSVDRAQIIAQRFGARDVDPRIRREHWLVDALLDAEPVEGWPRTGSVLTRDRAIHALIGVRLGRAALGEDAVDIGTLLDFSLDVAGTTRFAALPAAERDGLTDWLTHTVGDAAGLLLRLAAEGRAADAMPLGIVGTAAVGENASPAAALAFGGLLGGVRPEQLGAFTEAVEGALERWVSEAESGGRNSAGAREKVLAVTRRAEELAATAGLTAELAGNRFLPSAFTARLHDFATALTAALDGTGKLDAAEDALGALRTHHLARLAGERMRAVDMAVRLARWLEHPVPEPTSVADAIRRYSTEWAWVDRALTTLWAGDPAGDPVLGRAYQAVFRAVRERRAALDEAFATHLPSWTRHASIDDPGGCLLIERVLHEVVVPLARQKAPVIVVLDGMSGAVAADLAEQLTQRTWLEASPKARRIAAVSAVPSVTRASRPSLLTGTLTAGDQTVEKDGFAAFWKRPGGSGLLFHKADIAGDAGHRLSDQLLTALSDESNVVGVVLNTIDAALDHGREGDRTGWQPGDITYLPELLDAARNYGRPVVLVSDHGHVLDRPDGTKVPVDDVESARWRVGEPGEGELALSGPRVLLGGGSVVVPWREDIRYTNRKAGYHGGVALAELAVPVLVLLPALNTLPDGWELLPADRVAPTWWQRRAEQPSPPQAQPKPAEPSATAAPPARRARKEQPDALPLFGVDDQKARDADGDRAEQPSLGQRVVDSEVYAGQRAFVPKAPDRRVVAAIVDALVEAGNRLPLNTVAELAGRKSRGPEFFATILQRLLNVDGYPVLSVDGGQWLSLDTDTLCLQFGLTRD

SEQ ID NO: 2225 - protein, 929 aa, Rhodococcus triatomae
MTTATSLPEADLPGIRTLIGQLRVKGHRRGVLAVAAVPTWSGPDTLDLDGSTVRIRTAPSVLAIRDALTERSAYDWVVVLTDRDASELPVGVLDHLTVGRLSNLDPWPALRELFKANRQEFNLLSLENNAARSALRSLDDAVPPAPGGVLTSDHLFGALAGRNFGLTPDKFTPHQVALWSTDTERTTQFTAWQSRTDESLVEQFFTWLERKLGPLGRTTALVLRSSGPEQLVPLGLVAALIDDSASSAAIVPAASNVTGKVSTLLEVELGRHTVTEAEIKVWGNTATLAVAGSDVPDATLRRAEDLVTKLQATALVGRSDVLPSALAPRIARFAAALDAAERTPDDTAITAVENAWADVTAHRLARVDGADASRDVRVAAAALRLLRWTRRTDTAPTTLAGWLTYYRADLSWVDGAVDEAFIGADNAVLANTAHRIVTTVRGRRARHDRAFAALLATSGTYRTTGSDAPTYVEDLLDRVVKPLTVRSQGSMQDARPSPVLLIVADGMSGSAANEVVADAVRRNRPQWQAYIPRDTEPVTVVMAALPTLTEFSRCSLLSGVLDRGGQAQERDGFSAWLAGQGMRGQGPVLFHKADLETVSRGNALAVDVRAAIDDTDHRPVVACVLNDIDDALDRSDPIGTVWTIDRFKRLDALMSAAAAVSRTVVLVSDHGHVVERREQPSVQRGEQVSARYRLAAGVDPATLPADEVFVEGPRVLTDDHRAVLAVDEQLRYTGLKAGYHGGGALAEVAIPVTILVNGAAPSHLGLIEAPAPQPAWWDPIRTTTPAPTVVTTPTKPTRKPTTKAPAQEESLFEFGGTTTTQPTTTAPVGGRDRITELLATDLFAQQYKTYGRKMSRDAIAALLRETVDGGGVLPLAQAAQILDVKAFRAGPAVQVIAQVLGIDGVVVLSVTGSDLELESAALFEQFGVA

SEQ ID NO: 2226 - protein, 917 aa, Saccharomonospora cyanea
MSAPPEVDRRMLEALVEHWLPEANGRRLLLVHGRYADGGDREFGIRTKECRCRVHVADRHSLLGVLEAWQDHQREHGSETDTADTLLVVTTGVEDHQFGWDLLAYAVQRRVLSVDRAQIIAQRFGARDVDPRIRREHWLVDALLDAEPVEGWPRTGSVLTRDRAIHALIGVRLGRAALGEDAVDIGTLLDFSLDVAGTTRFAALPAAERDGLTDWLTHTVGDAAGLLLRLAAEGRAADAMPLGIVGTAAVGENASPAAALAFGGLLGGVRPEQLGAFTEAVEGALERWVSEAESGGRNSVGAREKVLAVTRRAEELAATAGLTAELAGNRFLPSAFTARLHDLATALIAALDGTGKLDAAEDALGALRTHHLARLAGERMRAVDMAVRLVRWLAHPAPEPSSVADAIRRYSTEWAWVDRALTTLWAGDPAGDPVLGRAYQAVFRAVRERRATLDETFAAHLPNWTRHASIDDPGGCLLIERVLHEVVVPLARQKAPVIVVLDGMSGAVAADLAEQLTQRTWLEASPKARRIAAVSAVPSVTRASRPSLLTGTLTAGDQTVEKDGFAAFWKRPGGSGLLFHKADIAGDAGHRLSDQLLTALSDESNVVGVVLNTIDAALDHGREGDRTGWQPGDITYLPELLDAARNYGRPVVLVSDHGHVLDRPDGTKVPVDDVESARWRVGEPGEGEIALSGPRVLLGGGSVVVPWREDIRYTNRKAGYHGGVALAELAVPVLVLLPALNTLPDGWELLPADRVAPTWWQRRAEQPAPPKAQSARAEPAAPPARRARKEQPDALPLFGVDDQKARDADGDRAEQPSLGQRVVDSEVYAGQRAFVPKAPDRRVVAAIVDALVEAGNRLPLNTVAELAGRKSRGPEFFATILQRLLNVDGYPVLSVDGGQWLSLDTDTLCLQFGLTRD

SEQ ID NO: 2227 - protein, 945 aa, Gordonia polyisoprenivorans
MTTATGLPEADLASIKGVIGELSGKNYRPGVVAVAAVPHWAGPAELAHAGTRVLITTASSVLAIRDVLRRRTETDWLVILTDRPSTEIPAGIAEHLVTGRLRNLDPFPLLRNVFAASKQEFGLLGDQTEIARAMLREIGEKPTPAPGGVLTDDHVFTELGQRKFDLARANMTPHHVARWSMDPVATQRYTAWAEHAHPALVERYLLWLTRQLGELGPMLMSAWRRQGPASIVPLGLIAGVVAGTPQPDEDAAESIPRIRTRLEMKVDDVVLSESQLAAWGAVATLAVAGAHDPGPALTAAEALVTELHAEPLVARSDVLPSALVVRIAAFASRLAIATQHAVGGDTAADVNPVDLTPVDNAWAAVRAHRDHDAATAPRDVPVGAAALRLIRRLVEPWQHPATLSEWLTRYRTDWSWVDSAVNRAHIGADNPRLAHAVHQLLGAVRTRRAQMDREFATRLAAAGVHRESGSGAPLYAEDILDAVVLPLTARDHGATGAGLGGSEPSRSPVLLIVADGMDVASANDVVTDATRHRRPQWQDCIRADDDGPLTALSVLPSVTRFSRCSLLTGALAAGSQDRERSGFADWLQQRGLRGQGQVLFHKADLDAVSKGHSLALDVRQAVQDTASRTVVACVLNDIDDALDRSDPIGSSWTVSSFKHLDALLTEAAAVGRTVVLVSDHGHVVERREQPSVQRGDQISARYRGASGTPAADGEMLVDGERVLTDDHRAVLAVDEQLRYTGLKAGYHGGAALSEVSIPVSILVNGAIRSSLPLVPSGFAPPSWWDLDDAAPTPLPAPVTPSPAPAPAKRPAKNAKPAPTSGQESLFDVGETPAGSTADDAVADAAFDPIGRLLTSGLFLSQFKQFGRTLTHQSVGSLLRESQAANGVLPMSRVAEILGLRPAQARGAVAHLSQVFNIDGVSVIAQHGDDVTISSALLFEQFGVSP

SEQ ID NO: 2228 - protein, 908 aa, Amycolatopsis azurea
MACCRREGLMAQVPPITRAGIESLLTQHRHALDKQPGRCLVLVHGRYEPGERTEFRLKPIEGDQGERAVRVTDQPSILGITAEWLDYQHTGAASGVLVITTGVEPAELDWDLRGHALETSLLRIDPVENLKFRFGANRLDPRVWQSTWLVQAVLDAEPTSGWPRRGGVLTYDDALLALVGQRLGVDAATLDLDRLLEWSRSTATTSWAELDNAERDGIRSWLVERLGLAAEAVLTLVAAGRGRDALALGVVGAALSDQSLSRDALVSVGGLFPGIRSDAVEAFALAVDGTLSRWITAAGPADSPARHDVLTVLERADELAKQTGLTEALSSNPLLPSAWRARLRSVGAALPDPEAANRALGELGEHRLAELFSSQKTTATMAVRLARWLATPESGVPSVSAGVQQQVAQWGWVDYALAVLWAGDVAGEPVSAKAYRDLCEQVTARRTASDEEFALRLASWVPHARAQLSEGALLIEDILTTAAVPLAGDSAPLIIVLDGMSASVAAQLGDELSRRPNWLEASPVSGTRLAAVSVFPSITTVSRPSLLCGKPIAGGQSTEKDGFASFWKKHHKQARLFHENEVGGGAGQSLNPELVAALAGVEVVGVVLNTIDDTLGPGREGDGTTWRLQDIRYLTSLLTQARSYGRPVVVTSDHGHVLERGLASGPSPATAEYGGRWRTGAPAEGEVALHGPRVLEGNGKVVLPWREDIRYTQKRAGYHGGAALAEVSIPVLVLLPSVDVLPDSWAGLPAEQTTPSWWRGSPEQVIVEPAPAPKAPRKKQKAIPDGPGLFDHVLPEPIPPVPAVQKTLGQQVTASKIFATQEKFIRRGPNSDVVAAVIDSLADAGGKLSLAAIASTAGKAARNIDGFLATLQRLLNVESYPVLELIDGGRTVELNLELLRTQFDLDKP

SEQ ID NO: 2229 - protein, 925 aa, Marinobacter sp.
MPAMDPGNLLPIPILTQLQAVFQRDPEADCIALVWPTELPASEVLVAVGPHRVRAVYCVSELALREVLVAHQQQPAGKRPRLVLLSKFDGVHLALDVLARLWKNEPQRISPWKTLQQLIRVRDIDPRLTRKHGRWIAEALLSGYDRYHKKITFGDVLDQESAWRAIAIGHLHYQEPSLDLQSLLEWSAQDAVPGWVGALPDEIKANLGEWLAPALPDSHEAVSTILLNGQAGDLLPIALACSTLFSDAIEKQKAVEPAQLHGSRGVFRERYLAGKTLPLKALQPLGDAATALIGRWIAGRSFQCYEPVLAKTEQILASLDMQAQAQLSGLLTCGLQARLSNFACELEAAATQNDGALAEQALQQIKTHQLAGIGLFKDTVQRAEMAMRLVRWLKQRPITTGTAASLMIDYIDQGGFCDWARTAIWSGDVHSELNHVYKQLSERVSELRERQNFAFGQQLAGIGRGDSLPARLTPVESAIDTVLAPLAEQSPALLLVLDGMSEAVYRQLSGDLSRYNWLEIQSQAASSDTCLVAALPTRTQTSRCSLLSGALSAGVATDEKRAFAAHPRLKKIASTKFPPRVFHKQDLSQPGSGSLRSDVRGVIAGTEHRVLAVVINAIDDQLSSSSQVNVEWGFESIALLRQVMDAAREAGRVVVITSDHGHVLDHDSVFQPPSGEYGERYRSVAEGAPSELEVKVSGKRVLAPGQSVILPWSERLRYTRGKSHGYHGGASLQEVVIPLGVFVNASVRQHLDGWQEVPRRLPDWWLVPQQPLRVNDSKVESGVVNRAPKAPARSKLAAVSEVVDDMFGAAESAPAQPDASTPLEADWIDRFLESSVYQQARQRAGRTAISDDDLLKFIRLLQAQQWQIMEATLCRELQIPKLRVRGFLSNIQKLLNVDGYPILSVDRESQTIRLNVSDFRKQFEV

SEQ ID NO: 2230 - protein, 884 aa, Saccharopolyspora erythraea
MDHRVIEALVKDQLQHHTNRRLLLVYARYADTVESFPLTGQRRRVHVADHHSVLGMSEAWQRHLADHPADDDLLVVTTSVPEEQLGWDLRAYAIKRSIRNVDRARIVAQRFGAVDVDARVRAEEWLIDGLLDAEPSTGWPRAGSVLTRDRAIRALIGARLGRTVPADGTLDAGTLLEWSRGAEAGRFSELSPAERDGLVRWLTDTVGPAAAVLLRLVEEGKATDAMPLGVVAAVAAGPNPPLEAGLALGGLLGSAHGSELRAFTDAVEGTLTRWAHEAEVSRNGEPARRRVWEVVRRSDEIAAQVRLTESLRGNGFLPSAFSARLQALATAVSGPRARLGDAERALESLRDHVVARLAPERVRVAEMAVRLVRWLQEARTDVASVADGIARYISDTAWVDRALQVLWHGDPGGDAVVGQAYRSVWEEIRSVRDRIDEAFAGRLESWAQHASSVESSGALLIEQVLGEIAAPVARKTAPLVIVLDGMNGAVAAGLGEQLAEWSETSREPGRRDAAVAAIPSVTQISRTSLLTGTVTEGGQTVEKDGFKKFWRTRRRQAQLFHKADIVGQAGSWLSDELFAALADPDIVVGAVLNTIDDALDHGQEGDRVEWRLDDITYLSTLLNEARNYGRPVVLVSDHGHVLDRGGQQTQADGVESARWRRGAPSTGEVALRGPRVVPGDLVAPWREDLRYTPRKAGYHGGASLAEMTVPVLVLLPSLELLPNGWHVLPRERTEPPWWSARTVHAETESAPVKAPSRRKKTPDPAVEALFPVDAAAVEPVTSLGDRVASGEVYEHQRKLVPRPPDNQAVAAVIDALAAQPDGMLTTSAVAAAAGRAARRPEFFMSVLGRLLNVDGYPVVSVVDGGARVKLSLENLRTQFGIDKP

SEQ ID NO: 2231 - protein, 968 aa, Streptomyces turgidiscabies
MTDTVAAAPGAVRLNTATVTQYLSSQSSLAASLTGDGGGRRRVVLLRSALQWDGPAEPAWGEGRTACVAVAPSPLAVHELVLDHLTGRRPGPAVLVVLTDREQNELDPAITARVHKQRIDMVDSWDVVREAFGARQIDPRLKDVNWAAEALLDATPPGGWQPVPGGWLSRQYALTALAQRRLRLGRYDTEDGPRRLGEDRLDAQTLLHWSTGPGAPERLLGLRGPERAGLAAFLGEEDQAGLAGRALLALVDAERGSDAAAFGLVCAALWQHAETAPETYQSRGRAERYFGDQPPAVGEQLDALVGVFGRSAEEYVSTLLTAGHRGGGIDADQAREARRTSGIVLDRAAVLARQFGAEAAVASSPVLRGGMEARFTAIGRALAAGDTAAVAEAVGRLADHRLATDPEESARIERARMGQRLARWLATDPSADAPSVGDAIQRHTAETGWADLALEHIEAGGDPDSVLKAAYDTLGTRVRDRRRQIDASFARSLAGWTQDGTPPGGMLTVETFLDRVVGPVVRRGEERRVLLLVLDGMSAAIANELGEELRRSWAEFDPLAEDTPRRRAMAAALPTVTAVSRTSLFAGILMKGTQADEKRLFPALKLWSGAPAAVFHKDDLRTETAGDTFGQALTGVLTDGRTHVAVVLNAIDDRLAKEQKLGDGTWRVDDVPGLRELLRVAAAQGMAVIVTSDHGHVVDRHGTKADAATEPQSARHRLPGGGPLGEREIALSGPRVVWPDPGASIVALWDADSRYTALKAGYHGGASLAEFTIPVLAFLPFGAEPPKGWRELGDQRPPWWAPEEAGRSASDERSTRLAGVAPKKATAKPRKKQPDPESLPDALFDVMLTAGGDDALLTPTVVSRTEVLVAALLDSETYQGQLEGLARKPQQEQVHKALAALLDAGGTLPVTALAQRAGLPTNRGDGFAAVLRQLLNYDGVQVLETLPDGRTLRLHDALLREQFALRTG

SEQ ID NO: 2232 - protein, 894 aa, Gemmata obscuriglobus
MTQPAPTFGQIRAKVQAVRRKIPDASAVGIHAPGRYAGDRVRREGADTYRIEQCDSPLAARIALLGDEPAATVTVLVTGLADQDLGDDVLVRLAGRRLYPLDPWQIVKELFQAHAVDPRLRGQGWIADRLLELATAAGVPAAAGGYLDAEIVWPMLLQRLLGLEGDRPDLPLLLRWSAVPENVGRFRRLPDEPRRAIEGWLSASLGPTAAAVLRCAGATDQPDALPVGLALGVVHHPAAAGQLDRAAGRLERFLGGPTPEPAVTDRWHAAATEAVRLLDADTRARNGLLHRAEEVLREVQADEFAHLTDVLPRGFEQRLARLGGLLAVTADEPPAVAELTAARDAVRRHDQARREPRRVERVDMALRLARWLAAAGPEVAPRSLGAAAAEYVAQGSFVDWARSALRAGDPVRELSEGYARLLARVAARREAQNRRFAELLRDQTAAAARPADVTPVEAVLDQLVAPLAALAPVLVVLLDGMSPAVSRELTADLTRLDWASLGPGGRALPPGLAAIPCVTEASRTSLFCGRLATGSVADEAAGFAAHAALKLHCRAGQPPVLFHKIALTGPGDAALAANVREAVASAQKRVVGVVVNAVDDHLLKGEQLDLRWTRDEIKVLLPLLYEARSARRVVVLLSDHGHLLDDQTRAADGDGGERWRSDDGRPGEGELALRGPRVLLGDGHRLIAPWTERLRYVGRKNGYHGGLTPQEMLIPITVLAAGDLRPDGWVDAPDPAPDWWEPAPPLAALPAVVLPPKPSAPKVPTSLFDDEEETPAVPPVAPAVASSPIWVAALLASPVFTEQKKLGGRAVPDDATFAGLLAALDEAGGKLTSAALARRMSLPPFRLRGLLAVCQRVLNVDGFAVLGRDDPSDTVELNRSLLLRQFDLIAEDRP

SEQ ID NO: 2233 - protein, 885 aa, Rhodococcus ruber
MNTLTATRPIITAKLAKAVEKRYKGGVLGLRAAPAWDGGTFHHDGTPVTVVPCPSTLAVWEALESRADDQWLVILTPVDDKDLGDGVLAHLIDGRLLSPDPWDALRSTFAATTIEPALYRVPNDRALALGLLAAIPTAAITPAPGGVLTRTHVMSTLARGVLAITDDPATEIDTLAILEWSRRSDVTDNLARLRVDGGPEVMKAVAEWLAERAGRLGKPVAALLQSQRITELVPLGLLAGLVADPASTLDRGLFLGEYGLRRLDIEDLEAWHDDTAGLVVGTLVERERRAVLESAAAHVRELNIEHLAARSELLPQGLTARLDELAKAIEVALPADASHGPKQGGIDGVELAWQQVLQHMSARTSTSCRAAEAAVRLLRWLTVDTPTAGGLDVLTRRYVDVDGWVDAALVTAHRGADHRRLAEAITQVIAVVTARRRGHDRRFATALADTPHPTGALVEQLLPDVVLPLAKSTPTLLIVVDALSVAAATELAAAAAESGWIEAGVLGSSCRTGALAVLPTLTQRSRCSLLTGELKEGNDAAERTGFLKLLRDAKLQAAPGRIDPIFHKKALDTVPAGADLATDVANAIADTAGRPLVAAVLNFVDDTLHHTDPGGTNWGIDTITHLRALLQAAQRAGRAVVITSDHGHIIERRTSVKHDRVTVYGQRAHGDLDRVEDGEILVRGPRVLTDSSAVVLAVDDTIRYGPVNAGYHGGASPAEVVVPVLALHTGECPDTLTTLDPVEPHWWHSPVRLDTPEASPAPAVNQAAPTLFDNDEPAVADTGGDVAEGVLATTVFADQFRLAGRIVVRPDQIRALLAALLAAPARELTTAHAAALLGLAPSRVGGALLQIKRVLDVEGYEVLLLDSGVVGLDEAALREQFGIGS

SEQ ID NO: 2234 - protein, 869 aa, Mycobacterium xenopi
MSTLAVTEPIIRARLGKAKAKRYARGVLGLRAKPEWNGETFDFEGTPVTVVACPSVLAIWEAIDTRDSDAWTVVLTDVDDDELSDTVLAHLLDGRLITPDPWDALRSNFAASTIEPALYRVHNDRAIANGLLNILSPDAYTPAPGGVLTLDHAMAAVARDVLKIVNRPDVEIDTLAVLEWSLSGKAADGLSALAARGGTELTSVFHGWLAGRAAAIAGPLRALLATDRISELVPLGIVAGLFSQAHHDAKALGVFLGRYGLTSLTPADLDDWYVNARGLVTNALTSPHSVLQAAAGVVDDLGIGAAAASSELLRHGLEHRLTVLADAVTTALTRPETLPGVESAWTDVQNHFLSGSDPSCPAFAGAVRLVRWLAQTPTPATGLANASALYVRELSWVDTALVAARRGADGPHLAEALRAVIDTVAARRFHHDRGFAQALADAPNPPVQTIENVLAQWVIPLAKKTPTLLLVIDALSLAAANDLVAAAQRDGWVEISAAADGHRGAALAVLPTLTQRSRCSLLCGELREGPDTVERAGFVALIREAQLEATGGAPDPIFHKKALDAIPAGASLATDVSNAIADVEHQPLVAAVLNYVDDTLHHTDPGSADWTLTTITHLRALLHAAKNAGRAVVITSDHGHIIEYGTSTKVERANTYGQRAHGDYANIDPDRETLVEGPRVLTTDHKVVLAVDPDVRYQARNAGYHGGGSPAEALVPVVVLAAGTLPDFAVPVAGAEPPWWHASAPVITPVITKKPQEPSLFDTAEPPSALPEKVLRSKVFGEQLKLAKRNVVQQSQIRDLLAALLATSAHEIALAQAAVVLGVATARVNGALMQAKRVLDVEGYEVLRVANGVVRLDVDALKEQFGVSE

SEQ ID NO: 2235 - protein, 830 aa, Micromonospora sp.
PTSACRRAAASTRGTWSPRCSAARCGSTPPSCAPADGSPTPSPTLRRPRAGRRPPASSSPGTTRCGTSPGRYSASTPTHWTEPASSSGAPTHPTSSASATCPPNGPTGSPRSSARSPARSPCRSSPPSEPGTASTPSHSGCSPGYSGPGPPSRGPTWIWWSPAPGSSRASAVPASRRNRPARSGRRPRRGSTGPSTATMRYATTRAGCCAGRRTSRPRSTSPDGSPRPTCCRPGFTQRMRAFGEAVRLAVPAAGAPVAPAGELIERAQDRLAEVETHRSAERSRVETARMAVRLLRWLATPEGSAPATMLDAVQRQVRDDGWVDRARLDIFVGDVDPQVARAYRLLHAAVEARRARHDHQFAELLQDTTVAERDPGTLLRVEDVLDRVVRPIVDNGRRVLMLVLDGMGTAAAVEIAESLGRGGAWEELTPGGGPRVGVLAALPTVTQVNRCSLFSGRIAVGDRGTELRAFREQFPGGVLLHKSDLRTPAGLAVDPEVAAALGDPAVPLVAAVINTIDDALDRSDPGITEWSTDTVNGLRNLLVLAQDRVVVLVSDHGHVVDRGTEAVLRPADSSENRWRLTTGEPGDGELLFKGSRVALGGGEVILPWREELRYGPRKAGYHGGAAPAEAVIPLLLFAAHDENAVPGWAGAPVSSPEWWREPLRQAAEEAVSHEPAPTESRRPARRAARPPAQDEGLFDLPAPAATAPPSSAPTVPPAPSSPPPADSAATIVKALLASPVYADRRGTRAPLPDERVAAMVATLVAGNGRATLETLATRAGIPVHRVTGTFTVLRRLLQVEGYPVLSLDPDGRTAKLDIALMVEQFGLEVP

SEQ ID NO: 2236 - protein, 915 aa, Saccharomonospora xinjiangensis
MSAAPDIDRRMLEALVEHWLPEAGERQLLLVHGRYTEGADRSFPVKTSERRCRVHVADQHSLLGALEAWQEHQSSHADDPDALLVVTTSVADQQFGWDLLAYAVQRRVLSVDRAEIVARRFGARDVDPRIRQEPWLIDALLDAEPAEGWPRTASVLTRDRAIQALISVRLGRAALGDDAVDIGTLLDFSLDPAGTTRFAALPDAERDGLTDWLTHTVGDAAGLLLRLAAEGRAADAMPLGVVGTAAVGETASTSAALAFGGLLGGVRPEQLIAFTEAVEGALERWVSEAESGGRHSRAARDRVLAVTRRAEELATRAGLTADLAGNRFLPSAFTARLHSVATALTAALDGAGLDAAENALVALREHHLARLEDERMRAVDLAVRVVRWLTLPLREPASVADGITTYSTEWAWVDRALTTLWAGDPAGDPVLGRAFELVFRAARQRRDALDAAFAAHLPRWTTRAGVHDTGGCLLIEQVLDEVAMPLARQSAPVIVVLDGMSAAVAAELAEQLAENAWLEVSPREHRIAAVSAIPSVTRASRPSLLAGTLTAGDQTVERDGFARFWKGPGRSGQLFHKADIGGDAGHRLSDRLLEALSDETVAVAVVLNTIDAALDHGREGDRTGWRLHDITYLPELLDAARNYGRPVVLASDHGHVLDRADGPPVPGAGAESARWRTGEPGDGEIALRGPRVLLGGGTVVVPWREDIRYTHRKAGYHGGAALAELTVPVLVVLPSLHRLPPGWTVLAADRVAPAWWHRRAEQAPAPASVPVSSERAPRAVPPIVASPRVVSQLDPHEMSLFAVDAPEESAKPGESLGERVVASEVYAGQKAFLPKAPDRKAVAAVIDALVESGNRLPLTTVATLTGRTVTRAAVLTTTLQRLLNVDGYPVLSMDGGQWLTLDVETLCLQFGVERD

SEQ ID NO: 2237 - protein, 924 aa, Bradyrhizobium sp.
MTEAPLLSDADIRLEVERLFRRDHRSKLLALFGRGQLGHIDLDGLKWEIIPTSCELELRSKLPAPGAPPTTGSVYLVDWAEDALPLDVSCRLAGGRIYHVARDARLAALFGARQVDQGLVSTALARLVLSGSVDGLRKITGLRLTTNDLCKRVLEARFGTPESALESGTAWLRWVRNSDAGTAFARACEGDGLLRAVRHELFVWVGERLGSVGILGFRAWELGLVDRAIEALLLLAAVEKSEDAYLRGLVNGQIASIAPGLANEVRDAHEHGSAEALIAAVLSVENEADRRLLELAQQHAMSGGASALAAASDWLPAGHAAREEAVAAALTTLVDSPSADSMTAVLTAFDHLSAHRLDRIIRGSEHIEARKMAARLSAWLLARRVRPQLAEHGTPWQPAIELARRYTEEGGFLDWARQSARGMRGAGDALMTAVHRLCGAIDAEARADDQRFAQAYVSWIAAGKPSNEVLPIEDVTKRVVAQFLKGGQHRRLLLVLMDGMSYATAVQILQRLRDQRRWSPIAWRTPNWSGQLPIPPVLATAPTLTQVSRAALFAGVADPRFGDQGTDKDEERWASNPHVRELVGEEPLNVFFRREILAGHELTEEVKKAIADDERVVAVIVNAVDEQLKGSLQVAVDYSKTSILPLEALLSAAGGAERAVLLVADHGHAAGDAMRVASGRIPVGREGGARWRALAEGEQPQDGEVLLPRSSWKPRGSAGIAALWDTTLANRAPNYGEHGGLSLAEAVAPAFLIGPEWLDRVADDDVELSCRVLPEPDWWALKIARPATVPVAPIKEPKTPKAQLELLPVEQAKTPIAPPEAPTEPTLVARLRTSKLFTLQIAGVPKADVERVLTWLTVLVDAGGSMTAADFARLCGVRPHQVGGVVARMGVLNADGFAIVEHDVAGRRVVLHKARLLSQFGVTE

SEQ ID NO: 2238 - protein, 738 aa, Burkholderia thailandensis; identical to SEQ ID NO: 1873

SEQ ID NO: 2239 - protein, 901 aa, Planctomyces maris
MTLTAPTFSQIKAQVATIQQKSSRADVIGIQSSGRWSDDTRIQDGDQTYLIYQCDSPLACRIAIREPVEKKTTKVLITGLDENELGDDLRYRLAKHKLFNIDPWQMVCSQFNARNVDTRLTHHPWLAETLLELGSRHGFPPARGGFLDAESAWSFLLEHQIQLRGEAPDLTSLLKWTLDHTATQHFRHSTPEFQEATIKWLSEQAGPVARLILQCVQQEQFQQDPLPIGIAMIVLFHQEAQGKLEKACGKFEGRYFKNHSPEPELMQRWISSAREVVRSLQHAAPKRHRQIVQRSDEILKELSAEKYAYLSHSSLLGFEQRLIRFGETLSDMVSRNSWSEISVLQELSESVRKHDLANQDPRQLERLEMSLRLVRWLREESQSHQKDPQSLGAAARFQLETGGFLDWARLQLRHGDAVEVLSQAYLQLFEKVTQVRERQAQHVSQLLADWTSAGSKGNDVIPVEQILEQIVAPLAAEQPVLLIVIDGMSVAVCRELLSNLTRHEWVALAEPNHRFNRPAMAVIPSVTEFSRTSLLTGKLKQGGQNEEKKGFQNHPQLTGSNKNAQPPLLYHKAGLQGPDQSDLAGDLRKEIASSRSVVGVIVNAVDDNLLKGEQLDTRWSREQIQVLPTLLHEARNASRLVVLVSDHGHVLDCQTQHRPGTDETTGGERWRPAGVSPTEGETLISGSRVLSAGQKLVAPWSERIRYTMKKNGYHGGLSPQEMIVPIVVLSSTDEIPTGWSEQPIDTPAWWDEVLPEIEEIKPAAPAKPKRKPVSKTPMLFNDLEDEPETSAPAEAPAVPAWIQSLLKSPVFKDQKRLGGRHLPDDATFTRLLHALDRREGTMTLRALTRALEAPPMRMRGILAKTERVLNVDGYDVIRYDETSDTVELQRDLLLKQFGLED

SEQ ID NO: 2240 - protein, 974 aa, Streptomyces gancidicus
MTDTVVAVPGAVRLNTATVTQYLSSQPSLAASLTGDGEARRRVVLLRSAPQWDGPAEPVWGEGRTAGVAVAPSPLAVHELVLDHLAGRRPGPAVLVVLTDREQNELDPAILARVHKLRIDTVDSWDVVREAFGARQIDPRLKDVNWAAEALLDATPPGGWAAVPGGWLSRQYALTALAQRRMRLGRYDTEGGTRRPGDDRLDAQALLHWSTRPGAPERLLALRGPERAGLSAFLGEEDQAGLAGRALLALVDAERGADAAAFGLVCAALWQHAGPAPETYRARGRAERYFGDQPPATGDQLDVLVTVFGRAAEEYVTTLLAAGHHTGGTDADQAREARRTTGIVLDRASALARQFGAEDAVAASPVLRGGLEARFTAVGQTLTSGDTAAVADAVRRLEDHRLAAESEEAPRIERARMGQRLARWLATDPPAEAPTVADAIQRHVAETGWVDLALEHIEAGGDPDPVLKAAYDTLGTRVRDRRRQIDASFARSLAAWTEAGTQPGSMLTVETFLDRVVGPAVRRGEERRVLLLVLDGMSAAIANELGEELRRYWAEFDPLPEGDAPRRRAMAAALPTVTAVSRTSLFAGTLMKGTQADEKRLFPALKLWGGARAAVFHKDDLRTETAGDTFGPALTEALADGRTHVAVVLNAIDDRLAKEQKLGDGAWRIDDVPGLRDLLRAAATEGMAVVLTSDHGHVVDRHGTKVDTAADPASARHRLPGGGPLGEREIALSGPRVVWPEPGASVVVLWDADSRYTALKAGYHGGASLAEVTIPVLAFLPFGAEPPKGWRELGDQRPAWWAPEETGKAPLLDGHAARPVAAMAPAPRKPSAKAKKAQAEVARMHHGELFDVALTTGGDDALLTPTLVSRTETLVTTLLDSETYQAQLGGLARKPQQEQVHKALAALLDAGGTLPVTALAQRAGMPVTRGDGFAAVLRQLLNYDGVQVLETLPDGRTLRLHEALLREQFALRAG

SEQ ID NO: 2241 - protein, 939 aa, Gordonia amicalis
MTAATGLPEADLAAIRGLIRDLRVKNHTRGVIAVAAVPQWSGEGEFSVDGQRIRVRTAPSVLAIRDAITNRREVDWVVILTDRDASELPAGVLEHLTGNRLSNFDPFPMLRDAFAASQHEFRLLDLDTRAARAVLRELGDTTTPAPGGVLTNEHVFATLAKLKFGLDPVEFTPHHVALWSIDVSRTQRFDTWSKTTEPALLEQFYAWISARLGTVGPLFTTVWRVNGPEHIVPLGMVAALLSDSAKAAASFPATADVIVEVRTRLKLELGDNVYSEQQLATWGNVATLAVTAAEDPTAALTRAESFVTKLHASPLVARSDVLSSALAPRIKHFAGALATSIDSDDLAPAENAWADVLAHRDARADTSDAPRDVQVGAAALRLLRRLRAPWQQPTTLADWLQEHRTDLSWVDSAVNNAFVGATDPQLAAVAHKLVTEIREKRAALDRSFARMLAAAGTHRESGTGAPLYIEDVLDQIVKPLTAPVSGPTGLGAHEAQASPVLVVVADGMDAATSHDVVADALRRHRPQWQDCRFTGADGPHTALATLPTVTKFSRCSLLTGALAAGTQDVERTGFSNWLQHNGLRGTGQVLFHKADLEAVAQGHALAVDVRTAVEDTDDRPVVACILNDIDDALDRSDPIGTSWTTSTFKRLDALLATAATVGRTVVLLSDHGHVVERREQASKQRGQQISARYRSAVSVDGASLPADEVLVEGQRVLTEDHRAVLAVDEQLRYTGLKAGYHGGATLAEAVIPISILVNGTVSVDGYVSRHLGLEAAPNPQPSWWTPARITSAPVTQVHVSAPTATKKKAATKMPQVDTLFDVGEPESLVASPDSSPTEGHDQVAKLLTSALFKEQFKLYGRRMSTDAIGTLLRETIAGGGVLTLPRAGEILGVKASRANSSVQVVAQIFNTDGVIVLTVNGGELALEAPLMFEQFQVKA

SEQ ID NO: 2242 - protein, 479 aa, Mycobacterium intracellulare
MDEEPLSHGLRAVLEAVRLRRDNHDREFATSLALQTIGSSTLPEDILLIEDLLADVVVPLAKEPRPVLLIVADGMSAAVATEIIDDVERRYDTWLECLPRGKARRSVAVSALPSLTKVSRCSLLSGMLATGQQDAERNGFASFMRAHGLTSALFHKLRLETSGAGFALSPEVGTAVDDIAGTGVVACVLNTIDDALDRSDPGIDWTTDAVSHLRPLLERARRAGRAVVLTSDHGHVIERREGRMLSVGAVSSNRSRPAEGGPEPELGEVRVTGTRVLMHNGDAVLAVDERLRYGPLKAGYHGGAAPAEVVVPLHILTPNEPPTGWALATPQQPLWWHSSVMADAVGRAETPPVPLHRFPKTERPTLFDDFDQPAAGDLAAQVLASETFAEQRKRAQRVTLSNQQIGSLIRHLVAAPGNRIDQATASIALDVPLVRLSGALPMAQRLLNVEQYPVLDRDADGVTVVLDLDLLKEQFGLSG

SEQ ID NO: 2243 - protein, 891 aa, Phaeospirillum molischianum
MTVGALSPQRIVGQVDWVLKKRRDARFIAIRSPSRGAWPPHLDCGERRFQIRWCSSPLEMREVLSETTEDGVVILTDLQETDLGGDVLARLCLERLFSIESWRMLGDAFQARKLDPRLRGCDWMADLLLEYRPPEGYAPVPGGILDADTAWRTLLSSVLGIAEARPDIETLLHWTVVDDGPYRFVRLPDAAQKGIAGYLRGVCGAAGELIIDTLLAGNGGEAVALGLVCEVVFSDGWTNSDLLSAAVRLEPLVGRSQIPAPAARLWAQAAIRVARKQPQFSRVIFQQAEDVLRGIHAFDHVVHSSMLPAAFDVRLSEAAAAIGPVLTGGGSGEAMVRAEQAAFRVFEHHQAALQPLRGERLRMALRLLRWVAATNASEASNFEDIALAYVAEGSFVDWARTALLGGDDLAPVSAVYVRLAQEIRARRERQNQAFASALVQWNRQASPVRSLTPVEAILDRVVVSAASSAPVLLLLLDGMSFPVFRQLAGDLADEGWNELAVDGAPLHAAVSIIPTVTEVARASLLCGRICQGAANVEKSGFANHPGLMRITKSGPAPILFHKGELSNGGALADVVRAALADARHRVVAIVYNAVDDHLSGADQARPRWSLDDMQLLRPIFHEARNAGRMVVMTADHGHVLEDGSRQAGKGTGDRWRPMDVTADGEMAFAGARVLSPDGAKEVLVPWSELLRYGAKKAGYHGGATPQEVLVPLAVFSAANDAPLWEFSPPATPEWWNSVPLSMEVPTPKPTAEIRRRPKKGPLAASQPTLFSEQPPPNPTLPESGSPSPDAGWIGRLMTCEIYEAQCKLAGKGAARNEDVRAVLAALEARGRLPRTALARQIGIPLFRLNGLLSNVRRLINVDQSPILVVDDTGDWVELDVRQLAAQFEIKV

SEQ ID NO: 2244 - protein, 864 aa, Nitrococcus mobilis
MSLTPTQLATHAAKALQQATGPVTLAYHWPQPWNGGDSIVVDGQTLPLRHCVSPLEIREALAEASDVSRVLLVSQQETGLGQDVLARVFRHRLLHVDRWQLVQEIYGVCQIDPRLFGMTWLPDALLAAAPARRTTAAAALTLDEAMSTCLAPVLGTGAAQIDLERLLHACEDSGQRWAELGAEAREQFRHFLVNRLGALADALLRTLDAGNGHAALGIGLACEVLYSPHAAQQLGLRDARVRLEQRLDGLRLKDDAGRQWAELSQRAILQRDTLQRQEDFRLAMELLEWLGAADFIGLSSLLPQALDRRLADLGKAVTSFMRSPATLPDVEAASQRVLDHRLPPADHPGPECARMLARLCRYEASLSTAEPAADPVADYLTHGAWEDWVRRSLRGARPEALARAVARLLDRVSQRRTSGDRAFAEKLAQATAADETPRALLPIESALSFVVAPLAQHNPVVLVVLDGMSQDVYLAIAETMAHRGWCAWSRPRQPRALLATIPSVTECSRASLLAGRLARGGAAQERQAFARHEDLRQASRAGKPPLLLHKAGLEQSHQLSAAAVEALSDPEQRIVAVVINAIDDALAKSEQVRIDWTLESIPLLAAVLEQARRGGRTVVLTADHGHVLERQSTLRGNGEGERWRRPGNPPEDGEILMSGPRVSTLMGEPLVAPWSEQIRYGVKKNGYHGGVARQEMLVPLGLWTADAAPPRSDADELVAAVPMAPEWWNATDDGATAAPPRPAKRRGRCVRPPIDDLFATSAPSAWLDDLLQSPQLARQRQRAGRMALQEARLCALLTYLDEHGGRAGIDQLAAAIEQPRLRMRGIVSAMERMLNIDGFPVITLEQGSGTVLLDIELLKKQFLA

SEQ ID NO: 2245 - protein, 1125 aa, Frankia sp.
MTVLPSSSSAGHAAPSGMSGAGAPRVTPAIVLGRVARLRRGGHSDHRDQPRVLLVRARPEWSGPADLDLGGRPVRVVACVSPLAVLEEVVRWTHAPVEDGWLVLLTDADEESLGDSLLAQVHRQRVDVIEPWLAVLEDFGATQADPRLRAPEYRWVAPALLEARPAAGWPRRPGGLLGREDALAELAAARLGLTELGLGAADLDIATLLRWTTTPGATAALGRLGDDERAGVTRYLVERTGRAGQALFTLTAAGNGDRALALGLVCDCLWPRPQPAQRGSAEPPAGTSGPGAGPGSGAGAGAVERVVERARVRVERYFGDVLLDDVTMRAFADAVHEVVTTALLTARPGAGSLGVGAAGGRGATEDASVTLHPDDGVPALLDTADRLLGDLDARAAGAASDILRSGFDHRLGMVAGAVRDFLAAAESGVHRSLLARAARDVMTAVGSLRGHLLAGLNRPEVERAAMAARLVGWLATQPTGSLTTTGAPATGATAGPTSLAAALDAHLDDGAWADIALSHLAAGTPAPVVGSAYGDLYLVVARRRRALDAAFARLLAQWTTTGRPAPAVQPVPAGPAAPLCVEDVLDRVVRPVVTARGGRALLLVLDGMSAAVAAQLAAELRRERWEECDPLGLPEADPAGSARRRAALAVLPTVTTTSRTSLLAGRLVTGDKTTEKTEFENHPRWGRRPTSLFHHADLAGAPGVALDGALTDALTSDIPLVAVVINTIDDMLDRGRPHDDGGWSLADVGRLRAVLGYARTAGRAVILTSDHGHVVDHRAERLTPAADAEILSARHRACAPGEGEGVAAEVLLAGPRVLAPGGRIVALWDPDTHYLGRHGGYHGGASPAEVTVPVLAFLPFRLSAASTNRHLPPGWRPLPDQRPRWWSLETTDLLGGLDSLAGGETVLLGRPASSAALAASAASAATAADGGAEATVALPRKRRRPAEEQTGPALFDLPAAATGGPSARPSADPAAGGAPEPGARMPGGAVAGASVPGGAAADEAVALGATGRPGAGGGPADPIDVLVAGLLASELFRSQLDGLARKVPVEKVEAAVRALLGANGTLATSVVAARAGERPVRAGGFAVTLRRLFNIDNYPVLEPIDDGHTLRLNVDLLRAQFGLAV

SEQ ID NO: 2246 - protein, 929 aa, Pseudomonas stutzeri
MSIMQASATLPMPVVTQLQAVFQRDAEADCVALVWPNPLAALAVEQVVEGRKVRAIYCVSELAMREALVKHQQDRKETSERLVLLSGFAETDLAMDVLARIWRNEPQRISPWKTLQQLIRVRDIDPRLTRKQSRWVAEAMLNGVERYQGKISFGEILDEETAWRSIAMAHLNYQEATLDLQSVLSWSTKGDVSALITALPGDIRDNLGDWLARGLPDTHEVVSTLLLNDQGSDLLAVALACSVLFSSDIERLQALDLTQLYISRGIFRERFLGGKKIEFRVLQPLGEVAVALVRQWIGALGFPSYARFLSKAEQILASLDMQAAAEHSSLLPCGLHARFSAFASALDQALDGGDSMAADFALQQIEGHRLAGLDRYSETVARANMAMRLLRWLKQAPNVDGTAVSLIGDYIEQGGFCDWARTEIWAGDAEESLSTVYQRLSQHVGRYRERQNQAFGQQLASIARGDHLPARFIPVERGLDDLVAPLAEQGQVLLLVLDGMSEAVYRQLSSDLTRNHWLELQPVGAQGDACLVAALPTVTQVSRCSLISGALCEGNANDEKKAFSSHPQLKKLASTKFPPQVFHKQDLSQPGSGSLHSSVRGVIAGTEHRVLAVVINAIDDQLSSSSQVKVDWSFETVALLRHVMEAAREAGRVVIITSDHGHVLDHDSVYQQSADENGERYQPVAPGITPSELEVLLSGERVVTANKQVILPWSERLRYTKSRSHGYHGGGSLQEVVIPLGVYINAATRQRVEGWREVPRRLPAWWYSTKAIQSDTPSAVDEPTVSVEAPTKKAAGKKQAVAEVVEDMFGFASPAKALSKSAPVVGTSDWVSELLSSPVYGQVRDRAGRTAISDDQMQTLLRLMEKYRWQVMEAVLCSELMIPKLRIRGFLAGAQKLLNVDGYPILSVERDSQTVRLNVADLKKQFEIQ

SEQ ID NO: 2247 - protein, 969 aa, Dietzia cinnamea
MTTASAGVAGGATSSSSLGTATAADLIPLLHGLYRDKQHKRGLLVMHARPEWDGTELRVDDLTVPVHCCRTVLEIRDVVRHRKDSEVPWRVVLTDLPEEQIPQGVKEHFQPLGRMRELDPVGTLLGMFSADKTDGRIPRGRDDVRGLTTALADHRDTLAPTPTPVLTADHLYGSISTLVLGLEQDYRLADLLAWSATPDAHAAWDELASRLTSNVRAGLITWLCRTFTLTGPGIRSLWAKSGPRSLLPAGLAAETLRTPDWQDTPTELTGARALFSHHIGATLGDQSLREWGSAAAKAVRTSLDHGQPLTAVLGEAHRLITGFEQNGGASLLAGSTVLPGAFQRRLDVYARGLTTALDGGSETALLRGLEALRAHVEAERSRPDDLETAAALVRLHRWNRTEATAVADRMRSAGHVEAMRAYVDELSWVDRAVNSAWRGFTADPKPAIGQSAADPDALGRRVLDRTLAVRRDIDRTFAALVGARLADRSTAGGALLVEDVLDRVVAPLRKSGPVESGQRSERALLVVVIDGLSVAAAHGLLEDVAARHATVWQRLDLASLGLDVAASALPSVTTASRTSLLSGELALGGQQEERTGFAALFPAHPSVSDGPLFHKADLDASIGDTVRSAIYDTKHVPVVGAVLNTVDDALDRSDPIATTWTTSRITHLDKLLDYARAVGRDVVLLSDHGHVVERSRIGKVTADGAVSARWRPATGGPAGENERYVSGDRILAPGVDGTPRHEAILAVDEDLRYTGKKAGYHGGASPAEVCAPVAVLVQSLDGLGEDSPFPAGPPVQDPWPAWWPLATATSTVAEAKTAVGQPAAGRAEQPTAPTPSTRRAAQRDANQVSLFESLDADEPPVSPTPDRSRKPADKFADLSRSPYFKDRVKTQQLKPTPREVADVLREVAANNGRMPVAVLGNLLGLNALQVSGTIARIQKVVNVDGMPVLEREDNDVVLTTQTLFEQFGL

SEQ ID NO: 2248 - protein, 840 aa, Eubacterium saburreum
MAELNLKQIIDRLNAEFTGETRKLVFWYDDKAEFAEDMETVELQNAKIYHLQPDNQFYTKYFLERVDKTTNYLIYAPFPKPDVRDNHLEDTCAYSRRFFADRASLLSVDLGIEEKYKPVIEKHIKFFANKERTQRFYDLEIENFNEENILVGLLSAVCKARTCSFEEVVRIVLTDGELADNALLQEFEKYDLLSAFWQLCEQHFGYTDTKPSLERLLVTLFVTYTGRYVHAEFPAAWKSFVSYKSGNIIAFLDSLMNSVLYRDKYDALSAHVTKGLNVLLAFAGMRVDDLVECDTFLAVDQVLVKWLIGRLVSEDIGAIANGLTIPELCEKRVKMHFGRKTGKTYQMLSSACSMVKEADYHAADGLKPIIDRYLAADYNMDRQYRKFYYYYDQLESTESFEPLRELVENIYTNEYLACLLPAWNAGIQTDGAFSAIPLQREFYNANLRYTKERTVVIISDAMRYEVGQELFARMQDDPKCTAKLSVQLSVLPSYTRLGMAALLPHKTLEMTDDFQVLADGILCDDLAGRQQVLQSYNPDSVCVQFDDIKNLKVAELRDVLTKRQIIYVYHNQIDARGDKANTEDEVFNACEEAVQEIMDLIHRISVSGNTYHFIVTADHGFIYKRDKLTESDKISGKSAEKAFVNRRFIVSKAALEDDGIDHMGMGRVLGNEDSKVVSYPVSSNVFKVAGGGANFVHGGSSPQEMLVPVLEFKMERGHMETKNAEIALVSIVHKITNLITSMDFIQSDAVSDTVKAAKYRIFFLSEDNEKISNENSYVADSREENAQKRIFRMRFTFKNKKYDKDKQYYLVVYDEESGLEQWRQHVIMDIAFADDFGFGF

SEQ ID NO: 2249 - protein, 767 aa, Vibrio cholerae; identical to SEQ ID NO: 1828

SEQ ID NO: 2250 - protein, 700 aa, Eubacterium saburreum
MAELNLKQIIDRLNAEFTGETRKLVFWYDDKAEFAEDMETVELQNAKIYHLQPDNQFYTKYFLERVDKTTNYLIYAPFLKPDVRDNHLEDTCAYSRRFFADRASLLSVDLGIEEKYKPVIEKHIKFFANKERTQRFYDLEIENFNEENILVGLLSAVCKARTCSFEEVVRIVLTDGELVDNAFLQEFEKYDLLSAFWQLCEQHFGYTDTKPSLERLLVTLFVTYTGRYVQAELPAAWKSFVSYKSGNIIAFLDSLMNSVLYRDKYDALSAHVAKGLNVFSAFAGMRVDDLMECDTFLAVDQVLVKWLIGRLVSEDIGAIVNGFTIPELCEKRAKMHFGRKTGKTYQLLSSAYSMVKEADYHAADGLKPIIDRYLAADYNMDQQYRKFYYYYDQLESTESFESLRELVENIYTNEYLACLLPAWNAGIQTDGAFSAIPLQREFYNTNLRYTKERTVVIISDAMRYEVGQELFARMQDDPKCTAKLSVQLSVLPSYTRLGMAAVLPHKTLEMTDDFQVLADGILCDNLAGRQQVLQNYNPDSVCVQFDDIKNLKVAELRDVLTRRQIIYVYHNQIDARGDKANTEDEVFNACEEAVQEIMDLIHRVSVSGNTYHFIVTADHGFIYNRDKLTESDKISGKSAEKAFVNRRFIVSKAALEDDGIDHMSMGRVLGNEDSKVVSYPVSSNVFKVAGGGANYVHGGS

SEQ ID NO: 2251 - DNA, 3450 bp, Halorubrum lacusprofundi
atgctggcgctcgtagacacagttccaacatcctgcgtcttcgtgtgtgacgctttctatgacaccctcgaactctgtacctatctcatccccgacgaggacgaccaagacgcctcctcgttcgaccatccctcggaactccgcgtcatcgaccctgcctgtgggagtggacacttcctgctctacgctttcgacatcctcgagcgaatctggtgggccgagactgacctcgaccgcagcgagattcccgcgaaaattctcgagcacaacctctacggcgtcgacatcgacttacgctcctgccagctctccgcgttcaatctctacctgaaagcccggacccgtgcagaagaagagaacgggaacttcgagatgcccaacgttggtatcgtctgtgccgacgctcgcgtcgccgaggtcgaggaggccgtcgatgtccttgaccagattacaggcgaaggaacggacgttcgcgaggcgctcgacgaaatcatcgaagagttccagacgaccgaggcgctggggagcctgctagacgttcagagcacgctttcagaggagttcatggaggagcagacggacattatggattggggcggtgaggggccgcatacgttgaacgggttcctgagacagctacgggaggccgttgacgagcgtacatccgattccttcggcgaacagaatctccggagtttcctgaatctgctagtggtgctgacgcaggactacgatgtctccctgatgaatccaccgtacgggtcgggcggtcgaatgccgaatcctgtccaggattacgtggaagaccactacgagtacacgaccgaatactacatcaacttcttcgaagcgtgtgatcggctggtgaaacctgacgggcgtatcgggatgctcgttccgtggtcgttcatgttcaacaagtccttccaggacttccgcgaagacttcgtcggcgggcgtggatcgtttgatttcttctcggaattcggctatgacatcctcgacaacgcgactgttgggactgttgggactgtcgtccgatctgagactgagagcgccgtccgatctccctccgagagcgaacaaactgggacatttatccgtcttccagatgtgtcgaaagctgaaaaagagcagaagttcctcgaatcgtctttcgtagagtccgaatcggaggtccaacgactgtatcagcgtaacctctccgagttcgacatggttccaggaactccactctcgtattgggttcccgttgagttgcgtgagctatacgagtcagaaaccgtgcttgacgcagataacgcaggtctaaaagaacgagagacactaggagatatcaaacaagggattgcaacagctgacgattctcggtttgtccatcagttctgggagaacacagacacacctgcttgggcaccatttgcaaagggaggcgcagactcttggattcttccgcgagttaagcggacagtttggtgggggaaccagggtgcggaaataaaacggtattacggctcgcgtccacaaaatacggaatattactttaacgaatcactcacgtataccgtagctaagcgaagtggaaggcgatttgggtacttgcatgaatcatctatcttcggccataagggatccgtactagttcctgaccgcgccatctggaacgctctttcatacacgaacagccacctgttcacctatctgatgctcactcaaacctctgaacggatgtgggaggttggattcgtttcaaaggtcccgtggcgagaggaactcgaagctattgacgaactcgaggcactctcacaagaagcggtcgggcatctcatctcaaagcgtcagtacgacttcgtctcaccccattacgacgggccgattctcttggatgtactcggcgtagatgacccactcccgcagtacgatcacccccaccgtgaactacgcgagaggctcattgtcaacgaaccagaaagcactgcctcggcaaattcctcgctcaccgatattggtaccgcagcggcaaaacacctcgaacggatagaggcagatctccaatcctgtgcagacgcaatcgatgaggcagtcttcgactgctttgatatcaccgattaccagcgtgagaccgtactccaagagatcgccctccggactatcgaggatccgcgtgagcgcgaggaatacgatccggagtccataacggaacccggtgacgacttccctgagatggtgaaggatctccttctccacctcgcaatccgtaccgttcacgaggacgatgatggcatcgtcccactttccgatgtggacggtgaagatggtctcctctcccggattgaagacgagttcgatcggctctttagcgagcacgcttcggcacgcctcgccgaggtcgaccagattctcgggagtcggaccgccgacgaagaagcgtacccgaaccttcgcgaatggctcgaagacgacctgttcgactaccacgtctccacgttcgaccggacaccgattctgtggcgactaacgaccgaacggctcgtctccgacccagagggtgaaggcttcgcctgtcttgtggactaccatcagcttgatgctggtgtcttcgaccgtcttcagaaccggtacctcgaaccgcggaaagccctcctccgggaacggcgtagcgcagcgaaccgccgacgtggcgacgactcgctgtccgcgtcggagaaagcagccgctgcagaggagtatgcacgatccgagagcggcctcgaacagattgacgtattcgaggaacgactgtccgagttggcacagtcgtcgccgcgtgagtggcccgaagcgaaccagcagactgctgaagaggcggtagagacggtagctgacttccgcgaagagacggcatctcgtctggaaacactcgaagagttggctgcaatcgacgacgtcgatatgggcgatctcttcagcccgtcgttctacgaaacggttcagaaaaaccaggacgagtggttggatgcgcttgacgacctcgagtctgctttcgaggcgtatgcggccgatggttccgagccagtcgaagcccatctctacgatcttttcgagtattacgacgatctcgtcgggtccacgcactacgcgagcaatggcatcctgttcatgacgtattacttcgggaagttcgaagacgccggacagtcccagatcggggacacaggggtgtcggagcgccagcgtctcctctcagagttagccactggcctcgattcgtacgagaagctcgcgaacgaggtctccgaaacctgtgataccctcgcgagtgacgtttcttccgactgggaggatcgagcgctctccgagataacgacttcggggtaccgaccgaatcgaaagcacggtgtcgagatcaacattcggccgctcgccgaagcgaaaatcgtcccgaagacggtggaagacgacgttctctga

SEQ ID NO: 2252 - DNA, 867 bp, Halorubrum lacusprofundi
atgactgacgattcactctctcaacggaaggcgcaactggacaaagccgaacgcgaacatctcgaggacgtcgtcgaagagctccgcgagcgcgtcgaggacaacgtccgatatcaactcacgcagaaaggccttgacgacgagccggagggtccggatacgctggacgaggacatcgagcagcttgtcgaagcaatcgaactcgaaggcgtcgacggccacacgtgggacgaggcgttcgagcagtacgtcaccggcgtcggctacaccatcgtcaaccgcctcgccgcactgcgctgtatggaggtgcgtgacttcatcgacgaagaggttacggtcttcaaggagaacggcctgacgccggccgctgagacgctcgttcacgaggagttcctcttagaggacgaggcgattctggaagcctaccacaacgcctgtgatgagttggccgaggagatcgagatcctcttcgaccggtcatcgtcgtacagtctggtggacccggacgacgacacgttcgaggcactctgcgggatgctcgatgacgttccagacgaagtgtggcgagcggacgacgtgctcgggtgggtctatgaatactacaaccgccctgtcgtcgaggcgcttgacgcgaagaacacgctcgaacctgacgacgtcggcccggcaaatcagttctacacgccccactgggttgtgcggatgctcgctgacaacagtctggggaagctctatctcgaagcgaccgaacaagagtcgtcagttcccgcggctgaagaactctccattgaggaaagaaaagagcgcctcgtcacgcccgaagacgcaccaggcgttcccgaactctgtgagggtgtcatagaatag

SEQ ID NO: 2253 - DNA, 4326 bp, Halopiger xanaduensis
atggacggacaatctacccaaccccggaaggcccagctcgacaaggaagaacgcgagcatctcgaggacgtcgtcaccgagatgcgcgaccgcgtcgaggcgaacgttcgctaccagctcgaggacgagtatgacctcgacgagaaaccggacgacgatgcgtccctaagcgaggagcaggaagacctcgtcgaggctatcgaactcgaagccgtcgacgggaatgattgggacgacggctacgagcagtacatcacgggcgtcggctacacgatcgtcaatcggctggccgcgctccgttgtatggaggttcgtgacttcatcgacgacgaggtcacggccttccgcgacgacggcctcacgccagccgccgaccggctggtcaccgaggagttcatgctcgaggaggaagccgtcctcgaagcctacaggaacgcgtgcgacgatctcgctgaggagatcgacattctcttcgaccgctcaacggcctacagtcagctcgatcccgacgacgacacctacgaagacctctgtgggatgctcgatgaggtatctgacgaggtctggcgggccgacgacgtactgggctgggtctacgagtactacaacgtcaatcttcttgacgatcttcgacggaagggcgaccgtgaaggactagagcctgaagacgtgccagcagcgaaccagttctatacgccgcactgggtcgtgcggatgcttaccgacaactcgctagggaagctctatctcgaagacaacggaacgctgcaggagacggttgatagacaggactcactgacgcccgacgaacgtaagaatcgcccactatcccccgacgagtccccagatattgcggatttctgtacctatctcgtcccatctgaagaggaaggtgaaccaccggagttcgacggccctgaagacatccgcgtcattgacccggcctgtggaagcggtcacttcctactgtacgcgttcgacgtgctggagcgcatctatcgggccgaaacagatctcgaccacgccgaaatcccacgagagattctgcggaacaacctctacggcgtcgaccttgatatgcgtgcctgccaactcgccgcgttcaatctctatctgaagggccggacgcgggccgaggccgagggcgcgagcggcttcgatatgccggaggtcggcatcgtctgtgccgacgcgaaggtggccgacatcgagggcgttgaggaggtgttcgacgaggtggccgacgggaagtcagacgtggaggatgccctccggcgtatccttgatgcgttcgaggaagttcacggcctcgggagtctgctggacgtgcgtgggacgctcggcgacctgttcgaggacgacagcgagcaggccggggttcagattacgctcggtgacgacccgcgggaggatcacacgctcgggcagattctacacagtctgcgtgatgcagtcgaccaacaccgggaggaggattcgttcttggcgcaggacttgcgaagcttcgtccgactgctagacgtgctggcacaggactatgatgtggcgttgatgaatccgccgtatgggtcgaagaatcggatgccagacgtggtgcaggattatgttgaagagcactatcgatactcatctgagttttatatcaacttcttcgaggtctgtgatcgagtgtctaaggaggatgggagaatcgggatgctcgttccccggagctttatgtacaaaaaccggtatcaagacttccgcagtgactttattggagatgaggggagtttcgacttcctagctgaatatggaattggcatcttggacaatgccaccgttcggacagtaggtactgtagtccaatcaggagcaaatcaggggtctaaggggtcgttcctccgacttcacgatatacaaactgagcagaaagagcaggtattcactgaggttctctctgattccaacgataacgaggtgattcgtagcttcgatattgaactgcaagagttcgataagatacctcgcaccccaatttgttactctattcctcaagaaatccgcgcgttgcacgaatgtgaaacaaaactggacgcagagcacgcaggggtagatggagaatctatctgtaacgcagttccgggacttcaaacagccgatgatgaccgtttcgtcaggcgattctgggagattgacgattatgaggttttcaaaccgattgcgaagggtggagcagatgcatggctagtccccccggtcacagagactgttgagtggagtgggaatggaaccattcttaaacgttccagcaagtcgatcagaactcggaacgaatcgctatatggcaacaagggactgagttggacttacataaaggatacaggtcgtcgattcgggtattatccgggaggcttgttcagccatactggttttatgctctttcccaaaacggagaagtctctttggaagatgatggccatactgaattcgactctctaccacaatctctttctctcactgacgacagagcggcactggaacgcaggcgaggttggtagtgttccgtgggtcgaatcgattgataagcaagacgggttggagtctgcggctcgcgagcagtacgaaattatggtggaacagcgagcaaatgatccatcgagtccctactatacagggccgagcctacttcctacggaaagcggcgattcgttctactcgcacccacattcgcgaagtctgtcggaatctgaggcctcaatcgatccaagcaccatatcggtaagtgacccaatcagacctgctgcacgaaaggaggaacaagcccgactgaagcggcgtcagcagctggagaatctatccgagcagatagattctcaggtgttctcagcgatcgagctttccagcgaagttcaggatagagcccgacaggagatattcctccgaacatccgaagaccccgaagatcgcgaagtccccaaccccgaatccgtccctgaagtcccggacaaccttgacgaacaggttaaagaccttgtccaccacttcgcgatgaaagccgtccgcgaggaatccgacggcatcattccgctcgaaggtacggacgagcaggccgacatgctcaaccacatcgtcgagcaattcgaggacgcgtacggcgagcacgccgaagaccgcctcgtcgaggtcgacgatattctcggggccgagtccgccgccgacgaggcgtaccccaacctccggtcgttcatcgaggacgaactcttcgcctaccacgtcgacacgatggagaacacgcccatcgtttggaagcttagcacggcgcggctcctcgccgacgcgaagggcgagggcttcgcgtgcttcgtcgactaccaccaactcgatgccagcctattcgaccgcctgagcaaccagtatctcgaaccgcggaaagccgaactccgcgagcgtcggtcggcagcgaaccaacgtcggaacaacgagtcactctccacaagcgaacgcgctgaggcgaccgacgagttcgagttctgctccagtgcgctcgaacagatcgccgaactcgaagaggtgatgcaggaactcggctccaccagtgagcgcgagttcgacgacgacgatcgcgaacgcgtcagcaagctagcccccaaggtcgccgcgttccgcgaggagaccgcggagcgcatcgagacgctcaaacgactccgcgaaatgaacggcgaggagtggttccaagacaccttctccgataatttctggaacgccgtcgacgagtggcgtgacgagtgggtggacgctcttgaggaactggaacacgcttgcgaggagtacgccaaacccagcgacgagcccgtcgaagcccaccttgccgacctcttcgactacttcaactggcggctcaaaggctcggatcattactccagcacgggcatcctcttcatgacctactacttcgagcgcgaggggagcgacctcctcgacgacgatggtgagccgttcgataacctcaccgaggatgagaagctgctcgcctcgctcgcgacgggtatcgacgacgcatccgtccttgacgaagagtacctccaacagattgcggatgatgaaggcgtcgacaacgtggacgagttaccaccgctagcggagttcaaggcgctcgctgaggaaatcgatgaccgctgtcagacggtggataagcagattccctcggactggtcggatcgtgcgctatcggagatcacgacagcgggttaccagcctgtccacaagcacggcgtcgcgatcaatattacaccgctcgcggagaaggacatcgttccggaggtagtcgaagacaaggtactgtag

SEQ ID NO: 2254 - DNA, 3678 bp, Salmonella enterica
atgaataccaataacatcaaaaaatacgctccacaggcccgtaaccagttccgcgatgcggtgatccaaaagctaaccacgctggggatttccgctgataaaaaaggcaatctgcaaattgcggatgccgagctcgtcggcgaaaccatgcgctatggtcagttcgactaccccaaatccaccctcacccgccgcgatcgtctggtaaaacgcgcccgcgagcagggctttgacgtgctggttgagcactgtgcctacacctggttcaaccgcctgtgcgccattcgttatatggaaatccacggttatcttgaccacggcttccacatgctctcgcacccggataacccgacaggctttgaagtgctggaccacgtaccggaagtcgcggaagcattactaccagagaaaaaggcgcagctggtcgagatgaagctttccggcaaccaggacgaagccatctaccgtgaactgctgctggcccagtgccacgccctgcaccgcgcgatgccgttcctgtttgaagctgtggacgatgaagctgaactactgctgccggataacctgacccgcaccgactccattctacgcggtctggtggacggtattccggaagaagactggcaagaagttgaggttatcggctggctgtatcagttctatatctctgagaaaaaagatgcggttatcggtaaggtggtgaagagcgaagatattcctgccgccacccagctgtttaccccaaactggattgtgcagtatctggtacagaactccgtcggccgccagtggttgcagacctacccggattcgccgctgaaaggcaaaatggactactacattgagccagccgaacagacgccagaagtgcaggcgcagctggccgccattacacctgccagtattgaaccggaaagcatcaaagtactcgacccggcctgcggctccgggcatattctgattgaagtctataatgtgctgaaaaatatctatgaagagcgcggctatcgcgcccgcgatattccacagctaattctggaaaataatatttttggtctcgacattgacgaccgtgctgcccagctttccggctttgccttattaatgatggcccgtcaggatgaccgccggatattcacccgcgacgtgcgtctgaatattgtctccctgcaggagagcctgcatctggatattgctaagctgtggcagcagctgaacttccaccagcagaaccagactggtagcatgggggatatgtttgccgaaaatacagcattagcccataccgacagcgcagaatatcagctgctgatgcgcacgctgaagcgctttgtgaacgccaaaacgctgggctcgctgatccaggtgccacaggaagaagaggcggaactgaaggcgtttctcgaagcgctatatcgcatggagcaggaaggcgatttccagcagaaggcagcggcgaaagcgtttattccgtatattcagcaggcgtggatcctggcgcagcggtatgatgcggtagtggcgaatccgccgtatatgggtggcaagggaatgaatagtgagctgaaagagtttgccaaaaataacttcccggatagtaaagctgatttgtttgcaatgtttatgcagaatgcattttctttgcttaaagaaaatgggtttaatgctcaagtcaatatgcaatcatggatgtttttgtcaagttatgaagcactacgtaactggttattggacaataaaacatttattacgatggcacatttgggagctcgggcttttgggcaaatttctggagaggttgtacagacaactgcctgggtgattaaaaaccaacactccgaacgttaccaacctgtattttttagacttatagatggtagggaagaagtaaagaaaagcgatctacttctaaggaaaaatatatttgataaatttacacagcatgattttaaaaacataccaggaatgccaatagcatattggatagacttgccgagtctattatcttttcgccaccataaaaaacttggagaaaaaatagcattaaaagcaggcatgtccaccggtgacaatattaaatttcaaagatattggtacgaggtttcaataaaaaaaacccttatcacaaataaagaatcaaatacaaaaatcgacattcataatatcaaatggtttccttgtagtagtggaggtgaatatcgaaagtggtatggtaataacgaaatagttgtaaattgggaaaataatggttacgaaatacgaaattttaaatttgagaatggcaaaactcgctctgccgtaagaaatgatgagtattactttagagaaggcataacatggtcaaaaataagccaaggtaatttttgcgtgagatatcgtccaaaagggtttgtttttgatgatacaggccgttgcggcttttcaaataacaaaaatgagttgctttacgctgcgggattaatgtgcactccggttgtaaaccattatttatcaatactagcccccacacttagctttactagtggtgaattagcctcagtaccatatccagaaattgaagatgaaattatcgaattagtcaccaatgctattgaaatagctaaaaatgactgggactctcaagagcaatcatgggattatgtttgttcaccattgcttgaacacaattcaactcaattgctacggaatatctacaaacaaaaaatcaatacaaatatcaagttagtcgaaacacttctcctaatagaaaatactataaataatatttttatagataaattacaacttgacaaaactataattaaagctgtattgcaaagtgaaataactctactatgtaatccaaactatcgatataaaaatattcaagatcataccgatctaaccaataagtattacactgatatcactatagatatcttaagctacatcatcggctgcatgatgggccgctactccctcgatcgcgaaggactggtctatgcccatgaaggcaataaaggctttgccgaactggtcgctgaagacgcgtacaaaaccttcccggctgacaatgacggtatcctgccgctgatggatgacgagtggtttgacgatgacgttacctctcgcgtcaaagagtttgttcgcaccgtttggggcgaagaacacttgcaggaaaatctcgaatttatcgccgaaagcctctgtttatacgcgataaaaccaaaaaaaggcgaatctgcgctggataccatccgccgctatctttccactcagttctggaaagatcatatgaagatgtataaaaagcgtccgatatactggctgttcagctccggtaaagagaaagcgtttgagtgcctggtctatctgcatcgctacaacgatgcgacgctggcgagaatgcgtaccgaatatgtagtgccgctgctggcgcgctatcaggccaatatcgatcgcctgaacgaacaggtcgatggagcctcaggcggcgaagccacccgtctgaaacgtgagcgtgatagcctgagcaaaaaattcaacgaactgcgcagcttcgacgatcgcctgcgccactatgctgatatgagaatcagtattgatctcgacgacggcgttaaggttaactacggtaagtttggcgatctgctggcggatgtgaaagccattaccggcaatgcaccggagattatttaa

SEQ ID NO: 2255 - DNA, 3684 bp, Clostridium sticklandii
atgaacaaatcagccataaagagctttgcaatatgggcgaggactaaactaataaatgaaatcacatacaaatcaggactcataggaataacagacaaggggatatcacatccccttgattcttctactgacaatatccagcattttaacataggaacagaaaaaccctatgaaataaaagatagagaaataaaacaaagagatgcctacataaagagaataaaagaaaaagaagctacctcagactacaatactgcatttaactatatcatagaagaaatagcctacacttggtttaatagactcatagctatcagattcatggaagtaaatgactatctcccatcaaaaacaagagttctatcaagtgaaacaaaaggaaaaatagagcctgatatggttacatctccatttgatacagatatggaatttacatcagaggaaaaagactacatcatcagcctaaaacatgacaacaagctagatgaactatttagattcctatttataaagcagtgcaataccctaaatgcagtactaccagagctgttcgaaaaaacctctgactacacagagctactacttaccatatcatttacagatagcgatggcatagtaagccacctagtaaacgatatcccagaagaagacttcacagaagcagtagagataatagggtggctgtatcagtactataacactgagccgaaagatgaagtgtttgcactacttaaaaagaatgtaaaaatcacaaaagagcgtataccagcagctactcagctatttacaccagactggatagtaagatatatggtggaaaactccctaggaaaattatgggtagaaggacatccaaacaatgaattacaatcaaactggaaatactacctagaagaagcagagcaagaagaccatgtaaaacaagagctagaaaaaataagagaagaatacaaaaaactaaatccaacagatataaaagtgattgatccctgtatgggaagtggtcacatactagtctatgcctttgatgtactcatgcagatatatgaaagccaaggctacacccaaagagacgccgcaaactcaatcatagagcataacctctatggtttagatatagatgacagagcctatcaactagcttattttgctgtgatgatgaaagctagaaaatacgatagaagattcctaacaaaagaaataaagccaaagctctatgcaataaaagaaagtaatgaaataaacaaaaaccatctgaaatatttcggaaattcactaagcgatatagaaaaaaacctagcaacatcacaggtagaatatctcatagatacatatatagatgccaaagaatatggctctattcttaatgtagataattgcaactgggaactactgtatagatttatagaggattttaatatagaaggtcagatgagcctagactcagtaggagcagaagacaccaaaaaatcactccaagaacttatacctatagctcatgctatggcacagaaatatgatgtagtaattacaaatccactgtatatgggtggaagtggtatgaatacaaaagtatcaaactatgtaaaaaaacactacccagatagcaaatctgatttatttgctgtgtttatagagaaatgcatgaacatgacaaagaaaaatgcttttcaatctatgataactcaacatgcatggatgtttttatcaagctatgaaaaactacgttcaaacataattaaaaatgattttatatctatggctcatctaggagctagagcatttgaagaaataggtggagaagtagttcagaccacatcatttgtattaagaacttcagatattaaagattataaagctaactttgtaagactagtagattttaattctcaaattttaaaacaagaagcttttcttgcacatcagaatatacatacagcaatcaaagaaaacttctcaaaaatccctggttcaccgattgcgtattgggcaagcaacaaaattttatcgctatttaatcaagtaaaattaaaagatgtagcaacatttaaagagggaataacaactgcaaacaatgatttatttttgagatattggtttgaagtttctgaattagaattttcaatttccacaaaaaataaaacatttaagtggataccatataataaaggtggaacatatcgaaaatggtatggaaatagagattatgttattaactgggaaaatgatgggatatgtataaaagaatatactggctcatcttttagaaatttcagatttcagagaaaagaaggtgggacattttcagcattaacatcaggtggattatcagcaagatattctgaagaaggatttgcttttgatagtaagggaacaatgtttttttctgatataaaattgaagaatatattatgctatttgaattcaaaaattcttaataaacttttaaaatttgtttgcccaacattagattataggtttggaacaattgaaaagctaccttttttagacattaattatgacatcaataattgtgtaagaatttccaaaaccgactgggactccttcgaaacctcatgggattttagaaagcatccattgatagacgaagctctccttatatccgatatggatgactgggaagaaatggataatagttcagatttagaaacgagtcctgagattgagattttctttgatactggagtagatatagtaagtagccgtatagcaacttcatatgaaatgtatagagattttactgaaagacagtttaataaattaaaatcaaatgaagaagaactaaatagaatctttatagatatctatgggttacaggatgagcttacccctgatgtagaggataaggatgtaactatatatcgtatttttgatagtaatgaagctataccagaaagtatgaagtctagtaggtattctcttacaaagcatgatgtgatagttagctttgtttcttatgctgtagggtgtatgtttggtaggtattctctcgatgtagagggactagcatatgctggtggggactgggatgatagcaagtattctctttttattccagatagagataactgtatacctatcacagatgaagagtacctagaagatgatatagttggtagatttgtagagtttgtaaaggtagtctatggagctgatactctagaggagaacctagactttatagcggatgcactagaaactaaaggaaatacttctagagagatgattaggaattattttgtgaaggatttttacaaagaccatgtaaagacctatcagaaacgccctatctactggctatatgatagtggcaagcaaaatggattcaaggctctagtgtatatgcatagatacactgctgatactactggtatagtgcgtgtagattacttgcacaaaatccaaaagatatatactagtgagatagacagaatgaaagatatggcagaaaacagtgacaatgctagagaagtagcacaagcagaaaaaagaaaagaaaagctaataaaacaactaaaagaaaccaaagaatatgacgaaaaaatcgcccaccttgcacttagccgtatagcaatagacctagatgacggagtaaaagtaaactatgaaaaagtccaaacagcacaagacggcaagaaactagagatactgggcaaaatatag

SEQ ID NO: 2256 - DNA, 3627 bp, Photorhabdus asymbiotica
atgaatacttccaatatcaaaaaatacgctcctctggctcgaatccagttctgtcatgccattacccaaaaactgacatcgttagggattagtgttgataaaaacagtgacttgcagattgctgatgttactgaaataggcgattgggtccgttttggtcgctatgaatatcctaaaacggtattggcgcgccgtaatcgattagttgaacgtgcgcatgtacagggttatacccaattaattgagcatgtcgcctacacttggtttaatcgcctgtgcgctattcgttacatggagctacatgggtatctggatcatggtttccgtgtgctatctcatcctacagatcctattggttttgaggtattagcgcatgttccagaggtggttgggaacctggcgttaagcaatcctcagcagctggtggaaatgaaactagcgggtgatcaggatgaagcgttgtatcgcgagctgttgttaggacagtgtcatttcctgcataaagctatgccgttcctgtttgactcgctaaatgatgaaactgagcttctgttgccggataatttgacacgcactgactcgatcctacgcgggctggtggacagtattcccgaagaggactggaagcaggtagagatcatcggctggttgtatcagttttacatctctgaaagaaaagagcaggttattggtaaggtcgtgaaaagcgaagatattcccgcagccactcagctgtttacccctaattggatcgtgcagtatctggtgcaaaactctgtgggtcgccagtggttgcaaacctatcctgactctccgctcaaggagtgcatgccatactatattgaacccgcagagcagattgccgaagtgcaggtgcaattagcgaccattacaccagatagcattgaaccagagagtattaaagtacttgatcctgcatgtggttccggtcatatcctaatcgaagcctacaacgtgctgaagcgaatatatgaggagcgcggataccgccgtcgtgaaattccgcggttaattctggaaaataatatctttggtctggatattgatgatcgtgcggttcagctctcaggttttgtgctgttaatgatggcgcgtcaagacgatcgtcgtatctttacccgtaatattcgcctgaatgtattgtcgttgcaggaaagctcccagctagatatttcagctttgtggcaggggattaacttgcatcaacaaagctgtaccggtagtacttttgatatgtttgctcagaacgagatcagcactaatagccaaagtgctgatgaatatcaattgctggaaaggacgttagcgttatttacgcaggcaaaaacctttggttcattgattcaggttccgcagcaggatgaggaagcgttggaagtgttgttacgacagctcattgagttggaagctagtggtgatactcatcagaaagaggctgcgcgtatcttaattccttttatccatcaagcatggttgctggcgcagcgctatgatgtggtggtagcgaatcctccgtatatgggcacaaagggaatgaatggtgatctgagagaatttgccaggaagcagttccctgacagtaaatcagatttgtttgcgatgtttatgcagcacgcatttagtttgttgaagatgaatggctttaatgctcaagtgaatatgcagtcgtggatgtttctatctagctacgaggcactacgtgaatggctgctagatactaagatttttgtcactatggcgcacctaggctctcgtgcatttgggcagatttcgggggaggtggttcagactacggcttggataatgagtaaataccatgttgatggttatttgccggtatttttccgtttgattgaaggaggggaggaagagaaaaaaagtttgttaatagaaaagaaaaaccgttttgataaagttaaacaggatagtttcagacaaatcccaggagtaccgattgcgtattggatctctacgggattgatgaatctttttaaaagtaatttacctatggaacactatgctgatataagcacagggctaagtacaggaaataatgatcgatttcttaagatgtggacagagattaatcatttgaatagagattgggtcccttgtcaaaaaggtgggtcgtatagaaagtggtatggtaataatgaatttgttattgattggggaaataatggtgaaagattaaagaaattcaaaggatctacgttaagaaatgtccataattattttagggaagggatttcatggactagagtatctagtgcaagtacagcgttcagatattttgaagatagttttatttttgaatcgactggccctagcctttttccaaaagaaagcgataagaaaacactgtacttctttgctggattattaaattcaaaactcgcaacagtattattagaatttattgcacctacattagattttctaagcgggcatattgctaagctgccttgtcttcaaggaaattggattgatgttatttctgaaaattcatctaaactcattaaaattgctaaagaggattgggataactatgagatttcttgggatttcaaaagaaatccaatggtcgaaaataatgaaaggaggttgttatcatcatataaaaaaatgagagctgatttttcaaataatattgaaataatgaaagatcttgagtttgaaaataattcggtcattgtaaaaaatagttcattagagcaagatgtctgcattgatatagttttaaatgagataacattaacctgtaatccacattatcgttacggtaacgaatcaacagagcaagaattggaaaatcgtctccaatccgacaccttagccgagcttatcagctatatcattggctgcatgatgggtcgctattctctcgatcaagcaggtttagtttatgctcatgcgagtaaccaaggttttgctgaattagtagcacaaggtgcctataaaactttcccggcagataacgatgggattcttccactgatgacttccgactggtttgatggtgatatcactgtacgagtgcgtgagtttgtccgtaaagtttggggtgaggatcatctacaagaaaacctcgactttatcgccaaaagcttgtgtttgtacgcgatcaaagagaaacgcggtgagtcgtcactggagaccatccgtcgttatctttctagccaattttggaaagatcacctcaaaacctacaaaaaacgcccgatttattggttgttcagctctggtaaagagaaggcatttgagagtttggtatacctgcatcgctataatgactccacgctggctcgtatgcgtaccgaatatgttgtgccgttgttggcgcgttatcaacgtcatattgatctcctgcaagaccagcgcgatggggcatcatctgctgctgaaactaatctcttgaagaaaagacaggaaggtttcaccagaaaatttaatgagctgcgcagttttgacgatcgtttgcgccactatgcagatatgagaatcacccttgatctggatgatggcgttaaggttaattatggcaagtttggtgacttgctggtggatgtgcaagttatcactggcaatccaccggaggtagcgtaa

SEQ ID NO: 2257 - DNA, 2016 bp, Acidiphilium multivorum
atgacactattcatccgagctgtcgccgccgaggacaaagcggccgcgataaagcgggcgatatcgggcgattccgctgataggttcgcacctgaccttgatcaattcaagcagctacccggtacgcctttcgcttactgggtcggtgctggtgtgcgtgcagctttccagcgctttcaaacggttgagggcaatgggagggctgttcggcaaggcctggcaactgccgatgactttcgttttgtaagaacgcattgggagattgaccctcgggaccgcggcaagaagtggtttcctttcgccaaaggtggacgactttcgccgttttatgctggcatccatttggtcgtgaattgggccgatggcggggcagagatcaagaacaatctcaatgagaagggtaatgtcagatctaatgtttggatgctccgcgatacagctgcaaactattttttcaaaggcgggctaacctggcctcttagagcgagtaagttcgcgccgcagccattacccgctggatgcattttttcggtgagagggtattctgtctttcttgaagaaatgctgttattgccttctcttgccatttttaatagcaagccgtttgactacatattcaaagctctgcttggtcggtttggatatccagagttcattgtcggcgttctgcaaaagttgccttgggccgagccatctgtcgagcaagccaatgacttggcggctcttgcgaggagtgcttggagccttgcgcgaaccgctgacacggcggtggaaacatctctggcgttcacactccccgcgcctctcaatgctgcggacagcgttgccgccgtgacgagcaagctcgccggattgcaatcgaagatcgatgcgatttcattcgaattgtttaacctggatgagagcgacaggactgagatcgaaggtgcggccgtcttcgcttcagccgaaatcaatgaagataacgatgaaagcgaagacgacaattcagaagtcgctgctgctgagaatgcacagttttacgttctatcctggtccgtcggagtcgcattcgggcgcttcgatatccggcttgcgactggagagcgctcaattccgcctgagccggagccatttgacgcattgccggaccgtagcccggggatacttccgagtggcgccgctccgtttatgccgtgcagcggcatatttgtcgatgaccccgggcacgcggacgacctaatttcgcgaattatcgctgtctatgaacgcgtaggccagccgtggcccgaaccagctgccctgcggcgcagcttcgctcgggaattcttcccgggtcatatcaaaatgtacactaaaagccgccgaaaggcgccgatatactggcaactagcgactccgacaggaagttattcggtctggctctatcttcataccctaaacaaggacacgctttttcgggctcagacggactatattgcgccgaagctcgcgcacgagcagcgccaactcgatcagctgcgggccgactccggaccaaacccgagcgcctcacagcgaaaagcaatcgaagcccaagaagctttcattggtgaattgcaagctctcctcggcgaggtgaagcgtgtggctcccctttggaatccgacgctcgacgacggtgtggtgatcataatggcgccgctctggcggctcgtgccccagaacaagccgtggcagaaggaacttaaggcgaaatgggacgaactcgccgcaggaaagtacgactgggcgcatgtcgccatgcatctgtggcctgagcgtgtggtccccaaatgcgccactgaccgaagcctcgccatcgcgcacggccttgaagaggtcttctggaaagagggagataatggagattgggtctcgcaatcgtcgccgatgcgctcgatcgaggagctcgtacacgaacgcacatcggctgcggtcaaggccgcgctgaaggagctgtctgaagcttcggcaccgaatggcgcgaagacccgagcacggaggtcatcatcatga

SEQ ID NO: 2258 - DNA, 1923 bp, Acidiphilium multivorum
atggataaggcgacgcgaaacgctatcgagcgggcgacccagcaggcgcggaagctgttggacgaggatttttcgtcacagctcgaaggcacgttcgacgtgttgcgcagcggcgtgatcgctccagccggtggcgcgcatttaacggcccgccagaagtttcagcgggacaaaatcgtcgcgacgatcgaacacaagcgggccgctggggccaccgccgttgaggcggtcaccgactatgtaagggattctgcgttcacgacgctgaaccggttcgtcgcgctcaaaatgctcgaagcacgccagcttgtgcaggagtgcatttccaaaggcgaccaatcttctggattcaaggagttctgcggtatggcgccgggcgtagcgctgctacccgacgccgccggttatcgcctttatgttgaaagcctgttcgacgagttctcgactgagatcaaggtcctgttcgaccggcgggatgccgcctctgtcctgtggcccaagcggcagacgttcgaagcattgctagccctcctaaatgcgcctgacctgtcgggagtttgggatgaggatgagacgatcgggtgggtctaccagtttttcaatagcggcgaagagcgcaagaaaatgcgcgacgagagccaggctccgcgtaacagccgcgagctggccgtccgcaaccagttttttacgcctcgctacgtcgtccagttccttgtcgacaacacgctcggccgcctctggctggagatgcacggcgtgcaatctcgattgaccgacctctgcgaatatctcgtgcgctccgccgatgacacggtccaggtacgtccgaagaaggatccgcgggacctccggattttggaccctgcctgtggctcagggcatttcctcctctacagcttcgacctcttgctcgcgatatacgaagaagcctggtccacggaggggccagctcccgcaagtgatgcgactggccgatccttgcgcaatgattacgctgatctggccgatcttcgacgatctgctccgaagctaatcgtcgaacacaaccttcatggcgtcgatatcgacccccgctgcgcgcagatcgcggctttggcgctatggctgcgggcacaacgcgcgtggagggactttggcgtacccgcgtctgatcggcctcgaatccagcgcacgcacatcgtagtggcagaatcgatgcccggagacgctgcgcttgttgacgaattcgcagcccgtcttgaccccccgctgctacgcgacctcttcaaaaaaatggtgggcgagagtcgattggcgggggagctgggcaccctccttcgagttgaagccgccatcgccgcggagcttcgacgcgctcgcgaacaattcgtcaagcagcgccaaaccacgggatttctgccgggcatggagcctgtggttaagcagggttctttggatctctcaggcatcgacgatgaccgcttctttcatgaggccgagatccgaattgtcgaagcactccgtgcgttcgctgagtcggcaactggtcgcgccagtgtgcggcgcaggctttttgcagacgacgcagcccagggggtcgctctcatcgatttgacgcgaacgcggttcgacgtggtcttgatgaaccctcccttcggcgcatgcagcgtcgcggcgaaaacggaattcgacaaatcatacccccgcacaaagaacgatgtgtacgcagcttttgtagaacgaggtatcgaactccttcaccctcgtggacggctcggggcaatcacctcacgaacaggattttttctttcgagcttccagaaatggcgagaagaagtcctgttgccaaaagcgccaccacgcatcgtagctgatttaggcatcggcatactagacggcgcgatggtcgaaactgccgcttattgcttggaggcagtggcatga

SEQ ID NO: 2259 - DNA, 1824 bp, Acidithiobacillus ferrivorans
atggaaaccgccaagctcaaaaaattcgctcaacaggcccgccgcttgctgctggaacaggtgggtgccaggctgggactggtgctggaggcgggcagcgccgcgcgtcgggaaaaccccagcaccgtgaccgagctggaaaaacagattcagcaaagcagtcgtgcgcaagttatcgacaaggtggcctacatctggttcaaccgtttctgcgccctgcgctttatagacgtgaatggctacacccgcatccgggtggtatcgcccgcccaggaagatcagattcagccggaaatcctcgccgaggccaaaatgggccatctcgacgcagagcgcatcccggagaatacgcgtcagcagattgcagccctgctccatcacggcacccccagccgggacccggaccaggaagcctatcgcctcttgctagtcgccgagtgcaacagtttccaccgggccatgccttatcttttcgagcgcattgccgattacaccgaactgctgatgcccgacgacctgctctcggccaacgccatcttggccgccacccgcaacgccatgacgccggacgcctgccaggatgtggaggtgatcggctggctctatcagttctacatctcagagaaaaaagatcaggtctttgaaggcctgaagaaaaaccagaagatcactcccgaaaacattcccgccgccacgcagttattcaccccgcactggatcgtgcgctatctggtggataactctctggggcgcctgtggatgctcaaccatcctgactcaccgcttgtcgggaaaatggagtattacatcaagcccgaagcgcgtgaaaccgacttcctgaaggtcaataaacccgaggacatcaaggtctgcgaccccgcctgcggctccggccacatgctcacctatgcctttgacctgctctatgcgatctacgaagaggtcggcaccgaccccagcgagattcccgagaagattctcacccacaacctctacggtatcgagattgacgaacgcgctggcgaactggccgcttttgccctcaccatgaaggcgcgcgccaggcagcgccgcttcttcaacaaggccataaaaccccatatctgcgtgctggagaaaatcccgttcaacgatgaagaactggacgaataccgtgctgcaatagggcgcgaacggtttaccccggatatgcgcagcaccttgaggcagtttgcagaggccgataactttggttcgctgatccaacccaagctggctaacgccgggacggtgctggcactgctggaagagcaagacttcagtggcgagctgttcctcaaagagacccataacaaggtgctgaaggcactgcatcaagccgccaccctcagtcctatatatcatgtggtgattgccaacccgccctatatggggggcaagggcatgaacgcacggttgggggcgtgggcgaaagaaaactatccgaacagcaagtctgacctctttgccatgtttatggagcgaggcttggagttgctgcccaagtacggctatagcgcaatggtcaccatgcagagctggatgttcttatcttcttacgaatctctgcgcaaaagaatcctacgtgatactgctatcgagtgcatggcgcacatggcgaatatggtcatgggaattgcttttggtacggccgcaactgtttgcaagaaaggcggaagccctgaagcgagaggggcctactgttatgtcgagtacgaagacatcggatcgaataataagcccattgcattcccgccgagaaatgaaagaaaccgaaaggcagcaagacaaaacgaggccatctag

SEQ ID NO: 2260 - DNA, 1773 bp, Acidithiobacillus ferrivorans
atgaagaatgatgaaataacacttaaaactgaagtcgaaggtaacttcgccaagcaggacaccacacaccatttctaccgtgcctctgcgaatgacttcaaaaaaattcccggcagcccaattgcatattgggtgagtgaaaggatgagagatgtttttgaacgagcacaatcacttgaggatatcgctgaagtcaagcatggtctttcaacagggaagaatgaagcagtagttcgtttttggccagaagtgtcatttatagattttggtgcgggtttttcttcacgtgacgaggctctcgacagtaacaaaaaatggttcccgtacaacaaaggcggagactttagaaagtggtatggaaactgtgagtttatcctgcgttatgaccaatgcgggaacgagcttatggcttcattttctggtcatcgtcatgatggcaagagtcattatttccgtgaaggagtaacgtggacttttatatccagctctaagtttgcagcgaggtatactccaaaaggatttgtttttgatgttagcggatcttctctttttgttgataactcaaaacggatagttgcgtttctgtgtaccgatttgtgctttggtattctcaaagctctaaatcctactttgaattttcaggtaggaaatctaaagttattgccaatcgagttggctcaaattataggtaagtctgccgaaatagataccatcgctaatacagctattttattttcaaaaactgactgggatgcctacgaaacctcctgggacttcaccagcctaccgctgctacaccgcgattatcatgatctaactctgaaggccgccaatcaaaatctccgcacccgttggcaagaaatgacccaggaaatgcagcaactcgaagaagaaaataatcgcatcttcatcgaagcctacggtctccaagacgaactcacgcccgaggtgccactcaaggaaatcaccctcacctgcaacccccactaccgctacggcggtgacaaaactgaagaagaactggaagcgctgttgctggccgacaccatgcgcgagttcttgtcctatgccacaggttgcatgttcggccgccacagcctggacaaaccgggcctgatactggccaatcagggcgatacgctgaccgagtatttgcaacaagtgcccgagcccagctttatgcccaaccaggacaacgtgatccccgtactcgatggcgattggttcaccgacgacatcaccgagcgtttccggcagttcctgcgtgtgacgtttggcgaagcccactacgaggaaaacctggtctttattgagaccgccttgggcaaggatgtccgcaaatacttcctcaaggatttctacaacgaccacgtcaggcgctacaaaaagcgtccgatctactggctcttctccagccccaaaggcacgttcaacgccctgatctacctgcactgctaccgcccggataccgtcagcgtggtactgcaatatctgcgcgacttccgcaaaaaactcgccgcccgtctcgactacctgcaacaggtcggcatcagcccttccgccaaccagagcgaaaagacccgcgcacaaaaggaaatcgacaccatcaaaaaacaactgctggaactcgacgactacgagcgcgacaccctctacccgctggccaccgcacagatagcgctggacctggacgacggcgtcaaggtcaactatctcaaacttggccccgcgctcaagaaaattgtcggcctggacgccaagggcgaagattga

SEQ ID NO: 2261 - DNA, 3534 bp, Acinetobacter baumannii
atgaataccagtaatattaaaaaatacgcaccgcaagcacgcaatgattttatcgcagccatgcgcaagcagtcggccaaatacggcatcaccgcagaccgcactttaccaacagagcagaaaggcgacttgttgctgattggcgatcaggtttttcccctgtcagtaatgaaaccgcgtgaaaagctgatcaagcgcattcaaaccagcagttttgagcagaccatcgattatatcgcttatagctggtttaaccgtctttgtgcgattcgctacatggaatgcaaaggcttgctggatcatggtcgtcgtgtactgagcagtgccgatggcagtgcaggcttgccgcagattctggaagagtgtctggatattgacttaccgggtttagatgctagccgtgtggctgaactcaagctggatggcaataaagacgaagagctgtaccgagagctgttactggctcagtgtcatgcattgaatcaggtcatgccattattgtttgaacaggtttctgatgaatctgagttgctgttaccggataacctcaccaaaaccgattccttgatccgtgatctggtcagcagcattccagaagaagactggtcggatgtacagattattggctggctgtatcagttctatatttctgaaaagaaagaccaggtgattggtaaagtcgtcaagagtgaggacattcctgccgcgacacagttattcaccccgaactggattgtaaaatatctggtacagaacagtgttggccgtttatggatgatggcacagcctgacagtacgctggccaataattgggaatattatattcaacccgctgaacaaacggatgaggtcaatgcacagctgaaacagctgattgatgttcgtattagtgaagatggcgatactttaaaccctgaaagcattacggtgctagatccggcctgtggttcggggcatattctggtggaagcctatgattgcctgaaagccatttatttagaacgtggttaccgcagccgtgatattccacgtttgattctggaaaacaacctgtacggcattgatattgatacccgtgcggcacagttggccagttttgcactgctgatgaaagcgcgtgaggatgaccgccgtttatttagcaatccaccgaagctgaatattattgcgttgcaagacagccaacctgaacgtttagacgcattgagtcaggatttggcaaacactggtattgcgcaggcggatttaaaagaattgctagaattatttgaacatgcttcaacttttgggtctttgattcaggtgcctgaagtattcgctaaaaagctgcctgatttagaaacaaagctcaatatagcattagcgtcaggggatatttttgcacagcagtcagcacaggagttattacctttagtgcagcaagcgaatttattagcaaagcaatatgatgctgtgattgcgaatccgccgtatatgggtggcaaaggcatgaatacagccttaaaagattttgccaagaagaaattccctgacagcaagtcagatctatttgccatgtttattgaacgtggttttggatggtgtaaagaaagtggttttaacagtatggtaaccatgcaaagctggatgttcttgtcatcttatgaagcgatgcgtgaaaagttattacaagatcgtacaattcaaaccatggcacatttaggtgctcgagcatttcctgaaatatcaggggaagtcgtacaaacaacagcttttgtgatgcaagggcaacatataaatggatttaagccagtattttttagacttgtagatacagggcaggatcaaaaagaatcagaactaagatcaggacttaatcgttttgactctacgattcaagatgattttaagaaaattcctggtagtcctattgcttattgggtaaatatacagactcgaaatttattttctggaaataagcttttaggagagatttcagaaccacgtcgtgggttggcaacaaatgataataataagttcattagaagatgggcagaagttagcaatcaaaaaatggcatttggttctataaatagggaagatgcgaaaaattctaataaaaagtggttcccgtataataaaggtggagaatttagaaaatggtatggaaataatgagtatttagttaactgggaaaatgatggtgaagaaatgtttgcgcttgcaaaaaaattatatggtagcccaacacgaacaataaaaaatcttcaatattattttagaaatggcatatcttggtcaatgattggctctgggacatttagtgtacgttatatggataatggttatatttttgatcaggcagctgatagtttatttgctagaaataatgaactccttgaaattataggacttatgaattcacctgtactagaatttttgaaaataataataaatcctactatgaatacaacagcaggtgtaatctctcaattgccttatgttcctttctcagcctcaaatcaggcaagagaaaatgtagaggagatgattaaatttgcaagagatgactggaatgtatacgaaacctcatgggactttactcaaaacccaatcattcgtacgcagcagtcaaacctagaacaagcgtttaacacatggcaacagcaaaatgctgacgctgtggcagaaatgaaacgtctagaagaagaaaacaataagctgtttattgatgcttatggtttacaggatgaattaacgccagatgttcctgatgagcaaatcactttaacccgtgccgaccgtgaaaaagacagccaacgtttagtgtcttatgtacttggctgcatgatgggacgttatagcttagatgaaccaggtttgatctatgcccatgcaggcaatcaagacttcgatgccaaccgttatctgaaattcccagccgatgctgacggcattattccattgactgaaatgcactggtttgaagacgatgcaacgcaccgtattcgagagttcttaactgcagtgtggggtaaagatacactggatgccaatatgcagtggttggcagaaagcttggacaaaaaagccaacgaaacagcggaagacacgatccgccgttatcttgctagtaagttttataaagaccacatgcagacctataaaaagcgcccgatctactggttattcagcagtggtaaacaaggcgctttccaggcattggtgtacttgcaccgctataacgaaagcactttggcgcgtatgcgtaccgaatacgtcatgccgctgatttccaaaatggctgcttatgctaattctctggaaacaacaaaagaaagcagtgactctgcggctgaaatcaaacgtatcgagaaaaaactgcaagacttgcataagcaacaggctgaactgagtacttttgaagaaaaattacgtcactatgccgatcagcgtattacgttagatctcgatgatggggtgaaagtaaactacggcaagtttggggacttgttagctgaagttaaagcgattacgggtgataaaacagaatga

SEQ ID NO: 2262 - DNA, 3402 bp, Alteromonas macleodii
atgagacagccactggacaaagcgctaagaaagaagcttgaagaaacagtaattaaggcccgcgacattgtagaagccgcagtgaaggaaagcttgcagcgtttgggtgttgcggagagccaagcgccaagctatttaaaagacaacgaaaaagtactgcgaaataaactacgtgcacacgctcgccagcttggtgatcgcctatcagatggtaaacaagaaataacgcgattagccaatgaaatggcatacgagcattggcatcgcatgctatttgctcgttttttagagcaaagtaacttattgatgtacgacgcacaaacgccagttacgttagaggaatgttttgagcttgccgaagaggaagaggattgcaaagacgggtgggagctagctagccgcttggcacaaaaaatgttgccgcaaatcttccgcgctgactcgcccgtgtttgaagtaaagctttcaatgaaccgcattgatgaattagaaagtttaatttcaaagctcgatacacaaacctaccaagcacaagacagccttggctggtgttaccaattctggcaaaccaaaaagaaagaagaagtaaataaatcaggtgtgagaattggagcacaagagctaagccctgttactcagttatttacagaaccttatatggtgagttttcttctcgataacgctttaggtgcttggtgggccaataaactcctttctaaagacgatttgattcgagccaatagcgaacaagaattacgtgatcttgcttctattcacggtgtaccacttgaatatttgcgcttcactcaagatgaatttggtaacaacattgggtggaagccagctgctggaggatttgaaaaatggccagagcatttaggggaattaaaagtacttgatccttgttgtggatcaggtcacttcctagttgctatattcttaatgttggtccctatgcgaatgaaattggaaggactaacggagaaagaggccgttgatgctgtacttcgtgataatattcatggccttgaacttgaccaacgctgtgtagaactcgcggcttttgcactagcgttagaagcttggcgttacccaaacgcaggaggctatcgtgtattgcctgagcttcagctcgcctgttcaggtatgtccattgccgaagcgcaaaaggaatggaaagatttaacaaaaggcgatgaagcattaacagatgcaattgcttggatgcagtataacttcaaagatgcaccgaccttgggtagtttgattgaccctattagagcgttggaaaaagaccagacaccaccatggttgcttttgcaaaatgcgatgaatcataaaattgatgcaagtaatgaagctaaggcgacagcccaaggattagctaaagcttctagtatactgtctactaagtttgaatggatcgcgacaaacgtcccttatttgggggatataaaccaagatgaaaagctgcaaaagcatataaagcgaaattatcgtgcaggtaaaaaggatcttgccaatgcctttacacttcgttgcgctgaaatgttgactgatataggaatatgttcccttgttcttcctcaaaactggatgttcttgaaaacatatcaaacgttcagagaacagattctcaataaacaccgtttctcattaattgcgcgtttaggttcaggtgcattcgatacaatatcaggagaagtagtaaaagctattttatggtcgtttcaaaaggttcaattacaagataacgagtttgtagcgttagatgttagtgagagcaaaggagcagttggtaagtcttgtagtctgatagcgtcagcattgacttatctaaaccaggatgaccaattggctaatccaagggcagctctgatactaagtgaactgaaccacgatcaagagagtctctcaaaatattgtattcctcactacggttcaaaacctggtcaaacagatagagtcaaaagatacttttgggaattgaacaaaatcacaagtgactggatgttactagagtcgacccctcaagagtcgatgacgctgtcagggaaatctaatatctgctattcgctagaagccatgaaataccggcaaattagagagttcggtatccgaggagctgatgcttggggatcaaaaggtgttattgccgctaggacaagtaagttaaacgctgttagctatttaggaaaggtctttgacgataattgctatgctttaattcctaagaacgcgggtgacctagcggctatttggttatttcttacatcagacttgtacaatatcgaagtgaggaaagtaaatcagaaactcgctgtagatactcaatccatggtaaacgtaccatttgacattgaatactggagacagttagccagtagtttttaccctaacggtcttcctacgtattattcgaacgatgctagacaatggttgttccacgggcacccttgtgaatcagttgtttggtgcgaagaatctaaaactacagctataagtcagctacgtcaggacgacacagttctccaagtaactgttgctcgcttacttggctaccactggcctgctgaattagatactgaaatggaacttgcgcctgaaatgcgcgaagtaataaagaggaatgctgactttgcagatttagttgatgatgacggtattgtttgtatacctgcagtccgtggtgagaagtctgcagccaaacggttagaagccatgttgataaaagcttatggcgatgcttgggatagctcggtcgaaactaacttacttaaagccgttaaggctaaagacctagaaagttggctccgtgataaattctttgaacagcattgtaagctttttcagcatcgaccatttatttggcatatctgggatggtttaaaagatggtttctcggcattagttaactatcaccagcttgattacaaaggcttagaacgacttatttatacttacctagatgactggataagtaatcaaaaacgtcagctagccgaaggcaccgacggcgctgatattcgattaactgcagcggaaaacttaaaaatacaactagaagcgatattagcaggggaagaagggttagacatttttgttcgctggaaacctcttgaagagcaacctattggctggaacccagatcttaatgatggtgtacgcttaaacattcgaccatttatgcttgccaaagatgttggcaagaagggggcgggtgtattacgtgcgaagcctaatattcattggaaaaaagaccgagggacagacgtcgaatcagctccatggtataacctgggactagaatatggcggcaagcaaggcgaccgtattaacgagcatcatttatctttgtctgtaaagcgagaggcgcgaatgaaactaaaagaggctgattag

SEQ ID NO: 2263 - DNA, 3390 bp, Anaeromyxobacter dehalogenans
atggcatcgctcgaccgcaaccttcgcagggagctcgaaggcgccgtcaaggaggctcgccgcgtagcggaggccggcgcgcggcaggccatcgggcagctcgccgtcggtcaccacgagccctgggccgcgctctcgcccgagcagcgtaagctgcgcaaccgcctgcgcgcgcacgggcgccagctcggcgacaagctcgaggagcgcaaaggaacccagaccaccgagcggctcacccgcgagtccgcctacgagcactggcatcgtctcctgttcgcgcgcttcctcgcggagaacgacctcctcgtcgagccggagtcgggcatggcgctgtcgctcgacgagtgccgcgagcttgcgcgcgagcagggcaaggactggctggtgctggcgagcgacttcgctcagcggatgctcccgcagatcttccgcgccggcgatccagtgctcgaggtggcgctacctcccgagaagcgacaggagctcgaggcgatcctcgaaaggctgccgcgcgccgtgttcacggcggacgacagccttggatgggtgtaccagttctggcaggcggaccagaaggacgcagtcaacgcctcggagcacaagatcggcgcggacgagttgccggccgtgacgcagctcttcaccgaggactacatggtcctcttcctgctgcacaacacggtcggcgcgtggtgggccggcaaggtgttcgcggcgaagccggagctcgcgcgcacggcagtatccgaggacgagtgccgcgcggcctgcgccgtccagggcatcgagtggcgatacctgcgcttcgtacgcgagggggacgcctggcggccagcgccgggtacgttctcgggctggccgagggccgcgaagggtctcacggtgctcgacccgtgcatgggcagcgggcacttcctcgcattcgcgctgccgatcctggtcgcgctgcggcaggccgaagagaagctgtcgatcgccgaggccgtggacgccgtgctgcgcgacaacctgttcgggctcgaacttgatccgcgctgcactcagatcgccgcgttcaacgttgggctcacggcatggaagctcgcgggctatcggccgttgccggcgctgaacctcgcgtgcgccgggcttggcatcaacgctccggtgtcggagtggacggcgttggcggcaggcgatcggcccgcggagcaggcgatgaagcagctctacgagctgttccggcaggctccgaccctgggctcgctcatcgatccgacgcgcgtcggcggtgagttgttcgttgctcagtttgacaagattcgaaacctcctctcttcagcgttggcttcggagaaatccgaggacgctgagctcgccgtggtcgcacaaggacttgcgcgcgcggcaacgctcttggccgtaaagtacaccctcgtagcgacaaacgtgccgtatctcgcgcgtggaaatcagtccgatgtgcttgcgcagcactgtgaatcgcacttcgccgatgcgaagactgatttggccacctgtttcatcgagcggtgtcggtcgttgttggcgcccttcggggcagcggctctcgtgacccctcagaactggctgtcccaagattactacgcgtcgtaccgcaagaggctcttgcgcgacgcacggttcgagcttgctggtcagctcgggcccggcgccttctctgggatctcgggggaagtcgtgaagcccctgctgatcattctgagcgggcgcagtcacgatgcagcccacgagttcttggcgattgacacgactcctttcgcgtcggcagtggacaaggccgcagccctgtgcgccgacgccctccacaaggtcaaccaagcacgccaactcatcaatccaaagtgccggatcagcatggaggaggcgtcagctgagccgcggctctcgaagttcaccatctactcgaacgggattcagacgggcgattctcctcggtacttgcgctcattctgggagctgcccgcgctcgacgagcgatgggctgcgcagcaaaccacggtcgatgcaaccacttcgtatggcggcatgtcacaggcaattctgtgggagaacggagcagggagcctagcgaaagccgccgaaaatgcatcgcgtcagacggtcttgaggggcaaggaggtgtggggccgacgaggcgtgctcgtgagcgctatggggtcgctgaacgtctcgctctatctcggcacgctgttcgacgacaataccgtcgccgtcgttcccgcgagtgaatcgcacttggcgccgatctgggccttcatgagcgataccgggtaccacgacgctgttcgtcggatcgacaaggcgctgaaagtgcggggtccactcatcgaggtgccgttcgatatcggcgcttggtccggcgccgtgctccctgttccgcacgcgctcgatccgacccagtggatcttcggaggacatccgcgaggtgcctcaaatcctctccaggtcgctgtcgcacgactcgttggctatcgatggcctcgacagcggcaggcgacgtttctcggctttcctgcactcggaccggacggcctagaacgacatgtggatgacgacggtatcgtgtgtttgccttcgcttcgcggagaggctcctgctgccgagcgtgttcgcgcgctccttgctgacgccttcggcgcggagtggtcggcaaacaagctgagtgagctgctcgccgccgtggatttcggcggcaagtcattggatgactggcttcgcgacggcttttttgaacagcactgcgagctgttcgaacggcgcccgtttgtctggcagatctgggacggtcgcaaggacggtttctccgcgctcgtgaactatcaccagctggctgcgcccaacggcgagggccgtcgcatcctcgagaagctgacgcatacctatctcggcgactggcttgaccgtcagcgcgcagaccagaaggcgggcatcgagggagccgacggccgcgtggcggccgctgagcacctgaaacgcgagttggagaagatcatcgagggcgagccgcccttcgatctcttcgtccgctggaaaagactgcagcagcagcccgtcggttgggagccggacatcgatgatggtgtgcgcgtcaacattcgtccgtttgttgccgcgcgtcccttgacggtgcgcgcacgagccgcgtgtatcctccgggtaactccagacattcggtggggcaaggacaagggcaaggagccgacgcgccaaaaggcggacttcccgtggttctggggttgggacgagagcgcgcaggacttcgcgggtggcaaggagttcgacggcaatcgctggaacgacctccactacacgcgcgctgcgaagctcgccgcgcgtgagtgcgcgaagggaggcaagtcgtga

SEQ ID NO: 2264 - DNA, 3939 bp, Aromatoleum aromaticum
gtgctgcccaacgaacgtcggggtgacgtggcgatcatcgccggccgcgaatggccggcgaaggtgcatgagcagcgcgaacagctcatcagacgcattcggcgtgacggtttcgcccagaccatggaagcagttgcctacacctggttcaaccgcttcgcggccctgcgctacatggaactgcacgactacctcggccacggccaccgcgtgctgtccagcgccaccgccggcggcctgcccgacatcgtcgcgcatgcctccgacctcgccgcgagccgccaattgcccggcctcggcgccgatgtcgtgacggaactgaagcttgccggcaacaaggacggcgagctctaccgcctgctgctcgtcgcccagtgcaacgcgctttccgccgccatgcccttcctcttcgagcgcatcgacgacgaaaccgagctgctgctgcccgacaacctgctgcgcaccgactcggtcatcgccaagctggtcgccgagatcgcggaagaagactgggccgaggtcgagatcatcggctggctctaccagttctacatcagcgagaagaaggatcaggtcatcggcaaggtggtcaagagcgaggacatccccgccgccacccagctcttcacccccaactggatcgtgcaatacctggtgcagaacagcgtcggccgcctgtggctgatggccaacccggccagtacgctcaaggccgagtggccgtactacatcgaaccggccgagcagacgcccgaggtgcaggcgcaattggatgagttgattcggcagcgctgcctggaggggagtggtcagtggtcagtggtcagtggtcaggaggggcgggatggcgattacgcattatcgggaactgattgtttggcaaaaggcaatgaacttggtcgagcaggtgtatcaggccaccaaggtgtttccgagagacgaggtttatgggctgacgagtcaagtacgtcgggcagcggtatcgattccttccaacatcgcggaaggtcaggcgcggaagtcacgggcggagtttcgcaattttctgtcgatcgctcaggggtcgaaggccgaagtggaaacgcagatcctgattgccgtgcgtctcaagtatctgacgcaggaacaggccgcaccgatactgtcactgctggaggagatttcgaagatgctcgccgcactgcaggcacgtcttctctgaccactaaccactggccactaaccactccgcctttagatcccgaatccatcaccgtgctcgaccccgcctgcggttccggccacatcctggtcgaagcctacgcgctgctcaaaggcatctacctggaacgcggctaccgcctgcgcgacatcccgcgcctgatcctggaaaagaacctttacggcctcgacatcgacgaccgcgccgcccaactcgccggcttcgccctgctgatgaaggcccgcgccgacgaccggcgcctgttcaacgacccgccccggctcaatgtgctgagcctgcaggagagcaaggggctggacctggacgaactcgccacccacctcgcatccttcggtatccagcgcggcaccatcaaggcgctgctcgataccttcgaacacgccaagaccttcggctcgctgatccagattccggacgcgttgaatgcgcaactgccggcgctggcggaggcgctggggaaggcgaacgagaccggggatctgtatgcgcaggcggcggcgcaggatttgctgccgctggtggagcaggcgaaggtgctggggcggaagttcgatgcggtggtggcgaatccgccgtatatgggcggtaaggggatgaacggcgcgctgaaggagttcgccaaggccgcattccccgatagcaagtccgacctgtttgcgatgttcatcgagcgcggttttgcttggtgcaagcccaacggcttcaacagcatggtgacgatgcagagttggatgttcttgtcgtcctttcaatccatgcgggagaagttgctcgaacagcgaaccattgagacgatggcgcatctgggcgcaagagcgttttccgagatttctggcgaagtcgtacaaaccacggccttcgttctgcaaggtcagcatttcttcggattcaaacccacattcttccgcttggtggatgggcaggaggcggacaaagaagcagcgttgcggagtaatcagtgccgctttgatgccacggcgcaggatgatttcaagaaaattccgggaagtccggtggcttactgggttagccgcgcgctgttcgatgttttcgcaaccctcgaaccgctgcaagagcgtgcccatgtacgcaagggtcttgcgacttgcgatgacctccgttgggttcgtctgtggcatgaagtcgactattcgctcagcaacactcaacgagagccgtcatcagaagaagtgggacggctaggtagatggttccctttgctgaagggagggtccttcagaaaatggtatggcaatactgcctacctaattaattgggaaaacgatggccgacttctcaaagcgtcgattgtcgaacgctacggtggcggcagttacacgaaagaagtcaggagcgaagattactattttcgcccctgcaacacttggtcggatatcacgtccgggtcatttggtgctaggtactgccccaacgggtttattacgagtacggttgggggcgggatctactctgcttcagattctgatgagtaccagttttgtgcgatgctcaattcgaaaccgacctccgattggctgcggatcatcaaccccacattgcatgccaacccaggtgatatcgcgcagttgcctttacctccacacgaggtccttacgggtgtggagatttctcgcctcggccgagcagccgtcagtttaaccagatccgactgggacgcttacgaacgctcctgggacttccaatcctttcccctcctgaccgcctccgccgaccccgactccacccttgagtccagctacaccgcctgggtcacccagaaccacgacaccatcgtggagatgaagcgtcttgaagaggagaacaaccgcctcttcatcgatgcctacggtctgcaggatgaactcactcccgacgtccccatcgagcaaattacgctcacggtgaaccccgcctaccgctacggcggcaacctcaccgaagttgagcaatggacccgcttccgccaggacaccatggaggaactggtctcctacgccatcggctgcatgatgggccgctacagcctcgacgaacccggcctcatctacgcccacgccggcaacgtcggcttcgatgccaaccgctacaagaccttcccggccgacgccgacggcatcgtgccgatcaccgacgaattctggttcgaggacgacgccgccaaccgcgtgcgcgagttcctgcgcgccgtgtggggcgccgacacgctggacgagaacatggcctggctcgccgagagcctgggcaccaaggccaacgagacgccggacgaaaccatccgccgctatctggccgacaagttcttcaaggaccacctccagacctacaagaagcgccccatctactggctgttctccagcggcaaacagggcgccttccaggcgctggtctacctgcaccgctaccatgaaggcacgctcgcccgcctgcgcgccgaatacgtggtgccgctgaccggcaagctgcaggcccgcatcgacatgctggaaaaagacgccgccgccgcccccagcaccgccacgcgcaacaagctcaacaagcagatcgaaaagctgcgcaagaaacacgtcgaactgctggcctacgacgagaagctccgccactacgccgatatgcgcatccgcctggatctggacgagggggtgaaggtgaactatggcaagttcggggatttgctggcggaggtgaaggcggtgacgggtggggcgggggatgagtga

SEQ ID NO: 2265 - DNA, 3426 bp, Arthrobacter sp.
atggaaactgcaccactgaagtccttcgcaacctgggcgcgcacatcactcatcaaggaggtgactgctcgccttgcggcagtgttggccccgggttcgcccgagagggttgagcggcctggcgttgtgtccgcgctggagaaggccatcgccgccgctggaggcgaggccggcaaggccgcgatcgcagatcgcgtcgcctacacctggttcaaccgcatcattgcccttcgcttcatggacgccaacgcctacaccgggatcggtgttgtctcgcccggcgcggacgctggcggacagcccgaaatcttgtctgcggcgaagggcggccagatcgacgcggcggtcgtgacgagcgcgcaaacacgagacaccgttctcggcctcctgggcgggacccgcaagagtgccgacgcacagggcgaggcttactcgatcctgttggcggaatattgccgtcactggaacaaggtcatgccgttcatgttcgagcgcgagggcgactacaccgagcttctgatcccgagcaacctgctcgcggatgcgtcagtcctcagccgcgcggtcagcgtactcacgaaggaggtctgccaggacgtcgaggtcattggctggctctaccagttctacatctccgagcggaagcaagaggtgttcgacgggttcaggaagaacaagaaagccggcgccgacgagatccccgccgccacccagctcttcaccccgcactggatcgtccgctacctcgtcgagaactcgctcggtcgactctggatgctgaaccatccagcatccgggctggtcactcagatggaatactacatcgccccggtcgacgaggagaccgacttcctcaagatcaccaagcccgaagagctgaaggtcatcgaccctgcctgtggctccggccacatgctcacctacgcgttcgacctcctctacgccatctacgaggaggagggctacacgccgtccgagatccccggtctgatcctcaccaacaacctctacggcactgagatcgacgcgcgcgcgggggccttggccgccttcgctctgacgatgaaggcgcgatcgaggcagaagacgttctttagcaaacgggtcgagccgaacatctgcgtgatcgacccgatctcgttcggtcccgaggagcttgacttccttgtcactcggggcggcgaccgagatcgcgaggtcgcccattggaatcagttcgcgcgcgcagacatcttcggtgcgctcgttcaacccagcgaagacctgatcgtctcgctctcagcacacttggccatgcacccaccggcagccggcgacctgattgcagccgacatccatgaccgggcatgtcaggtgctgcgatatgcgcaattcctcagcccgcgttaccaagttgtggtggcgaatcccccatacatggatgcgcgaaacatggctccaacgctttatgaatacctgtcagacaaattccgcgcgggccacacgggtgttgatctcgcgttcgttctgcgggcgcaatcgcttgtcccgcgtggcgggtatcttggcctgcttagtatggacagttggctgggcaatgtggagtgcgctgactttcgggacatcgttcgagccgacctgccaccccagctggtacttcacctcggcgctcgtgcttttccagaaatcgacggcgaggtagtccaagtcaccgcaacgctgttccagcgaggcgcaaacagctcgtccaagacgaccttcatcggcgccaccgaggggacgactgttaacgcgaaggtcgctcagttccatgatcccgaacgacgattcagacacgcactggactggtttgacgtctttccgggcagggttcttaccccttatgccgcctccgagaaagcacatgcgacgttcggtaccgctcctgccatgaacaccatcgctgaggttcggacagggctccaaactggtgacaacgtgagattcttgcgccactggtatgaagtttcgttcgagaaggttcgcacgggcaccgcgtctccgggagcgcgatgggtgccctacgtgaaatcaagttcgccaactaggtggtttgctcgcgaggacctagtcgtagattgggcgaacgagggcgcggcagttcgctctcaccagagttcggtagttagaaactcgtcctactattttcggtcagggctctcgtatgggggactcgcaggtagcctcaaggcccgactcgttgctgctgatgcaatcttcgaccagaagaactcgatggtcttcccgatcggacggaccactacgcatcagctgcttgcgctgatgaacagttccgcattcgagactctggcgcgcctggtatcaccgaagggtttcggtgttggcacgctggcccaattgcctatccctgctgaggcgttggttgctccgcgggtcgaagaactcgccgagcgggcggtggaattgacggcactgctatttgaccgatctgagacttcgcgtggcttcgaaggtctcagttcaatcttcttgggtcaaggaactaaatctggtttgcagttcgccgtcgagcttaccgccaagactgagacggaagtccgtacggagttgcacaacctagaccttgagaaccacgccttctttgcagaagcgctacctgcgacgcgtgcttccgaggacggacacaacccaacacgtgcagatgctgttgcttcgtccgtcgtggtcaaggatctcctgtcctacgccgtcggttgtatgttcgggcgctacagcctcgatgagccgggcctgatcctggccgaccagggctcggcgttgcaggactacctggcaaagattccaacgccgaccttcaagccggacgcggacaacgtcatcccaatcgtggagggcgattggttcgcggacgacatcgtcgctcgcttccggcagttccttcggaccgccttcggggaggagcacttcgaggagaatctccactttgtgacgacgtcgcttggcgtcaaggacatccgagactacttcgtgaagtccttctacaaggaccactggcagcgatacaagaaacggccgatctactggctgttctccagcccgtcgggcgccttcagcgcaatgatctacatgcaccgctacacgccatcaacggtctccactgtccttaacgagtacctccgtgagtaccgggccaagctcgaagcaagccgccagcaccaggagaagctcgccgtctccggcactggccgccagcaggcgaccgcgctcaaggaagtggatcgtatgcgtaagatcctgttggagcttgacgactatgagcacaaagtcctctatccgttggcgacgcagcaggttgcgatcgatctggacgacggagtgagggcaaattatcctaagctgggtgccgcgctgaggaagatcccaggcttggaggcaaacgatgactga

SEQ ID NO: 2266 - DNA, 3489 bp, Azospirillum lipoferum
atggcatcgctggcgcgtgatcttcgccgcaatctggagaccagggtccgcgaagcgcgggtgctggcggaggtcggggcgcgcaaggcgctggaacggctgggggtacatctgtccgccagccccggctatctgaccgaccaggagaagaagctgcgcgccaagctgcgcgcccatgccaagcggctgggcgacgagcgccgctccgacggcagccaggacatcaagcggctggtgccggaggtggcgtacgagcactggcaccgcatgctgttcgcccgcttcctggcggaaagcgacctgctgatcgacgacgggctggcgcttacccttgccgatgtccaggaactggcgcgggagcagggaaaggactggctggagctcgccgccggctatgcccaacgcatgctgccggagatcttccgcagcgaggatccggcgctggccctggccctgccgccggagacccgctcggcgctggaggaccggctgaaggcgttgccgcccgccgtgttccgggccgacgacagcctgggctgggtctatcagttctggcaggccgacgagaaggagagggtcaacaagtcgggcgggccgatcggggcggacgagctgccggccgtcacccagctcttcaccgaggactacatggtcctgttcctgctgcacaacacgctgggggcgtggtgggccggcaagatcctgtcggcgaacccggcgctcgccgccggggcggcggacgaggcggagctgcgcgcggcctgcgccctgccgggggtggactggacctatctgcgcttcgtccgggaaacgcgggaggatggcggcgagggcgactggcgcccggcggccggcaccttccccggctggcccggggatgtgaaggacatcaccttcctcgatccctgcatggggtccggccatttcctggtcttcaccctgcccatcctggcggcgctgcgcatggcggaggaggggctgaaccggaaggacgccgtgctggcggtgctgcgggacaatctgcacgggctggagatcgattttcgctgcacccagattgccgccttcaatctggccttcgccgcctggcgcctgatcggcgagtacgtgcaattgccgcccttgcatctcgcctgctccggcctttccatcggcatggcgaagcaggatttcctgaagctggcggacaaggtggcccgcgccgccgacccgcaggccaggaccgacctgctgggcgcggaggcgacgctgctgaacgcgcaggtggacagccgcatccgcaccggcctgtcccgcctgtatgacctgttcgagaaagcgccggtgctgggtagcctgatcgaaccgcgtcgggccggcggcgacctgttcgccgccgactgggacctgctggaaccgatcctgacgcaagcgctggccgacggcagcgacgaggtagcagaaatggccgtcgccgcacaaggccttgccaaggcggcggagttgctagcgaatcggtatgtgctggtggcgacaaacgtaccgtatttgggacgtggaaaacagtcagactcgttgcgaaactggatagatgagcactatccgagatcaaaaaacgacattgctaccgtcttcatggagcggctgttggagataattgtcccaaatgggacttttagtaccgttgcgccggataattggctttttttaccagcctatcgtgatctgaggaaaacatccctgatcaagaacggattagatatctgcgccctacttggtccggctgcgttccaagatatgaattggtgggcagcgcgaacagggctgttcgctatgtctcgtaggagcaacattgtaacatcgcacatcaatctcattgatgccggagagaataagagcatctcagtgaaagaggcaatactctccggacaagaaggtggcgggttcacggtgcttccatcctcgactgcgttggtcggcaaggattcgcgcctcgaccttcagggcgggcacaaaggaaatattattggccatttcgccagagcatctcagggattaaagactggcgatgacgaccgactggtgcgcagtttctgggaaaccccagcgttgacggaaaactggcatccaatgcagtcgacatctcaggagcaaaagaactatggcggacagtccaacgttatctggtgggctgatggaggatcaagcgtagcacggcggcaaggaacgaaagcctggggaaatattggtgtttctatcggccaaatgcggctgctacccgcaaccatctatggcggtgaaatttttgacagtaatgtttgcgttctcattccgaacaacagggagcacgtatctgcactgctttgctttgctcattctggtgaacttactaagcgagtcagaaaaattgagccaggcagtaaggtgaacaatggcactttcgaattgatccccttcgacctcgcccactggcagagggtcgcggcggagaaatacccggacggcctgccgaagccgcattccgacgacccgacccagtggctgttcaacggccatcccgtcggctcggacgatccgttgcaggtggcggtggcccggctgctgggctatcgctggccgcgccagaccggcagcagcttcatggactgcccggccatcaccgagccggacgggctggagccccatgccgacagcgacggcatcgtctgcctgtccccggtcaagggggaaccggcggcggcggagcgcctgtccgccctgctggcctccgcctatggcgccgactggacgccgcagcgcctgaccgccctgctgtccgccgccggcgacggcaaggcgcgcgacctcgacgcctatctgcgcaaccatttcttcaagcggcatgtggagctgttccagaaccggcccttcatctggcatgtctgggacgggcggcaggatgacggcttccacgccctggtgaactatcacaagctggcggcccccggcggcgagggccggcggacgctggagaagctggtctatacctacctgcgggaatggatcgaccgctgccggacggaggtgaaggcgggtgccgatggagcggagggccggctggccgcggcggagcatctgcgcggccggcttgaggccatcctggagggggagccgccctacgacatcttcgtccgctggaagccgctgcgccgtcaggccatcggctgggagccggacgtcaatgacggggtgcgcatgaacatccgccccttcctgaccgcccgccccctggacgccaagtccgccaccgcctgcatcctgcgcgtcaccccgcgcatcaagtgggacaaggaccgcgggaaggagccgacgcgcccgaaggacgactatccctggttctggaactgggatcagaagacggcgaatttcgccggcacgggtgacgagcccgacggccagcgctggaacgatcttcattacagcaacgacgccaagcgcgcggcgcgggaacggaaggggggcgaagcatga

SEQ ID NO: 2267 - DNA, 3621 bp, Bifidobacterium animalis
atgaacacgaaccagcttcaacaattcgccgccaacgcgcgcatcgcgttaatgagcgcgattgaacctcgggtccgggaggcgcttgaccccaattcggcgttgcatgccgacaataccgcggcatgcaaacaccttgcccacaacgccccatccagcaatgaccgccatgcgattgatgcgtatgtggaggaactcaccgaacggtatgcgtaccggtggttcaaccgcatcatcgcatttcgctacatggatgtacacggctacacggtgacgccggtcgtctcctcggccgacccgacgaacgtcaacggcctgcccgagatcctcgctgccgcacgccgcggcgaatacgacgaacgcgtcttcggccccgcgatccgcacgaacgaggcaatcaggcggcgagtcgaggcgatcctcgacggcgacatcacgaccgccgacccgcaaggcgccgcctacggcctgctgatggccgccgcctgcaactactggcactcctcgctgccgttcctgttcgacgagccgaacaccatcgaaggcgcgatagacgtcgtcctgatgccgcagaacctgctggccgacggctcgccactgcgcgaggcgatcggcgtgatgacgcccaaggcctgcggtgtagacgaattaagcggcaacgtcgaaatcatcggctggctctaccagttctacatcgcgccacgcaaagacgatgtgatggccggcttcaaaaaaggcaagaaagccggcgcggaggagatccccgccgcaacacaattgttcacgcccgaatggatcgtccgctacctcgtgcagaacaccgtcggacgcctatggatggaaaaccaccccgattgcgcgctcgcggacggctgggaatactacatcgcccctaccagtgacgacgacacagcgaaactcacggtcagctcccccgaagagctcaccgtatgcgaccccgcatgcggttcgggacacatgctcacgtacgcgttcgacctgctctacgagatctatgaggacgaagggtatgcgccatccgacatccccggcctcatcctcgaccacaacctcttcggcatggaaatcgacgaacgcgccgcacaactcgccgcgttcgcgttgacgatgaaggcacgcggacgctcacgccgcttcttccgcaagcagatacagccacacatcgaacagatcaagaagctccagttcagcgaagaggaaaccgaagaactcaacgaactgtatgacgtcacgttgtcatccgagacctggaacacgtacgccaacgcgaacgtgttcggctccctcatccaacccgacacgatgcttgccacggtctgcgacaacaacgacgagccggagtcactggcattatatgcagcggacctcatcgaacgcggcaaccgcgtcctcgaacagacccgctatctgagccgcacctacgccgcggtcgccggcaatccgccatacatgggtggcaagaacatgagcacccagctcaagaagtatgtcgaagagcactacccgaaaggcaaatccgacctgttcgccgcattcatgctcagatgcatgcagctggtgccacaacatggcatggtcggcatgatcaccatgcagtcatggatgttcctgacatccttcgaggacctgcgcaccacattgctgcatgccatgcatatcgatacgatggcgcatctgggtgctggggcattcgacagcatcggcggagaagtcgtctcgacaacagccttcacgatgagcaagagcaacgatgaccatcgcggcgcctatatccgcttggttgacatcaaaggcgaccacgaacagtccgaagcctgccaagccaccatcaagcatgacaaagcgttgatgtttgaggtggatcagcaggagttcgcccagattcccggctcccccatcgtctactggctgccagaagcagtattgaacaccttcaatgaggggaaaccactttctgaaatagcacaacctcggcaagggctggcgactgccgacaacaatcgttttgtccgcgaatggtgggaggtcagccaaaacagaatcagcttgaactgcgacagcctgcaatccgcagcagcaagcggtgctaaatggttcccctacaataaaggtggcgacttccgcaaatggtacggcaatcaagagttcgtcgtcaactgggcgaatgatgggcaggagttaagggatttcagacctcgttctgtgattcgaaatccctccttctacttccaatcagccgtgtcttggtcaaatgtttcctcaggtatgccatcattccgctattatccggaagggttcatcttcagccacgtcggtgactgcctttttggtgacaaagacatattgcaacaattgcaatccctatgcaactcaagctacatgaaagcattactgtcagcaatagctcccacacttcatttcgaagtcggacagattgctactataccagtacactgtttgtctaatgcagtgaaagcaaaccttcatttactgattgaggcatctcggaaagactgggatggttttgaaacagcttggtcattccaatcaaatctcttaatagaaaacgacacaacaatatcctctcagattcaatcacttggctcagtgtggacagagctcagtcggcaacaatgtgaacatgagatagagaacaaccgtcttgtagcagaagcttatggcatcgaagacgatgtgccgattgacgtgcctctcgaacgcgtatccctcaaacgcaacaaagcgttcgcctatccgaaggcgagccccgaggagcgcgatgagctcttcacgctcgatctgatcaaagaactcatctcgtatgcggtcggctgcatgttcggacgctattcgctcgacgagcccggcctcatcctcgcgtcgcaaggcgagacgatggacgatttccatgcgaaggtgccggatccgtcgttcgaacccgatgcggacaatgtgatcccgatgtgcgaaggcgactatttcgaggatgacatcgtcgcgcggttccgcaagttcatcgcggtcgcattcggcgccgagcatcttgaggagaacatcgcatacatcgaacaggtcttgggcaaatcgttgcgcaagtatttcctcaacgatttctacaacgaccatgtgaagatgtattcgaatcgcccgatctactggcagtatgcgagccgcaccgacaacaaaggcgcgttcaaggcgctcgtgtacctgcaccgctacacgccatcgacgacgagcacggtgctcgcgtatctgcgcgactacatcgcgcgcgtctccgggtatgctgagatgctcgagcggccggaggaagccacgaatacgggatcagcaggaaaaagaaccaaggccaagacggccaaggacctgcgcgaggcggacaggctacgcaagatcgtcaacgaatgcaaggcatacgaggatgacgtgctctacccgttggcgacacgcaacatgccgatcgacctcgacgacggcgtgctcgtcaactatctgcgcatgggcaaggcggtgcgcgcgatccccgcgatcgagaagaaacgcaaggacgtcgagacatgggaatggcccgtgcacccattgggcgcagaacggtag

SEQ ID NO: 2268 - DNA, 3390 bp, Burkholderia sp.
atgacacacagcatcagtaatcaaccgctacccaaatcgttacgcacccaactggaaaacaccgtcaaggcggcccgggaagcggcggaaaaaggtgcaagcgctgcgctggcccagatggcggtggcggaagccaaggcacctgactatctgcctgacgagtctagggctctgcgccgacgcctgcgtgctcacggccgtgcactgggtgatgtaaaggccagcgacgacacccaaggtgtccaacaccttgtgtgggaggtggcctatgagcactggcatcgtatgttgtttgcccgtttcctggcggagaatggtctgctgttgtgggagccaggtgctgcggtgtcgcttgaagattgcgaagcgctcgtgcaggagactgacccagagatgaatctgggtgccaagaccaagtgggaactggcgggcaagctggccgctcgaatgctgccgcaggtgttcaagccttacagcccggtgttcgagttggccttcgcgcccgagtatcagcgagagctggaacgcctgatggccgccctgtccagcgagatgttcaaggccagcgacagcttaggctgggtctaccagttctggcaggccaagcggaaggacgaggtcaacgcctcggaaatgaagattggcgccgacgaactgcctgcagtcacccagcttttcaccgagccttacatggtggacttcctgctccataattcgctgggcgcttggtgggtgacgcgccatcccggcaagacctgcccggtgccactgacctatttgcgcacactggaagacggcacacctgctgcaggcaagttcgaaggctggcccgaccggctcgacgagttcaacctgctggacccatgctgtggctcggggcacttcttggtggctgccttcctgatgctggtgcctatgcgcatggcggcagagggcctgagcgcgagagatgcagtggatgccgtgctggccgataacctgcacggcctagaactggaccctcgctgcgtggaaatcgccgtcttcgcgctggccttggcggcatggcgctatccggatgagaacggcgacttactcggtgtgcgtgccgacatgccagcgccccaggtggcctgctgcggcctcaaggttgccgcgaagcctgaagactggatggcgctggtgccagacgatgcgcccaacgcggcgttcctgcgacaggaactgcgcctgctgcatgtgagctttgcccaggcgccgctactgggtagcctgcttgacccggcacggagcctgaagaacgacctggccacctccagcctcgacatgttgcgcgcgttgctggaacaggctttggccaccgagcgtccggccacgctgtcggggctcggcagcgaattgcaggacgacacttgggacctagcgttgaccgcccgtggactattggatgctgcccgactgctggatactcgttaccacttggtggtgaccaacgtaccctatctggcgcgcggcaagcagcatgacgccctcaaggactacttcgaaacccactatccggaagctaagaacgacctagccaatgtgttcctagaacgctgcctggaactggcccacgagcctaaaggaagcctgggcgcgggcgtggtgcaaattgtaatgccgcagaactggctgttcctcagcagctacacgaaacagcgtaaatcgcttctcaagcgtgtgcaatggaacctgttggcacgcctcgggccgcgcgcattcgagaccatcaacggtgaggttgtgcaggccattcttctgacccaaacgcgcgcgccggctgcggagggtttgctgctgcgcggcttggatgctagcaggcccaaggtcacgcaggagaaggcggaactgttgcgtactggtgagttggcggcggcgagccagaagatgcaattactaaatccagatgcccgggttgtgctcgaagccagcgatgctggcgagttattagcacgatttgctgcgtcgccgaatggtatgcatggaggggattctcctcggttccgcatgcaacactgggagttgcccttgccgtccgcggactggcgtcactttcaatcccccgtcgacgagaccgtgctttatggtggtcgcgactctgttttcttctggccagacgacggaatgattcacctagacaatccgaatgcaagagtgcaggggcagtcaagctggggaagtgctggggtcgctgtccgtgtgatgaagcatctgccgtgcactatctatacgggggagatgttcgacatcagttgctcgcccgttacgccgtataacgagtcgcacctcgcagcgatttggtgcttttgttcttcgtccgaatacaatgaggcggtccgccaaattgaccagaagctaaacgtgactaacgcaacgctggtcaaggtcccctttaaccttgaacactggcagcaagtcgcggctgaacgctaccccaatggcttgcccaagccctattccgatgacccgacgcagtggctgtttcatggtcacccacagcctactagcgaccaactgcaagtggcggtagcccgcctggtgggctatcgctggccggctgagactgatgccacaatgaaactggccgacgaggcccggacttggatagcccactgcgacaagctggccgagcacaccgacgacgacggcatcatctgcctgccttcggtgcgcggtgagctgcctgcccgtgagcgtgtgctcaaagtgctgattgctgcctgggaaacggtgcagcccggcagttggaaacccgctgtgctcgacaagttgcttgccgacgccgactgcgctggcaaaagcctagacgcttggttgcgcgacaaattctttgagcagcacactaagcgttttcagcaccgccccttcatctggcacgtgtgggacggcctgaaggacggttttgccgcgctggtcaactatcaccaactcgacggcaagaacctagagcgcctcatccacacctatcttggtgactggattcgccagcaggaggccggcgtgcgcgatggcgtcgacggcgcccaaactcgcctggccgctgcgcaagacctaaagcgccgcttgcagcttattctcgaaggcgaaccgccctacgacattttcgtgcggtggaagaagctctccgagcagcccatcggctggaaccccgacctcaacgacggtgtgcgcctgaacatccgcccttttatgaccgccgaggttctgcgccacaacaagaagcccaagctcaacatttcgtgggaaaaagaccgcgggaaggatgtagaaagtgcaccgtggtacccggtgttcaagggcgagcgcatcaatgaccatcatttgactgtggcggagaagcgcaaagcgcgagccgagtcgggggattga

SEQ ID NO: 2269 - DNA, 3633 bp, Burkholderia gladioli
atgaacaaagccaatctcaaagcctacgcgccgcaagcgcggctcgatttcatcgccgccgtttccgctcgcgcgaacctgctgggcatcagcatacaaggcgttgcgcctgccgaaacccgaggtgatgtcgcgattatcgaaggacgcgagtggcccaaaaaggtgctcgcgcagcgccaaaaactaattgctcgaattgagaaggaaggtttctctcaaaccatcgaagcggtgacttacacgtggttcaaccgattcgttgcgcttcggtttatggagttgcacgactacctcgcgcacggttgccgtgtgctgtcgaaccgcgccggagggcagcccgaagtcctttcgcgcgcggcagaactggatctgcccgggttgcccgtcgatcgcattcgggacatgcaactggccgggaatcaggacaatgaactctacaagctcttgattgttgctcagtgcaatgagctgtcgcgtgtcatgcctttcctattcgagcgtatcgacgacgagtcggaactgctacttccggacaatctattgcggacggactcggtcatcgccaggcttattgccggcgtgcccgaggaggactgggcgcaaattgagtcgatcggctggctctatcagttttacatcagcgaacgcaaggacgaagtgattggcaaggtcgtcgagacagcggatattccggcggcgacgcagttattcacacccaattggatcgtcaaatacctcgttcagaacagcgtcggccgtttatggttagaggccaaccccgagtcggcgttggctcagggactggattactatctccctcctgcggcgcaggtgcctgaggcgcaagctgaccttgacagacttgtccgggtgcgaatcgccgaagacggggtggcgctgaatccagagtcgatcaccatttttgacccggcatgtggttcgggtcatatgctggtcgaggcgtatgagctcctgaaagcgatctacttggagcggggctatcgcccacgcgacataccgcggctcattctcgagaagaatctatacggtctcgacattgacgagcgcgccgtccaacttgcgagttttgcccttttgatgaaggcgcgcgccgatgaccgtcggttgctggacgctccgctgaaactgaacatctgcgccgtgcaggacagcgttgacactgacgatgcgctcatagcgaacataattcttgacgcagctgttcagattgaccgcggtgaatcgtctggcagtgctcatttgtttggaggggacggcgtgaccgatcacgcccatagcagtggtctccaagccgaagatctgcggatgcttgtgcggtttttccggcacgggaaggcgtttggttctttgctcatcccgcccgttgaactcgtcgaaaaattgtcgacgcttagtgcagtgttagatcaagtggagagcgacgggaatgccttggcgaagcaatactctcatgagctccgccagtattatttgcgtcccgcgcaattgttggctggcacctatgatgcggtgatcgcgaacccgccttatatgaacagcgggggcatgaacgccatcctcaaggcctttgcgcaggctgaatttcctgacagcaagctggacctcttctccatgttcatcgagcggggttttcgctggtgcaaggaaaccggttttaattgcatggttacgatgcagagctggatgtttctttcatcgttcgaaaccatgcgagagaaaatcctggcgaatcgaacgattgcaagcctagtccagatcggattcaatagctttccggagattaactccaaagtcgcccaggcttgcacgttttgtatcgccgcagtcccgatccggcatcatgttgcgcaatacgtcgatttgaacaccgcgccccagtcttcggataaggatgaggtgtttcggaagaggaccgccgcaatggttttctcggtggatcaaactgagttcggaaccattccgggaagtccaatcgcctattgggcctccgaccgtttccgcgagttgttcgcgagcggccgcaccattgaggacatcgcgttctcgaagcaggggttggcgaccggcgagaacggccgcttcatccgcctctggcacgaggtctccatcggcaagattggcctctcgatggacagccgcgcagaggcgaaagcctccggcaagaagtggttcccgcacctgaaaggtggcgcgttccgccggtggtatggcaactttgagacggtggtcaactgggaggacgatgggcgggaggtgcgcgcgttcgggacggaaaacggggggcgggcgcgatcgcgggcgcaaaacgtcgagttttacttcaagcccggcatcacctggtcggatttgacgtccaccttttttggctcccgccaggtgccgcaggggttcatcatcaacacggtggggccgagcctcttcgccaaatcgggccactcgctcgatggccttctgggctacaccaactcgcgggtgttccagcgcatcgtcgacgtcagcttgcaaggtctgcactacaacaacggcgtgatcggcagccggccttacgtgccgccgacccacgtcgagaaggtgcgcgcgttggagcgtgagctcgtcgcgatctcgcgacgcgattgggacgcctatgagggctcgtgggagttcccgggccacccgtgcgcgtcggccgaggcgcgctcgctcgacaatctcgaggccgcgtggaacgcgtgggcgcaagccaagtcggcggacgtgcgcgcgatgctcgcgctcgaagagtccaacaatcaattcttcatcgacgcctatggcttgaacgacgagatttcgccgaccgtcagcgaagagcacatcacgctggtgcggccggaccgcgtcaaagacgcccaacgcttcgtctcctacgcgatcggctgcatgatggggcgctacagcctcgacgaacccgggctgatctacgcgcacgcgggcggcgagggctttgacccgacgcgatacgcctcgtttgccgcagacgccgacggcatcttgccgaccatggatctgccgtggttcgacgacgacggcgcgcaacgcatccgcgagtttgtgggcgccttgtggggcgtcgagcgcgcggacgaaaacctcgaatggctagcgcagagcctcgggcccaagagcgacgaggcccctgaagagaccattcgtcggtatgtggccgacagctttttccgggatcacgtgcaggtctacaagaagcgaccggtctattggctgttcagcagcggccggcagggcgctttccaagccctggtctacatgcaccgctacaacgagcgcacgctcgcgcgcctgcgctcggagtatgtcgtgccactctcgaccaagctggtcgcgcggcttgaattgctcgacaaggacgcggccgccgcaagctcgtcgtcgtcgcgcagcaagctacaaaagcaaatcgacgcgctacggaaaaagcacgcggagctgctgagcttcgacgagaagctgcgccactacgcggacatgcgcattcagatcgacttggacgacggggtgaaggtcaactacgcgaagtttggcgagctgctcgccgattcgaaaacggtcaccggcggcagcgatgactag

SEQ ID NO: 2270 - DNA, 1878 bp, Calditerrivibrio nitroreducens
atgcctacttttataaaattaacagattacaacagcagtgaggaaaaagagaaaggtttttttgacccaaaaaataggtatgtagcaaaacaggaagattttggaaagattccgggtagcccgattgcttattgggtgagtgatagagttaaggagatatttgagaagagcaagaaattaggagaaattgcagagccaagacaaggcctaataacaggagacaatgatagatttttaaaattctggtatgaagttgatatctataatattggttttggtttttcaaatagagaagaagcaaaagaaagtggattgaaatggtttccttataataagggtggtgattttaggaaatggtatggaaattatgaatatgtagttaactggaaaaatgatggaaatgaaataaaaaattttattgataacaaaggtaaacaaaaatcaagaccacaaaatgtatcatattactttagagaggggttaacttggacagcattaacaagtggaccatttaatctaagatattcaaataaatttatttttgatgctaaaggtcctatgctttttagtaaaataggcaatataaaatatttattatctttcacaaattgtatagtaacaaatagttttttaagaattttagcaccaactatggattataatcaaggccctgtttataaaattcctataatctttccaaaatctgattcaacaaaacaaaagatagaggaattaactcaggaatgcatcgatatctcaaaagaagactgggatagcagagaaacatcttgggacttccgaaccaatgagttggttcgaattatgaattatgaatttttaatgttgaatgaaagcaagaaaaataattcaaaatccaagattcaaaatttaacattagaaacgatttataatcgttattgcgagtattggagagaaaagttttttaaacttcactccaatgaggaagaactcaatagattatttatagatatttacgaacttcaagatgagcttacacctgatgtgcctcttgatgaaatcacaattttaaaggaagaaacaaagattgtagatggagatcttgtatttaataaagatgcaattgtaaaacagtttatatcatatgctgttggctgtatgtttggaagatactcactggatcacgaaggtttacatatcgccgatatgggagtaagcatagaagaagcaaattcaaaattcaacattcaaaattcaacatttactatagatgatgataatattataccagtatttgaatttgatttttttgcagatgatattgtttcaaggtttaaagagtttttaaagattactttttcagaaaagacattatatgaaaatctatcatttatagcagatgcacttggtaaaaaatcaagtgaatcagacgaagatgctattagaagatattttcataaagaattttatgtagatcatgtgagaaggtataataaaagaccaatctactggatgtttagctccaatccaaaaggtgctggtgcatttaatgtattgatctatatgcatagatactacccaggaattgtagctaaaatcaggacagactaccttcacccttatatagacaagatcgaattcgaaaaaaacagacttcagcaatcaatcgataacgatgtattgagtggacaaacattgaaaaaagctcaaaacacgatagataaaatagaaaaatatttaattgagctaagagagtacgacgtaaagcttaaatactatgctgataaaatgataaaaattgatctcgatgatggtgtaaaggtaaattattgtaagtttcaagatattttagtagtatttgataataaattgtgcacggagtcagaaacggaggaatag

SEQ ID NO: 2271 - DNA, 1740 bp, Calditerrivibrio nitroreducens
atggacacaggtgaaatcaaaaagtttgctgtaagatcaagacaattatttgtagagcaggtaaaagtaaaggctgctttgttgggttttagtgagaaggggattacagaatatagagaagtcaaaaatgaggtaattgtaaacgaaagggtatatcccagaaagcagtggaaagagattgagaggattgtaaaaaaaggtaagaatagctatttaaatctaatagatgaagtggcttatacgtggtttaacaggtttgtggctcttaaatttatggaagaaaacgggtatataagtcatcgctttgtaaaatcatcatcggaaaagtggtatcctgacgtattaaattcacctgagttgacaggtattctggataaaaatgaaataatacagctgaggctaaacaacgaatatgaaaaattatacaaaaagctcttgattgctcattgtaataatctcaacaaagctatgccctttatttttgaggagatagatgattatacagaattgttgctgtcggatctgcttttatcgtcaaaatcaataatagctcatattgataaggggctacctgcagagttttggaaagatgttgagattattggctggatttatcaattttatatctctgaaaaaaaagatcaggtaataggaagtaaaaaagcatacaaaaaagaagatataccagcagccacacagctttttacaccgagatggattgtggattatctggtacaaaattcggttggacgtatctggatggagtcgtatccaaaatctatattgaaagataggatgaaatactatgtagagtctgatgtagatgttgaaaagaaattttatttaaatttaaatccagaaaacctgatgataatagaccctgcttgtggatcaggccatattttgattagagtgtttgatattttgatgaatatttacagggagatggggtattctgatcttgatgcggtgagaaatatagttgagaaaaatctttatgggctggatatagacaaaagagcggtacaactggcttgttttgctgtgatgatgaaagcaagggaatatggaggctcaaaagtattatcccaaaaatttgacctgaatatttatgaaatacaggaagtggatgaaaatcttataacctccacagagtttataaaagggctatcaaaagaggaagatggcgaattacaagaaatattatcaatttttgtagaagccaaaaattttggttcattaattacaataccagatagatatatagaaaaacttgattattatctggatctattatcaaaacaattaaatgacgattttgatcttaccagaaaatatgcgtcaaaatattatcagatcttaaaaatagctaaaattttggggcaaaaatatgatgctatgattgccaacccgccatatatggggaatagatttcataatgatattttaaaaaaatttttgcagaataattatccagagtcaaaatcagatttatttgcggcgtttattgaaaggggctttgaatttttaaaagatggaggattcgaagcaatgatcacaatgcaaagctggatgtttttgagtcgctatgaaaagttgagaaagaaaattttaaaaaaatatcagatagtcaatatggttcatttagggacaagagctttccctgaaattggtggtgaagtagttcaaaatactgcttttgtaataaggaactgtaatcctggagatatacttgagtaa

SEQ ID NO: 2272 - DNA, 3624 bp, Carboxydothermus hydrogenoformans
atggataagagtgctgttaaaaattttgccgtatgggcaaggagaaagcttatagaagatatcactcaaaaagcctttgaaattggcataacggagaaaggaattgctaaggcagaaaatgtatcctcagatgcagttaaggtaaacggcaggctgctgggaaaacatgaggctaagcagaggggaatacttatagccaggataaaggaaaaagggtttcaggaagttatcgaggaagttgcctatacctggttcaaccgcataattgcaatcaggtttatggaggtaaatgattaccttccaacaggtgtaagggtgctttcttctatagaagaaggcaaagcggtgcctgatattattaccaatgcgctttatgttgatcttggccaagatcctgatatagtgcaccagtatcttgataaccatgatgatgaaggacttttcaggtatctttttattaagcagtgcaacaaactcaatgagattcttccctttctttttgaaaagattgaagattatacggaactgcttctgcccaacaacatgcttgcagagggttcggtcatacgacggcttgtaagcgatataaaggaagaggacttcagggatgttgagattatcggttggctgtaccagtactatatatccgaaaaaaaggagaaagtgtacgcagatttgaagaagaatataaagataaccaaagaaaatattcctgctgcaacccagctttttaccccagactggattgtaagatacatggttgaaaattctcttggcagactgtggcttgagggacaccctgatgaagaactgaaaagcaaatggaagtattatttggaggaagcggagcaggagccagaagtacaaaaacagcttgcagagataagagaaaagagtaaaaacatcaggccagaggatatcaaggtgcttgatccatgtatgggcagcggccatattttggtctatgcctttgacgtgctgtttgacatttacaagagtgctgggtattccgaaagggatattccaaagcttatattaaagaataacctttatgggcttgatatagacgacagggcagctcagcttgcttactttgcggtgatgatgaaggcaagaagcaaaagcagaaggatatttaaccagataaaggatgaaaatattgacctaaacctctgtgctattcaggaaagcaatggcatatctaaagaagcattagagttctttttgaggggtgccgatgaaaaacttaaagcggatgtggaatacctggttaaggttttccatgatgcaaaagagtatgggtctatacttgaggttgagcctgttgattttgatgctattgagaaaagactggaagagtttaagaatgaaacaggggatttatatgagtatcagtataggaatgtgatacttgaaaagatgccagcgttagtaaaacaggcaagaataatgagtcagaagtatgatgtggtgtgcaccaatccgccgtatatggggaacaaaggggtaaacagtagccttaaagattatatttccgagaagtttaaagatgtaaagtatgatttattttcagtttttatagtaagaaattttaactatgcaaagcaatatggccatttaggatatatgactccttttgtgtggatgtttatttcttcatatgaaaaattaagagaaattataatcaagagtaaatctattacttctcttgtgcaattggaatactcaggctttgaagaggcaactgttccgatttgtacttttactattagaaacgcttatattcctgcgaaaggagaatacataaggctatcagactttagaggaactgagttgcagccaataaaaactcttgaagcagcccaaaatcgaaatgttccttatagatattcagtgagccctcataactttgaaaaaattcctggcatgccaattgcgtattgggtgagtgaaaaggttattgattgctttaaaaaaggtagaccattaggcgaaattgctgagccgaaactcggaataacaacggcggacaatagcagatttttaagattgtggcatgaagtagcaattgataggataggatttaattatccaaatagggaaaaagcagctgaaagcaggtttaagtggtttccatacaataaaggcggagaatacagaaaatggtatggtaacaatgaatatgttataaattgggagaacgatggttttgaattaaaaaattttaaacctgcaacagtaagaaatattgattattattttcgcaagtcaataacctggtcatttgtaagttcatcatattttggggtcaggtattcagaccgaggctttatttttgatgtcggaggttcttctgtatttccgccagaaaaataccatttatttttgacagggtttttatgctccaagatttcaactttattaatgaaggttttaaaccctactctgaactttcaagtaggaaatgttgcttcgttacctgttatattaccaaatgatgatgaaaaggctaagatagattctctcgttgaagaaaacatatatatttcccgtaccgactgggactccttcgaaacctcctgggatttcaaaaagcatcctttgcttatccataaaggcagcagcaaaactatagaagaagccttcaacaactgggctaaatttgctgaacagcagttttataagctcaaagccaacgaggaggaactgaaccgtatattcattgaaatatacgggttgcaggatgagcttactccagaagttgatgaaaaagatgtaaccatcagaaaagcagatagggttagagacatcaagtcctttatttcctatgctgtcggctgcatgttcggcaggtactcaattgatgtcgaggggcttatctatgctggtggcgagtggaaggaaaagtggagtgacggtaaggttagaaagatcgaaaaagacgaggacggtaatgtgatatccgatacctgggtagatgcgacctatttgccagatgaggataatatcattccgattcttgatgatgaatacttcgatgatgatattgtgagcaggtttatagaattccttaaggtgacttttggcgaggaaaagctggaagaaaatatcaactatattgccgaaactctggggaggaagccttctgagaccccaaggcaggccatcaggagatatttcctgaaggaattttataaagaccatgtgcaggtctataaaaagcgacctatttactggctctttgattcaggcaaggaagacggcttcaaggcacttatatacatgcacaggtatgacgaatataccgtggccaggatcaggactgactacctgcatccgcttcagaggaaatatgaggcagaagtcaaaaggctcgaaatcctgattgaatcagatgtatcggaaagggaaaaggcagttgcccgcaagaaaaaggaaaagatacagaagcagattcgggaatgcctcgcttatgaccaagttattgctcacgtagcaaatcagcggatcaaaattgatcttgacgatggagtggcagtaaactacgccaaattccagggcattgagatcccgcagggagaaggcaaaaaaaccctcaaagcaaatcttttggcaaaaatttga

SEQ ID NO: 2273 - DNA, 3516 bp, Chlorobium phaeobacteroides
atggaaacacttaaattaaagcgattcgctcaatacgcccgacgttctctgctggaacaggtctccgccaagctgaaacttgtgctggcagaaaacagcgccgcccggcgtgaacgtgccgagaccgtcaagaaactcgaagaggcgatcaaggggcacggcaaggaacaggtcatcgagcgggtggcgtacatctggttcaaccgcttttgcgccctgcgcttcatggatgtcaatcgctacaatcgtgtgaacattgtctcaccggccgaccccggccagttccagcccgagattctggccgaagccaagatggggcacatcgacgaagaaatggtgcacgacaaggtccggcagcagatctttgccctgctcgatggcaaagcgcccagccgcgatccgcagggcgaggcttaccgcctgctggtggtggccgcctgcaacttctggaacaaggcgatgccgttcctgttccagcgcatcgatgactacaccgaactgctgatgcctgacgacctgctctcgggcaactccatcctcgcctacacccgcgaggcgatgacgccggatgcctgcgaggatgtcgaggtgattggctggctataccagttctacatctccgagaaaaaggacgaggtgttcgatggcctgaagaagaacaagaaaatcacgcccgagaacattccggccgccacccagctttttactccgcactggatcgtgcgctacctggtggaaaattccctcggccgcctgtggctgctcaaccgtcctggctcgaagctggccctgcagatggactactacatcaagccagaacaggccgagaccgacttcctacgcatcagcaaaccggaagagatcaagatctgcgacccggcctgcggctccggccacatgctcacctatgcctttgacctgctctacgccatctacgaggaggaaggctacgagcccgccgagattccggaaaagatcctcacgaataacctctacggcatcgagatcgacgaacgcgccggggaactggccgcctttgccctgaccatgaaggcccgcgccaaacagcgtcggttcttcaacaagggtgtcaagccgaacatctgcgtgctggagaatgtccacttcgacgagggcgagctgaaaaactacatggattttgtcggacgcgacctgttcaccgcgccgctgcaaaccaccctgcgccagttcgaagaggccgacaacttcggctccctgatccgtccggatgttaccgatgtggacggcatgctcaggattctggagtcaaaaaacgtctccgggcagctgtttatcagcatgacccatcagaaggtgctgcaagccctgaggcaggccgattacctgagcccgaaataccatgtggtgattgccaatccgccgtatatgggcggcaaagggatgaacgggcggctggcggcatgggtaaaggacaattacccgaataccaagtccgatttatttgccatgttcatagagcgtaaccttgatcttgctcagaagcatggagcggttgcgatgattaccatgcaaagttggatgtttctgtcatcttacgagtcgcttcgtgtacgtattctaggacagagcacactgctatcaatggctcacctcggtgcgcgggcttttgatagcatcgggggtgaagtggtgtcaaccacagcctttgtgttggagaactctaatcggctggattacaagggcgattatttaaggttagttgctggcaattctgaagccgagaaaaatgaggcaatccgtgaagcggttaagaatcctagctgtgactggttctatcgtgcatccgctgccgacttccaaaagattccaggaagcccgattgcttattgggcaagtgacaagttaatcgattcgtttgaccatccgaaaattcaagatattgcaacgctttttcaaggaataataacaggagataacgagaaacttgtgcgtgtttggcaagaaatatgcttaaagcgcgcttcgcttcaggcgcatagtattgaagaaatcgactgcattagcaagtattgggttccttataacaagggtggtacttttagaaaatggtatgggaatcgtgagttgcttgttaatttttcagagaaaggaagaaactttactcgtggcaagcatcagttttactctttcttctttaaaccttgtttttcatggacttacataagctcgaagagtatcgcatctcgatactttgataactttatttgggatgtgcatggttcaagtgcattccctgaaaaggaagaagacatctatttcttgatgtcactaattggttcgtacgccggatacgaagttcttaaaatattaaacccaacgataagctttcaggttgaaaatattgccgctgtccctgtggcccctctgaaaatcgaagtgaaacatgatattatttctagcactaagggattgattcagcttgctaaacgcgactgggattcctacgaaacttcttgggacttcaccagcctcccgctgctgaatcctgactaccaccagccaactctgaaggggacttaccagaaactccgcgcccattggcgagaaatgacgttggagatgcagcggctggaggaagagaacaaccgcatcttcatcgaagcgtacggcctgcaggacgaactgacgcccgaggtgccgctcaacgagatcactctgacctgcaacccgcactaccgctatggcaacgacaagagcgaggaagagttggaggcgctgctactggccgataccatgcgcgaacttgtctcctatgccgtgggctgcatgttcggccgctacgcgctggacaagccggggctgatcctggccaaccagggcgagaccatcgaggactacctgaagcgggttccggagcccagcttcccggccgatgacgacaacgtcatccccatgctcgatggcgactggttcaccgacgacatcgccgagcgcttccgcaagttcatgcgcgtggcctttggcgacgagcactacgaggccaacctcaagttcgtcgaaaaggcgctgggcaagaatggcaaggcccgcgacatccgtgattacttcctcaaggatttctacagcgaccatgtgaggcgctacaagaagcgccccatctactggctgttctccagccccaagggcagcttcaacgcgctgatctacatgcaccgctaccgcccggataccgttagcgtggtgctcaacgattacctacgcgagttccgcaccaagctcacctcccacaagaaccatctggaggcggtcagcatcagcgccagtgcttcacaaggcgaaaagaccaaggccctgaaggagatcgaaaagatcaccaagatgatcgccgagatggaggagtacgaacgcgaagtgctgtacccgctggccaccgagcaggtggagatcgacctcgacgacggcgtgaaggtcaactaccccaaactcggcgcggccttgaagaagatcgtcggcctggatgcgaaagaggattaa

SEQ ID NO: 2274 - DNA, 3705 bp, Clostridium clariflavum
atggataaaacagcaataaaaaattttgcagtatgggcgagaaaaaaacttattgaagatataaaacagaaggcttatgagataggtataactgagaaagaaataaaagagcctgaagtttctacatcagatacaataataataggagataggaccttgaataaggcagaaatgcaacagagaaaaagtcttgtgtcccggataagagaaaaaggatttaacaatgtgatagaggaagtggcatatacttggtttaacaggtttattgccctgcgtttcatggaagtcaatgaatatcttcctacaggagtcagagtgttgtcatccattgaaccaggcaagaaggagccggatattattaaggaagcacttaatattgaccttgatatagacagagaactagtgtatagattgcaggatggcaatgatactgagaccctctacagatatcttcttgtaaagcagtgcaatgccttaaaagaaatccttccgggactatttgaaaagattgaggattacactgaaatccttctgccttcaaacctccttggagaaggttccgttataaggcggttggtagatgacatacctgaggaggatttcaaagaccaggtggaaatcatcggttggatgtaccagtattatatttctgagaaaaaagatgaagtatttgaaggtctgaaaaagaatatcaagataaccaaggaaaatattcctgctgcaactcaattgtttactcctgactggattgttaaatatatggtggaaaactccctagggagactatggctggaagggcatcctgatgaagaattgaagagcaaatggaagtattaccttgaggaagcggaacaggaacctgaagttcagaaacagttggaagaaatacgtgaaaagtgcagggatataagaccagaggatataaaagtgttggaccctgctatgggcagcggtcatattttagtgtatgcctttgatgtgctctacgatatttacaagagtgcgggatattccgaaagggatattccaaggcttattcttgagaacaacctgtatggactggatatagacgacagggcggctcaacttgcctattttgcagttatgatgaaggcaaggagcaagagcaggaggatattcagggaaaaggtaaatgttaatgtatgtgctatacaggaaagcaatggcttctctagagaggctatcgattatcttgtaaattctgaggaaaccgagatagagaagcgggtgcatagggaggatgtagagtatcttattaatgttttccatgatgctaaggagtatggctctatccttgaagtaaagcctattgatttcgatgctattgagagaagattagaagagataaggaatgggggaacccaggatttatttgagtttcagtacaggaatataatacttgagaagataccggctttggttaagcaggcaaggattatgagtcagaagtatgacgtggtgtgcactaatccgccgtatatgggaagaaaagggatggtaagtaaactaacagcctatttagatataaattataaagattctaagagtgacttgtttgctgtttttattgaaatatccaggaaatatactaaattgcttggttatatatcaatgatttgccaacattcatggatgtttttatcaagttacgagaatattagaaagcaaattattaataattgtgcaatagtatcgatggtacatttgggttctaaagcattcgaagaaataagtggtgaagtagttcaatctactacatttgttataagaaactatgcagtagattctaaatccgtatttattagactagtaaattttaaagatgcacttgaaaaagaaagtagatatttaaattcaatacaaaaccctaaaatttcttataggtatgaaaatataaaacaaaaagattttaataaaattccaggtaatcctattgcatattgggcaagcaataaggttttaagcatttttgaaaactatccgcttctaaattctataggtgttacaagacagggtttagcaactggaaacaatgaaaagtttcttaggttatggtacgaagtaaaaatggaaaatatttatttttacgctaacgataaagatgaagcaatcgcttcaaaaagaaaatggtttccatgtaataaaggtggaagcaatagaaaatggtttggcaataatttatatgttattaattgggaaaataatggtttagatataaaatcttttaatggttcggttattaggaatgaaagttattactttcaaagtggaattacttggtcttcgcttagcacatcatttttagcaatgagatattgtccaaggggatttatttttgaatcaaaaggctcaatgctttttttaaatgatattaaatatattttaacaattttaggattattaaacacgaaagttattaatcactttattggaatgatttcacctacaatggattatcatgagggaccaataggtagaataccggtttattacaaaataatagaaagtgtagagaaattagtagatgaaaatattttcctttcatctactgattggaattcatttgaaatttcctgggattttcaaaatcacccgttattcacctacaaggaaaacagcacaacattagcacaagccttcgataattgggtatccttttcggaaaaacggtttaaccagttaaaatccaacgaagaagaacttaaccgcatattcattgaaatatatggcttgcaggatgaacttacacctgatgttgaagataaagatgtgacagtgcataggatttataatactaaagatgatattccggaaagtatgaaaggtagcaactatgtactaacaagagaagatgtaattaagtcctttatctcctatgctgtaggctgtatgtttgggcgatactcaattgactcagaaggccttatttacgccggtggagattttaaggataggtggaagtatgaagacgggcagtggaaagtaagaaagatagtaagagatgaagaaggcaaagtagttgaggatacatgggtagacgctacttttgtacctgacatggataatgtcctacctattaccaatgacgaatactttgaggatgacattgtcagcaggtttattgagttcctcaaggttacatttggtgaggatactttggaagagaacctcgattacattgccgatacattgggaagaaagtcctctgaaacagcaaggcaggctataagaagatatttcctcaaggatttttacaaggaccatgtacaggtgtaccagaaaagacctatctactggctctttgattctggcaagcaggacggttttaaagcacttatctatatgcaccgatatgatgagtttacggtggcaagggtaagaaccgactacctgcacaaattgcaaaaatcctacgaagcggaaattaagaggctggatattattatcgattcaaatgtttctcaaagggagaaagccaatgcaagaaagaaaaaagaaaaaatattaaaacagatggaagagtgcttgcagtatgaccaggtaattgctcatgttgcaaaccagaggataaagatagacttggacgatggggtaaaagtaaactatgctaagttccagggcattgaaataccgcaaggtgaagggaaaaaaccgttgaaagcggacttgctggcaaaaatttag

SEQ ID NO: 2275 - DNA, 3636 bp, Clostridium clariflavum
atggataaagtagtgataaaaaaatttgctgtatgggcaaggaagaagctaattgaagatataaagcaaaaggcttatgaattgggaataaccgaaaaggaaattaagcttcctgggtttgccacatccgatactgcaataataggagacagaagtcttagcaagaaagagattgagcaaagaaaaagtttagtgtccaggatagaggaaaaaggatataacaatgtaatagaggaagtggcatatacctggtttaacagatttattgctctgcgtttcatggaggttaacaattaccttcccacaggggtgagaatcctgtcatcggttgaaccgggcaaaaaggaaccggacattattaaagaagcattaaatattgacctggatttggaccgggaactggtttataaattgcaggatgaaaatgataccgagtcactttacagataccttctgataaagcaatgcaatgccttgaataaaatttttcccggattgtttgagaagattgaggattatagtgaaattttgctgccttcaaaccttcttgccgaagggtctgtcataaggcgtttggtggaggatatatccgaggaagattttaaagaacaagtggaagttattggatggatgtaccagtattatatatccgaaaaaaaggatgaagtttttgaagggttaaagaagaataaaaagataacaaaagaaaaccttcctgctgcaacccagttgtttactccggactggattgtcaaatacatgctggagaactctttgggaagactgtggcttgaaggacatcccgatgaagagttgaagagcaaatggaaatattaccttgaggaagctgaacaggaacctgaagttcaaaagcagttggaagaaatttgggcaaagagcaagaatataaggccggaggatataaaggttttagaccctgctgtgggcagcgggcatattttggtgtatgcctttgatctgctctatgatatttacaggaatgcaggatattcggaaagggatattccgaaactcatccttgaaaacaacctgtacggtctggacatagatgacagagccgttcaattggcatattttgcggttatgatgaaggcaaggagcaagagcagaagaatatttaaggaaaaggtaaaagttaatatatgtgccatacaggaaagcaatggttttccgaaagaggcaatagactatcttgtaaatactggggagacagagatagaaaagcggttactcagagaagatgtggagtatctcataaatgtttttcatgatgcaaaggaatatggctctttacttgaagtaaagcctgttgattttgatgccattgagagtagattggaagagataaagaaaggagaagttcaggatttagttgagtatcaatatagaaatattattcttgaaaaaataccgccattggttaaacaggcaagaataatgagccaaaagtatgatgcggtatgtaccaacccgccttatctcggaagaagaggtatgaattccaagctggccaaatttgttgaagacagttataccacgggcagaaacgatttgttcgccgtgtttattaagatatgtttaaattactcaaagaattacgtttccatgataactcagcactcatggatgtttctgtccggttttgaggaattgaggaaagaaatattgaacttaactgttataaagaatatgcttcatcttggaacaaggactttcgaggaaattggaggggaagtggtacagtctgtctcatttacaatttcgaaaattaaagtaagaggatataatggattatatataagactgtgtgattatatgagttcggaagaaaaaaggagaaacctgtttaacagaaataattattatacggtaaacagtgatgaatttttcaaaatagagggtgcacctattgcctattgggccagtccgaaggtaaaaaatattttttcagacagtataaaacttggagatatagcgtacccgagaaaaggtaactcaacatctgacaatgacagatttttgagattatggtttgaagttgatattgacaaagtgaattttaatgcaaaaaaaataatcaaggaagaaacaattgtcagaagatggtttccttacaacaaaggcggcgggtacagaaagtggtatggaaataactattatttgattgactggaagaatgacgctgaagaaattagaaaaattcctacagcggttatagcaaattaccattactttatgaaaccgggattaacctggtcaactgtttcgacaggtaaattcagcattaggattttcggatacggatttatctttgacaatggcggctgctgtctgtttaccgatgaggaagatagactttactatttggcattgctaaacagcaatatatttgattatttgttggggttattaaaccctaccgttaactatcagtcgggtgaaattgccaaattccctgtagtttttgcgaaatctgaggatgccgggaatagaatcaattcattagcagaagataatattcagatagcaagaattgactgggattcttttgaaacctcctgggactttaaaagacatccgctacttgcccataaaggggatagcagcactgtacaacaggctttcaataattgggctgcttttgcagaagaacagtttaaccggttgaaagccaatgaagaggaacttaaccggatattcattgaaatatatggcttgcaggatgaactttcaccggaggtggaggatagggatataaccgtcagaaaagccgaaagagtaagagatatcaagtcctttatttcctatgcggttggctgtatgtttggaagatattccattgatgcagaaggacttatctatgccagtggcgaatttaaggataaatggaaaaatgaggacggaaagtggaaagtcagaaggatagtgaaagatgatgaaggaaaagtaattgaggatttatgggtggatgctgcttttatacccgatatggataatattatacctgtcactgacgatgaatattttgaagacgatattgtcaaaagatttattgagtttcttaaagtaacatttggcgaagagactttggaggaaaaccttgattatattgccgataccgtaggtaaaaaggcggatgaaacttcaaggcaggctataagaaggtattttctcagggagttctataaagaccacgtgcaggtataccaaaaaaggcctatatattggctttttgattccggtaaggaaaatggatttaaagcactcatttatatgcaccgctatgatgagtttacagtggcaagggtgagaaccgattaccttcataaattgcaaaaatcctatgaagcggagattaagagactggatattattatagattccgatgcatcccaaagagaaaaagccggtgcaagaaagaaaaaggaaaaaatattaaagcaaatggaagagtgtcggctatatgaccaggtaattgcccatgctgcaaatcaaagaatagagattgacttagatgctgggataaaagtaaactatgcaaggttccaggggattgagattccccggggaaatgacagaaaggcattgaagacagacttattggctaaaatttaa

SEQ ID NO: 2276 - DNA, 3663 bp, Clostridium clariflavum
atggataaagcggcaataaagaagtttgccgtatgggcaagaaaaaaacttatcgaagatataaagcaaaaggcatatgagttgggaataacagaaaaggaaataaaaaagcctgatgtttctacatccgatacagtgataataggggacagaagcctgaacaggaaagaaattgagcaaagaaacagtcttgtgtccaggatagaggaaaaagggtttaacaatgtaatagaggaagtggcatacacctggtttaacaggtttattgccctacgtttcatggaagtaaacggttaccttcccacagggataagagtgctgtcatcgattgaacctgacaggaaggaaccggatattattagggaagcattgaatattgatctggatttggaaagggaactggtgtataaactacaggacgacaatgatacagaatccctttacagataccttctggtaaagcagtgcaatgccttaaacgaaatacttccgggattgtttgaaaagattgacgattatactgaaattttgctgccttcaaaccttcttgccgaagggtctgtcataaggcatttggtggaagatatatccgaggacgattttagagaacaggtggaaataatcggatggatgtaccagtattatatatcggagaagaaagatgaagtatttgaaggactaaagaaaaatataaagataactaaggaaaatattcctgcagcaacccagttgtttactcctgactggattgtcaagtacatggtggagaactctttgggaagactgtggctggaagggcatcctgacgaagagctgaagagcaagtggaagtattacctggatgaagcggaacaggaacctgaagttcagaagcagttggaggaaatacgggctaagagcaaggacataagaccagaagatataaaagtgttagaccctgctatgggtagtgggcatatcctggtgtatgcctttgacgtgttatatgatatttacaagagtgctggatattctgaacgagatattccaaaacttatacttgaaaacaacctgtacggactggatatagacgacagagcagcccagcttgcttattttgcagttatgatgaaggcaagaagcaagagcaggagaatatttagggaaaaaataaatgtcaatgtatgtgccatacaggagagtaacggctttccgaaggaggcaatggactaccttgtaaatcctgaggagacagagatagagaagcggttacacagggaagatgtagagtatctgataaatgtattccaggatgcaaaggagtatggttctatccttgaagtaaagcctattgattttgatgcaattgagagaagattggaagagataagggatggagaaattcaggatttgattgagtaccaatttaagaatataattatcgagagaataccaccattaataaaacaggcaaaaataatgagtcagaagtataatgttgtatgtactaatccaccatatatgggggatgacggcattaacttaaaactctctaaatttctaaaagaaaactataaggacacaagaagcgacttgtttgcagtctttatagaaaaaactattaagtttagcacaaaaagttcttatatatcaatgataacacaaaattcatggatgtttttaagaagttatgagaaattaagagggatgattttaaatggagcaactattaattctatggtacatttaggacctagggcatttgaggaaattgatggtgaggttgtgcgaacaactgcttttgtattaaacaacaatgttcttaacggctataaaggtatttatataagattagttgatatttataaaagtttggataaggaaaaagagtatttcgttttaaaaaatagatataatggtgtaaagcaaaatagttttaaaagaatacctggttcgccaattgcatattggtgtagtgaaatggtggctaattcttttatagatgggatcattttgaagaatatatccgaacctaagcaagggctaattacaggaaatagttctgcatttttaagaatttggtatgaagttaatatagaaaatattggttttaaaatgaaagatagggaagaagcgatagtaagcaaaaaaaaatggtttccaataaataaagggggagaatataggaaatggtatggaaataatgagtatatagtaaactggcaaaatgatggtattgagataaaaaattataaagacgaaaaaggaaaactaaaatcgagaccacaaaacatcgaatattatttcaagaaaggattaacatggactaaagtaacttcggctaaattttcagtgaggtttactgaggatggatttatctttagtgaagcaggaatgaagatttttgttcatgataatttattagactatataggtagtttccttaattcaaatttagtgaatgtattattaggagctttatctgaaacaatcaattatgagcaagggaatgttgcgcgacttccattaaaaatttgtaatgatattaatataaatgaaaaaataagtcatcttttcaaaactaatgtagatatttcacgtgtcgactgggattcctttgaaaattcttgggattttcgaaagcatccattacttaattacaagttcaatggcagaacgatagaacaagctttcaataactggtcagcttttgcagaagaacaattcaatcaactcaaaacaaacgaagaagaattaaatcgcatatttatacaaatatatggcttgcaggacgaacttaccccggaagtggaggataaggatataaccatcagaaaagctgacagagaacgagatataaaatcctttatctcctatgcagtaggctgtatgtttggtcgatactccattgatgcagaggggcttatttatgccggtggagactttaaggacaagtggaaaaatgaggacggtcaatggaaagtacgaaagacagtgaaagatgataatggcaaaattattgaggatacatgggtgaatgctacttttgtacctgatttagacaatattatacctattaccgatgatgaatattttgaggatgatatattaagtaggtttgttgagttccttaaagtaacctttggagaagaaactttggaagagaacttggattatattgccgatactataggcagaaggactactgaaacggcaagacagactattagaaggtactttcttaaggaattttataaagaccatgtgcaggtataccagaaaagacctatatactggctttttgattccggtaaagaggatggctttaaagctcttatatatatgcaccggtatgatgagttaacagtggcaagggtgagaaccgactacttgcataagttgcagaaatcctatgaggcagaggttaagagaatggatattattatagattccaatgcttctcaaagagaaaaagccaatgcaagaaagaaaagggaaaagatactgaagcagatggaagaatgtctacagtatgaccaggtaattgcccatgttgcaaaccagagaataaaaattgacctggatgacggagtaaaggtaaactatgctaagttccagggaattgaggtgccacagggagaaggcaggaagccattgaaagcggacttgttggcgaaaatataa

SEQ ID NO: 2277 - DNA, 3543 bp, Clostridium ljungdahlii
atggataaatccgcaattaaaaattttgcagttaatgcaagggttaaattaaaggagcaaatagaacaaaaggcatatacttttggcataacaaagaatgaaataaaaagtgtagaaacttttgaagatgcatttgaggtgaatggtaataggtatgacaaaagattacttaaacatagggaaagtttagttaaaaagataaatgaaaaagggtttgatcaagttattgaagaagtcgcatatacctggtttaatagattaattgccattagatttatggaagtaaatgaatatttacctagcgggataagggttttatcatctactgatagtaataaagcagaacctgatatcattcgtgaagcagcaaacttagattttgaaaatttaaatgtagatttaatttataaatttcaggatgaaaacaatacagaagaattatttaagtatttacttataaaacaatgtaatgaacttgggaaaataatgcatgtagtttttgaagaaatagaagattatacggaattactattaccagataatttacttcaagaaggatcaataataagagatttagtaacatctatcacagaagaagattttaaagaacaagtagaaattataggatggttatatcaatactatatttcacaaaagaaagatgaagtttttgcagatttaaagaaaaataaaaagattacaaaggaaaatataccagcagccacacaattgtttacgcctgattggatagtaaagtacatggtggaaaattcgttgggaaggctttggctagaaagtcatccagatgatgaattaaaggctaagtggaagtactatttagaagaagcaaagcaagaaccagaagttatgaaacagttacaggttataagggataaaaataaagatttaaaacctgaagatataaaattcctagatccatgtatgggatcaggccatattcttgtttatgcatttgacgtattatatgacatttataaatcagcaggatattcagaaagagaaattcctaaactcatattggagaagaatatttatggtttagatatagatgacagggcagcgcaattatcatattttgctgttatgatgaaggctagaagttatagtagaagaatatttagaaaaaaaatagacttaaatgtgtgctctattcaagagagtaatggattttctaaagaagccatagatttttttgcaagtggtaatgaactgttaaaagaagatgtagagtatttaataaatgtatttgatgacgcaaaagaatatggttctatattagaagttaaagggattgattttgatgtaattgagagaagagttgaagagataagaaatagcggtaccaatgatttatttgaattgcagtataagaatattattttggagaggatacctgatttgataaaacagggcaaaatattaagtcaaaagtatgatgttgtttgtactaatccaccttacatgggcaagaaaagtataaatgatagattgagtgattatttaaataaaaattatccagatacaaaaagtgatttaggtacagtctttatggaattatgtattaatcttgcagacagactaggatatatatcaatgataaatataccatcttggatgtttttgacatcgtatgagaagttgcgcaagaagattattaataatcatactattattaatatgttacataatggtagaggtgtttttggatcagactttggaacaactgcatttgtaattagaaataatttcatagataagtatgtttcttattataaaaagttatttcagaaacaaggggaagttgatagtataactgaaaaagaaaaaattttttttagtaataaaggtatttacattaataatcagcaagattttaaagttgtagatggaaatcctatagcatactggctaagtaaagatatgaaggaagcatttaaaagaggaataaaactagccaatattgcagaagtgaagcaaggattggcgacttcagataatgataggtttgtaagaatgtggatggaagtaaattataataaaattggatttaatataaaagatagaaaagaaaataattacaaaagtagtaaatggtttccgtataataaaggtggacagtttagaaagtggtatgggaataacatatatattgtaaactgggagaatgatggatatgaaattaaaaactttaaaaaatcagtggttagaaatgagaattattattttagagaaggcataacttggacgttaattagtagcagtctttttggtgtgaggataagtcctaatggatatgtatttgatgtgaatggtatgacactatttatagataaaagcaaaatatactatgtgttatcttttatgactagtaaagtatgttttgaagtgctaagaattattaattcaacaatggcatttcaggtaggcgatattagtagattacccataatattgaatgaatcatatgtttcaatagttaatgttttatgtgaagaaaacattaatatatctaagaatgattggaatatgtttgaaacatcatggaattttcaattacatccaatcatttcacatagaaatgtttcaaagacactaaaagatgcattctacaattggagtgttttttctaatgaacaatttaatataataaagtcaaatgaagaagaattaaatagaatttttattgacatttatggacttcaagatgaattaactccagatgtagaggagaagaatgtaactattagaaaggcagataagattcgtgatattaaatccttcatttcatactcggtaggttgtatgtttggcaggtactctttagatgaagaaggtttaatctatgctggtggagagtttagtcaagacagatataaaacatttaaagtagatatagataatgtaattccaattactgatgatgaatactttgaagatgatatagtgagtcgttttatagaatttgttaagattacttttagtgaggaaactttagaagaaaacttggattatattgctgatactttaggtaaaaaaggaaatgaaacgtcaaggcagacaataagaagatatttcttaaaagacttttataaggatcatcttaaaacttatcaaaagagaccaatttattggctttttgattcaggtaaaaatgatggattcaaagctttaatttacatgcatagatatgatgttggcactgtagcaagagttagaacagattatttgcatttacttcaaagaaagtatgaggctgaggtaaatagattagatatgattatggaaaacgccaatgtttcaacaagggaaaagaatgaagcaagaaagaaaaaggaaaagatacaaaaacaaatacttgaatgcattcaatatgatcaagttattgcccacgtagcaaatcagaagataagtatagatcttgatgatggtgttaaagtaaattatgctaaatttcagggggtagaagtaccacaaggggaaggtaagaagccgttaaaggctaatttattggcaaaaatatag

SEQ ID NO: 2278 - DNA, 3513 bp, Clostridium saccharolyticum
atggacaaaacagcaataaaaaatttcgcagtatgggcaagacgaaaactcattagcgaaatcacatataaagccggacttattggtattactgaaaagggaatctcgaagcccctttccatgtctaccgacaatattcagttttttgatatcggaaccggaaaacctactgagatttcagatcatgaaatcaagcagcgagaagcactgatcaaccgaatcaaagaaaaagaaggtacttcggattacaaaacagcttttcaatttgttatagaagaggttgcgtatacatggtttaaccgcttgattgctattcggtttatggaagttaatgactacttaccatcccgaattagagtgctttcaagcgaaacttctggaaaatccgaaccggatatggtgacaacaccatttaatacagatatggatttctcggcatatgaaaaagacagaatcatgcagcttaagcatgaaaatgagctggatgagcttttccgcatgctctttatcaaacaatgtaataagttgaacgaagtattgcctgagctatttgagaagacggcggattatacggagttgcttctgacaatttcgttcaccgatagtgatggtatggttagtcatttggtaaatgatatcgctgaggaagattttacagaggcagttgaaattataggatggatgtatcagtactataatgaagagcggaagaatgaagtcataaatatatacaaaggcactataaagaaagaggatattcctgcagcaactcagctatttacaacagactgggttgttcgttatatggttgataattcattaggacgctattggattgaaagaaacccgcagagcaagcttatagaaaagcttgagtattttgtaacccctaaaaatggacaaattcagtttgtgaacgaaaaggttgctccagaagaactaactttttttgatccctgcatgggcagtggacatatccttgtatatgcattcgatgttttgatggaaatatatagagaatgtggatttgtagatagagatgctgcacatgcaatcatagaaaataatatatttgggttagatattgataatcgcgcttatcagcttgcttattttgctgtgatgatgaaggccagaagctatgacagaagatttctaacaagagaaatagaacccaatgtactggcaattaatgagactaataatatatcgagattcaattgtgatggtattacaaacaatgaggaagaaaataaaattggagaatatctaatcaatgcatacaaacatgcaaaggaacttggcagcttgatttctgttgataagcatgattacaagtcattcattgaatatcttggcaactgtagcttgtcaggccagctcacattggaaagtgatcactggcttagagttgtcatgccagagatgaagcggttggcaaagcaagcatcaattatgtcagaaaagtatgctgttgtatgtacaaatccgccttatatgaataaattagaagggcaacttaaaaagtttgtcgtagatgaatacaaaccttatagtggtgatttattctctgtgtttatgtatagaaattttgaatactgcagatcaaatgggtactctgctttcatgacaccatttgtgtggatgtttatcaagacctatgagcaattaagagagtatattattaaacaaaagtcaataacaactcttgttcagatggaatactctgcatttgaggaagccaccgtaccaatttgttcatttgttttgaaaaatggtaaagaaaaggaaaaaggagtttatctaaaattatctgaatttaaaggcggaatggaaatccaaaaacaaaaggtgttatatgcccttgaaaataataattgcgaatatctatttgaggcagatgaaaagagcttcttaaccattccgggatcacctatagcttattgggtaagcaacaatatgctgaatatattccaattaggaaagagttttgaaggaataacaaagaaaggtgttctgacaggcgacgataaggtttatgctcgactttggtttgaggtgagttttgcgaaaattggatttggtttaaaatcacatgaagatatgttggttagtcgaaaaaaatggtttcctgtcactgcaggaggatttaaacgaaaatggtatggcaactttgaaaccgtgattaaccttgaaaatgatggacttgatataagaacaaatgtaacaaattatagattgcgagaaagcacctattacatgaaagaagctattacatggacggaagtatcatcaggtatgtttagctgcaggtatgttccaataggtattttatttgggaatggtgggccagtaagcttttttaataatggtgaaataaagtatcatcttggattgctaaattcaagcacaacgatgtcaatactctcctatttagcaccaacaataaactatggacctgaacaaattaataagattcctgttattaagaaaaacgtggaattggtagaaaacattgtaacagagaacgttgaaatttcaaaaaatgaatgggattctttcgaaacgtcttgggagtttaaaaaacatcctcttttagatgccgataaaatagaatcagcgattcagtattggcaagacgaatgcaacattagatttaatcagttaaaagtcaatgaagaaaaactcaatgaaatattcattgatatttatggtttagaaagggagctaagttcagtagtagaagataaagatgtaactgttcgaaaagcagacataaaaagtgatattaaaagttttatttcttatgcagttggctgtatgttaggcagatactctcttaattatgatggaatagcttttgcaggaggagaatgggacgattcaaggtacaacaaatttaaaccagacaaggataactgtattccaattactgacgaagagtactttagtgatgatattgttggtcgctttgttgaatttattaagtgcgcatacgggaccgatgtacttgaagacaacattgattttatagcaaatgcacttgataacaaaggaaatacatcaagggaaataattcgcaactattttttaaaggatttttataaggatcatataaaaacctatcaaaaacgtccaatatactggctttatgacagtgggaaacaagatggattcaaagccctggtctatatgcatcgttatactgctgatacaaccggtattgtccgagttgattatctgcataagatgcagaaaatctacatgagtgaaattgatcgcatgaaagaaatggaagaaaacagcaataatactagagaggttgctcaagctgaaaagagaaaagaaaaacttatcaagcagctgaaagaaaccaaagagtatgatgagaaaattgctcaccttgcgctaagtcgtatagcaattgacttggatgatggtgtaaaagtgaactatgagaaggttcaaacggggcaggatggcaaaaaactagatattctcgcaaagatttaa

SEQ ID NO: 2279 - DNA, 3858 bp, Clostridium saccharolyticum
atgaacaagacagccataaagaattttgcgatttgggcgcggaataagatgattgcagatgtcagctatgatgcccgcctgatcggtattacggaggacggcattgcaaagccattgccgcagagtttcggcggtacgcagttcttcgatatcggcaccgcagaaccatattcgatttccagcgaggccgtgcatcagcgtgacaagctgatagaggttattcaacagaaggaaaaggataccgactacaaaaccgcatatcagtatgtgatcgaggaggttgcttatacatggttcaaccgcctgatcgccatccgtttcatggaggtcaacgactatctgccttcccatatccgggtgctttcttccgagagcggaaagctggagccggatctggttacaacaccgtttgacgcagagctgcccttcactgcggaggaagaggctcagatttttcagctaaagcaggacaacaagctggacgaggtgttccgcatcctgttcttaaagcagtgcaacgctctgaacgagattctgcctgctctgtttgaaaaaacaaagaactacacagagctgctgctcagcctgtccgttaccaaccaggatggcgtggtctatcatctgatccacgacattccggaggatgatttcaacattgagcgcggtggtcaggtggagatcatcgggtggctgtaccagtattacaacaccgagccgaaggccgctgcctttgcaaagaacgggaagatcaccaaagaggaaatccctgccgtgacccagctgtttaccccggactggatcgtccgctacatggtggagaacagccttggtcgtctcttcattgacaagcggaagaacgaaggcgtctttgccgatgggcgcggtctcgatgagatgacttgggacgaggccgaggaaaagcggatcgccaccgaaaagcagattgccgagcagatggagtggaaatactatttgcccgaagctgtgcagacaaaggaagtgcgcgaacagctcgataaaattcagcagcagagtgagtacaaagatgtgcgggacatcaaggtcatcgacccctgtatgggcagcggccatattctggtctatgccttcgatgtactgatgcagctgtatgaggatgccggatacagccagcgggatgccgccaagagcattttggagaacaacctctatggtctcgacattgatgaccgtgcctatcagttggcatactttgccgtgatgatgaaagcacggcagtacaaccgccgtatcttaaacggtgagaacacctgtcatgtctatgccattcaggagagcaacagcatcaaccgtgcgcatctgaaatatttcggcgcagggatggacgatattgaaaagaatgccgctaaaatgcagctggaaggcctgctggacaccctgaccgatgccaaggaatacggctctattctgaatgtagatgcctgtgattgggacttgctacgccggtttgtggagcagagcggtgaagacgagcagatgtcgatggattcctttgggctggaggataccaaggagcatctgtgggtgctgattgatattggacagacgatggcccagaagtatgatgtggtggtgacgaatccgccgtatatggcaataagcagtgctgcgccaaaattaaacaattatgtgaataatcattatataggtggaaaaacggatttgttttccgcatttattgaaaaatgtttgcagatgacagctcctaatatgtatacgacaatgattacccaacagtcatggatgtttcttacgagttttgaaaaaatccgaaatattgttttgagttatagcattgcaaacatggcacatcttggtgcaaggggatttgatgagattagtggcgaggtggttcaaacaacatcgtttgtaataagaaaaacaaatgtgggagaaaaatacaagggaacatactcgcgtctcattgatggttcaactgaatccgagaaaaaagaaatgtttatatccggtaagtatcaatatattagtagcgcacacaatttcatcagaatacctgaatcaattattgcgtattgggtgagtgacaatacaatagattgctttgagcagcggacgcttgagcaggttttcattacaagggaagggatggcaaccgcagataatgagcggtttttgagattatggcatgaagtaaaccaacataatattctttttgatgcacttgatgcccaagatgctgttattcgacatgcaaagtgggtcccatataataaaggtggtacgaccagagattggtatgggaataacgactatgttgtagattgggaaaatgatggtgttgaaatcaggaataataaagacccgaaaactggacggattcgttctcataattataatggagaatttgcgtttaaggaaggactgacttggtcagctattagttcgggggatttgtctgtaaggtattgcaagaatggtttcctttttgattcaaagggagcgaaagggtttgcaaaacaaaaagaaaatttgaattggatattgggactattaaatagcaaaattgcaatgcaattccttcagtttttatcgccaactttagattttaaggttggagatattatttcaattcccttcctttttgacgctaatcagaaggcgagaattgatgaaatagtgggttctattgtaagaatgagccaaattgaatgggattcttttgaatcctcatgggattttgttcgtcacccacttgctccttctgctcgcctgaaacaagatcagttagagtctcaatttaggaacgatagaatggagaaattcggcaggctgtcttggcattatgaaaactggcggagagactgtgaagagcgctttaattctctcaaatccaacgaagaagagctgaaccgtatcttcatcggcatctacggcttgcagaatgaactgaccccggaagtggaagagaaagatgtgaccgtgcgcaaggcggacttgcagagggacatcaagagcctgctcagctatgccgtgggctgtatgtttggccggtactctatttacaaggatggtctgctttttgcgggagaaccgtattccttgcaggcgtttgtggataagctgaacgaccgccccggaacgatttctgctgaagaattgcagcgagcataccgcaatgagggtgttgtggttgatgaaatgttcttcccggatgctgacaatgttatccctatcaccgatgaagaatatctggacgatgatatcgtatcgcgcctgtgtgcatggctgaaagcagtgtacggtgctgatacgctggaagcaaacttggattacattgccaaggcactgggcaataagggcagcaccagccgggagattatccgtaactacttcctgaacgatttcttcaaggatcactgccagacttactctgtcaccggctccggcaagcgtccgatctactggctgtttgacagtggcaagcagaacggcttcaaggcactggtttacctgcatcgctatacgccggataccatcggtaacctgcgtatcgactacctgcacaagatgcagcgtgtatatgaatccgagatcaaccgaatgcaggatatgatggatcacagcgagaatgcccgtgaggtggcagcagcttccaagcgaaaggataaacttgccaagcagctgaaggaatgccgggaatacgatgagaagatcagccatctggcactttcccgtatcgagcttgacctcgatgacggcgtaaaggtcaattaccgtaagcttcagaccgcgcaggatggtaagttctatgaggtgctggcagacagtaagaacatcatggcgaaagagaagaaataa

SEQ ID NO: 2280 - DNA, 7368 bp, Clostridium saccharolyticum
atgatgacaaaaacggcttattatatgcagatggcacaggaagctgcggcgcagatcactggcagcaaagaacagtggacagcgtttctgaccacatccgcacggctttataagtatccctttgcggagcagctgatgatctataagcagagaccagaagcaacggcctgtgcagagtatgatctctggaatggccggatgaaccgctatgtgaagcgcggctccaagggtattgctcttttggatatgcgcggtgagcagccgagacttcggtatgtatttgatgtggcagatactggagaacggaagaattcccgtccggtacagctctggaaaatgaacgcggagcatgagcagccaatcattcgagcactggatgcagcgtttgatgttcctgtcggtgccgggtctctggaaaatcatatcatggaagcggcggaacgccttgcaagggactactgggaggaaaaccgcaggcagatcagtgacatcgttgcagattcctatctggaaggatatgatgaactcaacatcggagcttcctttaagagagctgccactgtcagcatcgcatattccgtctttacccggacggtgggcaatgcagatgactattttgaacacgaggattttctggacatctttgattttaatacgcaggctgccgccaatgtgctgggtactgcggtcagcgaaatgtccagccagatcttccgggaaattgaacgcacgatccgaacctatgaaagagataagcaggcagaaaggagccaaaaaaactatgatggagctgaattacacgaagaacggcgattacctgattccggacattcagttgtcggtgcaggaacagaagcccctgggcaagtacgggaggatgcgcagagcgttcctgcaggagaacaacacgctgctgtacaatcacctgatcctgaccgagaaactgtacccgcacctgtgggagattcaggagaccgcgaccgcacggatggagcagatgatggcggagcttctgaaagcgaatccggcaccggacaagaaatcgaaccagatggcctgggtgcagcacatgaacatgctgaaagcgcaggcagaggaagtcattctgacggaacttatcaacagctaaactttatgagcctgtttcagtccgaagcagagcagattcagaaaattgatgcggcggcagagaatgcagtcagagaagcggagagcgaaaagccctccgcttttgttatttctgaggatgaaatcgaccggatgctgcggacaggctccaattttgaaggcgggaaaatccgtatttatgcgctgtatcagcagcaaggggacacaaaagaacgagctgcatttctgaaagcggaatacggtctcggcggtcacagctatacctttatggatggcagtcgcggttttgctgattataacgggaaaggcattcagcttcgcaattatgaccatgaccgggaagtgcgcctcacatggtctgcggtggataagcggttagaccggcttgtggaaaatggtcagtatctgactgcgctggaaatggaagagtatcggaagctggagcaggaatacggcgcgccgcttcctatgccgacagccgcccatgtatttccgccaacgccgccggaacactacgataccggaaatgaacatgtggataatatgctgaacacagctgcggaggtctatgccagaagtgaactggcagcacctcagcggtttaccgtgatggaaacagacgatggctatgcggtctgggatgatattcaggacggcattcatgtagagccggatggtgtcagcgaagagtttaccagcgaatgggaggcagaaacctaccgccagcagctgattgaaaaagtccaggaacgagaagccaaagactggctctatgttgagcagagcaagcaggatttgcagcaggacatttcattcccagaagtggaatccgaagaagcagcggaaccggctcatgcagtgacagatcctctggtattggaaatgcaggaacacgccagagaacttgccagagagtcaggctatgcaccggatgaacggtttgtagtcacgatgaccggcgagaacttcccggattctaaggatgcgtttgccatctgggattatgtaagagaagagtattacggatattcggacggaaaagtgcagacatttgccgattatgtgagtgcatcagaggcgttgcaggagattcgcggcagagctttgggggctgaaaaagagcttgcaactgtgcagccagaacccgcagctccggtgcagccggattatcgtgtcggcgatacgctgtatctggacgggaaggcatttacgattgaaaaagtcgggcttttcgatgtggagcttcgggacccggattccgtgtatccgatcttccgctcggaaagcaaggaaaatctggcaagacttttgggacatgaggataatgttcacctgcacaatctggtggttgatctgaatcctggaaaagaagcagcgttccgggcagagcatgaagcaaaacatgcagaaaactatcgcatcaacagctttcacctcggtgaaggcagtcctaaacagaaattccgtgccaacatggatgccatctacacgctgaaaaccttggaaaatcagcacagggatgcgacaccggaggaacaggaaacgctggccaattatgtcggctggggcgggctggcagatgcctttgatgcagagaaaactgcctggacaggtgaatttaaggaactgaaagcagctcttacggaagaagagtatgccgcagccagagcttcgactctgaatgcgcactacaccagtcctaccgtgatccgtgcaatctatgaagcattggacgatatgggctttgagaaaggcaatattctggaaccgtcgatgggtgtcggcaacttcttcggtatgctgccggattccatgctgggaagcagactgtatggtgtggaactggattccatcaccggacgtattgcacaaaagctgtatccgcaggcagaaatcaaggtggcaggctttgagaccaccgatcggcgcgatttctatgatctggccgtgggcaatgtgccctttggcaactaccgtgtcagcgataagctctatgataaactcggcttttctatccacaactatttctttgccaaggcattggatcaggttcgtcccggtggcattgtggcctttgttaccagccgctatacgatggattccaagaatccggacgcgcgaaagtatctggcgcagcgggcagaactgctgggagccatccgacttcccaataacgcattccgtgccaatgccggtacagatgtagtgtcggatatcattttcctgcaaaagagagaccatcccattgatatcgaaccggattgggtacatctggggctgacttcggagggaatcaccctcaacagttatttcgttgaccacccggaaatggtgctgggcgagattacaacggaaagcacccagtatggtaaggaagaatgtacggtcattccgattccaggagcggatctgggagaccagctgcatgaggctgtgcagcacatcggcggtcactatgaagcgcaggagctggcaccggaggaagaactgtccttgcagggcgaaaccattccggcagacccaaatgtaaagaacttctcctatgcagtggtcgatggggatgtctacttccgtgagaacagcatcatgcgaaaggctgacctttctgcgacagccaccggcagaatcaagggcatggtggagcttcgtaccatcgtgcaggaactgatcgactaccagctgaacgattacccagaggacgcgattgcccagaaacagcgggaactgaatgtggcctatgaccgattcgccgatcagtatgggcttatcaactcccgtgcaaatgcgcaggctttttcggaagattcgtcctattatctgctgtgctctctggaaaatgtagatgaaaacggcagactggaatccaaggcggatatgttcaccaaacggacgattcgaccggaacgggctgttaccagcgtagatactccggctgaagctctggcaatctccatcggagagcgcggcagagtggatttgccctatatgtcggagcttttaggaacgcctggagaatatgaaaaaatccagcaggaactgcatggtgtcattttcaaagacccgatgacgcagggcggcgaggaaaccggctgggtaacagctgacgaatatctgtccggcaatgtccgggaaaagctccgcgtggcagaactggctgcggcctctgaccctgcctttgcggtaaatacggaatatctgagaaaggcgcagccgaaagatctggatgcgtcggagattgatgtgcgccttggtgccacatgggtcaatcgggattatatccagcagtttatggaagaaacctttgaaccgccgttttacctgcgccgaaacattgaagtgaaattctctcccatgacggcagagtggcagatcaccggcaagagcacaccgagccggaatgatgtccatgcctatatgacctacggcaccagccgagccaatgcctaccggattctggaggatacgctgaatctgcgggatatccgtatctacgataccgtggaggatgcagacggcaagcagaagcgggttctgaataaaaaggagaccacccttgcccagcagaaacagcaggccattaaagatgcgttccagaactgggtgtggaaagacccttatcgccgtgcggaactggtggaaaagtataacgagctgttcaacagcacccgccctcgtgagtacgatggttctcatatccgctttggcggcatgaatccggagatccggctgcgggaacaccagcagaatgccattgctcatgtgctgtacggcggcaatacgctactggcccacgaagttggtgccggcaagaccttcgagatggcggcttctgctatggaggcaaagcgactggggctgtgccagaaatccatgtttgtcgttccgaatcatttaacccttcagtgggcaaacgagttcctgcgcctgtatccgagtgcaaaactgctggtagcaagtaaaaaggactttgaaaccgcccgcagaaaaaagttctgcgcacgaattgccactggcgattacgatgcagtcatcatcgggcattcccagtttgagaaaatcccggtgtccgcagaacggcaggagcggattttgactgcccagattgatgaaatcgaaaatgccattgctgagatgaagtcccagaatggcgaacgtttttctattaaacagatggaaaagacccggaaaggattggaggcgagattggagaaactccgggcaaccgaccgaaaggacgatgtgattacctttgagcagctgggcgtagaccggttgtttgtagacgaggcacacgcgtttaagaacctgttcctctacacaaaaatgcgcaatgttgcaggcttgtccacttcggaagcgcagaaatcttctgatatgtttatgaagtgccagtatatggacgagctgaccggtgggcgcggcatcatttttgcgaccggtaccccggtcagcaacagcatgacggagctttacaccatgatgcggtatctccagtacggcacgttgcagcagaaagggctgacccatttcgacagctgggcttctacctttggtgagaccaccacggccattgaactggcaccggaaggaaccggataccgggcaagaacgagattcgcaaagttcttcaacctgccggagctgatgaacatgttcaaggaagtggcggatatcaagacttccgatcagctgcatctgccggtgccggaggcaaagtttgaaaccgtggttgtgcatccttcggaacatcagcaggcgatggtagcggagctttcggaacgggcagcggctgtgcattccggcgtggtagacccgtcggtcgataatatgctgaaaatcacatcggatggcagaaagctggggctggatcagcggctgatgaatccgctcctgccggatgaccccaacagtaagctcaacgcttgtgtgcggaatgtgcttcggatttatgaggaagggcagtcggataagctgacccagctgttgttctgcgacctcagtacaccgaagaacgatggaaccttcaatgtctatgaggatatccgcgctaaacttatccagtccggtgtaccggaggaagaaatcgcatttatccatgatgcggataccgaggcaaaaaagaaagatctgttcgccaaagtccgtaccggacaggtgcgggtgttgttaggttcgacacagaagatgggcgcaggcacgaacgtgcaggacaggctggtggccgtgcatcatctggatgtaggctggcggcctgcggacatgacccagcgaaatggccgtatcatccgtcagggaaaccgaaacaaagaagtgcaggtttatcagtatgtgacggaaggaacctttgatgcctacctctatcagacactggagaataaacagaagtttatcagtcagatcatgaccagcaaatctccggtgcgttcctgtgatgatgtggatgagcaggcactttcttatgcggagatcaaggcactttgtgcaggagacccgcagattaaggaaaaaatggacttggatgtagatgttgcaaggctgaaagtattgaaggcagaccatcagagccagcagtaccgattggaggataagctgatgaaatatttccctgcggagattgagaaaacgcaggggttcatcaagggttttcagtcggatattcggacggtggcggcacatccgctgccggaagaagggttctgcggtatggaggtgaatggcacacattttattgaaaaagtagaggccggtgaagcaatccttgcaatctgtaaagccaatcagagtctggagccggtgccgcttggcagctatcgaggtttcaagatggagctggaatttgacagcttccagaaagagtatcaggtgctgctgaaaggcgatatgacccaccgagtgcccatcggaaccagtgcggcgggcaatatccagcgtctggacaatgctcttgccgggattcctgcaaggctggaaaaggcggaacagcagttaggcaatcttagaagccagcaggaagcggcgcaggccgagcttggaaaaccgtttccccaggaggcagaactggcagaaaagagtgcaagactggcagaactggacgcgctgctgaatatggatgaccgtggaaatgatgatcctgaccgtgagaaaacaacggaaaaaccgtctgtcctggcagagctgcgtgaccgtgccggtcgcattccgccggtgacacatcgagatgatgaggaggtggcactatga

SEQ ID NO: 2281 - DNA, 3651 bp, Clostridium sp.
atgaataagaccgccataaagaatttcgccatctgggcgagaaataaactgatcgcagatatcagctatcgtgcaggccttatggggattactgcagatgggatccatactgcgcttccgcagtctaccggtcagacagaattttatgatatcgggacagcagaaccttatgcgatcacgggagaagcaatccgtcagagaaaacatctggtggaactgatccaaagaaaagagaaggatacagattataagactgcttataagtacatcatcgaggaggtcgcctatacctggttcaaccgcctgattgctgtgcgctttatggaggtcaatgactatctgccgagccatatccgcgtgctgtcttccgatactggaaagatggagccggatctggtgacaacaccctttgatttggagctggacttcaccagagatgagcagcagacaattctggaactgaaaaatgtaaataagctggatgaagtattccgcctgcttttcatcaaacagtgtaatgctctcaatgagatccttcccgcactttttgagaaaacccatgattatacggaacttcttctgaatctctccgtcatcgatcaggatggtatagtttaccatcttgtgcatgatattccggaggaagacttcgatgtggaacgaggtggccaggtcgagatcatcggctggctgtaccaatattacaacacggaaccgaagaatgaagcctttgcaaagaagggcaagatcaccaaggaggaagtgcctgcagtaacgcagctcttcacgcctgactggattgtccgttatatggtggagaacagccttggccgtctgtgggtggaggggcatccgaatgatgatttgaagtctggatggaaatactatctcgaagaagcagagcaggaaccggaggtgcagacgcagcttgcggaaattcgagctgagtatgcgaagttgaatccggaagatatccgtgtcattgatccaggtatgggcagcggacatattttagtctatgcctttgatgttttgatgcagatttatgagagcgccgggtacagccagcgcgacgctgccagaagcattctggaaaacaatctctacggtcttgatattgatgaccgtgcctttcagatggcgtactttgccatcatgatgaaggcacggcagtacaaccggcgtatcctgaacggagagtacaggcccaatgtatattccattcaagagagtaatggaattgatcgtaatcagctcaagtattttggcgcgggcttgaatgaattggagaagaataatgccatcacgcagatgaacgtacttctcgatacattcaaggatgccaaggaatacggttcaattctttcggtagagcagtatgattgggatctgctggatcgatttgtgtccaacatcgaagtgattggacagatgagtatgtacacggtgggtttggatgataccgcggaggagttaaagcagctgattgctcaaggaaaggcacttgcgcaaaagtatcatgtgacaactacgaacccgccctatatggccattagtagtggaaccggaaggctcaatgagtatgtcaagaattattatccggatagcaaaagcgatctttttgccgtttttattgaaaaatgcaaaagcttgacttttaatcaaggtttcgatgcattgattactatgcatagttggatgtttttatccagttttgagaaattacgattaaaaataaagaatactgatattattaatatggcacacttaggtgctagagcatttgaagagataggcggtgaagttgtacagactacagcatttgtgtaccgaaacacttctttttcggggtggaaatgcacatttgtacgaattgttgatgcgaagtcacagttagagaaagaacgaatatttctgtctggaactcaaagatacttgtttaagcaatcgaatttcgacaagatacctgggactatatttggatattggataagcgataaaactatatctgctttcgagaatgcagaagattttatgtctaaatatgcagaagccgaaggaaaaaatgtaactactgataatgctaggtttattcgatgtttttgggaaatatcatctgaagacactggtacattatcaatggggaaaaagtggcttttgtgtgcgatgggcggaacatacagaaaatggtttggtaatgttcaaaatgttatagattggtcgtcgaaagcacgtaatttttataaagaagcccctgcgggaagaattataagacaagagttttggaatttacctggtgtaacatggggaaaaatagggactggtgatgctaattttagattgttgccttctgagtatatgtatcaagagacagccattttacaaaagaaaatggaagactctctgttttcacttgcattattaaatgctgcaacaagtacttacttcttaaaagtaataagtcctacgatgaacttccaacagcaggatataaactcaattcccattcctaaagtaggaagtgaggacaaggctagaattatagaaatcaccaaaaaacttatccatagctcgatggatgattggaactcctttgaaacagcatggggttatgaaagccatccgttagtaaaaataggccttagatattgcaggctgaatgataataatacaacgattgaagagagcttccgtgcctggtcagatgaatgtgaaggccattttgaacaactaaaagcaaatgaagaggaactgaaccgtatctttattgatatctatggattgcaggatgaactgacaccggaagtagaggataaggctgtaactattcgctgtgctgatctccagcgagatataaaatcactgctgtcatatgcggtcggctgtatgtttggccgctattcccttggtaccactggacttgcttatgccggtggtgattggaatgagcagaaatacgggcagttcaagccagatgcggataatgtcattccgatcacggatgaggaatatctggaggatgatatcgtctcccgcctctgtgacttcctgaaggtcgcctttggcgagcagacgctggagcagaacctggactatattgccaaggcgcttgacaacaagggtgattccagccgtgagatcattagaaattatttcttgaatgatttcttcaaggatcattgtcagacttattctgtgaccggctccggcaagcgtccgatttactggctctttgacagcggcaagcagaacggattcaaggctttgatctatttgcaccgttacaatgcggatacgatcggaaatcttcgtattgattacctgcaccgtatgcagcgtgtctatgagagtgagatcagccgcatgcaggatatgatcgaccacagcacgaatgctcgtgaagtggcacagtcaacgaaacgccgcgaaaagttgcagaaacagctgaaagaatgtcgtgagtacgatgagaagcttgcgcacttggcattgtctcgtattgaactggatctggatgatggggtgaaagtcaactatcgaaagctccagatagcaaacgatggcaagttctatgaggtacttgcggattccaagaatatcatggctaacgacaagctgtggaagcagtatgttgagacatggaagaaatga

SEQ ID NO: 2282 - DNA, 1908 bp, Cupriavidus necator
atgactatttttttgcgtctcttgactgaaaaggacaagcagaatgcacttgcgaatgctgttcgcaatggcggtgaaaatgtgtttgaagttgacgcagccagcttttgtcaaatcccaggggtgccttttgcttactgggtgagcgaccgcattcgcttgatgttcaagacgcatcgcccattcaaaagtgaagaacggctggcgacccgaggggcatctacgtgtgatgatttccggtacgttcgagtctggtgggaagctgcggaacgtcaagggaaaagcaagtgccggtgggttccatttacaaaaggtggcagtttctctcgtttctattctgacatccaacaagtggttgactgggacgatgttcgggaaacatttaggggttttgtcggcagacccggccgttggctggatcgtccggaggctctagattactactttcgacccgctctaacctggccgctacgcggtatctcgttctcagcgcagttagtcccaaaaggatgcatcttcagcgtcggcggcaaagtcgccttggcgccaaaaggtgaattgcttgcattggcgggcattttcaattctggaccgctcgatcatctggtgcgcctctttgcgggcaaagtgggaggtgtgcaatatgaaacgggattgatcaatcaattgccaatcccaaagatcaacgagaatacaagcgaagagctttcttgccttgctaagcgcggctggtcgatcaggaggagtctcgattcggttattgaaacttcacacgcgttcttactgcccgctgccatccgcggaaggctcggcgaattcagtcctgcgacggtcgaattagaactcaaggtaattcaggccaaggtcgacgccattgcgtttgatctttacggcctaacggaagcagactgccttacgctcagccagataagagagtgttttggcggagaggaagactcacagggaggcgacgaggatgagtcaaacagtgaagatgagaagggcagtgaaatagatctgccgtccaccgacactctactcagctgggctgtcggagtcgcttttggccgcttcgactggcgactagcaactggcgagcgcgaagcgccgtcagagccagaaccattcgatcccttgcccgcaaagtctcctggaatgttgccggacggagccacgcccttccatgctcacgcaggcattctggtcgacgaccccggccacccgaatgaccttgcccgcttgatggaagaggccttagttcgcgtcgatgcaccggtaccgttcgacgtacgccgctggctgcaacgggatttcttcgcattccatctacagcgctattccaagagccgccgcaaggcgcccatctattggccgctggccacgacgtcaggtagctacacgctgtgggtttactaccccagcctgagcagccagacgctctacacggcgatcaatgatttcatagaacccaagctcaagcaggtgggtaacgatgtggtcgcgctgcgcaataaaggcgcggcccgctcacgcgaagaagaaaagcaattcgaatcgcttcaaaccttcgagctggaattgatggagctgcgcgacaccctgctcaagctcgcgcccacctacaagccgaaccgcgacgatggcgttcaaatcactgccgcgcccctgtggccgctgtttcgctacaagccctggcagaaggtgatcaaggacacttgggccaagctggagaaaggcgacttcaactgggcgcatctggccatgaactactggcccgagtgcgtgcgtgaaaagtgcaagagcgacaaatcgcttgccatagcgcatggactggaggatctgtacgtcgagcccgaggggcaaccaaaaaaggcgcgcgacaggaagaaggttgggggcgcggaatga

SEQ ID NO: 2283 - DNA, 999 bp, Cyanothece sp.
atgaccttagaaatgcagaaattagaagaagaaaataaccgtatttttatcgaagcgtatggactacaagacgaattaacccccgaagttcccttaaaagaaatcaccttaacctgtaatccttattatcgttataacagcgataaaccccaagaagaactcgaaaccttactcctagcggatactatcaaagaatttatctcatactcagtgggttgtatgtttgggcgttattcccttgataaagaaggcttaattttagctaaccaaggagaaaccttacaagactactttgttaaagtaggaagtaagaagtgggaagtgagaagtaaagaagaaaatacccctaactcctcactcgactctctccactctccacttcccacttcccacttcccactcgaccctctccactttatcccaaccgaaaccaacgttatccccatccttgagggagactggtttagtgatgatataaccgaacaattccgtcaatttctgcgagttacctttggggaagaaaactatcaacaaaacctcaactttgtcgaagaagccatcggaaaagacatcgaaaaatactttgttaaagacttttataacgaccatgttaaacgctataaaaaacgtccgatttattggttatttagtagccccaaaggaacatttaacgccctaatttatctccatcgttatcgcccagataccgttagtattgtgcttaataaatatctgcgagaatttcggattaaactacaagctagattagaaacgctaaaacaaattgatattagtgcgagtgcttctaaaaccgaaaaaaccaaagctttaagagaaaccgaacagatcaaaaaaatgctcagagaattagaagactatgaacaagaaatcctctatcccttagccatagaacaaatagaaattgaccttgatgatggcgtaaaagtcaactatactaaattgggcaaagcccttaaaaatgtgacaggattaagttaa

SEQ ID NO: 2284 - DNA, 3657 bp, Cyanothece sp.
atggatacatcaagactcaaaaagttcgcccagtatgcccgtcgttatctcagagaacaggtagcgactaagttagaagtggtcttagctcaaaatagtgcagcaagacgggaaaatcctgaagctatccgtaagttaaccgaaaatatcgaagtttcagggaaagaacaggttattgaacaggttgcctatacttggtttaaccgtttttgtgcgttgcggtttatggatagtaaccgttataactccattggggttgtgtctcctgctgaggggcaatttcagcctgaaatcttggctgaggcgaaaatggggcatattgatgaggaaatgataactaaacacagaaagcagatttttgatttattaagcggtaatgcaccgagttctgatgctcaaggggaggcctatcgtttattaattgtcggggtatgtaattattatcataaggtgatggattatttgtttgagccaattgataattatacggagttattaatgcctgatgatttgctgtcgggtaattcaattttggcttatactcgtgaggcaatgactcctgaaaattgtgagagtgtggaggtaattgggtggttatatcagttttatatttctgagaagaaagatgaggtttttgaggctcttaaaaagaataaaaaaatcatacccgaaaatattccggcagcgactcagttatttactcctcattggattgtgcgttatttagtagaaaattctttggggcatttatggatgttaaatcgtcctcagtctcgtttaattgagatgatggattattatgtggatagtgggaagtgggaagtgggaagtggggagtctagtttaggaggtgaagatgatgaccgtcagaaattatcaggagttaatcgtttggcagaaagcgatggacttagtggagttagtttatcaggcgacaaaaatgtttccgaaagaggaactttacggtctgaccaatcaagtgagacgggcagttgtttcgattccgtcaaacatagcggagggtcaaacccgtcaatcgacggcggaattcaagcgttttctctcaatagcgcaggggtcgagagcagaggtagaaactcaaattatgatagctcagagactcaaatatctcagtcaggaggagatggaacaaattctcaatctggccgaggaaatcaagcgaatgatttatggactaacagccaaactaaaataacttcccactctccacttcctacttcctacttaaaaataaattctcctgaagatttaaaaatttgtgatcctgcttgtggttcgggacatattttagtctatgcttttgagttactttatgctatttatgaggaggaaggttatgcagtaaatgagattcctagcaagattttaacccataatctctatggtatggaaattgatgaacgggcaggaagtttggcagcttttgcattaactatgaaggcaagggagaagcaaatacggttttttcgtaagccgattcagcctcatatttgtgtgttgaaaaaggttgagtttgaggagtgggaagtggggagtgggaagtgggaagtggatagtgagaagttgggggtaagtcgtgatgatttattacatgatttacatttgtttaaagaagcggataattttggggctttgttacgtccaaaaatgtctgaaaaccaaatagctaatttaagagattactttgctaatttatggaaaaaaattcctaatccttctttgtttgaacataaaacccatgagaaggttatggatgtgttaaaacaggctgattttttaagccctaagtatcacattgttgttgcaaatccgccttatatgggtaataagggtatgaataatcggttaaaggcttttttacaggataattatagtaatgtaaaatctgatttattttctgcttttatgattcgtattttagaaatgactttacaaaaaggggaaatgggttttgttactccctatgtttggatgtttatttcttcttatgaaaaattaagaactttgattttagagaaaacgacaataactagcttaattcaattagaatataatgcttttgctcctgcttgtattccagttgctacgtttaccctttctaatcaaaatttacctaattttaaagggggatatattaaattatccgattttagaggtgcagataatcaagcaccgaaggcattagaagcgataaaaaatcctaattgtggttggttttatcgggcttctgcaagtgattttaagaagattccggggagtgcgatcgcttattgggttagtgatagtattcgcatctctttttctaaatataaatctatttctgagcagtatacagtcaagtcgggaattatgacaggcaatgatgatacttttctgaagttttggtttgaggttaaaataagtcagatcggttttaatttgatttcttatgatgaaatgaaaagttattggtatccaataagtaaaggaggaaattttaggaaatggtatggaaataatgaacacattattaacttaagagatgatgcttatgatattcgtaatggaggaggaaactttagattaagagagaaaaatttatattttagaccttatataacttggtcacgcattacttcatcacaagttgcctttagattttcacaaggtggtattcttttttcagatgccggaccaggaatttttgcagaaaatgattgtcagaaaataataacttttcttaatacaaaactgagtaattactttttagcctgtattaatcccacccttaattaccaaacccgtgatattgaatcattaccatgtatagatatccaaaaagatgttcagactccttatttaataaaaaccacaaaatcagactgggattcttacgaaacatcatgggattttaccacccttccgcttttaagagtgggaagtgaacagtgggaagtagagagtggagagtgggaagtgaatagaaaagagggaacagtggtgaatagtaatgaaacaatagatagtaagcaaaaaacagttgatagtaatgaaacaatagatagtgaaccgttaatagttgataatagaaatgaagaaaagactccccacttcccactccccacttctcactcaaaactccccacttcccactccccacttctcactcaaaactccccacttcccactccccacttctcactcaaaactccccacttcccactccccacttctcactcaaaactccccactccccactccccacttcccactccccacttctcactcaaaactccccactccccactccccacttcccactccccacttctcactcaaaactccccactccccactccccacttcccactccccacttctcactcaaaactccccactccccactccccacttcccactccccacttctcactcaaaactccccactccccactccccacttcccactccccacttctcactcaaaactccccactccccactccccacttcccactccccacttctcactcaaaactccccactccccactccccacttcccacttcccactcccctaaaagaaacctatcaaaccctgcgccaacaatggcaagaaatgaccttagaaatgcagaaattagaagaagaaaataa

SEQ ID NO: 2285 - DNA, 4080 bp, Dehalococcoides sp.
atgagtttcgataaggatacacgcaatcttctggcgaagaccgtcgttacatgccggcgtcggctggtcgaagatactactgaccaactccgaggactcttcggtctccatccggacggtaccgttctgccgctcgaacaacttatccacttatcacccgatcaaaacgcggctgctcgtcatttgcgtgatctcctggaccattacactgtcggcacagatgggaatgaatcagaccgacggaaagtcgcttatgagcggatggttcttgaaatatcctttaccgctctcaaccgtttggcagctctccgactgtgcgaggagcgtgggctcgttatcgaatgcgtccggaaaggtatgtcatccgatggctttcagatgttcgaacgcatctcggttggggctctgggatcgcgttacgacacctatcgagtctttctggagtgcatgttcgatgaactcgcgcttgacttgggagtgctgttcgatcggacaacgccccagtcatcggtgttcccatcagagcgatgtatggaagagattctctccgaacttaataagcccgagctcaagcacctgtggaccgaggacgagaccattggctggatctaccaatatttcaatccccccgaagagcgaaaagcgatgcgggaagcatctcaagccccgcgaaatagtcgagagttggcagtccgcaatcaattcttcacgccgcggtatgttgttgaattcctaaccgataataccctaggccgtatttggtatgagatgcgtaaaggtgcaactgcgctcaaggatgagtgcagatatcttgttcggcgtcagaatgaagtcttcctagaaaagggtgacaaggccccgatcgaaccggaaaatgaaaacgacctttcccagcaagaagtgctcagacggccttttcacattgtgcataggctgaagaaagatccccgcgatattcgcgtgctcgacccagcctgcggctccggccactttctcctttatgccttcgatctgctggaaagaatctatgatgaggcgtgggcggaagaggaaggcccaaagtcagaggttaccggctgcagtttgcgcgatgacttcgagactctcgacatattacatcgcgaggctccgaagctgatcgtagagcacaaccttcacggcattgacatagacccccgcgccgtacagatcgccgcattggctctctggttgcgggcgcagaaaacctggaaaatacttggactcaaggctgccgataggccgcagattgtcagagcgaacattgtaaccgccgagccgatgcccggcgagggtgatatgcgtcgggagttcaccgctaacctcaaaccgcgagtgctgggacagcttgttgacgtggtattcgacaaaatgaagctcgctggcgaggcgggctcgctcctcaagattgaggaggaaataaaagatgccgtcagcgaagccaggaaccaatggatgaaaagccctcagccagaacaggcggtactctttaccgaattaattaaaccgaaacctgaaagagagcagttgcgcttcgatctctcgggagtgaccaacgagcaattctgggagcaggcggaggagcgcatactagaagccctcaaagattacgctgagcaggttgaaaacggacgaactgtccgccgtcgtctcttcgccgaagatgccgcccgaggatttgccttcattgaagtatgccgcaagaaatacgatgttgtactgatgaatccgcccttcggtgagccaagccaactttccaagcaatggataggatgcacctatccgattaccaagaatgatatcctcgggcctttccttgaaagagcaattatggttctcaatgtcgagggcactgttggaacaattaccgctaaaacagcctttcagctttcttcaatggcgggctttagaaaagaactcattttaaaagaaacaacgataaaagtatttgctgatttgggtagtgaagtgttggactcagctatggttaagacagcagcttatgttctgggcaaagcacgagaagatgtgcacagcgtattcatcaaccttaccggctcccaggataaggctgggcaacttgccctagaagtctcagacggactttcaagcaagaatgtgttctgggtaaaacaaactgaatttaatcacattcccggagctccttttgcctattgggcggatagcataattcggagatgtttcgcaaaatacccttcgcttgcatcattgaacgcagaggtaaagcaagggttaggaacgaccgacgatttccgcttcgtaagagctacatgggaggtctcaccgggttcgattggtgtgcaaaaccgctggtcgttttacgccaaaggtggtgaaagcaacgacttctattcagatattcatctagttgtcaattgggctgacaagggaaaagaagtctacgcgttcaatggtattccttttggaggtgcaggcgctccgattcgaaacccatctttctactttaagccaggtttgacgtacacaagctataccaacaagggcttttcgccaagagtcttgccatcaggctgtatctttacaaccgcgggcatggccatattcgtctctgatccactcacaatgttgagtttgctcaacagccgggtcattcaactttttctcctgatgatcaccgatgagagaaaatgggaagtgggatacgtgagtagcatcccaattacaaagttgaatacagtggatatcacgaggctttcggatatggctcttcgtggctggcgagaggcaatatcatcgacgttttgggacgagacgcaacgttatttcaacgctattgcgggagcagctcggatttcttcactgcgcaccgaaccggagcggcttaagctcgattcacaaaattctctcaataagttgcaggcaatccgtcgtgaaatcgatgagttgacacttgcctcgtatgggttgacaagtcgacacatcgagtttgttaacatgcggttagggattgaaacaaaggagaatcccgaagaaagcaatatcaccgccagtctcatttccttacttatcggaattgtatttggtcgctgggatatccgtattgcgatggactcttcgctcgctccagagatacccgacccattcgacccgccgcctgtttgtccaccgggcatgctggttagtcccgacggcttgcctgcaaaacccgattatatcgccagtgaagaatggcttcgcgcccgaccgaacgctgacaccctaccgccagtaactggggttaaaaaaaccaccatccctgatgacagttacccattacgtatctcttgggatggtattctagtggacgattccggcttcaacggtagtcaacctaaccgggacgacatagtccgtcgcctgcgagaggtaatagatctcatctggaaagaaaaagcccatgatatcgaacaggaagcctgtgagatccttggtgtttctgatttgcgtgattacttccgcaaaccagcggggtttttccaggaccacctgaaacgctactccaagagccggcgcaaagctcccatatactggccgcttactactgcttccggttcgtacacaatctggctttattatcatcgcctgaccgaccaaaccctatatgcggccgtcaataagtatgttgaacctaaaattgatgagacggagcggagtatcgctcgcattgaggaagctctaaagagttcatcggggcgtgatctgacacggcttaccgaccaattccatgacgcacgttcttttcttaacgaacttcgagatctaagagaagagttgctgcacatcgcgactctaccctttaagccgaacctcaacgacggtgtcatcataaacgctgctccgttccacaagctcttccgcctgcgatcgtgggcaaaggactctgaggactgttggaagaaattggagaagggtgactatgattggtcccacttggcatataccatttggccggaccgtgttcggaatacctgtaagaaagaccgttccattgccatcgctcatggtcttgaaaacctccatgatgggatcgaaggagagtga

SEQ ID NO: 2286 - DNA, 4314 bp, Dehalogenimonas lykanthroporepellens
atggcctttgatcaaacaacccgaaaacggcttgccgactttgtcggtaaaacccgtctgttgttgacggaggaattcacccgccaactgcagaacgactacgggctcgatcccaatagcggtgacgtgaccgacctggcccggcttgaacatctggacgatgcacgtcgcgagacggcccacctgctccgcgacaccatggagcactatcttgctgccgccgataccggaacactatccaaggccaaaaaggcccgtcaggatattcttgaccgcatcgtccgggaacaggccttcaccattctcaatcgtctctgtgccctgcgaatggccgaagcgagggggctgctaatcgaggccatcgccaagggataccagtccaaagggttccagctctatcagcgcctggcaggcaccgcactgggagaaaccggagcctgttaccgtcagtttatcttcagtgtttttgacgagtttgccgtcgatctgccggttctttttgaccggttcagcccccaaggacgtctgttcccccgcgaggcggcactactcaatgtgctgcaggagatcaaccacccggatatcgatccgctctgggccgaagacgagaccattggctggatttaccagtatttcaatcagaaggctgagcgtgatgccatgcgcaaagcgtcgaggtctcccagagactcaagggagatggctgtacgcaatcagttttttacgccacgctatgtggttgagtttctgacggataatactctcggccgcttatggtacgaaatgacccaggggaacaccgcccttaaggacttttgccactacctggtatgccgtcccacagagatttatttggccgaaggtgagcaggtaccaaagcaggataaaactgtcgaggggctttcccaagaggaacttctcaaacaaccggtttacatacctcaccataaacttaaagatccccgtgacatcaagatgctcgatcctgcctgtggctcgatgcattttggtctttatgccttcgatctttttgagcgtatttacgacgatgcctgggatattgaagcgcagcttggtgcagacggttttattcggaccgaggggctcaagccactccatgtatcctacagtgacaaggacgcctttctgcgtgatgtgccgcgcctgatcattgagcgcaacattcacggcatcgatatcgatcctcgcgcagtccagatcgccgggctgtcactctggttgcgggcacagaggtcttggcagacgcggaacgtcaaagctctggaaaggccccagattcaacgctccaacatagtttgcgccgagcccatgcccggtgaggccgatatgctgaacgagtttaccgatcagcttcaacctcgggtattgggtcagcttgtaacaatggtctttgagcgtatggcgcttgcgggtgaagcagggtctctactcaaaatcgaggaagagatcaaaggtgctgtcgcagaagccgtgcagcagtggcaaaaaggtccaaagcctgagcagcagctccttttccccgggatggaagcctcgcagccgaagcaacaggagttgaggtttgatgtcacggggattaccgacaaacggttttgggagcaggcagaagatcgaatcctggatgctctaaaaaagtatgcggaacttgcggaaaacggccacgcaacgcgccgcagattgttcgcgaaagacacggccaggggattcgccttcatcgacctgtgtcgtaatcggtacgatgcaatcctgatgaacccgccttttggagcatcaagtcgcgaatcgaaagaatatatcgacgaccgttacccaaagtccaagggtgatgtcctcgccaatttcatcgaacgcaccttgcaactcagtacgagtcaagggcgagtcggtgcaatctcaagtcgaaccccattcttcttgggttcatttgacaacttgagaactgaggttcttggtaaagacggtcatgttcgcctgctggcagatttaggtgatggcgtacttgaggccatggtggagacggcgatctatgtcattaccaaacatcgacgcggcgaaccagaatcattatttttccggttgcttgtcgatgccgaaaaaggtgagctcctgcgtgagcttaaggaagagtgctcctgcggtgagacgtctgacagaacatttgttataaatccaagacattttgaatcgttaacaggaaatccatacgcctactgggtttcgaaatccaccattgaaaccgtcggtacccatccttgcattgagggaaataaagcggcgatacgtgtcggccttcaaacgggagaagatcttcgtcatcttcgccttctctgggaagttccaagcggagctatcgttccacgcctgccacagttgaataacccaagtctggacataaggtaccagtgcctcagtcaactgagaaatgttggtcattgggtaccattttcaaaaaccgacatggcagctccttggttcagcccaatcacattggtagtcaattgggaaaatgacggaaaagagctgaaaaattttaccgattcaaaaggcaaagtcagatctcgtccacaaaacgaagagtattatttcaaaccaggcttcagctacatgcttcgctcaacgcgactggttccttacttggttccatcaggtgtcatgcccacggcaggcagggcacagatattcccagacgacggtgaggagtatgccgtgcttggtatctgcgcctccaatgtggggagtgccgttgcgagatttagtggggaaatgtttgctcggccgaaattccaagccagcatggtccaaggactgcccgtgtgcgaattcccccaagaaacgttggcgactatcaaagatcatgttgatgctgaagtgaacaaacgccgtgccgtggttcagcgctatgagccgtatcaggagtttttacttccggcctggattcattcgggagagggcggggaaacagcctgggatctgtattcgctttttggccggggtttggaaaatagaatagcagaggctttcggcctcaatccggaccagcttgtagaactggaacgagatatccgtgaagcggtttcaatccgaggacgttcggaagacgatgaatccgaagactctcatgatgagtcaaatgaggatgatcaggagctgaatgttgaactcatttctgaaacgcccgaggcaaaagccgttggacttttgatgtacgttgttggtgttacgttcggccgctgggatgttcgtattgccattgatccttctcttgccccgaaattgcccgccccctttgatcccttgccggtttgtcctcccggaatgttggttggtccggacggtcttccagctcagtcgggttgtgtcgtcagcgaggaatggctccgtgcccggccggacgccaatactctgcccaaggatggagcaatcgggggagcgactattccggatggtaaataccctgttcaggtttcatggaatgggattttggtcgatgaccctgccaatgcatgggacattgtcaatcgaagtagatctgtatttgagctgatcttcggggatcaatacgagagtgttgaagccgagatatccagtatcgttggagcacgctctcttcaagactatatccggaagtcatcaggcctttttatcgatcacttgggcgtgtattcaaaaagccgccgctatgccccaatctactggccaatttcaaccccatcaggttcttacacactgtggctttactatcaccgtctgactgatcagacgctgtatacctgcgtgaacgatttcgtcgactcgaaactcaaagaggtatccgacgatgcaaccaatttgcgcagtaaatccaaccggtcatccgccgaggaaaaagaactcgaacgcttaagcgatcttgagctggagctgaaagatttccgtgacgaactgttacggatcgccaggttctggaagcccaatctcaacgatggcgtgcagatcaccgctgcgcctttgtggaacctctttcagcatcgccaatggaaagcccgcctcaaagatacctgggaaaaactcgaagccggtgattacgactgggcgcacctggctctttccatctggccggatcgcgtcgtccgcgccagccataaggatcggagttacgccatcgctcatgatcttgacgaccaactctggcatgaagtggaggttgagaaggttggccgtggcggccgtgtgacgaggacgactgagtggcagccccgggacttgagcagcgcagacctgcagggaatcatcaatgaggtcaaggcacgatga

SEQ ID NO: 2287 - DNA, 3534 bp, Desulfitobacterium hafniense
atgaacaagaacgcaattcagaaatacgcaatttgggcgcggaacgaactcattgagcaggtgaagcagcgtgcctaccaatacggtatcagcgaagagggctacggtgacaagtacgctaccgttatcgccgggcgtgtgctaacagccggcgagaggtcccagcgacaggcgtttgtcggagaaatagaaagatatggctacaagcaagctgttgaggaagtggcgtatacttggttcaaccgttttgtcgccttgcgctatatggaagtgaacgactatttgccgacccatgtccgcgttttttcggacccaagcggtaactttaagccggaaatcctcacgaatgtactgcatcttgatctacctggcttggataagacaaaagtatctgaacttctcaacggcaacgccacggaggaactctaccgttatctcctgttgacgcagtgcaacgctttgaatgcgctcctgcccgagatgttcgagcccatgggtgcttacactgaaatgctcctgcctaacaacatcttgaaaccagagagcgttatcgggcgattggtgaaggacattcctgaagaagatttccgggacgcggtgcaaatcatcggttggctgtaccagtattacaataccgagccgaagcaggcggtatttgatggactgaaaaagaacattaagattacgaaagagaatattcctgctgcgacccaacttttcacgccggattggattgtccgctatatggtggaaaactcgctggggcgaattttcatagggagtaggattcagggattagggattagtttaactgaagccgagcgcattgctaaggaaaaagaaatcgcaaatagattcggatggaaatactatatcccagaggcggagcaaacgccagaagtccgcgcacaactactccccaatccctattccctaattcctgtcgaggacctaaaaatcctcgacccctgtatgggtagcggtcatattttggtatacgcctttgacgtactgatgcagatatatacttccgagggctattctgagcgcgacgctgcgaagctgatactggaaaagaacctctacggcttggagatagaccgtcgtgcctttcagcttgcttatttcgccctgatgatgaaagcacggcagtataatcgcagaatcttcactctcggcgtgcgcccgcaggtctacgagccgacaggctacgcggacggtatggaatacggggcgctcgtgcgcgtggataaacttgaagaaatgcaaaaagtgactatgggacagcttgcaactgacgataacgccgatacttttgccgtaaagctaaacacttggaatttccgcaggctgctcgcgcagaagtacgatgtggttgtgaccaacccgccgtatatgggtgcgtcgggtatgggaacgaagctctcggattttgttaaggccaactttcctgacagcaagagtgatgcaagcacggcatttatggagcagacgctgtatctgtgtaagccgactggttatatggctatgataaatattcctgtgtggatgttcttatcgagctatgaaaagttacgcaagaaattgatgttacaaaataccattaccaatatgctacatttcggacgtggcatttttggttctgactttgggtcaactggattcgttattggcagaaaacatattgtcggatatgttggctcataccgccgcttgttcgagaagcaaggagcagttgatagcgtagaacaaaaagaaaaatggttctttgagggaatgggtaaatttactgctactgccgacaactttgcaaaggtacccagtagccctgtggcgtattgggtgagcaagaatatgttgcgggcgtttgaaacgggtaaattactcggtagtattgctgattcaaaacagggccttgcaactgcggacaacgatagatttttgcgtttgtggtttgaagttgcaacgaacggtgtaaaatttgacgctcataacgaagatgaagcattggcatctggtgcgaaatggttcccttacaataaaggtggagaatttaggaagtggtatggtaacaatgattatgttgtaaactgggaaaacaatggcgctgaaatcagagattttacagatggcaaggggaaactacgttccagaccgcaaaacacgcagttttatttccgtgagtgctttagttggtcacttgtgtcatctggtgtagctgcttttcgttataaaccatcagggcatatatttgacgttgcgggaatgagttgttttgctaataaagaactgtactacttacttgccctttgcaacaccaaggttgtaatgaaaatattggagattgttgcacctaccataaattatcaatgtggcgatatagcaaatattcctattttgattgctgatgaagctgtcgagcagataaacgataaggtgcagcagaacattaccgtttctcaaaaagactgggacgcatttgaaacctcgtggaactttaaaaggcatccacttgtagaatttcgtttggctggtgcatacgcttggggcgacaacgaaccggttcgcagaattagtttcgcatataaagcgtgggagatgcttgctgatggccattttcaagcactcaaggccaatgaggaggaactcaaccgcatcttcatcaacatttacggattgcaggatgaactgaccccggaggtcgaggataaggacgtgaccgtgcgccgcgccgacttggggcgcgagattcgctcgcttatcagctatgccgtgggctgtatgttcgggaggtactcgcttgatgaagaaaggctgatattggcagggcaaccctacggtgaacgatttgcttatgccagcgttccagttgctggtggaggccccttatacagggtacagggagattgttatctgcgaaaatcggacagtactcttaaggtatgtacctatgcccccgacaaggacaatatcatccccgtctgcgatgatgagtatttcgatgacgacattgcggggcggtttgtgcaattcataaaaaccgtctacggcgcggacacattggaagaaaatctgaagttcattgccgacgccctcggcggcaagggtacgccccgcgaagtcatacggaactatttcctgaatgacttctacaaagaccactgcaagatatatcggaagcgcccgatttactggctgttcgacagtggcaaaaagaacggtttcaaggcgctcatctatatgcatcgctactcgcaggatttgctcgccaagctgcggacggactacatccacgagcagcaagagcgttaccgcacccagcttgcccacatcgcaggtgcgctgaacaccgctacaggtgcagaacgggcgcggctcctaaaacagcaggacaaactgtccgagcaggcgcgggaactcggcgtgtatgaagaaaaggttcaccatctcgccgaccaaaatataccgatagacctcgatgacggtgtgaagaagaattatgagattttcgccgacgttctggcgaagatctga

SEQ ID NO: 2288 - DNA, 3492 bp, Desulfobacula toluolica
ttgaacacatcaaagctgaaacaatttgcacagaatgcgcgaagacaattgatagacatggttgcaacaaagctgtccatcgtgctggataccaatagtgcggccagaagagaacgggaaaaagccgtaaaagatcttgaaaaaaaaatctcccggacatcccgcgaccaggtaatagaaaaagtggcctacatctggttcaaccggttttgcgcattaaggttcatggatgcaaacagatataccgccatgggtgtggtatcacctgcccgggggttctcccagccggaaatcttgatggaagccaagcagggcaatattgatgacgggttgagaattgatcaagaaaaagtgtttggcctgctcaatgaaaccattccaagcccggagccacagcaggaagcataccggatgctgctggtcgcagtctgtaacgattacaacagcattatgccgttcctgtttgaaaagattgcagactttacagaactgttgatgcccgatgatttgttgtcagacagttcaatcttgaccgctacccgtgaagccctgtccgaagaggcctgtgctgatgttgaagtgattggctggctgtaccagttttatatctcggaaaaaaaggatgaggtgtttgccgggcttaaaaaaaataaaaaagtgacaccggaagatattcctgcagccacacagcttttcacacccaactggattgtccggtatttggtggaaaattctcttggacgcttgtggattttgaatcatccagactccaggcttgttgataaaatggaatattatattaagccggagcaggaagaaacagattttcttgtgatcaaatctccggaagagataaaaatatgcgatcctgcctgcggttccggtcacatgctggtgtatgcgtttgaaattctttatgccatttatgaagaacaaggatatgatgcccctcaaattccacagctcattcttgaaaataatctatacggtattgagattgatgaacgggcaggagagcttgcagcctttgcattgtttatgaaagcaagagaaaagtatcgtcgtttctttaaaaagaatgtgcagccaaatatttgtgtccttgaaaatgtgtcttttaaagagcatgaggttaaaagttatatggatgcagttgcccctgatctttttaccatggatctttcaactttactgtatcagtttgaggaagcggataattttggttcattgattcgtcctgaattaacaaatatccctgatgtattgagtcttttagacgagaaaaaagtatctgatgatatttttcttcagagtattcatcagagggttttgaaagttttaaaacaggcagactatcttagccctaaatatcatgttgttgttgctaatccgccgtatatgggcaaaggaatgaatagtcggttaggacgttgggttaaggataattacccaaacagtagggcagatttatgtgcgatgtttatcgaacgtaatatagatatgagccttgggaaaggcttggtttccatgataaccatgcacagttggatgtttttaacttcatttgaaaaatttcgtaaaaatgtaattactcattatccactattaacaatggcgcatattggagcaagaggttttgacagtattggcggtgaagtagtttcaacaacggcctttgttataaaaaaatcaaatttgatcgattataatggttcatatttaaggctcattgaaggtcgcaatgaacttgaaaaaaaaaatatttttaagaagaacgctaatagcggtgaattactattcaataaatcaattaaagctttttataaaatccctgggcaacaattggcttattgggctagtgagaatattctaaatggatttagtttgcccaagctgggagatatttttcatgtaaaaagtggtttgacctcgggagataagaaacgattcgtaagagactggtttgaatgccaaattgggcacataaattttacagcgcaaaatggaaaatttaacggactaaagtggttccctcacaatgatggaggaacagtaagaaaatggtatggtaatagaaaaagtgttattaactgggctgatgatggagaagaaattaaaaatttctcaggatctactgtaagaagtccaatccattactttaaatcaggtgttacatggagtgatataagtacatctttttttgcggcacggtatcttccatcaggctctgtgtttgaaaatacaggatcaattgtcgttgcaagcggtagagaggcaaaaattgttgttgggttactttgttctcatgtggccaaacaatatatggatttaatgaatccgaccttacattatggtgtcggtgaagtagcaaaattaccatttaaaaaaacaaagcaagatattgaatttatcatagcaagatgtattaaactatcaaaatttgattgggattcttatgaaacatcttgggattttaaatgtttacctttgatttgtggagaaaaagagtcaataaaattttctattccaaattatcctttatcaactaaaatagaaaaatcttacataaaattaagatctttgtggcaagatataacagtggaaattcaaaaacttgaagaagagaataatcgaattctacttcaagagtatgaattgcagaatgagttgtcatcaaatgtgccaatatcggagatttctttaacctgtaatccatattatcgttatggtgaaaataaaagcgataaggctcttgaaaaacagctcttatcagacaccattaaagagtttatttcatattctgtaggttgcatgtttggccgttattcattggatcgagaaggattggtattagcaaaccaaggagaaacgatagaaaactaccttgcaaaaatacccgaaccaaaatttatcccagacgatgacaacgtaatcccaatcatggacgttgactggttcacagatgacatagccgaacgattcaaaaaatttttaaaagtaacattcggagaagaacactacacggaaaaccttgagtttattgaaaaagccattggcaaggatatcagaaaattctttctcaaagatttttacacctatcatgtgaaaatgtacaaaaaacgccccatatactggatgttttcatcgccaaagggcagcttcaatgccctgatctacatgcaccgatacaggccggatacggtttccataatcctcaatgattacctcagggagtttagaaccaagctggctgccagaaaagacaaccttgaaaatatcagtatcagcacatctgcttctcaaggagaaaaaacaaaggccttaaaagagatcgaaaaaatcaaaaaggtgctggatgaggtgaatgaatatgaacgggatatcctctatcccctggcgacaaaacagatagaaattgaccttgatgatggagtaaaggtaaactacccaaagtttggtaaagcgcttaaaaaaattgcagggttgagttga

SEQ ID NO: 2289 - DNA, 3426 bp, Desulfomicrobium baculatum
atgcagcctctcgctagatcccttcgcaacgatttggagaaaaccgtcaaatccgctcgcgacattgctgaaaatgcagccaaggcatgcttggagcaacttggagttggtgagtctgtgccgttttcgcatctatcagacgaacaaaagaacttacggcgaaggctccgggctcacgggagacaacttggagatattcgatctaccaaaggggagcaggaaataaccttgcttttggaagaagtggcatatgagcattggcatcgcatgctttttgcccgttttctggctgataataatttgctcatgttcgacggcgtggccgtcacgttggcagaatgcgcggagctggcagcagatgaagatgaaggctttaccaatgaatgggagatggccgccgatctggccggagccatgctgcctcagatatttcgcacggattcagttgtcttcaaactgcatttttctccggagcatcagcgaagtctggagcggctcatcgcagatttacccgtagatgttttcatggcgtccgattccttagggtgggtgtaccagttctggcaaagcaagcgcaaagacgaggttaatacatctgaggtcaagatcggcgcgagagagttgcctgccgtgacccagcttttcaccgagccttatatggttgcttttctcttggacaacacgctgggctcttggtgggcatcaagaaaactgacgaaatctgaattaagctctgcaaaagacgaagacgaactccgcaggaaggcatcgctccccggcgtcccgctgtcgtatctgcgttttgtaaaaagtgaagacgatttgtggactccggctgcgggaacattccttggttggccgagaacattttctgagctgaaaatactcgatccaagttgcggttcgggtcactttctggtcgccgctttgcaaatgctggtacccatgcgcatggagcttgagaagctgtcagtgcatgaggctatcgacaaagttctcactgagaacctccacggtcttgagattgatcaacgctgtgttgagattgccgcctttgccctagccctcaccgcatggagatatccaagcgctggcggttatcggacattgcccgaacttaatgtggcctcgactggactttccatcagcagtactaaagaacaatggatggctatcttggaagggcagcatctgaagctcgacctgcggttccattttgagcaactttacaatcttttcaccaaagcgccaaccctaggcagtttgatcaatccgcataggtttttgggacgtggtctcttggacgagagtggcatgcgagtcctgatgcaggttttgcgcacagctataaaattcgaatcgaccgcttcggacaagtatgaacttggggttgtggccgccggattaactaaagcagccgaactacttgcggagcgctataccttggtggtcactaatgtgccctatctcgggcgggggaaacaggatgatgtgctcaaaaaacatctggaaacccaatatcctcttggtaaggccgacctagccaccgcttttgttctgcgttgcctcgaattctgtaccaagggagggtccaccgcgctggtgacaccccagaactggcttttcctgacgacttataaaaatcttcgcgaaactctcctgcgaaaccgttcatgggagatagtggctaggttgggagcaaaaggctttcaaacaccaatgtgggacttcaatatccaactcagcgtactcactgcttccaaacccgttgacgatcaggcgatgtctggaatcgatgtttctgaggccagccgtcccgaagaaaaggcggcgttgctacgaggagatgatcctgctgagattttggttctgcctcagaaggagcaactcaaaaaccctgacgcacgagttctgttcgaacttcattgcgatttgaaacggcttggtgattttgctgaaagcgttaaaggtatcactacaggtgactctgaccgttttatccgacgtttttgggaggtcgaacggcgccttcctgggtgggaatggttccaaagcactgtccaagcacacatcacgttcggcgggtgtgagtcaatcgttgagtggcatgacggcaatggcccgatgaacgaagttccaggtgcacgaacatatggccgcggagcgtggggaagccctggtgtggtggtgggccaaatggctcgtatgtgtgcaactctctaccaaggcacgccctacgacaacaatgcttgtgtgttaaaaccgacgaatcataaccatctgcccgcgatctgggcgttcgccacttctccagagtttgtcaccggtgtccgagtcctagaccaaaaggtcggagtaacgaatgccaccttcgagaagctgcccttcgacctcgaccactggcagaaggtcgccgcggagaaataccccagcggactcccagaaccggaaagcgatgacccaactcaatggcttttccatggacgaccagaaaactctttcgctccacttcaagttgctgtcgcccgcctgcttggctaccgatggcctgccgagcttgacgcaaacatgcgcctcagtaatcgagccagtaaattagccaatagctgtgccgaattgggtcactttgcagacagcgacggcattgtttgtatcccgccagttcgcggggaagctcctgccgtcgaacgcttactaaatcttctggccttggcgtacggccaaaattggggctctgaaatgctctccgaactcctcaaagccgcagatcatgccggcaaaacgatcgagtcttggctgcgcaataaattctttatccaacactgccaactctttcatcaacgccctttcatctggcacatatgggacggccttcccgatggtttttcagccttggtcaattaccacaagctcgatcgcaagaatatggaaactctgatatatacgtatctaggtgactggatcacacgccagagagacgagatattgtcaaacacggatggcgcacaagagagactggccgctgctgaaacacttaagcaaaggctcgaactgatccttcaaggggatacgccctacgacatttttgtgcgttggaagccgttactgaaacaaccaattggttgggagccagacctgaatgacggtgtacgtgttaatattcgtcctttcatgaccgtgcctgacatcaagaagaaaggcgcaggcgtacttcgtgaaaaaccaagaattgactggaagaaggatcgaggcaaggaaccagttcgtccacaaaatgattttccttggttctggggatgggatgaaaccattgattttgcaggtggggcggagttcaccggcgatcgttacaataattgtcattacagcctcgacgttaaacgccgggcgcgtcgcgtgataagagcagaggatagtacatcatga

SEQ ID NO: 2290 - DNA, 3552 bp, Desulfosporosinus meridiei
atgaataaaacagccattaagaactttgcgatctgggcaagaaataagctcatcgcagagattacatataaagcaggactgctgggtattacggaaaaagaagtcaaaagccccctgccgcagtcctcaaaagatgtccaattctttgatatcggtacaagagagccgtactctattaccggcgtggaaattgagcagcgagcaaaactggtcgcagcaattcagcaaaaagaagagcagtcggattacaagactgcttttaagagcgtggttgaagaggtagcttatacctggttcaatcgtctgatagccgtgcgatttatggaagtaaatgactatctcccatctcgaatcagagtgctgtcttcagaaagcagcacaaaagcagaaccggacttggtgactacgccttttgacgcagatctggagtatacgccttatgaaaaagaccgaatcatgcagctgaaacatgacaataagctggatgagctttttcgtatgctctttatcaagcagtgtaatgctctcaatgtgattctgccggaattgtttgagaaaacgaatgactacactgaacttctgttgaacgtatcttatactgataaagacggcatggtttatcacttggtgcatgatattgatgaagctgattttaaagaagcagtcgaaataattggttggatgtatcaattctatatttctgaaaaacatgaagaagtagtaaacgttattggtggtaaatctataaagaaagaagacattcccgcagcaacgcagctttttaccaccgactgggttgttcgatatatggtcgataattcgcttggtcgttattggattgagcgtaatccagatagtaacctgaaagaaaaacttgaattttttatttcaccccaaaaaagtgatatcacatatatagatgaaaaagttgatcctaccaatattaccttttttgacccgtgcatgggtagtggtcatattttagtatatgcttttgaagtttttatggcaatttatgaagaatgtggctattcccagcgtgatgcagcaaaaaacattataacaaataatctatttggtcttgatatagataaaagagcttatcagttagcttattttgctgtcatgatgaaggcaagaagctataaccgacgcattttattgatggatatcaacattaatgtatgcgcgatctatgaaagcaatggggtaacaaagtttacatatgatgatttaacctttaatgaatttcagaataacattggtgaatatttgattaatacttttaggcatgcaaaagaacttggctctttgcaaacagttgattatcatgactatatttcattcgctgattatttggatcagtgcattacaaatgatcaattaaatctttttacttctatatggatgagtgaaacgcttccattaatgagaaagttagcaaaacaagctgaaatcttgaaagaaaaatatactgttgtatgtaccaatcctccttacatgaacaaattagaaagtcaccttaaagaatttgtaactactcgatataaggcgtactcaggtgatttattttctgtgtttatgtatcgtaatttgtctttctgtaaggaagatggctatgctgcttatatgactccaaatgtatggatgtttttgaaaacatatgaaaatttgcgaaaatttattgttgaagagaagtcaatttcatctcttattcaaatggcaaaaggagcattcttcaaagaagctgttgtagatatatgtacttttgttttggctaataagccttctagtattgaaggcatttatattaggcttgaagattttaaaggagatatggatgtacagaaagaaaaagttctggaagcaataaatactgataattgtagttttttatattcaacaaaaactgataacttttctagaatatctggtatacctatagcttattgggttaagaattatgctgttttttcggcgaagaagttcagccatagttatttttctggtggaagaaacaaaacgcataataacgatgtctatgttcgtacatggtgggaagtaaagagaacacctggatggaggccgtactctaatggtggcgtgttcagaaaatggtatgggaataatactgatgtagtaaattggacacctggtgcaagagatttttaccgccaacatggcggcttgttaaatgaaaagttctgggataaagaagggataacatggaatgatattacttctggtttaccaagctttagaattaaacctgctgatagcatatttagttccgtttccccaacaatatttaacttgtcctttaagtgtgataatgctgtattgggatttctcaactctaaggtaagcatatatctacttaatattacaaatccaacattgcatacgcttgttggaaacgttctagacttacctgatttaatcgagaacgtaccggtatcatgctttgaattggtcgcaactaatataaaattagccaaaatggattgggatttctttgaaacaagttgcgattttaaacgtcatcccttcttaactttccagaccgatacagttgcaaaatttagcacctattacctaaatgagaatgataatatatctagtatttgttcaaacacagcaaatggctgggtagaaaatgcatttaagatctggcgctttttttcagaggcacaatttaaaaaactgaaatctaatgaggaagagctaaatcgtattttcattgaactctatggtttaaagaaagagctttgcccacaggttgaggaaaaagacgtgataatccgcaaagcagaccttggacgtgatgtgcgttcttttatttcgtacgcagtaggttgtatgtttggtcgctacagcctcgacttggatggacttgcatttgacggtggtgaatgggatgattgcaaatacaacacctttatccccaacaaagacaatatcctacccatctccgatgaagaatactttgaggatgatatcgttggactgttctgtgccttcgtcaaaataagctttggtgccgataatttggaagaaaatctggacttcatagccaattcgcttggcaataagggtaatacctccagagaagtcatccgaaattattttctaaaagatttctttaaagatcattgcaagggttatcagaagcgtccgatatattggctctttgacagcggtaaaacagatggtttcaaagctttgatatatctgcatcggtatagtgaggataccattggtaatctgcgtattgattacctccataggatgcagcgagtatatgatagtgaagtcgctcgtatgcaggagacgattgataacagtgataatgcccgtgaagtggcagctgcaaccaagcgaaaagaaaaactaaaaaagcaattgaaagaaaccaaggaatacgatgagaagattgctcaccttgctcttgcccgtatttccatagatctggatgacggagtaaaggttaactatgaaaaagtccagactggtaccgatggcgagaagcttgaagtgctggcgaagatctga

SEQ ID NO: 2291 - DNA, 3657 bp, Desulfovibrio magneticus
atgcccataaatcgcaatatcttaaagacctatgctcctcaggctcgtcgcgaatttattcaggccgtgacggacagggccagtgtccttggcctctccgaaaagaaaatcgagccagcggaagtcgcgggtgatgttgcaatcattgccgggcgtcctttcccgaaggaagtggctgcaagccgaaaaaaattggaagacaggattacgctcaatggcttcacccaggtcatggaggaagtcgcttatacttggttcaaccgctttaccgccctgcggtacatggaactgcacgattaccttgggcatgggtatcgcgtgctaagtaaccccagtggttctgacatcccggaaattctggagaaggctaccagcgttgacctcccgggactggacaaggacaaggtgacggaattgcgtctgactggcgataaagacgctgaattataccagatgcttttgataaagcagtgcaatgcgctccatcgcgtcatgccagcgctgttcgaggcggtcaatgacgccacggaactcctgctcccccaaaatctgctccagtcaaattcgcccatccgcaaactggtcaacgatatcccggaggagaactggtccgagattgagatcgtgggctggctgtaccaattttatatctcggaaaagaaagaccaggtcatcggcaaggtggtcaagagcgaggatattcctgcggccacgcagcttttcacccccaactggatcgttaagtacatggtccagaacaccttgggtcgtaaatggctcacgacttaccccggctcctccattaaggggaaaatggaattttacatcgagcctgccgaacaggagccagaagtccaggccaagctggatgccattacccccaaagagcttaacccagaagaactgacgttcatggatccagcttgcgggtctggtcacatccttgccgaagcctatgacttgttcaaggacatttaccaggagcgcggctaccgcaccagggacatccctcggcttatcctggagaagaacctctacgggttggatatcgacgatcgcgcggctcaacttgctcgattcaccgtcctcatgaaagcacgggctgatgaccgccgtattctcgatcccgagaaccccgccaagctgaacatcctggccatccaagaaagcaaggggctggatgttgatactgtggccagcgtgctacttcgcgaccgggtcagggagatcggcagcaaaggggcacagcagttgaccctggttcagcccaagatgacccaagggaccctgagtgaaaccgagaaaccggaagtcacgaaggacgagttattctcactgctgaacctctttgaaaatggcaagacctttggttcgctgctgtcggttcatgaccggcttaagcaggcactacccaggctggagaagctggtcgctaagtcattgcaggcttatgatatggaatctcggcgatatgccaaaatgttgttgccgctagtccaacaatcaaaagtgttagccaagcaatatagcaatgttattacaaaccccccgtatatggggtcaggctatttcaacgaaaagcttaaaaattttgtaaacgaagaatacaatggttattcacaagatatttatggatgttttatttttagatgcttgtctatgggagaagaaaaagcatacgctgggatgataacaacaccaaactggatgtcgatgccgacattcttttatttgcgggagtatattcttaaaaaaaatactttactgttattgacagacaatggaagaggagtttgggggccagactttggaagctgtgcctttataatacaaaacaccaacactccaggatatgcagccagatttaaaaagctatatgacaaacagggagaagtcaattcaaacaatgttcttattaataactttttttctaacgcatggcaaaatacaaatttgtcgagtttttataatattcctggacttattctctcttcttacaaactaagcaaaaaattaagagataactttaaaaattttaaaacaattaatgatattgcgaaagcaaagcaaggaataaagactggtcataacgacacttttctccgctattggcatgaagtctcatgcttaatgactagttgcattggaaaatccgaaaacagaacccataaatggttcccgtgcacaaaaggtggcgattatcgaaagtggtatgggaatcatgaatatttgcttaactgggagaatgacgggaaagaaattaaaaacttttactcaccgacgggaaaattacgatcccgtccgcaaaatatacaatacttttttaaaagcggaataacgtggtcaaaaatatctatctcagatatttcctcaaggattttcccagagggattcacgttcgaaagtaatgggtcggtcatatttcctgatgatgaaagtgatattatatcattgctaggaatacttaattcgaatgttgctaaatatattctgtctgcatttgccccaacagtcgatttcggagaaggatcgattctgaagctgcctgtttgtctatgcgacaacttgacaagaacatctatcgagcttgcaataacaatttcaagagacgactgggactcgcgcgaaacgtcatgggactttcgggcatcccctcttgtgagggaaaatgctaagccaaccatcagccaatcatacttaacaatgacatgctcttgtcaaaatcaaacaaacaagttgcttgaaattgaaaataatatagattgttattttatcaaaggctatggtttagaaaatgaactggggcatgcaaaggctgatctcaataaaatcactctatttgccaacccgctccatcgatacggccctggaaagtcagagattgaatacaaggaattgctaaaagcagacactgttcgtgaactcatttcgtacatgatcggctgcgcgatgggccgttactcccttgatgaaccgggattaatctatgctcacagtggcaaccaaggctttgatccctctcgctacaccagcttcccggctgacgaggacggcatagtgcccataatggatgacgactggttcgaggatgacgccacaaagcgattcgtggagttcatcagggtcgcctggcaatccgaaactttagaggataacctaaagttcgtcgccgacagccttgaccctaagcatggcgaaaagcctattgacaccatccgccgcttcattagccagaaattcttcagggagcatcacctcaaggtttacaagaagcgccccatatactggctcttctccagtggtaaacataaggccttcgagtgcctcgtctacctgcaccgctataacgaaaataccctggcccgtatgcgctccatgtacgtcacccccctgcagggcaaatataatgcccgcatagagttcctggataaggaaaaagacaatgccagttctgcaagtgccgccaagaagctgcaaaaagagctggatacaatgcgcaaaaagcagcaggagctaagagaattcgacgaacttctccgctactacgccgatcagcgcatcactctcgacctcaacgatggcgtgaaggtcaattacggaaagtttggatctcttttagctgaagtcaaagcaataacgggcgacagcggcgattag

SEQ ID NO: 2292 - DNA, 3477 bp, Desulfovibrio vulgaris
atggaaaccgcaaaactaaaaaaattcgcccagttcgcccgccgcagcctgctggaacaggtctccgccaagctaaaactggtgctggctgaaaacagcgcggctcggcgtgaatgtgccgatgccgttaagaagcttgaggaggcgatcaaggggcgcggcaaggaacaggttattgaccgggtagcttacatttggttcaaccgcttttgcgccctgcgtttcatggatgtgaaccgctacacccgcatcggcgtggtgtcgcccgccgagggacagttccagcccgagattttggccgaggccaagatgggccacatcgacgaagaaatggtgtcaggcaaggtccggcagcagatatttgccctgctcgatggcaaagcccccagccgcgacccgcagggcgaggcctaccggctgctggtcgtggccgcctgcaacttctggaacaaggccatgccgttcctgttccagcgcatcgatgactacaccgaactgctgatgcccgacgacctactctcgggcaactccatactcgcctacacccgcgaggcgatgacgccggatgcctgcgaggatgtcgaggtgatcggctggctctaccagttctacatctccgagaagaaggacgaggtgttcgacggcctgaagaagaacaagaagatcacgcccgagaacatcccggccgccacccagctcttcaccccacactggatcgtccgctacctggtggaaaactccctcggccgtctgtggctgctcaatcgtcccggctcgaagctggttgagcagatggactactacatcaagcccgaacaggcggaaaccgacttcctgcgcatcgccaagccggaggagatcaagatctgcgacccggcctgcggctccggccacatgctcacctatgccttcgacctcctctacgccatctacgaggaggaaggctacgagcccgccgagattccggagaagatcctcacgaataacctctacggcatcgagatcgacgaacgcgccggggaactggctgcctttgccctgaccatgaaggcccgctcaaagcagcgccgattcttcaacaagggtgtcaagccgaacatctgcgtgctggagaacgtccacttcgacggcaatgagttgaaggactacatggattttgtcggtcgcgacctgttcaccgcgccgctccagaccaccctgcgccagttcgaagaggccgacaacttcggctccctgatccgcccggatgtcaccgacgtggacggcatgctcagaattctggagtcaaagaacgtctccgggcagctgtttatcagcatgacccatcagaaggtgctgcaagccctgcgacaggccgattacctgagcccgaaataccatgtggtgattgccaatccgccgtatatgggcaagcgcagcatgaatggtcgtttgcaggtattagcaaaagacagctaccaaagaagcaagactgacctgtttgcaatgtttatcgaacgcaatgtggacttagctaaagattccgcatacgtcgctatgatcacaatgcagtcgtggatgtttctttctacattcgagaatttaaggtcgaatattttatccaacagctccatagtgagcatggcgcatcttggcgctcgtgcctttgattcaatcggtggcgaagtggtttctacaacggctttcatctgtaagaatattgctgatagagaatataaaggaacatatcttcggctcgttgatggagaggatgagcaagaaaagtcaaatcagctaaaagaattaaagggccgaccttacttagcttcgtcggacgattttgacacaatacctggccgcccaattgcatattggatcagtgaaaaagttaggaacgcttttgcgcaaggaactccatttggcgacgttggttttccaaaagtcggtatgcaaacgtcaaacaacgacaagtatttgcgactctggcccgaggtctcatttcatgaattcaaagatgaagagatgcctccaaaatggatcaaatatcttaaagggggagcctttaggaggtggtatggcaatcttgactacctcttgaggtataacaagaaccctcagtttataaagcagcagccaaacgctacagttctgccagagacaaagcttaaagaggcaaaatgcacatggacggatcttacgtctggaccatttaacgccagatatgcgcctgacgacacatttcacgatatttctggtcactgtttctatccaccgagaaacaagcaaatggtattgcttgcctacagcaatacacggctttttgactatcttctatcgcttatcaatgcatcattccattttcaggtgggcgatgttgcgaagattcctgttctcgaagtagacccaagcgcttcaaataacgcatcaacgttagtttcgttatcaaaaaatgactgggattcctatgaaacttcttgggacttcaccagccttccagtgctaaatcccgactaccgccagccaactctaaagactacctaccaaaagctccgcgcccactggcgagagatgacacttgagatgcagcggttggaggaagagaacaaccgcaccttcatcgacgcctacggcctgcaggatgaactaaagcccgaagtaccgctcaacgagataaccctgacctgcaacccgcactaccgctacggcaatgacaagagcgaggatgaactggaggctctgttgctggccgacaccatgcgggagctggtttcctatgccgtgggctgcatgtttggacgttatgcgctggataagccgggtctgatcctggccaaccagggcgagaccatcgaggactacctaaagcgggttccggagcccagcttcccagccgatgacgacaacgtcatccccatgctggacggcgactggttcaccgacgacatcgccgagcgcttccgcaagttcctgcgtgtggcctttggcgaggagcactacgaggccaacctccggttcgtcgagcaggcactgaacatcaagggcaagcgcaattacagcatccgcgactacttccttggcgagttttacaccgatcatgtgaaacgctacaaaaagcgccccatctactggctgttctccagccccaagggcagcttcaacgcgctgatctacatgcaccgctaccgcccggatacagccagcgtggtgctcaacgactacctgcgcgagttccgcaccaagctcacctcgcacaagaaccatctggaggcggtcagcatcagtgccagcagcagccagggcgagaagaccaaggccctgaaggagatcgagaagatcaccaagatgatcgccgagatggaggagtacgagcgcgaggtgctttacccgctggccaccgagcaggtggagatcgacctcgacgacggcgtgaaggtcaactaccccaaactcggatctgcattaaagaaaatacccggactcgatgccaaggaagactga

SEQ ID NO: 2293 - DNA, 3477 bp, Desulfovibrio vulgaris; identical to SEQ ID NO: 2292

SEQ ID NO: 2294 - DNA, 3621 bp, Desulfurivibrio alkaliphilus
atgcagccactggataaaacattaagaaacctcctggaacgcagcgtccaggaggcccgggagattgccgagaatgccgcccgggccgctttggagcagctcggggtggcggaacccaccccgccgccgcacctgagtaagctggagcgtgcgttgcggctcaggctgcgggcccacggccgccagttgggtgatgtactcaacggcggcaagcgcaacaccatggagcggcttattgaagaagtggcctatgaacactggcaccggatgctctttgcccgctttctggccgaaaacgacctgctgctctatgatggggtcgccgtcagcctggcagagtgcgccgagctggccggagacgaggggttgcgcaatgaatgggaactggccgctcgcctggccaccgccatgctgccccagatcttccggctcgactcaccggtgttccaactgattctgccgccggaacatcaacaacgcctggagcggctgataaccgagctgcctcgggaagtgtttaccgccgccgactccttgggctgggtttaccagttctggcaatccaagcgtaaggaggaagtcaacgccgccgaggtcaaaatcggcgcccgggaactgcccgccgtcacccagctcttcaccgagccctacatggtctccttcctgttggacaacgccctgggggcctggtgggcgacccgccgcctgagcccggctgagcttgccggcgccgccgacgaagaggagctgcgagccagggccgccatccccggcctgcccctggagtatctgcgtttcatcaagatgcccgctgccccggcggcagagggccgggatgagggggaagcctggacccccgccgccggcacctttgccggctggccccaagagctgagccaattcaaaatcctcgacccctgctgcggttccggccattttctggtggccgccttcctgatgctggtccccctgcgcatggccctggaaaacttaagctcccgccaggcggtggcggccgtactgcgggacaatatccacggcctggaattggaccgccgctgcgtcgaactggccgccttcgccctggccctcaccgcctggcgctaccccgatctccccgccccctccgcgcaagattccccggctgccccctcgttttcagccgacggagccgggggtgcggcccccctgggctaccgccccctgccggagctgcacctggcctgttcgggcctggccatcggcttggcccgggaggagtggaaacaactgaatctaagcaaacccaacctgcgcctggccctggagtggctccacgacaccttccaggaggccccggtgctgggcagcctgctggacccggccaaaaccgaggccgcccggatcgccccctgggacgaactgagcgccgccctggaccgggccctgaaccaggagcagagcgccgaacagcaggaagtggcggtggtggcccagggcctgaccaaggccgccgccctgctgaccggcaagtatcactggctgctcaccaacgtgccctatctggcccgaggcaaacaggatgaacgcctgcgcgacttctgccagcgccactaccccgcggccaagaacgacctggccacggtttttctggagcgctgcctggaactgtgcgtccacgaaaaagccgccccgcccgcaccagggcgggaaagttcggggctggccggcggggcggggcgccagggcgtggtttccgtggtcctgccccagaactggctctttctgaccagctaccggaagctccgggaaaagctgctgcaaaacgagacctggcacctgattgcccgcttggggccgcaggcttttcaaacgccgatgtgggacttcaatgtccaactcctcaccctgagccggggagccatccaaggcggcgggccgggaccgctgtgggccgccgccaacccggcggccaacccgccccccccgcacctgatcgccggcctcgatgtctccgccccccgcaccgctgccgccaaggccgccgccctgctcaccaccgaactcaaacaggtggaacaggcccggcagttggataacccggatgccgtgataagtttttcggaaataaattctctgagtttattagggaagcatgcaagaagtttagctggtgttgacagtggagattctcagcgattcatgttcaggcattgggaacaccccagactcttggacggatggatttatcagctaaatagcgtaaatgtaacaatcgaatatggtggtcgtgaaaatattcttttttttgaaaatggacagggttcactatcaaaatgccctggaggtagtattcgaaatgttaaattttggggaaagcctggcgtaacagtatccacaatgggcaacaacgcagcttcattaagtctgggtgaaagctggtgcagaaattgcgcgtgtttagttccagagaaagtcgaacatcatcttgctctttggtcgtattgttcatctgaaaaatttttcacagcagttcgggaaattaatcagaaattgagggttgcagaagcgatatttgaagtagtccccttcgacctcgaccactggaccaaggtcgccgccgaacaataccctcacggcctgccccaaccctattccgacgaccccagccaatggatcttccacggccacccctgcggctcggtggtctgggatgaaaccgccaaacaaaccgcccccggccccctgcgccacgatgccaccgtcctccaggtcgccgtcgcccgcctcctgggctaccgctggcccgccgaactggatggcgaaatggagctggccgccgagcagcgggagtgggtccagcgcagcgccctcctgctgccccacgccgacgaggacggcattgtctgcatccccccggtccggggcgaggccgcagcctccgaccgcctgctcaacctgctggccgccgcctacggtgaggcctgggggggcgccaccctggcccgtctgctcaacaacgccgatcatgccggcaagaccctggaaacttggctgcgggaaaaatttttcagccagcactgcaagctcttccaccaccgccccttcatctggcagatctgggacggcctgcccgacggcttctcggccctggtcaactaccatcgccttgactacaaaaaactcgaaaccctgacctacacctacctgggcgactggctcgaccgctgccgccgggacctggccgaaggggtggacggggccggcgaaaaaatcgccgccgccgagagcctgcggcaaaggctggagctgatcctggcgggcgaagccccccacgacatcttcatccgctggaagcccctggaacagcaacccatcggctggcaccccgacctcaacgacggggtccgcctcaacatccgccccttcctcaccgtccccgacatcgccaaaaagggcgccggcatcctccgcgacaaacccaacatcaagtggaacaaagaccggggcaaagatgtagaatcagccccctggtatcacctcggcccccaatacggcggccaaccaggcggccgcatcaacgaccaccacctgaccctggccgagaaacgtctggccctagaaaaggagcatgcaggatga

SEQ ID NO: 2295 - DNA, 1728 bp, Enterobacter cloacae
atgagccagctagaaaataacaatatggacaataatctatatcgagcctcagcagtggatcttaataagattccaggtagcccaatcgcgtattgggtacctaactttgaaatattcaatctccctaaaattcgtgagaaatggatctctggtggaagaatcaaaactcatgatggacagaaatacattcgctatacatgggaagtgtcaaggaaaaacggtcaatggaagcgattgattaaaggtggagactttcggaaacactttggcaatgaagactttttagttgattggtcggaagaagcaatttctttttacgaaatgaatggtggattgtatccagaaaagttccaatcaaaagaaggaatttgttggtctaaaataacatcatccttgcaaggttttagaattaaacgggctgtgactgaatacgattcggcttcaccaacaatttttaatgatgattttatttgtgataaatatctgctttcattcttgaactcaaaggtctcgcaatttcttctaaaggccatcaacccaacaataaatacacaagttgctgatataatggcacttccagtttgtaaagtaagcattgatatacaaagaaacattgaaaacgctcaagataaactgatctctatttcttccgaggattggaactcatatgaaacctcatgggagttcactcaactcccgttactaaattttaattttcacgcatcaacaataagtcatacatatgaaaaaacaaggcgttactggcatgaaagaacgctaaaaatgcaacggttagaagaagagagcaaccgtatttttatcaatgcctatggcctgcaggatgaattgaccccagaagttccgctctcggaaattactctcacctgtaacccttattatcgttacggtggaaacttaaccgatgaagaacgcaagcagcgcctacaatccgacaccatctccgagctaatttcctacatcatcggttgcatgatgggccgttactcccttaatagtgaagggttagtttatgctaatgccggtaacaaaggttttaaaacactagtcgaagaaggtgtttttgcccttttcccagccgacagcgatggtattctaccaataaccacaaaagcttggtttgaagatgacattgccactcgggttgaagagtttgtccgcactgtctggggtgcagatcatctggaagagaacctaaaatttattgccgccagcctatacctagccgcgatcaaaccggtgaaaaaaggaggtgaaacctcccgtgaggctattcgccgctacctctcgactcagttctttaaagatcatttgaagacctacaaaaaacgcccgatttactggctattcagttctggcaaagagaaagcctttgaatgcttggtctatttacatcgctacaatgaaacaactctcccgcgcatgcgcactgagtatgtcacacccctgctcggccaaatggatagccgtattgagcgcctgcgtctgcaacagaatgaagcagaaacagccgaagccaaactcatcggtaaagagatcgatagcctgaccaaacagcttaccgagctgcgttcttttgacgaccagctcaaacactatgctgatatgaagatccagttcgatctcgacgatggtgttaagatcaactacggcaagttcggtactttattagctgaagtgaaagctattactggtgataaagccgagtaa

SEQ ID NO: 2296 - DNA, 1944 bp, Enterobacter cloacae
gtgagccttaatgaacactgccaatttaaaaaaatagcccctcgggctcgtacagcatttatcacagcgatcaaagcacgcgctgctgaatttggaatcactgccaagggccatattgagccggtaattagcggtgaagttttgcaagttgctggatttacccatccagccagttgtgcctctgcccttaagcgcctgcaacaacggcttgcaaacgatagctatgagactttaatagagcatgtcgcatacacttggtttaaccgattctgtgccatccgctttatggagttgaaaagcgaagagggatatttagaacacggtgtacgtctgctatcacacccgtctcagccacagggttttgaagggttggatcgtgcccctgaggtgatcgattcccttataacagaaggtgtggctttggataagcccgctctgttggacttgttgctagcaggtaatgagcaggagactctcttccgtgagctgcttctcggtcaatgtcaccgactgcatcaagcaatgccatttttatttgaagccattgatgatgaaacagagctcctgttgcctacaggtcttacccgtactgatgccttctggcgcgaactggtagatgagatcccagaacttgactggcagcaagtagaggttatcggctggctttaccaattttatattagtgagaaaaaggatcaggtcattggtaaggtggtcaaatccgcagacattcctgccgctactcagctgttcacgcctaactggatagtacaatatctggtgcaaaactcagtgggccgtcactggctgcaaacctatcctgagtccacactcaaaagcgcgatgccctactatatcgatcaaggcgaacaggcttccgaggtagtggcacatctagctgaacttactagcgccagtatcgagcctgaatcaatacgcgtactcgatccagcctgtggatccggccatattctggtggaagcctataatgtgctctatcgaatttatgaagaacgtggttatcggagccgcgagattccggaacttatccttaagaacaacctatttggcctcgatatcgacgaccgcgctgcacagctggcgggttttgctttgctaatgcgtgcccgccaggatgatcgtcgtctgctttctcgtaacaatgattctggtattgacctgaatatttactccctacaggaaagtcgacacctcaacattcagaaactttggcaagcacttaatctcaatgctgatgcgcagcatggccagactcaagatctacttagagtagcccaagatacagatgacccccgtctgacgcttctaaaagacctgcatcagcgttttcttaatgccaaaacactgggctccttaattagtatatctactgagcaagcctcagctattgaggagctctataccacgattcaggaactcagcaaaaatggcgataatatgcaacgacctgagtcgaagaaactattgccgctgttagaacaagcccgcctactagctaagcgctatgatacggttatcgcgaatccaccgtacatgggcagtaaggggatgaatgcggatctgaaagagttcgctaagaagcagttccctaatagcaagtcagatctgtttgccatttttatcgagcgaaatctggatttaaccaaagagtcaggtgtggtagcgatgatcaccatgcaaagctggatgttcctctcttcatacgagtcattgcgtacccgaattttgaatcaacacactatcctgagtatggcccatcttgggacaagaggatttgatagtattggtggagaagtcgtctcaactactgcattcgtattagggaattttcacctttcaagctatcagggcgcttatctccgtttagtggatggcaactcggaagcagaaaaagcagccatgtttaaagccgctattgcttaa

SEQ ID NO: 2297 - DNA, 3672 bp, Erwinia sp.
atgaatactaataacatcaaaaaatacgcgccacaggcccgtaaccagttccgcgatgcggtgatccagaagctgactacgctggggctttccgctgataaaaaaggcaatctgcagattgcggacgccgggatcgtcggcgaaaccgtgcgctatggccagttcgactaccccaaatccaccctcactcgccgtgaccgtctggtcaaacgcgcccgcgagcagggctttgacgtgctggttgaacactgcgcctacacctggtttaaccgcctgtgtgccctccgttatatggaaatccagggttatcttgatcacggcttccgtgtgctctcgcacccggaaaacccatccggctttgaagtgctggatcatgtgccggaagtggcggaaactctgctgccggagaaaaaggcacagctggttgagatgaagctttccggcaaccaggacgaagcgctgtaccgtgaactactgctggcacagtgtcatgccctgcaccgtgcgatgccgttcctgttcgaagcggtggatgatgaagccgagttgctcctaccggataacctgacccgtaccgactccattctgcgcgatttggtagacagcattcctgaagaagactgggaagacgttgaggttatcggctggctgtatcagttctatatctctgagaaaaaaggtgccgttattggcaaggtggtaaagagcgaagatattcctgccgccacccagctgtttaccccgaactggattgtgcagtatctggtgcagaactccgtcggtcgccagtggctacagacctacccggactcgccgctgaaaggcaaaatggactattacattgagccagccgaacagacgccggaagtgcaggcgcagctggccgccattacgcctgccagcattgaaccggaaagcatcagggtgctcgacccggcctgcggctccgggcatattttgattgaagcctataacgtgctgaaaagtatctacgaagagcgcggctatcgcgcccgcgatattccgcagctgattctggaaaataatatttttggtatcgacattgatgaccgtgctgcacaactttccggctttgcattattaatgatggcccgtcaggatgaccgccggatattcacccgcgacgtgcgcctgaatattgtctccctgcagggaagcctgcatctggatattgccagactgtggcaacagctgaattttcatcagcagagccagaccggcagcatgggggatatttttgccgaaaataccgcattgcctcataccgacagtgcggaataccagctgctaatgcataccctgaagcgctttgtgaatgccaaaacgctgggctcactgattcaggtgccgcaggaagaagaagcggaactgaaagcgtttctcgatgagctttatcaccttgagcaggaaggcgatttccagcagaagaccgcagcgaaagcgtttattccgtatattcaacaggcgtggatactggcgcagcggtatgatgcggtggtggcaaatccgccgtatatgggcggcaaagggatgaatcgcgagctgaaagagtttgctaaaaataatttcccggaaagtaaagctgatttgtttgcgatgtttatgcagcatgcattctctttgctgaaagaaaatggatttaatgcccagataaatatgcaagcctggatgttcctgtctagctacgaatcgctgcgcggttggttattggataataagatgtttatcacaatggcccatttaggggcgcgggcatttgggcaaatttctggagaggtggttcaaacaacagcatgggtgattaaaaatcatcgcaatgaaaaataccaaccagttttcttcagactaatcggcggcacagaagctgaaaagaaaaatgaccttcttttgcacaagaatattttcaatagattcaagcaaaatacttttaaaaaaataccaggttcaccgattgcctattggatagatacttccagcctactctcatttagtgttaataaaaaacttggtgaaaaaatatctttaaaagctggaatgtcaaccggagacaataccagattccagcgatattggtttgaaatttccttggacaaatcatccattaataaaaattataatggaaagccatcaacatataaatggattccatgcagtagtggtggggaataccgaaaatggtacggtaataatgagttggttgtaaattggatgaatgatggttatgaaataagaaatttcaaatttgagaacggaaaaacccgatcagctgttagaaatgatgaattttactttctcgaaggtataacttggtctaaaataagccaagggaatttttgcgtaagatatcgtccagaaggttttgtttttgatgacacagggcgctgtggattctcaaatgacaaaaacaacctcttatttgcagcaggattaatgtgtacgcccgttataaatcactacttatcaattcttgctcctacacttagttttacaagtggtgaattagcatcagtacccctttccgaattagacgatagaatacccgagctagtcaagagtgctattaacacagccaaaaatgactgggattcatccgaactatcttgggattatgataaatccccattactcaaaaacaatcccccccccttaatgctcaagcaagtctatgagcaaaaggtattaacagataatgaaataactgaactacttacgactattgaaaataacataaacaatatttttattaaaaaaaatggattggataacagcgctgtaaaatcggtatcaaaaaacgaaataacccttttatgtaatccgttttatcgatacaaaaacattacaaattacaccgagcaactaaaaaaatattatacagatttaacaattgattttcttagctactccattggctgccaaatgggccgctactccctcgatcgcgaaggcctcgtctacgcccacgaaggcaataaaggcttcgctgaactggttgccgaaggtgcatacaaaaccttcccggccgacaatgacggtatcctgccgctgatggatgacgagtggtttgatgacgatgttaccgcgcgcgtcaaagagtttgtccgcaccgtctggggcgatgagcacctgcaggaaaacctcgattttatcgccgaaagcctctgtttatacgcgataaaaccgaaaaaaggcgaagctgcgctggataccatccgccgctatctttccacccagttctggaaagatcatatgaagatgtataaaaagcgcccgatctactggctgttcagctccggcaaagagaaagcgtttgagtgcctggtctatctgcatcgctacaacgacgcgacgctggcgagaatgcgtaccgaatatgtcgtcccgctgctggcacgctaccaggccaatatcgatcgcctgaatgaacaggtcgatggtgcctccggcggtgaagccacgcgtctgaagcgtgagcgtgatagcctgagcaaaaaattcaacgaactgcgtagcttcgacgatcgcctgcgccactatgctgatatgagaatcagtattgatctcgacgatggcgttaaggttaactacggtaagtttggcgatctgctggcggatgtaaaagccattaccggcaatgcggccgggatgatttaa

SEQ ID NO: 2298 - DNA, 3852 bp, Erwinia pyrifoliae
atgttgccagtgagatgcgcaaagccgctggcagcgaagtactggaaaccactgagcaggtggaaaaagcgctggatacgcttcgcgcagcgctgctggcagccattgaggcaggtgacaggatccgtcttcagtaaccccatttcagggcagcgctctgctgccctttgcaggatttctatgaatactaataacatcaaaaaatacgcgccacaggcccgtaaccagttacgcgatgcggtgatccagaagctgaccacgctggggatttccgctgataaaaaaggcaatctgcagattgcggacgccgggatcgtcggcgaaaccgtgcgctatggccagttcgactaccccaaatccaccctcacgcgccgtgaccgtctggtcaaacgcgcccgcgagcagggctttgacgtgctggttgaacactgcgcctacacctggtttaaccgcctgtgtgccctccgttatatggaaatccagggttatcttgatcacggcttccgtgtgctctcgcacccggaaaacccatccggctttgaagtgctggatcatgtgccggaagtggcggaaactctgctgccggagaaaaaggcacagctggttgagatgaagctttccggcaaccaggacgaagcgctgtaccgtgaactactgctggcacagtgtcatgccctgcaccgtgcgatgccgttcctgttcgaagcagtggatgacgaagccgagctgcttttaccagataacctgacccgtaccgactccattctgcgcgatttggtagacagcattcctgaagaagactgggaagacgttgaggttatcggctggctgtatcagttctatatctctgagaaaaaaggtgccgttattggcatggtggtaaagagcgaagatattcctgccgccacccagctgtttaccccgaactggattgtgcagtatctggtgcagaactccgtcggtcgccagtggctacagacctacccggactcgccgctgaaaggcaaaatggagtattacattgagccggccgaacagacgccggaagtgcagacgcagctggccgccattacgcctgccagcattgaaccggaaagcatcagggtgctcgacccggcctgcggctccgggcatattttgattgaagcctataacgtgctgaaaaatatctacgaagagcgcggctatcgcgcccgtgatattccgcagctgattctggaaaataatatttttggtctcgacattgacgaccgtgctgcccaactttccggctttgcattattaatgatggcccgtcaggatgaccgccggatattcacccgcgacgtgcgcctgaatattgtctccctgcaagaaagcctgcatctggatattgccagactgtggcaacagctgaattttcatcagcagagccagaccggcagcatgggggatatttttgccgaaaataccgcattgcctcataccgacagtgcggaatacccgctgctaatacgtaccctgaagcgctttgtgaatgccaaaacgctgggctcactgattcaggtgccgcaggaagaagaagctgagctgaaggcgtttctcaatgcgctgtatcgcctggaacaaaaaggggatttccagcagaggtccgcagcgaaagcgtttattccgtatattcaacaggcgtggatactggcacagcggtatgatgcggtggtggctaatccgccgtatatgggcagtaagggaatgaatggtgagctgaaagagtttgccaaagataatttcccggaaagtaaagctgatttgtttgcgatgtttatgcagcatgcattctctttgcttaaagaaaatggatttaatgcccagataaatatgcaagcctggatgttcctgtctagctacgaatcgctgcgcggttggttattggataataagatgtttatcacaatggcccatttaggggcgcgggcatttgggcaaatttctggagaggtggttcaaacaacagcatgggtgattaaaaatcatcgcaatgaaaaataccaaccagttttcttcagactaatcggcggcacagaagctgaaaagaaaaatgaccttcttttgcacaagaatattttcaatagattcaagcaaaatacttttaaaaaaataccaggttcaccgattgcctattggatagatacttccagcctactctcatttagtgttaataaaaaacttggtgaaaaaatatctttaaaagctggaatgtcaaccggagacaataccagattccagcgatattggtttgaaatttccttggacaaatcatccattaataaaaattataatggaaagccatcaacatataaatggattccatgcagtagtggtggggaataccgaaaatggtacggtaataatgagttggttgtaaattggatgaatgatggttacgaaataagaaatttcaaatttgagaacggaaaaacccgatcagctgttagaaatgatgaattttactttctcgaaggtataacttggtctaaaataagccaagggaatttttgcgtaagatatcgtccagaaggttttgtttttgatgacacagggcgctgtggattctcaaatgacaaaaacaacctcttatttgcagcaggattaatgtgtacgcccgttataaatcactacttatcaattcttgctcctacacttagttttacaagtggtgaattagcatcagtacccctttccgaattagacgatagaatacccgagctagtcaagagtgctattaacacagccaaaaatgactgggattcatccgaactatcttgggattatgataaatccccattactcaaaaacaatcccccccccttaatgctcaagcaagtctatgagcaaaaggtattaacagataatgaaataattgaactacttacgactattgaaaataacataaacaatatttttattaaaaaaaatggattggataacagcgctgtaaaatcggtatcaaaaaacgaaataacccttttatgtaatccgttttatcgatacaaaaatattacaaattacaccgagcaactcaaaaaatattatacagatttaacaattgattttattagctactccatcggctgccaaatgggccgctactccctcgatcgcgaaggcctcgtctacgcccacgaaggtaataaaggcttcgccgaacttgtcgctgaaggcgcatacaaaaccttcccagcggacaatgacggtatcctgccattgatggatgacgagtggtttgatgacgacgttaccgcgcgcgtcaaagagtttgtccgcaccgtctggggcgatgagcacctgcaggaaaacctcgattttatcgccgaaagcctctgtttatacgcgataaaaccgaaaaaaggcgaagctgcgctggataccatccgccgctatctttccacccagttctggaaagatcatctgaagatgtataaaaagcgcccgatctactggctgttcagctccggcaaagagaaagcgtttgagtgcctggtctatctgcatcgctacaacgacgccacgctggcgagaatgcgtaccgaatatgtcgtcccgctgctggcacgctaccaggccaatatcgatcgcctgcatgaacaggtcgatggtgcctccggcggtgaagccacgcgtctgaagcgtgagcgtgatagcctgagcaaaaaattcaacgaactgcgtagcttcgacgatcgcctgcgccactatgctgatatgagaatcagtattgatctcgacgatggcgttaaggttaactacggtaagtttggcgatctgctggcggatgtaaaagccattaccggcaatgcggccggggtgatttaa

SEQ ID NO: 2299 - DNA, 3672 bp, Erwinia pyrifoliae
atgaatactaataacatcaaaaaatacgcgccacaggcccgtaaccagttacgcgatgcggtgatccagaagctgaccacgctggggatttccgctgataaaaaaggcaatctgcagattgcggacgccgggatcgtcggcgaaaccgtgcgctatggccagttcgactaccccaaatccaccctcacgcgccgtgaccgtctggtcaaacgcgcccgcgagcagggctttgacgtgctggttgaacactgcgcctacacctggtttaaccgcctgtgtgccctccgttatatggaaatccagggttatcttgatcacggcttccgtgtgctctcgcacccggaaaacccatccggctttgaagtgctggatcatgtgccggaagtggcggaaactctgctgccggagaaaaaggcacagctggttgagatgaagctttccggcaaccaggacgaagcgctgtaccgtgaactactgctggcacagtgtcatgccctgcaccgtgcgatgccgttcctgttcgaagcagtggatgacgaagccgagctgcttttaccagataacctgacccgtaccgactccattctgcgcgatttggtagacagcattcctgaagaagactgggaagacgttgaggttatcggctggctgtatcagttctatatctctgagaaaaaaggtgccgttattggcatggtggtaaagagcgaagatattcctgccgccacccagctgtttaccccgaactggattgtgcagtatctggtgcagaactccgtcggtcgccagtggctacagacctacccggactcgccgctgaaaggcaaaatggagtattacattgagccggccgaacagacgccggaagtgcagacgcagctggccgccattacgcctgccagcattgaaccggaaagcatcagggtgctcgacccggcctgcggctccgggcatattttgattgaagcctataacgtgctgaaaaatatctacgaagagcgcggctatcgcgcccgtgatattccgcagctgattctggaaaataatatttttggtctcgacattgacgaccgtgctgcccaactttccggctttgcattattaatgatggcccgtcaggatgaccgccggatattcacccgcgacgtgcgcctgaatattgtctccctgcaagaaagcctgcatctggatattgccagactgtggcaacagctgaattttcatcagcagagccagaccggcagcatgggggatatttttgccgaaaataccgcattgcctcataccgacagtgcggaatacccgctgctaatacgtaccctgaagcgctttgtgaatgccaaaacgctgggctcactgattcaggtgccgcaggaagaagaagctgagctgaaggcgtttctcaatgcgctgtatcgcctggaacaaaaaggggatttccagcagaggtccgcagcgaaagcgtttattccgtatattcaacaggcgtggatactggcacagcggtatgatgcggtggtggctaatccgccgtatatgggcagtaagggaatgaatggtgagctgaaagagtttgccaaagataatttcccggaaagtaaagctgatttgtttgcgatgtttatgcagcatgcattctctttgcttaaagaaaatggatttaatgcccagataaatatgcaagcctggatgttcctgtctagctacgaatcgctgcgcggttggttattggataataagatgtttatcacaatggcccatttaggggcgcgggcatttgggcaaatttctggagaggtggttcaaacaacagcatgggtgattaaaaatcatcgcaatgaaaaataccaaccagttttcttcagactaatcggcggcacagaagctgaaaagaaaaatgaccttcttttgcacaagaatattttcaatagattcaagcaaaatacttttaaaaaaataccaggttcaccgattgcctattggatagatacttccagcctactctcatttagtgttaataaaaaacttggtgaaaaaatatctttaaaagctggaatgtcaaccggagacaataccagattccagcgatattggtttgaaatttccttggacaaatcatccattaataaaaattataatggaaagccatcaacatataaatggattccatgcagtagtggtggggaataccgaaaatggtacggtaataatgagttggttgtaaattggatgaatgatggttacgaaataagaaatttcaaatttgagaacggaaaaacccgatcagctgttagaaatgatgaattttactttctcgaaggtataacttggtctaaaataagccaagggaatttttgcgtaagatatcgtccagaaggttttgtttttgatgacacagggcgctgtggattctcaaatgacaaaaacaacctcttatttgcagcaggattaatgtgtacgcccgttataaatcactacttatcaattcttgctcctacacttagttttacaagtggtgaattagcatcagtacccctttccgaattagacgatagaatacccgagctagtcaagagtgctattaacacagccaaaaatgactgggattcatccgaactatcttgggattatgataaatccccattactcaaaaacaatcccccccccttaatgctcaagcaagtctatgagcaaaaggtattaacagataatgaaataattgaactacttacgactattgaaaataacataaacaatatttttattaaaaaaaatggattggataacagcgctgtaaaatcggtatcaaaaaacgaaataacccttttatgtaatccgttttatcgatacaaaaatattacaaattacaccgagcaactcaaaaaatattatacagatttaacaattgattttattagctactccatcggctgccaaatgggccgctactccctcgatcgcgaaggcctcgtctacgcccacgaaggtaataaaggcttcgccgaacttgtcgctgaaggcgcatacaaaaccttcccagcggacaatgacggtatcctgccattgatggatgacgagtggtttgatgacgacgttaccgcgcgcgtcaaagagtttgtccgcaccgtctggggcgatgagcacctgcaggaaaacctcgattttatcgccgaaagcctctgtttatacgcgataaaaccgaaaaaaggcgaagctgcgctggataccatccgccgctatctttccacccagttctggaaagatcatctgaagatgtataaaaagcgcccgatctactggctgttcagctccggcaaagagaaagcgtttgagtgcctggtctatctgcatcgctacaacgacgccacgctggcgagaatgcgtaccgaatatgtcgtcccgctgctggcacgctaccaggccaatatcgatcgcctgcatgaacaggtcgatggtgcctccggcggtgaagccacgcgtctgaagcgtgagcgtgatagcctgagcaaaaaattcaacgaactgcgtagcttcgacgatcgcctgcgccactatgctgatatgagaatcagtattgatctcgacgatggcgttaaggttaactacggtaagtttggcgatctgctggcggatgtaaaagccattaccggcaatgcggccggggtgatttaa

SEQ ID NO: 2300 - DNA, 3495 bp, Erythrobacter litoralis
atggataccacaaagctcaggaaatttgctcaatttgcgcggagtaccttgattgatcaagttaccgtaaggctggaagccgtcttgagcgacggctcgtcggctcggcgtgaatacccaagggccttcaagaagcttgagacattagttggcaaactcggacgagagcaagttgtcgaaaaggtcgcctacacctggttcaatcgcttcactgctttgaggtacatggatgtcaacggtctctccccggttcgcgttgtgtctccgtccgtcggtcaatttcaaccggaaatactctcggatgcgaagtcggggagtatcaatgagcaaatcgtccccgaaatcactcgagatgaagtcctcagtctactggatggtcgcacctccagccccgacccacagggtgaggcttaccgactgcttgtcgttgccgcgtgcaactactggcacgacgctatgccttttatgttcgagcgcatcgacgattacgccgagcttctaatgccttcggacctccagtccaacgcttcgatactcgcataccttcgtgaggcaatgacacctgacgtttgtgaagacgtcgagatcatcggctggctctaccagttttatatctcagagaagaaggatcaggtcttcgcgggcctcaagaagaaccagaagatcacggcggagaacattccggccgcaacgcagctcttcaccccgcattggatcgttcgctatctggtcgagaactcgctggggcggctctggctgctcaacaatccgcacagcgggctggcggccaagatggactactacatcgcgcctgaagaacccgaaacggatttcctgcgcatcaccaagcctgaggagatccgcatctgcgatcccgccgcaggctcggggcatatgctgacctatgccttcgacctgctctacgcgatctacgaggaagagggatacgacccgaccgagatccccgcattgatcctatcgcataacctgaccggcgtggagattgacgaccgtgcaggcgcgctggcggcctttgcgctggcgatgaaggcggcggcgcggctgggacggcggcggtttttgcggatggaagctaagccagacatctgcgtgttgcagaacgtagcctttaaagaggccgagttgcaggacgtgaccgccgtggtgggcaaggatctgttcaccgatgagttgcgcgagacgttgaggcagtttgagcaggccaagaacttcggctctctgatcttgccgagactacgcgacccggccgaggcactaagggtggtcaatgcgcgggattttgacggagatttgttgctgaaagaggtgcagcagcgcgtcatcgccgtcctgcgcatggccgaggcgctttcgccgcagtatcatgtggtggtggccaacccgccttacatgggttcagggggcatgaacccagaaatgaccagcttcgcgcgtgtgaacttcccagacagtcgcagcgatttgtatgcaatgttcaccgagcgctgcctatctcttaatgtcgtttacggcatgtctgcgcttgtcaccattcaaaactggatgttcatttcttcctttgagaagctgcgcgacaagttaatttcacggtaccacatttcagatttgctgcaaatcgggttcaatagtttccctgagttgaactcaaaagtcgtacaggctgtcgcattcgtgataaagaatggaaaatcaaaatacccagggcgatatattaatctgaacgacgccgctcagtcagccaacaaaagagaaatactcgaactaaagttgaaagagaacgatgtatttctgacggaagacgaaaagttctcatctatcccagggtcacctatcggttactggctctcggactcggtgttcaaggtttttgaaaatctaccttcgcttgcaagcgttgctccgacaaaacagggccttgctaccggcgacaacgaacagtttcttcggcagtggtacgaagtcagctcttctgaaattggacaggggacactttcgtcaaaagagacggaggatcggccagagcgctggtatccctgcaacaagggtggggaattcagaaaatggttcggaaacaacgccattgttgttgactggcaacattcaggaaaacgtataaaatccttcaaggacaacaatggaaagcttcggtccagacctcagaatgagaatttctattttaaacccgggataacatggtcggcaatctcaagtggcgggctttcgatgcggttatctccattgggttccatgttcgaaacgaaaggcgcaatgtcctttccggaagaagagaacattttcccggctttgtccttcgccaacaccaaagtcgtaaaccgcttgctgctggctctatcaccaacgttggatttccatgaaggcccaattggtcggttgccttatttgcgcgtctctggcgcagcggacattggacgacgttgttccgaactggctcgctccgactgggacgccttcgaaacctcgtgggattttaccacgcttccgctgctctcacccgatcatcggggcgagaggctggcgagcagctacgccacgctccgcgcccattggcagtccatgacggacgagatgaaagcgctggaggaagagaacaaccgcatcttcatcaacgcctatggtctgcaagacgagctgacccccgaggtgccgatcgaggagatcaccctcacctgcaaccccgcctatcgctatgccgttaagagctccgaggaggaccgcgaaacccgcctgcgcgccgagaccatggccgagttcttgcattatgccgtgggctgcatgttcggccgctacagcctcgaagaaccgggcctgattctcgccaatcaaggcgagacactggccgactacctcgaccgcgtgcctgaccccagcttcatgccggacgaagacaacgtcatccctgtgctagacgaaaactggttccccgacgacatcaccgaacgcttccgcctgttcctgcgcgcgaccttcggcgagcagcatttccgcgagaacctgaagttcatcgaggacagccttggcaaggacatccgcaagtatttcactaaggatttttacgccgaccacgtgaagcgctacaagaagcgcccgatctactggatggtctcctcccccaaaggcactttcaacgtgctgatctacatgcaccgttatcggggcgatacggtgtcagtcatcctcaacgattacctgcgcgagtttatcaccaagctagagggagagcgcacacggctggagaagctctccgacgatcctgccgctagccaaggccagaagaccaaagcgctgaaggatgcggccaaagtcgccaagcagatcgatgagctgaacgaatgggaacgcgacgtgatcttcccacttgcgcagcgcaagatcgagatcgatctcgatgacggggtaaaagcaaactatccgaagttcggttctgccttgaagaagatcgctgggttgagctga

SEQ ID NO: 2301 - DNA, 3615 bp, Escherichia coli
atgaataccaataacatcaaaaaatatgccccacaggcccgtaacgacttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgggagcagggttttgaggtgctggttgagcactgcgcctacacctggtttaaccgcttatgtgcgatacgctatatggagctgcacggttatcttgatcacggcttccgtatgttatcccacccggaaaccccggccgcgtttgaggtgctggatcatgtgccggaagtggcagaagctctgctgccggaaaataaagcgcagctggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccaaactggattgtgcagtatctggtacagaactccgttggccgccagtggttgcagacctacccggactcaccgctgaaagacaaaatggagtactacattgagcctgcggagcaaacgccggaagtgcaggcgcagctggcggcgattaccccggccagcattgaacccgaaagtattaaagtgctcgacccggcctgcggctccggtcatattttgattgaagcctataatgtgctgaaaaatatctacgaagagcgtggttatcgcgggcgtgatattccacaactgattctggaaaataatatttttggtcttgatatcgacgaccgggcagcacagctttccggttttgcattattaatgatggcgcgtcaggatgaccgcagaatatttacccgcgatgtacgtctgaatattgtctctttgcaggaaagcctgcatctggatatcgccaaactctggcagcaactcaatttccaccagcagatacaaaccggcagtatgggggatatgtttgctgaaaataacgcgttaacacaaaccgacagcgcagaatatcagctgctgctgcgcacgctgaaacgctttgtgaatgccaaaacgctgggttcactgattcaggtaccgcaggaagaagaagcggaactgaaggtattcctggatgcgctgtatcgcctggaacaggaaggcgatttccagcagaaggccgcagcgaaagcgtttattccgtttattcagcaggcgtggattctggcgcagcgatatgatgcggtggtggcgaatccgccgtatatgggcggcaagggaatgaatagtgagctgaaagagtttgccaaaaataatttcccggatagtaaagctgatttgtttgcaatgtttatgcagcatgcattttctttacttaaagaaaatgggtttaatgcacaaataaatatgcaatcttggatgtttttatccagttttgaggtgctacgtgaatggctgatcgaaaacaaaacgtttgttaacatgattcacctcggatctcgagcatttgcggagatttcaggcgaagtcgtacaaacaactgcatgggtaatgaacaattatgagatcaataaatatcaacctatatttttcaggttaattgaaggtaacgaatctcaaaaaaataaaactttaaaaaaacgtgaaagtaactataaagacatcactgttgatgatatgaaaaacatacccggagcaccaatcacgtattggttaaagggcatacataacttcaagcgagctaagctagctcattatttcttatcgggtggaagaaataaaactcataacaacgatctttacgttagatacttctgggaagtttctttgaaagaaaaaaaatgggttacctatgcaaatggtggagagtccagaaaatattatggaaatgatcaatatgtaattaactggagtgatgaagcgaagctttactatgactcgcatggtggcctttccaattctaagttttggaataaattaggtataacatggtcccttattggcacaaaaagtatttcatttcgtattaaaccaaaacatctccaatacagttcgggatcacctgttattttttgcgaggatttaaatcaaacatatgttactctggcatttttaaactccactgttggtcaatattatctttcagcaatcagccctactattaacactacagtaaatgatgttttatcgttaccagttcctgaactagactgcatgcatagtgataaaataatttcactgactgaaagttatataaatattagctcagatgactggaattctttggagacatcacctgaattcaaaaaaaacagtttagctttcaatattgcaaaacaaaaaaaaataaaaaaatcatgtttgtatttgcaggagaaaaacaacgccaccttgataaaagctcaggaaattgaaaatgaaattaataaaatattcattagaaattataatctagatgaatactctgaaatcgtaaaagaccgtgacgatataactttatatataaatttaaaacacctttatggtagcgatatctcagataacatacgtcaaaatagatatttttccgatcagttatctgagatgatgtcatattccatcggctgcatgatgggccgctactccctcgatcgcgaaggccttgtctacgcccatgaaggcaacaaaggtttctccgaactcgtcgccgaaggtgcctacaaaaccttcccagctgacagcgacggcatcctgccgctgatggatgacgaatggtttgacgacgacgtcacctctcgcgtcaaagagtttgtccgcaccgtctggggtgaagaacacctgcaggaaaacctcgaatttatcgccgaaagtctctgtttatacgcgatcaagccgaaaaaaggcgaatctgcgctggagaccattcgccgctatctttccacccagttctggaaagatcatctgaagatgtataaaaagcgtccaatctactggctgtttagctccggtaaagagaaagccttcgagtgcctggtgtatctgcatcgctataacgatgccacgctgtcgagaatgcgtaccgaatatgttgtaccgctgctggcgcgttatcaggccaatatcgatcgcctgaacgatcaacttgatgaggcgtctggcggtgaagccacacgtctgaaacgcgaacgcgacagcctgatcaaaaaattcagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2302 - DNA, 3615 bp, Escherichia coli; identical to SEQ ID NO: 2301

SEQ ID NO: 2303 - DNA, 1209 bp, Escherichia coli
atgaacagtaactatatgccattcacacaacgagatagtctcggaagatactatacaaaagaatccataagtgcattattggtttctcagatgaaagctgaaaaagtcaataatattattgatttagcttctggtgaggggagcttaacctatgctgctttagaccgatggaagaatgcagaagcatattctttggatatagaatctcggatgtcaaaaaaagtatgtgataatcttactcatattgtaacagatgcccttgttcattcatttcctgaaatgcttgcccgacatcaaggaaattttgatgttgcagtatgtaatcctccattcactctccctgaatggagggatgattattttaaaatcattagtgagattggcgcagataaatatatatctgtctcaaaatatgtcccagcagagataatatttatatctcaagtcatcaggtttcttaaaaagggcggtgaggctggaataattttacctgatggtatatttacagcaagaaagtttataggtttaagacgatatttattgaatgaacattcaattacaaaagtcattgaattgcctaggaatatcttcaaaaggacagaggctaaaacacatattttaatttttaataaaaaaattatgcctcatcataaaatacaattacattgtataactaaagatggggaattgtcgcctcctgttttaattagaaaagaagatgcggttgagagaatggactactcttatcattataataaaaatgaaggtaaagggtttagcacaatagggatgcttaaaaatatttcaatttttagaggtaggtttaattcaaaggaaattacggaacatgtttttcatacgacaaaatttagtggtgatgaaaagtacattaaattccactgcaactctgtagaagaattgaagccatcaaaattagatgtcattgctaagcctggtgatatattaatagcaagagttgggcgaaattttcataaaaaaatattgtttgttgagagcggctattcttatatcagtgactgtatttttctgatacgagcctctggtggagataagaaaaaactatttgattttctttgttctcaagatgggcaagaggaattatctcgagcgagtagtggtgtagccgcacaacatattacaatggatgcattaaaaaaaatacatcttgtaaggattaaacatgactga

SEQ ID NO: 2304 - DNA, 3618 bp, Escherichia coli
atgaataccaataacattaaaaaatatgccccacaggcccgtaacgacttccgcgatgcggtgatccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagactccgaccgcgtttgaggtgctggatcatgtgccggaagtggcagaagctctgctaccagaaagtaaggcgcagttggttgaaatgaagctttccggtaatcaggacgaagctctgtaccgtgaactgctgctggggcagtgccacgccctgcaccacgcgatgccgttcctgtttgaagcggtagatgacgaagcggaactgctgctgccggataacctgacccgtactgactccattctacgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccgaactggattgtgcagtatctggtacagaactccgttggccgccagtggttgcagacctacccggactcaccgctgaaagacaaaatggagtactacattgagcctgcggagcaaacgccggaagtgcaggcgcagctggcggcgattaccccggccagcattgagcctgaaagcattaaagtgctggatccggcctgcggttccgggcatatcctgacagaagcctataacgtgctgaaggccatttacgaagagcgcggttaccgtacccgtgacattccgcagctgattctggaaaacaatattttcggcctggacatcgatgatcgtgcggcgcagctttccggatttgcgatgctgatgctggcacgccaggatgaccgtcgtattctgggccgtggtgtgaggctgaatattgtctccctacaggaaagtaagctggatattgctgaggtttggaccaagctgaacttccatcagcatatgcaacgcggcagcatgggagatatgtttacccaagggacggcactggccaataccgacagcgcggaatataagctactgatgcgtactctggcattgttcactagtgcaaaaacgctgggatcactgattcaggtaccgcaggaagacgaagcggcgttgaaagcgtttctggagagattgtatcgtctggctgttgaaggtgatattcagcagaaagaggctgcggcagagctgatcccatatattcagcaggcgtggatactggcgcaacgttatgatgctgtggtcgcgaacccgccgtatatgggggggaaagggatgaatggtgatctgaaagagtttgctaaaaaacaattcccggacagcaagtcggatttgtttgcgatgtttatgcaacatgcattttctttactcaaagaaaacggttttaatgcgcaagtgaatatgcagtcatggatgttcctgtctagctatgaagcgcttcgtggatggttgctggataataaaacctttattacgatggcacatttgggggctcgagcatttggtcaaatctctggagaagttgttcaaactaccgcatgggtgattaaaaataaccattcaggattttataaacctgtatttttccgtttagttgacgataatgaagaacataaaaaaaacaatctcttgaatcggatgaattgctttaaaaacactctgcagaatgactttaaaaaaatacctggttcacccattgcttactgggcaacattggcgtttattaattcctttcttaaattgcctgctcttggaactcgtgctgtgaaaggactagatacaaacgggtccattgatgtatttttgcgcagatggccggaagtcagcataaattcctttgatgcattagggaaaggtaactcaaaatggtttccgattgcaaaagggggtgagttgaggaagtggttcggaaatcatgagtatatcataaactatgaaaatgatggcattgaattaagaaaaaacaaagcaaacttgagaaataaggatatgtactttcaggaggggggaacctggactgttgtatcaaccaccggtttctcaatgagatatatgccaaaaggattcctttttgaccaaggcggttctgctgttttttgtgaaaataatgatgagctatcgatatataacatcctggcctgcatgaactctaaatatatcaactactctgcaagtttaatttgtcctacgcttaactttacaaccggtgatgttaggaaattccctgttataaaaaacaatcaccttgaagatttagcaaaaaaagcaattgagatatcaaaagcagactggaaccaattcgagacatcttgggagttcagtaaaaacaagttaattgaacacaaaggaaacgttgcttattcgtatgctagctattgtaactttcaagataaactgtatgaacagctagttaatattgaaaaaaatattaataacataatcgaagaaatactgggttttaaaatagaaacaacagagaatagtgagttaattacattaaactcgaacaaaatatatcgttatgggcaaagtgaaaccaatgatacattcctaaacaggcatcggagtgacaccatttcggaactcatctcatattcagtcggctgccaaatgggacgctattccctcgatcgcgaaggcctcgtctacgcccatgaaggcaacaaaggctttgccgaacttgccgctgaaggtgcgtacaaaaccttcccggcagacaatgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctctgtttatacgcgatcaagccgaaaaaaggcgaatctgcgctggagaccattcgtcgctatctttccacacagttctggaaagatcatatgaagatgtataaaaagcgcccaatctactggctattcagctccggtaaagagaaagccttcgagtgcctggtgtatctgcatcgctataacgacgccacgctgtcgagaatgcgtaccgaatatgtggtgccgctgctggcacgttatcaggccaatatcgatcgcctgaacgatcaacttgatgaagcttctggcggtgaagccacacgcctgaaacgcgaacgcgacagcctgatcaaaaaatttagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggcgatctaa

SEQ ID NO: 2305 - DNA, 3675 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgtgagctgggttttgaggtgctggttgagcactgcgcctacacctggtttaaccgcttatgtgcaattcgctatatggagctgcacggttatcttgatcacggcttccgtatgttgtctcacccggagacgccggccgcgtttgaggtgctggatcatgtgccggaagtggcagaagccctgctaccagaaagtaaggcgcagttggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccgaactggattgtgcagtatctggtacagaactccgttggtcgccagtggttgcaaacctaccccgactcgccgctgaaagacaaaatggagtactacattgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgcattattaatgatggcacgtcaggatgaccgcagaatatttacccgcgatgtacgtctgaatattgtctctttgcaggaaagcctgcatctggatatcgccaaactctggcagcagctcaatttccaccagcaggtgcaaaccggcagtatgggggatatgtttgctgaaaataccgcgttaacccaaactgacagcgcagaatatcagctgctgatgcgcacgttgaaacgctttgtgaatgcaaaaacgctgggctcactgattcaggtaccgcaggaagaagaagcggaactgaaggtatttctggacgcgctgtatcgcctggaacagaaaggcgacttccaacagaaagcggcagcgaaggcgtttattccgtttattcagcaagcgtggattctggcgcagcgatatgatgcggtggtggcaaatccgccgtatatgggcggcaaagggatgaatggcgagctgaaagagtttgccaaaaataatttcccggatagtaaagctgatttgtttgcaatgtttatgcagcatgcattttctttacttaaagaaaatgggtttaatgcacaagtcaatatgcaatcatggatgttcttgtcgagctacgaagcgcttcgcggttggttattaaataataaaacatttatcacaatggctcatttaggagctcgagcttttgggcaaatttcaggtgaggttgtacagacaactgtatgggtagttaataataaccatactgagttttaccgccccgtatttttccgcttaatcaatgggagtgaagaggaaaaaaaaagtgcactaatttcgcgcaaaaatatgtttaatcacaccttacaaaacgacttcaaaaaaatccctggagagccaattgcttattgggtaagtgatatatatagggatattttcacccagtcaccagctctctcctcaatagctaaaccaaggcaagggcttgcaacttcagataataatagatttttgaagctatggtatgaaccatcattaagaaaaattaacttttccgcaaaagatcgtgccgacgcattaaattctcaggcaaaatggtttccttgccaaaaaggtgggagttatagaaaatggtttggtaatcatgagtatcttgtaaactgggaaaatgatggccgtgaacttcttgattttgcagcaagcctgtatggttctccaaccagaacaataaaaaatatccctttttattttagagaaggtgcaacttggtcgacaatttcgtctagtgatttttcaattagatatagcccaactggttttatatcagaaaccaaaggtgctgtttgttttgctgatgataaagatattttattatcgatcctaggattcggtaattctaaattagttaattattttttgaaatcattatcaccaacgcttgattaccacgaaggtccgataggtaaacttccttttaaaggaaagcttaaggctcaagttttagaaaatgttgtaaatttaatcgctatttcagaggaagactggaatactgaggaaacatcttgggggtttaaaaaacaccctatcacaaaattagacaacctgaattatttgcaggctagttttgaagcttttaaaaatgatgtacaagaaactataattagaacccaacagcttgaagagttcaataacaaggaaataattagagaatatggactagaatcagagctaaactataaagtttctttagaagaaataacattaacggtaaatcctgattataagtattctggaaccacggatgataaatcaaaaaggatgcagtcagacagtctttcctccctactatcctatgccatcggctgcatgatgggccgctactccctcgatcgcgaaggccttgtctacgcccatgaaggtaacaaaggcttcgccgatctcgtcgccgaaggtgcctacaaaaccttcccggccgacagtgacggtatcctgccgctgatggatgacgagtggtttgacgacgacgtcacctctcgcgtcaaagagtttgtccgcaccgtctggggcgaagagcacctgcaggaaaacctcgaatttatcgccgaaagtctctgtttatacgcgatcaagccaaaaaaaggcgaatctgcgctggagaccattcgccgctatctttccacccagttctggaaagatcatctgaaaatgtacaaaaagcgccctatctactggctgtttagctccggtaaagagaaagccttcgagtgcctggtgtatctgcatcgctataacgacgccacgctgtcgagaatgcgtaccgaatatgtggtgccgctgctggcgcgttatcaggccaatatcgatcgcctgaacgatcaacttgatgaggcttcaggcggtgaagctactcgcctgaaacgcgaacgcgatagcctgatcaaaaaattcagcgaactgcgcagctatgacgaccgcctgcgtcactatgctgatatgagaatcagtattgatctcgacgatggcgttaaggttaactacggcaagtttggcgatctgctggcagatgttaaagccatcaccggcaatgccccagaggtgatctaa

SEQ ID NO: 2306 - DNA, 3654 bp, Escherichia fergusonii
atgaatacgaacaacatgaaaaaatacgcaccaaaagcgcgccgcgaatttatggatgcggtagctaaacgattaaatacctttggtatcaccgcgaataaaaagggcgagctacaaattgcagaagcgaatctacaaggttctgtgcttcaaatcgccggtaacagttttgacggtaaactggccgagcccagaaaacgcatagtagccagaagccagaaactggggtatgcacaacttattgaacaagtagcttatacctggttcaaccgtctgtgtgctattcgctatatggaaatccatgactatctaggccacggttttcgtgttttgtcgcacccagacaaccctaaaggctttgaaattatcgaccatgcccaagacgctgcggatgaactcggattagatagagctcgcattgttgaactcaagcttgcgggcaacaaagacgaagagctgtatcgtgaactgctgttaggccagtgccataagcttcatgaggcgatgcctttcttatttgacgcattggacgatgaaactgagcttcttctaccagacaacctaacgcgtaccgactcaattctgcgtggattggtagacggcatccctgaagaggactggcaacaggtagaagtgattggttggctttaccaattctacatctctgaaaagaaagatcaggtaatgggtaaggtggtcaagagtgaagacatccctgccgccacccagctatttacacccaactggattgtgaagtacctagtacaaaactcagtcggtcgtcaatggctgcaaacctacccagactctgccattaaaacgcagatggaatactacattgagcctgctgaacaatctgacgaagttaaccaacagctaaaggctattacgccagaatctattgaacctgaaaccatcaaagtacttgaccctgcttgtggttcgggccacatattgattgaagcctataacgtgttaaaagccatctacgaagagcgtggtttccgctctcgtgacattccaaagatgattctggagaataacctctacggcctggacatagatgatcgtgcagcgcagctatctggctttgcgctgatgatgatggccagagatgacgataagcgtatttttacccgtaacgtgcgacttaatgtactgtcattgcaggaaagtaaccatcttgacctgccgaccttatggaaagcactcaatctatcgggaagttggcaaagcggcacatcacaaggcttgttctcagatgatgatcaagatttaagctcgttcaatgcagacaaccgctaccaactgctgaagcgaacgttggcaagatttactcaggccaaaacctttggttctttgattgatgtacctagcgatgaccatgaacagctaaaagaaatacttagcactctagtcgagctacaagagtcaggcgactcaatgcagaagcctgcggcgaagcagttgattgaatttgttcatcaggcattggtactgtcgattcgttacgatgctgttattgcgaatcccccttatatgggaagcaaataccaaacggctgaagttaagatgtttttaaaagataactttaaaggttatgaaaaggatttattttcagcctatatagttcgaaatctacaacttgctaaagagcatggccagcttgggtttatgacgccttttgtatggatgtttatttcaagctacgaacaactaagaagcactttaattgatgatgaaattatctcaacgctaatccagttagagtattccggttttgacggcgcaacagtgcctatttgtacctttacactaactaaaggtcatattcctgaatatatcggttcatatatacgattgtcggattttaaaggtgctgcaaaccaagcacctaaaacgctccaagcaataaaaaatcccgaatgtggctggttttacaaggctaagtcagatgatttcaaaaagatccccggaagcccaattgcttattgggcgtctagcttacaattctcaatgttcgattcacacccgttgcttacaagcatcgctaatgttgctgaagggactactactggtgatgtaaatagattcctaaagatgtggcatgaaatagatgtcaatggcttaggtataggttttgatagtcgagaaagagcaaaggattctggaaagaaatggtttccatacaataaaggaggggaatatagaaaatggtttggaaacaacgattatgttgttaattgggctgaagacggtaaagaattaagacaatatcaaggttcctttttacgtggtgaaaaattctattttaaagcaggtttaacttggtcaaaggtttcaagtgggatcttaagctttcgcctttttgatgaaggttttttgtttgataccggaggcttatgtgcgttctctgacaacattgagtacattgcagcaatattgaactcaaaagtatcactggatattatgagtattcttgctccgactctaaattttacagttggaactgtatctagtttacctatagtagaaggtattccgagactaactgaaaatgccaatagactaaaaagactttccaagtcagattgggatagttatgaaacatcatgggattttactaaacacccgctgttgtcacatacatcactattgataaaggattcatatagccgcttattgctcgaaaatagtcaatctctcaaagagtatagagaaattgaagagtacaacaataaggttatcgctgaggcttatggaataacatcagacgctttaacaattgctgatcatgagattacattgttttcttctttcggttataggtatggtcccgatcgcgctgttaacggtgaatttttgtatagatctgatgtcgtcgctgaacttattagctactcaataggagcgatgttagggcgatattctattgatagtaaaggagtagtctatgcccacacagcaaacgagggctttgaacagcttgttgccgaaggagcttacaaaacattcccagccgatgaagatggaatcattccgttaacagatcaagagtggttcaaagacgatgctaccaaccggttccgtgagtttgttcaagttgtttggggtgatgatcatctgcaagaaaacttggatttcgtcgccgaatcactatgtctcaacgccattaaaccgaaaaaatctgaatcagctctggagacgattcgccgttatttatcgactcagttctataaagaccacctgaagacttataaaaaacgccctatttattggctgtttagctcaggcaaacagaaggcttttgagtgcctggtgtatttgcatcgctacaacgagggcacgctttcgcgtatgcgtaccgagtatgtcaccccgctactaggcaaatacgatgcttatgcagagcaacttgagaagcagattgaaacggccgactcgaccagtgaagcaaaccgcttcaagaaagagttggatgccttaatcaagaaacaggtcgaactacgagagtttgatgacaagctaaaacactatgccgatatgcgtatttcactggatctggatgatggcgtgaaagtgaattacggcaagtttggtgatctgttggctgatgttaaggccattaccggttcggccccggaggttaactaa

SEQ ID NO: 2307 - DNA, 3525 bp, Exiguobacterium sibiricum
ttgaataaatcggcattaaaaaaatttgcaattgaagcaagaagagaattacttgaaaaagtagaacttcaagctagaaaactgggtattactgcggagtcaattcaaaaagtaagtgtagaaagttcagacgctgtctttatcgaaggtagacagctttcagatacagaaagaaagcaaagaaacaaacttattgctcgaatcaatgatataggctttgaccgtgtgatgggtgaaacagcatacacatggttcaatcgttttgttgcattgcgttatatggaagtaaatgaataccttccaacaaaagtccgtgtgctttcttccaattcagatagcgcagaacccgacatgatgaaagaagcattgtctttaaatttaaatttggataaagactatgtgtatgacttaaaactgaataataaaacagatgagttatttaaatacttgatcaaaatgcattgcaatgacttgaatcgctatatgccatttatgttcgagacgattgaagattattctgaaattcttttccctgaaggattacttggaacagattcattcattagtcaaatgataaatttagaatttataccagaagagaattggaaacaaacagaggtcattgggtggctgtaccaatactatattgcagaagaaaaagatcgagttttcaaagctaaaaataagtataaagcagaagaaatcccttttgcgacacaactgtttacacccgattggattgttcaatatatggtgcaaaattcactcggacgttattggacagaagctcatcctgaacataactacttaatagcgaattgggagtttttcttgaaacatgaacaagaagatttccaagaaaaaattgctccgtatgtaaataaagaattaaacgtagaagaaattaaatgtttcgatccagcaatgggcagtgggcatattctgttgtacatgtttgatgtgttatatgagatttatagtaagtgcggttacacagaacgagaaatcccaagactaatccttgaaaacaatttgtatgggttagatattgatgatcgtgcttatcaattagcaagtttttcaatggttatgaaagcattacaatacaatagacgcttcctaagaagtattgaaaaagaaggacttatattaaacttagcagctatacaggaaacgaatagctggagtgacgatgtcatttcttatgtggctggagacgataaagagacgaggatttcctcaactaaagcattttttgaagaatataaaaatgccaaaacctttggttcgcttattcaagcgaaagaaactgatttgacgtatttagaaaagagactacaagaaatcaaagaaaatccgatagcagatatctttgagactaaaaagcgtgatcaagtaataactgcactaccacttctgattaagcaaacgaaaattatgagtaaacaatacgatatcgttgttatgaatccaccatatatggggtcaggtagtatgaacaaagaattatcagactttcttataaaaaactatcctgattcaaaagcagatttatttgctgcttttatggaagtagatcattacttaaaacagaatgcgttttatgctgcgattaatcaacaatcttggatgtttttgtccagctacgagaaactacgagaaaaagtcattaaaagaaaatccatcgacacaatgttacatttaggaccaagagcatttgaggaaatcggtggagaagttgttcaatcgacagcatttgtactaagaaatactgaaatacgagattataaaggtacgtatttaagattaattggaaatagagcagcggatgagaaaagagacaaagtgattggagctgttcaaaattcttctatagcatatcgctattctttcagccaagagaactttagaaaaatcccgggaagtcccattgcatattgggtgggaaataaaatagcggaaagttttgttcaaaatactttgcttggagaaatagctaatccgagaataggtctggttacgggtgatacaggtagatttcttaggatgtggtttgaagttgcggatgagaaaataaattttggagcaagtagctcattagatgcaaaaaaatcaaaaagaaaatggtttccgtatcaaaagggcggaacgtatagaaaatggtatggtaacaatgaatatattgttaattgggagaatgatgggcatgaaataatacacgataactctgttaatggaagagtgaagtcgcataattataatggtatgtatgctttcaatgaagcaattacttggacaaagattacctcaggagcacctgcatttagatttgtaccgtttggatatctttttgatgatgccggacctttatgttcggtaaataataagttaaacttttttcctatattggcattgttaaattcggtagttggagaattttatctttctttaacaaatcaaacaatgaatatactcccagggagtataataaagactcctttttataaagaagtaatggagaagcacaatattattgaaaaattagttacaaatagcatagctatttccaaacgaaattgggactgttatgaaacttcctgggattataaaaaacatccgttgatagaatatgatactaaatcatttagattatcatttgagcagtgggagcggattgcagaaactgaatttaatcaattaaagttaaatgaagaagaaattgattatatcttcattgaaatttatggcttagaagacgagcttacatctaaaatagaggataatgatataaccattcataaagcagatttaggaagagacactaaaagcttcatatcctatgcaattgggtgttcttttggtcgctattcactagataaagatagtttaatctatgctggtggagagtttaatatgtctcaatacaagatattcccagcagatgaagacaatattattcccattctatccggtacttatttcgaagatgatatcgttacaaaatttgtcgactttgttcgaataacgtttagtgaagagacacttgaagaaaatctagactttattgcagtggcaatcggtcgaaagaaaaatgaaacagcaagagaggctttgcgtcgctacttcctaaatgatttttataaagatcatgtgcaagtatataagaaacgaccaatttactggttattcacatcaggtaaggaaaaggcattcaactgcttaatctatatgcaccgctatgataaaacgacgctttctcgcatgcgaacggactatttacacgaagttcaaattcgcttagatgcggaaaagaaagacttgcttaatgttattgaaggagatttgactacgaaggaaattagtagtgctaagaaagcacttaagtcgctcgacaaaaaaatagatgaactgaaagcttacgacgagttacttcatcacatggcagatatgcaaattgaaattgacctagatgatggtgtgaaagtgaactatgaaaaatttaagggtttagtggcaaagatatag

SEQ ID NO: 2308 - DNA, 3717 bp, Flavobacterium branchiophilum
atgaaactctctgatcacgtagatagcattcgcgaacgcatatacaaagcattcaataatcagtttgctcgcttaggaattggtgccaataaactaatggaaatcgacaaaattccaaccgatttgcattccaaaagaaagaaaattgaaatcttaatagccagccatgaaggcgaaacaggaaactacgaagaagcacgtgaaaaagcgttagacgagctaacttttacactgttcaatcgtttggcagctatcaaagtgatggaagcccatcagctttttaatcctattgttaccaagcaagcggctcatgggggtcgttcctttggacataaaatttggttagaaaacaaccccgaaaaaagaaacgaggaattagaaggaatgcgtgattattttaaatacgaattcaacaaattgggcgatgacctaccgttgtttcacaaaaactatccgtatgccttattaccttatgttattgagctaaacgatattgtagaagccttcaatgcagttgaaacagatatagatattattaaatcccaacaaccaacaactaacaaccaacaaccaaacatctggcagtccgatgatattttaggttggttgtatgaaagctacaacaatgctaaaaagcaagcccataaagactctggtgataaaacggagtacgacaaagtaagtttgcaatcgcaagtctatacaccacgttgggtggtggaatttttagttcataattcattgggaaaaatgtacttagaaatgtaccccgattctgaaattaaagacgagtacaaaattgcaaacgctcctaaaaccagagtacgtgagcctaaacccttacacgaaataaaacttattgacccagcttcaggctcgggtaactttttgttgtatgcgtttgcttttttctatgccctgtaccaagaccaaatagacaattatggtgccaattatgacgaagaagacattccgaaactaataattgaaaacaacttatatggggtggacttagatgaccgtgcagcacaattagcacaattaggtttatggatcaaagccaaacagaaaaaccgaaataccacaacattaaacttccatgtggtttcgtctgatttcttcttgcctgattttaaggaagtgctacccatttttgaaagtggcattgccgaccaaaaccaacgcaaaattgtagaagaaatttggaccgatttacaacaagcccataaatttggctctttagttaaaattgaagaaaaactaagcatcaaattacacggtgctttagaaaaacaaaacgaaaaccaaattcgtatgtttgatgctgacaccatacaagaatacgaacgttttacagccgacttttttagaaacctcgaaaccgcagtagcacaatatgccacccaagcgggaaactcgtttttgactgacaaaaccaaagacgccattaccttcctgaaactcatcacccaaaaatatgatgtagcaacggctaatccgccttataccgatagtgccgattttggccccgaactcaaaaaatatatagagagcaattacaaaaagccgtttgcttttcataccaatttatacgccacttttataaaacgttgttttgagttgaccaatgaaattgggaaaattgcaatgatacatcctagaacatttatgtttataaaaacttttgaagatgttagaaaattcattttagaaaagacgcatttaaatgtttttgttgattacagcttaagtaatttgtttggctcaataatggttgacccagcattttatgtaatggaaaaaaatattaaaacttcagataatgcttggtttatatctctagaccaatatacaagaacacctaatgaaaaatttaaaaaagaatttactcttgaagcacttaatgattatattgaaggaaaagataatatccacaaccataaacttccccaatccaaactcaaaatcatcaaatcctatccttttatttattggatatctgatgagtttagagagaagtttggggaaggtgatattaagagtgttctttctccagctcaaggtgcagcaactacaaataatttgaagtttttaagattttggtgggaattggataaagatgaactttcaaaggattatccagttgacaaaaaaaaatgggtgaattatgcaaaaggcggtccttatgaaaaatggtttggaaatatgtggctttacttgaattatgcaaacgatgcagattctttaaaaaaagcaggggcagttcttagaaattcagatttatattttaataaaggggtaacatattcagcatctggatccaaaggtgcatcttttagaattttaccagaaaactctgtttttgacactggaggttcttgtatttttgctaatagagatttcaaaaacacaagtttcgttttaggatttatgaattccaagttagtttcttacatagttgattgtttgaacccaactgtgaacgctcaagttggtgatatgcaaagagtgccatttgttttacctaaaagcaagcttgaagaagaagtgaaaatacttgtcgaccaatgtgttgcaataaaagattttactgcatcttttaaaatttatgaaagtaattttaacaaaaccaatttaatagaaagcaaaagcatatcagatttttataatttagaaaattatctaattacccaagtcctaattaatgaagcaatcattaacacaaagatctttgaagtctatgagttaactgatgcagataaagcaatggttttggcaaaagaaggcgaaagcattggtggtttgccggtaaccgctgctgccaaaaaagactatttagaaaatgaagtggcagagtttcctttagaaaacatcaaagattttatccaaaatttaccagaaacagccttttctacagaagaaaaagacaaaatagtagcagagtttcctaatttgtaccaaagcaataatgatttagaagagttttgcattcgccatcaggtcaatcccatcaacgtatggtattggttcaaagaaagcaacatcattccaaaacaacgtatgaacactttggcaatggagtttttagcggatatgattcgtgaaatcttattagaagatgaagacggcatcattccattagtacccaatgcaggagaaaaaatcctattagaccgcattgaggaaaaattcttagaaaaaggtttttctatggcacagtattccgcttttgatggagtattaggtcgtaatatcaaagaatacctcaatgggcatttcttcaaagctttatcagatcatttgaatttgtttatgtacttgcctaaaacaccatttatttggcaccttacttcaggtccagaacaaggttttgattgctatagcatcatttacaaatgggacagagataaattaatgcgagtgcgttccgtgtacatcgaacaccgcgaacgagctttagtcaaccgccaaacagatttaagaaacaaagaagttttatcagcttcagaacaaaacgaagccgataaaatatacaagcaactcaaagaaatagaaagcttcaaagccaaaatagacgagctactacaagagggctacaatcctatcctagatgatggtgtaggcaaaaacatagccccattacaaaagaaaggaatgttagcctacgaggtgctcaatgcaggacagttaaagaaatatttaaacacggattggtaa

SEQ ID NO: 2309 - DNA, 3513 bp, Gallionella capsiferriformans
atgaacaaatccaaactcaaatcctacgctccgcaagcacgccgtgatttcattgcagcggtaacagctcgcgccaatttgcttggcttgtctgattctggcggtaagcttgaggtggcaatcggtgagagaaaaggggatatcgccatcattgccggtcaggaatggcctgccaaggtatatgaactccgcgaacggctgatcaagcgtatgacaaccgagggtttcagccataccgttgatgcgattgcctacacctggtttaaccgttttgctgcgctgcgttacatggaaattcacgactatctggatcacggctaccgtgcgctatccaatcgtgaaggcggcatgccggaaatcctgaatcatgcgaccgaactggatctgccgggcttgaataaagacagggcggttgagcttaaactcgctggtgacaaggacggtgaactctacaagatgctgctggtcgctcagtgcaacacgctttcccgctccatgcctttcctgtttgagcatatagacgatgaaaccgaactgctgttgccggacaatctgttgcgcaccgattctgtcatcgccaagttagtcgcagctattcctgaagaagactggcaggaggtagagatcatcggctggctgtaccagttttacatcagtgagaagaaggatgaagtgatcggcaaagtggttaagagcgaggatattcccgctgccacccagctttttaccccaaactggattgttaaatatctggtgcaaaacagcgtcggtcgcctgtggttgatggcgaatcctgcttcaacgctaaaaagtgaatgggcttattacatcgaacctgctgagcagacgccggaagttcaggctcagttggatgccttgattcagacccgcatgattgaagacggcggcagcctgagtcctgaaactattaagatgctcgaccccgcttgcggctctggtcatattttggtggaagcctacgaggtgctgaagggcatctatttggaacgcggctaccgcttacgcgatataccccgtctgattctggaaaagaacctttttggtcttgatatcgatgaccgtgccgcgcaactggctggatttgctttgctgatgaaggctcgcgccgatgatcgccgtctgttcgataatccaccaactctcaacgtgctggctttgcaggagagcaaggggctggatgcagtgcagctttccgctgcgttagtgggtagtggacagtgggcagtgggcagcaagcaacaactaagcacggatgtttgttcactgatcactgtttttgaatatgccaaaacctttggctcgttgattcagattccgccgtcgctgaatatgaaactggcgacgatggcggagagtttgcagcaggctatcaagagcggcgatcttctttccgagtcggcagcgcaacaattgttgccgctggttgagcaggcgaaagtgttggggatgcagtttgatgcggtggtggcgaatccgccgtacatgggtggtaaggggatgaacccagtattgaaggattacgcaaaggcgacattcccggatagcaagtccgacctgttcgccatgtttatcgagcgaggctttggttggtgcaagcctaccggcttcaacagcatggtcacgatgcagagctggatgttcctgtcgtcttacgaggcgatgcgggaaaagttgctgacagatcgcactattatgacgatggcgcatcttggcgcacgggcattcagcgagatttccggcgaagtcgtgcagacgacagcgttcattctccaaggcaagcattttagtggctttaagcctgtgtttttccgacttgtggatggcttggaagctgagaaggaagccacgctattggcgggacttaaccgccatgatctgactattcaggatgctttcaagaaaattccgggtagtccagtggcttattgggtaggaaaaaaaataattgatgctttttcgaaaaatcaattgattggatcgagggcaaaaaaagggattacaactggtgacaatgaaaaatttctaagatattggtttgaggtttctattgaaaagctatcaatgcttggaggcaataaatggtttccttctcaaaaagggggggagttcaagaagtggtatggaaaccttgaatttataattaactggggaaatagtgggttcgagatcaaaaatttcaaaacttcatctggcgcactccgctctgttattcgtaatgaaagttactactttttggagggggtgagttggacggacgtatcaactggaaaaattagtgctcgatacgttccagatggtttcttgtttaatgcgtcaggcccgacggttttttccgaaaatccgatgttgtttcttgcaaatttgaacaacgttgtaacttacaaaaatactgaattcatctgccccactatccacttcgaagttggacagatacaaagattaccctttactaatattgatgacacctcgcatgtcaatgatcttgtcaggatggcaagacaagactggaacgcgtctgagtattcttgggaatttgaagaatcaccattggcagcgaaaagaggaaatacgttaaagaaaacgtgggatcaatggcaaatagcttgtgtggaaagagtcttgaaaaccaaagcccttgaagaattaaacaatcgcctcttcatcactgcctatggcctacaagacgaactctcccccgaagtacccgaagaacagatcactctcacccgcgccgaccgcgaaaaagacagccaacgcctgatctcctatgtcatcggctgcataatgggccgttacagtctggacgagcctggtctgatttatgcgcatgccggtaatatcggcttcgatgccacccgctgtcagactttccccgcagacgcagacggcattgtgccgcttaccgacgagttctggtttgaggatgatgccgctaaccgcatccgcgaattcctgctggccgtgtggggagctgaaacactgaacgagaatatggcttggctggcggaaagcctcggcatgaagggcaacgaaacatcggaagaaactattcgccgttatctcgcgtccagctttttcaagaatcacctgcaaacctacaagaaacgcccgatctactggctgttctccagcggaaaacagggtgcatttcaggcactggtttatctacaccgttaccacgaaggcacccttgcccggatgcgcgccgaatatgtcgtgccgctgaccagtaagatccagtctcgtatcgagatgctgatcaaggatgccgaagtcgcaaccgttacctcagtccgcaacaagatcaacaaggaagtcgaagtgctgcgcaagaaacatgtcgagctgctcgcctatgacgaaaaactccgccactatgccgatatgcgtatccagctcgatcttgatgacggcgtgaaggtgaattacggtaagtttggcgatctgcttgcagaagtgaaagcggtgacaggtgggagtggagatgagtga

SEQ ID NO: 2310 - DNA, 3345 bp, Gallionella capsiferriformans
atgaaaatagccctcgcacgcgaacaccgtaaaacattggaaaccgtgatcggccaggcgcgtgtagctgccgagtcaggtgctatcaaagcgctacaagcgcttgcggtcggtgcgaaggaagtgccatcgcattttactgatacacagaaaaagttacgtgtgcgattgcgtgcgcacggtcggcaattgggcgatgtgctgcgcccggatgacactcaagccgttgatcatctcatcaccgaagttgcctacgaacactggcaccgcatgctgttcgcccgctttctggcggagagcaatttgctcatgcacccgcatggctatccggtctccctgcaagattgcaaggaagatgcggccaccatggaaccaccggcacgcagtgaatgggaagtcgccggtcgctatgcctcggccatgcttcccaacgtatttcgtcctgatacacctacgctggcgctggaacttcctttggaaaccgaacaggcgctggaagcactgttaaacaaattgcccgctaccgtattccaggccgatgacagcttgggttggagctaccagttctggcaagcgccgaaaaaagaagaagtgcagcggcaaatgaagcaggcaggcaccaaggttggggcggatgaattgcccgccgtcacccaattatttaccgagcagtacatggtggcctttttgctggagaattccctcggcggctggtggcggggtcggcaccccggcaaaccgctgccgattgaaatgccctacctgcgcaccatagaagatggcactcccgctgccggtacgttcgccgcatggcctgacaccctggccgattttaaattgcttgacccaagctgcggctccggccattttacggtttcggcgctgtattacttggtgccactacgcgtggcgagcgaaacaatcagtgtgcgtgatgctgtggacaaagtgctagctgacaatctgcacggactggaacttgacgcccgttgtgtagaaatcgccgctttcgcgctggcactggccgcctggcgttaccctgatgaaactggcaaaccgctgggtcatcgaccattgccgcgcctcaatattgcctgttgcggtgttgccccacgcacaccaaaagcgacgtggctcaagctggccaatggagataggcagctcgaacatggcatggaagcgctgtatgcgctgtatcaaaaagcgcctgaactgggcagcctgatcgatccttcggcggtgacacgcggagatttggtggatgccaactgggatgaactgcaagtcttgatggaaaaagcgcttgccaactcaagcggcgatgaagcggaagttgaagcccgcgttgccgcacaaggcatggcgttcaccacccgcatcctcagtcggcgctaccatctggtcattaccaatccgccgtatcttggatcgggacagcacgggccggtactcaaggatttttgcgaggagcactacaaagcagccaagggcgatctcgccaatgtgtttcttgaccgctgcctgaagctctgcctccccggtggcgtggtgcaattcgtcatgccgcaaaactggctgtttctcaagacctacaaggcgcaacgcgagtatctacttagactcgaaacctggaacatggctgccttgctaggccctaagggctttgataccccgatgtgggatttcaatgtccagttggttacgctaacgcactcgacgccacccgctaaccattccttttatggactggatgctagcgaagggaaaacgcctgaagataaatctggattgctgatcagcacaacaggtatatctgttgaccagcaatcacaatttaacaatccagatttccgaatagtaatcggatcgagtgcgaatagtgatttgctacaaacgatagcttcatccaacgctggcatgctcactggtgacggaaattatttctgtcgttatttctgggaaccaaagagcgtccacccagattgggaattaatgcaaagcactgttagtaaaacgacacctcatggcggacggtcgcaagttgttttatgggagaacggatccggacagctattcaaatatgctgacagcgttaagcatctcaatacggccgtacagcggtggagaagtggtcagcaggtatggggaaaaaaaggggttgtcgtaagctcaatgggaagcttggaatgcaccctttattctggcgacaggttcgataacaatgttggcgtaattactccaactaatccctcacacctagctgcgatttgggcattctgttcttcatcacaattttcaactgaagttaggaagattgaccaaaagatcaacgtaacagcggccacatttgcaaaagttccctttgacatcgtccactggcaaaaagtcgccgccgagcgttatccaaaaggcttacctaaaccttattccgacgacccaacccagtggattttccacggccatcccaagcccgcgactgccccgctgcaagtcgcaattgcccgtctactcggttatcgctggccagcagaattcgatgctgaaatggaactttcggacgaagcgcgtaattggattagccgttgtgccgaattctatgatctcaccgacgatgatggcatcgtctgtctacccgccgtgcgtggcgagcctgcggcaattgatcgcttacgcgccttgctggcccgtgctttcggtgccgactggtctgccgcccgtgaagcgcaattgctcacggatgcgggatgcgacggtatgccgctggtgcaatggctgcgcgataaatactttgaacagcacattgcccgttttggcaaacgtccgttcatctggcatgtgtgggatggtcacaaggaaggtttctcggcgctgatcaattaccaccaactcacccatgaaaagctcactacgctgattcacctttacttgggcgactggatcactcagcagaaacgcgccgttgatgctgggattaccgatgccgtgctcaagctggcaaaggccgaagcgctgaaagtgaaactggaagccatcctcaccggcgaaccgccttatgacattttcgtgcgctggaagcaggaacatctactgccactcggttgggagccagatatcaacgacggtgtgcgcatgaatatccgtcccttcgttgcagcagaagtattacgtatcccacgcgccaaactcggcatcaaatgggaagccgaccggggcaaggatgtgcccagtgcgccctggtacaaactcggcccgcaatacggcgagccggaaggcacccgcatcaacgatcaccacaccacgctgactgaaaagcaagcggcaagaaacaaagcggggagcaaatga

SEQ ID NO: 2311 - DNA, 3435 bp, Geobacillus sp.
atgaacaaacgagcattaaaagaatttgctgtttatgcacgcaacgaactacgcaatcaaatcgccttgcgagcacaagcctttgggattactcccgaaggctctcctacgcttgtaacaggtgcggattatgttgaaatcaacggcaaaaaactgccattatcttataaaagcggtctacaaaaactgttaaaagaagttgaaacaaaaggctatgaccaagtgattgaagaagtcgcgtacacatggtttaaccgcttaattgcaattcgcttcatggaagtgcataactatttgccatcaaaaattcgcgttttatcaagcgaaacgagaggaaaagtggacccggatattttaaccgattaccaatatacggacttgccagtcgataaagaggagattgcatctcttttacaacaaggaaagcgtgaggaagcgtaccggaagttattgattgcccagtgtaatgaattgcatcaaattatggattttcttttcgaaaagatagcagactatacagaactactattgccagagtcgttgctacatgcggattcgttgattaacaaactaggaaaagaattaggagacgaaaacttcgaacatgtagaagtcattggctggttgtatcaatattatatgtctgaaaaaaaggaacaagtaggcggattgaaaaacacagctgtcaaaaaagaagatttacctgttgttacccaactttttacgccaaaatggattgtgcaatatatggtgcaaaattcattaggaaagctatatgatgaatggaagccggaaaatcatcttgtaaaagattgggagtactatttgaaatcatccgagaagctcccaataccagaaaacatctctttagaagaaataaaggtcatcgatcctgcttgtggctcagggcacattttagtttatgcatttgatttgttgtatgacatgtatttagaagcgggatatccagaacgcgaaattcctagactcattattgaaaaaaatctatatggattagatatagataaacgtgctgttcaactggcaagctttgcgttaatgatgaaaggacaagaaaaataccgccgttttctaaaaaaggcaacagatttaaaactaaatattcatgagtttgtagatagtgagcctatctcagaagaagtactcgctttcctaggagaaaaagtaggagatgtcagttgggttgccgctttacaagagaagtttgaaaatgcaaaacagtttggatcgttacttgttccagacgaacaggcatcgttttatttaaagtatattgaagcaatcgaatcctatgacgttaatgaagtagaactattagaagaaacatatattattgagttaaaagaaaaacttcttccgctattaaaacaggcgtatttattggcattaaaatatgaagtcgttgtaacgaacccaccttatcataataaatacaatcctgtattaaagaagtttatgaacgataactataaagattataaatcagacttatactctgcttttatctatcgctgcacgcaaatgacggttgaaaatgggtttgcagcacttatgacgccatttacatggatgtttatttcgtcccatgaaaaactaagaaagtatattattgagaaccaaagtatttcaagtttaattcagctcgaatactcagcttttaccgaagcaactgttccgatttgtacatttgtaattcagaatcaaaatcggacatccattggggaatatatcagattagaagaatttaaaggtgctgacttacagccaataaaggtaaaagaagcagtaaaaaataatgtagactatcgttattcttgtgatagtaaaagctttaatgcaattccaggttccccgattgcgtattggctgaacaaaaaagcaagagatgggttccaatatgtaattggtaacaattattcagcggtagctggtatatcaacaggaaataataatcgatatatatttgattggtatgaagtagactattcacaaatctctttttctaaaaaaggaggaattgattgtaaaaaatattatccgcatgcgaaaggtggagactatcgtaggtggtatggtaaccgcataaatgttattaagtataatgagcaatccattaaggaaatgagtagcttgcccggttttcgacatgatggaagaatgcactactttaagcacctaatatcttggagcaaaattactagctctatctttagtgctagatattatgagcccatgtttgtattcgatagtgctgcgcctagtatttctattgataaaatagattataatttgcttggatatcttaattcgaaggtagcatattattttatgaaagtaataaatcctactttgaattatcctccaggttatatggagttattgccttttagtcattcggaaaataaggtaattaatagtatagtatctgaaaacattgaaatttgcataaatgaatggaattcattcgaaacctcatgggacttcaaaaagcatccattcctcacataccgcggaaacgcaaagacattagaggaatgctacgcaaactgggcggaccatgccgaaaagcagttccgtcaactgcagaaaaatgaggaagaactgaatcgtatttttattgaattgtacggtttgcaagatgaactaacgccagaagtgccggatgaggaagtaaccgttcgccgcgcggatcgtgtccgtgatgcgaagtcgttcttgtcttactgtgttggtttaatgatggggcgttattcgttggatgtcgaaggtcttgcttatgcaggcggtgagtgggacgcatcgaagtataaaacgttccagcccgataaagacggcatcattccattgacggaaacagcgtattttgaagatgatgtcatcagccgcttgcaagagctattaatcattatgttcggtgaagagacgttagcggagaatcttcgttggctagcggagtcattaacgatgaaaaacaacgaaacaccgacagagcgtttgcgtcgttatttctttgacgagttctacgcagatcattgcaaaatttatcaaaagcggccgatttactggatggcagaatcagggccgaaaaaagcattccgcgcattattctacttgcaccgttacacgccagaaacactagcaacaatgcgctttacgtacgtacaaaacttacaagaaaaacttcgtcaagagcaaaaacgcctcgagcaagaccttatcaatccggatctatcttctgcgatgaagaagcgttatgagaagcaattgaaacaaattagagcccagcaggaagagctcgttgaattcgataaaaaattagcggaacttgccaaccaacgcattgccttagatttagatgacggagtggttgtgaactacgagaaattaaaaacgatccttgcgaaaataagataa

SEQ ID NO: 2312 - DNA, 3813 bp, Geobacter sulfurreducens
atgaacgatactttcgttgccgacatacagaaattcacccttgcaaatcgtgctcttcttgagcgggagaccgatgagcaacttcaaggtatctacggctggttgcccgacggttcctttgccgatgcatcccgttatccggctattcatcagcttgacgaggcccgagaaacgcgcctccaactggaacactatgcagaggaagaaaaagctgccggtttttcttctgttgattcccgtcgcaagatcgtccgcgagactgccttcacctggctaaaccgcctcgttgccttccgcctccttgaagagcgcaagctcttgaagcaaattgttgccaaaatagacaagtccaatggattcatcttctggctcactgctgaaggaaatgaagaggtttacaagctgcatcagcaaggcgacctgccgcttaacccaatgggtgaaggccccagcaacgtggcgtatcgccgattcatcctctggcagtgcggcgagcttgcccgcgatgtgtccgtgctctttgacccatccacacttcctacccgcctcttcccccggccagcgattgtcaagcaactcgctgaatccatgaacaccgaagcccgtatagaagcttggaaaccgggtaatgaggaaaccctcgggtgggtttatgaaggctttattgaagatgaaaacgaggctgtctttaagaaattcagcaaagggaaaaaggtcattgccgaggaaatcggcgcggcgactcagcggttcacccctcgctggatcgttcggtttctggtggaaaactcgctgggacgattatgggctgagatgcatcctgacagtaggctcaaggattcgctctcttacctcgtgccaatagagaactctcaagcccatccgctgaagctggtacgtgatattacattccttgacccctcatgcgggtcaatgcatttcggtctggtagcattcgacctcttcgctgagatgtatcgtgaggaatttgaaaaggcgggacagcccggctggccggagaacccttccgttaatgctgaagatgaaattgcgagcagtatcattgctcataatctgcatgggattgatatcgaccttcgttccgtccagatttccgctcttacactcttattgcgtgcgcgaactttaagccccaaatgtgcctttactgaccgtaatcttgcctgtgcgaacgtcgaacaaaccagcggcggcaagcttgagactctcattgctgctgctaaattcagtcaccccatctatgaacgtgttctccggacccttgccgctgagatgaaggattcggaccagcttggtagtctcctccgtttggagaggagtctggagagactggtgatcgaagaacgccgtaaggcggaagaaaataagcagtttcttctctcatttcccgggatatcgccagagcaatttgatacccaagcaggcattgaggagttttttgatctcctctctgatcagttgctgcggcatcttgacttttttgttcgtgcgtcacgagagatgggaggcgaccctggccatattgtaaacgaagctgccaaaggattgcgatacatgcagttggtctctcaccattatgatgttgtagcgaccaatccgccctatatgagccgccggaacatgtccgatgtcatcgctaagcatcttgataaacattaccctgaaacgaagggtgacctatacgccgccttcattgcccgatgtttggaattggttgcaccacagggaaaggtggccatggtaacgcagcaatcgttcatgttcatcgggacttatgagaaattccgaagcaacctactttctagagtgactgttgagacgatggcgcatctggggcctaaagcctttcccaatattactggagagaaagtcaatacaactgccttcgttattcggcgtgagccggatggaaagtcgctggaggagcactgtggggtgtacttccgcctagtgcgcgagagggatgctgtagccaagcaaatagcttttgagggtgcagtctccgctatgcgttcaggcatgaccactccaattgtcttcacctaccgccaaattgactacgacaccataccagaaaagccctgggtttattggatgcctgaaaagattcaggagcttttccgccaaggtcgcctcctttccgttgttgccccacccaaggttggtcttcagacaggggataatacgcgtttcctccgcaaatggtgggaaattggggtgaatcatattgccagaaatgcgacttcatgctcagacaccaagcgttctggagttaaatggattccttatatgaaaggcggagcacccatcccttggaatgggaatcatgaacatgttgttaactggaagatggatggtgttgaaatacgggccttctgtcccagggcagttgttagaaaccccaccttctatttccgaaaaggcgtgacgtggagcgatgtaagccccaaaggttttgcagggcggttatccccaggtgggtttattcatgatgtaaaaggcatgacgtgctatccgagtgacgaatcgctcaatgaagtccttggcatttttaactcgaccacagcgaagtttatcctgagcgccttgaatcccaccatttcctttcaagtaggtgatatcgaacgcctgccaatccccagcaagtcttccaaggacctagaagctaaagttgaagaatcagtatcattggctcaaaaggacagctccgacagcgaacggacctacgactttattcacccgccgctttgtgtaacggaagtagacgagagacatgcccgcttgcgacgaatcgaggaggagattgaccaggaggtcactcgcctctacggtctggatgaagcggaccgtcttgccctcaaaaccgaactggagggaataaaggctgtagctgaagataataatgaagaagaaggtgatacagaggaagaagaggaaaccgtcgcaggggcgtggaccgacttatcgcttgcccgcgcctgggtgagttatgctttcggcatggcccttggcagataccggattggcgagcccgagggcttggggcgaggaaactttgatgctgcgaccattgccgccatcagcgccctcatcgactctgacgggatcatgccttcggacgccggccatccccaggacatcgtgtctcggactctgcgaattctggaactcatgcgtggggaggatactgcgcggaggctcgtccgtgcagccaccggcggcgacggcgtgccggagaaccttctgcgcggcttcctggatcgcttcactggtcagccagaggtttcgtactggcgctatcattaccagctctaccgcaaacgccccatctattggccgttgcagtcgccaaaaagaaaattcaccgtctggattttccaggaacgcttcaccaccaactccctcttcgaagtacgtagaatggtagaggagcgcctgcgcatgctggagcgggagatcgccgacaaacgaatcgtggcagccagcaatcgcagtgtggcgaaagaactcgacaagctcctcgagctctccgacgatctgcgagatttttcgaaaaaccttcaagacatccttcaggccggatacaccccacatatcgacgatggggtgctcctcaacgcagctccactgcatactcttctgccgagctggccggagactcagaaggcttggcaggagcttgccgaagggaaatacgattgggcgcaacaggccatggaccattggcccgaacgggtacgggaaaagtgcaagacgaacaagtcattcgccatcgcccacgggctggcgtaa

SEQ ID NO: 2313 - DNA, 3261 bp, Haliscomenobacter hydrossis
atggcagcacttacccctccccagcgcagtactcttgagtcggctgtcaaactggcccgcaaacaggccgaaactggcgccctcaacgccctgcaagccctggccgtcaaccatcccgagccttttgtacacctgagccccgcccaacgggctttgcgcaatatgctccgcgccaaggcacgcctcctgggcgacggcctggatggccccactgccctcaaaaacctcagccacgaactagcgtacgaaacctggcacaaaatgctcttcgccaagttcctggaggccaatcacctgctgatgcacccggatggggtggcggtcaccatgacggattgtgaggaactggccgccgaggagggttttgccgacaaatgggataccgccgctagctacgcttcgcgcatgctcccggctatttttcgccccgaggatccgctgatgcaggtgccctttgcttccaacgaccgcatcaagctggaacaactcatcgatggcctggatgccagcatttttaccgccgatgatgccctgggctgggtgtaccagttttggcagagtgaagccaaagagcgcatcaacaaaagtggggacaaaatcgacggcgaaaaactgcccgcagtaacccagctcttcaccgagccgtacatggtacattttctgatcgacaataccctgggagcctggtggctgagccgccatcctggccaacagcctcctctcaaatttgcttacctgcgctgcctggaggatggccgccccgctgcgggccagttcgcgggttggccggatagcacggcggcagtcactgcgctggatccttgtatgggttctggccattttgtggcggcactttttccggtgtttgctaccctgcgcatgcacgaggagggcttgagcaaaaccgaggcgaccctgcgggtgatcgccgaaaacttgcacggcctggagctcgacccgcgttgtacccaaatcgctgccttcaacctggcgcttacggcctggaaattctgtggccagtacctcgttttgccggaaatgaacctggcctgtagtggcatcgccccgaaaggcaaggtggaggattgggtgaaattggtggggcaagccgcacaccccgttgaaaaaaatcgcctagaaaacggcatgcgtaccttgtaccagcattttcaattggctccggagctgggtagtttgttggaccctactacgatcaagccggatgcttttacggccagttttcaggacttgaaacctgttttggaaaaagcgctggaaaatgaagccgacgccgaacagtgggaacggggcgtaatggccgcgggcatcgccaaagcgggtcagctattgggcaaaaaatatactttgcagattaccaatgtgccgtacctttctagaggcaaacaggatacagtgttggccgactattgcgagcgaaattatcccgaagccaagggagatttagcaacggtttttttggataaaatgttaaaatccaacacgctaggtggattttcttgtagtgtaatcccacaaaactggttgtttttgacttcttataaaaaattcagagaaaaattgctcaagaataaaacttggaacatcgtcgcaagacttggagcaaagggtttccaaacacccatgtgggattttaatgtgatgctcattgccattgctcatcaaatacccactaacgatcaaacgatcaatggcctcgacgtttccgaagcgcccaatgctgcggctaaagatgaagcccttaaaacggctgagttgaaaatggtggggcaggtggagcagttggggaacccggatgcgagggtggtgctggaagcagtagacaattacaacttgttaaatgaatattgttcttccacgaaaggaatatctacatcagatgatcctgtttttattcgctctttttgggaaagaaaaaattttgactcagactgggaaccttatcaaactactccaaaaggagataattactggtctggttatgagttgtcaatatgctttcaaaacggaaatggaaggttaagaagcttagcaaaagcaatgaagcctgatcggcacatggatttgagagggcagcatatttggactaagaaaggggtctcgataggaattatgagtgaaatacctgcagctttttatttaggtaataaatttgatgcgaatatcaatgttatcataccaaataatgaaaaacactatcctgcgattttttgctattgcaactcaaatgagtttaaaattgctttgagaaaaattgatcaaaaaattagcgtaacaacttcaacttttgccaaagtccctttcgaccttgaacactggcaaaaagtcgccgccgaaaaataccccgacggccttcccctaccctacagcgacgaccctacccagtggcttttccacgggcacccgctccgaaccacccatccgctgcaagtggccctggcccgcctgctgggctaccgctggcccgccgaaaatgacccggagatggagctggcccccgaggcccgggcgctcatcgctgctgtccaggcttttgaccccctcagcgacgaggatggcatcttttgtatcccttccgtcaatgccgaggcggccggggccgatcgtttgcgcgactacctgcaagtagtgttcggcgatgcctggaaccaccaaagcctcagccaacttctggcccaggagggcgccagcgccagcaacctggaggattggctgcgcaatgagtacttcagccagcattgcaagttgtttcaaaaccgccccttcatctggcacatctgggatggccgaaaggatggttttgctgccctggtcaattaccaccaactggacaaagacaacctttccaaactgatctatacctacctcggcgactggattcgcatgtgtgaagccaaaaagaaggcagaagaaagtggtgccgaaggcctgctcagcgccgccctcaaactcaaaacgcaactggaagccatcctggagggcgaggccccctacgatgtgtttgtacgctggaaacccctggaacaacaacccctcggctgggaccccgaccccaacgacggcgtccggctcaacatccgcccctttgtggaggctggcgtgctgcgcagcaagttcaacctgaaatggggcgtggatcggggcaaaaatccgcccggggcgccctggggggaagtgagggataatgatcggcatttgaggctggaggagaaacgggaggcgagggagaaggtgggaaagtga

SEQ ID NO: 2314 - DNA, 3519 bp, Halobacillus halophilus
atgaataaagcagagttgaagagatttgctgtagaagccaggcgtgacctgatagataaagtttcattgaaagcagagcaatacggcattactgaaaatgatcaggaattgaaggttgaagaaaactacggacaattgtacgtgaacggtaaatcatatgatacagaaatgaagcaatcttttcgtacattacaacaacgtttgaacaacgtaggatacaatcaattaatcgaggaaatttcatatacgtggtttaacagaattattgctatgcgctatatggaagtaaacaattatctaccggataaagtcaacgtgctatcaagtagtacgggtaaaaatgatcctgacattttattgcaatttgaaactatgaatttagatgttaaacatcaaaaagtgagtgaaagcatacaagaaggagataatgaaaaagcctatcgaagtttgctcattgcccagtgtaatgctttaaaccagctactgcctttcttatttgaaaagattgaagattatacagagctattattacccgattatttattagaccaggagtcgattatacgtaaaattgtaaatgaattgtctgatgaaaacttctatcatgtacgtgaagacggtgtgcgttcagataatgtcgaagtattaggctggctgtaccaatattacatgtctgaaaagaaggaacaagttggtggactaagaaataatgcagtgaaaaaggaagacttacctgtagtaactcaattattcacacctaagtggattgtacaatacatggtacaaaattcattaggaaaactttacgatgagaaatacgaagataatcaactgtcacagcattgggagtattattttaaacataaagaaaaccatcatctatatcccaggtttgattcattagaagatttgaaaattatggaccccgcgtgtgggtctggacacattttaatttactcttttgatatgttatacgatatgtatgaagaagcaggttatccatcaagagaaataccacagttaattttggaaaacaatctctacggtttggatatagataaacgtgctcagcaaattgcgaactttgcactcctgatgaaggcagctgaaaaacaaccacgttttatttcaaggcttagtcgaaaaggtaagagtccaaaattgaacgtatatgaaatagtagaggctgatcaaacattatctgaggaggctattaattattttgcagaaaataaaatggaaaagtcattcatcaacgaattattaagccaatttgagaatggaaaacaatttgggtcattaataaatccaattgaattaccttatgaggaatggattaatcgtttatataacttagatgaccaaaaagttaatttacttgatgaatcttatatcaaagaactaaaggtcaagttattacctataatcgaacaagctaatttattatatcaaagatatgaagtggttataactaacccgccctatcatagtagatacaacaaagtgctgaaaaaatatatgaatgaaaagtataaagattataaaactgacttgtattcttcgtttatatatcagaccaaaactataactaaagataatggttactttgtattagttacaccatatacatggatgttcatatctactcacgagaaattaagaaaaaaccttttacaaaaatctgcattatcaagcttaattcatttaaattattctgcatttagtgaagcaactgttccaatttgtgcttttgtagctcataaacaaaccaaaagtactttgggggtctacctgaaactttcaaaatataaatctaccgaactttcttccttagttaaagaggcggctaaagaaaataggtcatataaatacattcataaaagtgaagaattttttaattttcctggtaatcgcattgcttattgggcaacggaatctgtaaaatcagcttttaaaaatcacaatgaactagggggtattgcccaaccaagggcgggtttacaaactggaaacaacgataggtttttgaggttatggtatgaggttggggttgaagatattggttttaatatgtccaaccttatcgaagctaaaaatagtaataaaaaatggttcccatataataaaggaggtgcctatagaaaatggtatggaaatcagtactatgtggtaaattgggaaaaagatggagaagaaataaaagaacttgcaactagcaaatacaagaattacactaggacggttaaaaacattaatttttactttagagaaggtttgacatggtcggatgttaactcacagtattttggaataagatattcaccgaaaggctttatttttgatgtcaaaggttcttccttatttactaataacaaagattttttatctatcattttaggctttttaacttcaaaagtttcaagtgaaatgttagagctattaaacccaaccattagttttcaaaccggcgatttaaaaagtttaccaatcattgaaccaactaatagaaatttagtaaaagagttagtagagagcagtgtacaaatagccaaggatgaatgggagtcatatgaaatatcatgggattttaaacaacacccatttataactaatataaaagaaattgaaaaaatttctgaggcaaatagttgttggaaagaaaaagttaataactacattcagcaactaagaaaaaatgagcaaagtttaaatgaaatatttatcaagacttatggtttagaaggggagttatctccaaaagttgaagaaaaagatattacaataagaaatgaaagtcgtataaataatactaaatcatttttatcttactttattggttgtgtcatgggccgttactcattagatgttgaagggctcgcttatgcaggtggtcaatttgatgaatcgatttatcaaaaatttataccaaaccattatggtctgattcaattaacagatgatcattactttgataaagatattattgtacgtttacgtgagtttctctcagttacctttagtccagatacagtagatgaaaatatggaatggttagctgaatcattaataataaagaaaaatgagtcaccagaagaacgactacgccgttatttcttagacgaattttttaaaaaccattgtaaaacctatcaaaaacgaccaatttattggttagttgattcaggtaaacaaaaaggtttgcgaacgctcatctatatgcatcgttaccaaccagatacaatggcaacgattcggtttgagcatttacaagaaattcaatcgaaataccaaaatgaaattgacatgattgatacacgtttagctaatccaagtttatccgcgactgatcgtcgtagcttagaaaaatctaggacagcttttcagaaaaagattgatgaactacaagagtttgataagcatttagctacttatgcgaatgaacaaattgatattgatttagacgatggtgttaaaatgaactacgctaaattttataatgtactagcaaagattaagtaa

SEQ ID NO: 2315 - DNA, 1371 bp, Halobacteroides halobius
atggataagataagaaataaactacaagaaataggttgtgatgaaattaagaagaagactactattgaagtagaaggtaaagagattacttatgatctagtaggtttgattaataagcagccagtagtagggatcgatataacagaagataataatgatacaaagcagattgggattttatctatgttaagccagagtgagcagataaattattatggaagttttaatactactactgaagaatttaactggtatcaactgactgaaggaaacatatctcaaatagagaaagtgccagtattacaaaaggagcaagagcttaatctagaagaagtaaagaagtggtatcaagagatctttcgcctgtttactgctaatagttctttaggacatgatactattatagaagtacttaaagttatactagttaaggttgaacttgataatggtagattaaatgctttagaagaaaatctgacactagaaaatattaagtcagcttatcaagagattattgcaactagtggctataatctaactcaagaggtttctgtaactgataaggtattagcagagtttgcaaccattaatttagctaagtttagaagagaagatctattagctgtatttaatcaggttgtttttgatgctttaggcagtaagcaagggccaatcttaacgcctcaacctctcgttaaggcactaggagaaatcttttctcagcaagaaggagtagagactatctttgatgggtcagctaaaatgggccaacttctgacagcctgtaaaagcaaacagcctcaggctaaggtatgggggatgaatcgagacttgactttaactgagatagctaaattaagatcattaattttagaacaagataatcagtttttagaaggcagtagtttagagttagagagagagaaaattgatcagttaccaactgaatttgatttaatagtttccaatcctgagtttagtaagccgattaaagataaagaactgatcaaagagtatcagataactgataagtctagagctaaagcagaagagttatatatcaatctctatttagacttacttactgcaggaggttatttagctattattcttcctgatggagtcttgactaataatagagcccaaaatattagggaatttatcttagataagtcagtcttaaaggctgtaatcagtctaccagaaactatctttcggccagctacttctgttagaactagtttagttattcttaagaaaaaagagactttggcccaagagcaaccagaggtctttatggcgacaccagaagataatcaagcattagaagaagtagtagctgacttagtagagtggggtggattgttttaa

SEQ ID NO: 2316 - DNA, 3468 bp, Halobacteroides halobius
ttggataagacagcaattaagaattttgccgtgcaggctagaaataaattaattgaacaagtggctcacaaggcctatcaagttggaattaccgagaatgaaatcaaagaagcatcagcaagtagtagtgacgctttgactattggtgagcgtcacttgaatcagaaagaagttgagcagagaaatgagttaattgctgagatagaagaaaaagattatcagcaggtgatagaggaagtagcgtatacttggtttaatcgttttgtagcacttagatatatggaagttaacgattatctaccgacaggagttagagtcttatcgtcagttaaaggggccaaggctgaccctgatattatgcgagaggctctaaatgtagatttagatattgatcgagaagaggtctatcagtatcaggatgataatgatcctgatgggttatataagtatttattaatccaacagtgtaatgaactacatcagattatgccctttatttttgaagagattaatgattatacagaactgttactaccagataatctactggccgaaggttcagtaattgatgatctagtaacagagatagaagaagaagattggttagagggagtagagataattggctggttgtatcagttttatatttcagagaagaaggatgaagtctttgctagtaagagcaaaattagtaaggaagagataccagctgctactcaattatttactcctaaatggatagttaagtatatggtagagaattctttagggagatattggttagaatctaatcctaatgaagacctacaagaagaatgggaatactacttagaagaggcagagcaggagccagaggttaaagaagaattagaagagattagagatagagatgttagaccagaagagattaaagtattagatcctgcttgtggtagtggccatattctagtttatgcttttgatgtcttgtatgaaatctatcagtcagttggttatatgagaagtgatattccaaagctgattcttgagaataacttgtatgggttagatatagatgaccgagcagctcaactagcttattttgcagtaatgatgaaagcaagagaaaagaatagaagaatattcagagatccagtagagttaaatatttgtgctattcaagaaagtaatactattgataaggctgaacgaaagatgattgaacagagtggagcagaaaatattagttatttgatagatgtttttgaagatgctaaggattatggttctattttagatattgagttcattgatgatcaggttattgaggaagaacttgagatgttgaaagataaattagggttgtcatataccaagattaaggataagttacagagcttgattaaacaggctcagataatgggacaacagtatgaagttgtagttactaatccaccatatatgggtaataggaatattaattctaaattaaaaaagtacttaaaaaagcattttaaaaatagtaaaaaagatttatttgctgtatttatggaaaaatgtatttcatttacaaaaagtaatgggttttctgctatgataacaatgcattcttggatgtttttaaaaagttttaggaatttaagaaataagttattaaaaaatattacaattgaatcaatggtacatttaggaccaaaagcttttgaagaaataggaggagaagttgttcaaacagtttcttttatatttagaaatattaataaaagaaagtataatggtaaatatattaggctgattaagtataatactgcctccaaaaagcaccaagagtattttaataaaggtaataaatatatatccaaaatgagtgactttgataagataccagatttccctattgcttattggattagtaattgtattatagaaatatttgaatctggaattcctttgtctgaattaggaaaaccaagagaaggaattcatactggtgatacaaaacaatttgtgaagtgttggagtgaaatagatattaacaaattctctctttcggagaatagttatgagacaataaaagaaaataatgtgaaatggataccatataataaaggtggtagctttagaaaatggtatggaaataatgaaatggcaatttgcttcgatgaagagtcaagaacacgaatgtcgaaattaaaaagtcatgtacgcccaagtgaagatttgtattttaaaaaggggattacttggtcattaattagtacttctaattttggagtaagatgttttaaagatggaatgctttttgacgtttcatcgcattcatttttttgtgaagaaagtatgtatctattttttgcagggttattaaatacaaatatagttaataacttattgaatatattgaatccaactttgaattttagctctggagtaataggtaaaataccagttattaaagattatactcaaggtcaatttaaaaatataaataatttagtagagaaaaacatcaaaatatccaaagccgactgggattcttttgaaacttcttgggacttcaaacgccatccactactaaaacataaaaacgatacaaccaaaattgaagaagccttcaataactggcaagaagtagccgaagatagattctatcaactcaaagaaaacgaagagaaattaaatgaaatctttattgatatttacggtttagaagatgaactagatcctgaagtagctgaagaagatataacagtcagaaaggcagataaagaacgagatattaaatcctttgtttcttatgcagttggctgtatgctaggtagatattctttagacgaagaaggtctagcctatgccggcggagaatttgatgagagtaagtaccaaactttcaaacctaatcaagcaggtattatccctatctgcaaggatgaatactttgatgatgatattgtaactcgctttatcgaattcttgaaggtaacttttggtgaagagcacttagaagaaaatctagagtttattgctgatgctctaccagggagaagaaagaatccacgagatagaatcagaaggtactttcttactaagtctagattctataaagaccataccagaaagtataataaacgaccaatctattggttattccagtctgatagtcgaggtaaagcctttaatgctttaatgtatatgcaccgttatgataaaggaacagtatcgaagattcgagtagattacttacatgaattacagaagaagatggaggccgaaaagcttcgtttagagcgaacagtagaatcagatgtatctagccgagaaaaaggaaaagctaaaaaaagaatcagtaaactagagaaggatttagaagagttaacagagtatgataaggaattaaatcatatagccaatcaacagatagagattgatttagatgatggtgtcaaagagaattatcctaagttttcggatatactagcaaatatgtaa

SEQ ID NO: 2317 - DNA, 3582 bp, Lactobacillus amylovorus
atggataagaataagattaaaaaatatgcgattaatgcaagaacagaattaattaatgctattaaagttaaactagcaactttaggcattgatgaaaatgagattcaagacaaattgtcgatttcaacgccagacaaggaatactatgttgatgataatgaagctaatgcattaactggtgcacaaattggctggcgcaaagatattgtagcagaattaaatcgtcacggatatcaagaagactctaagactgcatataaggattttgtagaagaagtagcctacacttggttcaaccggataattgctattcgttttatggaagttaataattacttgccaagtagagtgcgggttctttctagtgaagagggtagaaatgaacctgacattatcaatgaagcaatggaaattagtgatgatattggtggctatagcaatcaagaaaaagaattgatcactagcgcattaacagagaagactcctgagttaatggatagtttgtatacaatgctatttattaagcaatgtgatgcattaagtgagattcttcctggattgtttgaagagacatctaactatttgaagttgttgttcactccacattatgatcgtggcgtcattaaagaattaattgatgaaattccagaagaatactttgatgtcgaaaaagagggacaagttcaaattattggttggctttaccagtattacaatagtgaagctaaagattatgtcattggtttacctaaatctaaaaaatatcgaagtacgcaaatagcagaagctacgcaaatatttacacctgattggatagtaaaatatatggttcaaaattctttaggtaagttttggataaatgtccttaaagctagacataaagatttatcggagaaagatttagtaaaaaaatttaattggaaatattatatgcttgatgcgcctcaaactgaaaaagtttcagaaagaatggataaagagaatgccaagttgaaaaaatattcaattgaggatctaaaagttattgatcctgctatgggatcaggccatatattgtcttatatttttgacgtgctgattcaaatctacgaaagcgaaggttattctagaagagatgcagctactaaaattgttgaacataatctttatggtttagatatagataatagagcttatcaacttggttactttgaagtacttatgaaatatagagagtataatagacgtgcttttcgattaaataaaaatatacatgtcttatcaatcccatctagtgttgaattaaatggaattgatattaagtcagttttaacttcatattttaataaagaaacagttaacagtattgaaaacctaatccaatccttcacttatggtaaagacgagggatctcttttaaaaataaaagaaaatataaattttaagcttattaaagatatactggatgatccaagaatcatctcttctattgagcttcaacatatatttaaatatgttaaattattctataaggttgctaaaattttaaatcagcaatatgaaatcattgttactaaccctccgtatatgggttcatcaagaatgaataaagaattatcatcattcgcaaaaaagaattttaaaaactcaaaatcagatttatttgctatgtttttagaaagttggaatggtcatttagcatcgcaaggttattgtgctatggttaccatgcaatcttggatgttcttaagcagttttgaaaagatgcgcaagcaattattgaaaaaatatactatttctaacttaatgcatatggaaaataatgttatgggtatagcatttggtacagcagtgactattactcatttaccatatgattcagaatttaaaggtacatatcatcaaattaaaatgatggatgtgaaggaacataaaatcaataatcttcccgttaaagaaaatagatattcgcagattagtcaatcgaactttgataagatacctggtagtcctattgcttattgggcaagtgagaatctgattaatgattttgaagatagtattaaattagatcaaaaatatccagcaaaaaagggattagtttcaggtgataacgattactttttgagatattggttcgaaccaatatttaataatatttgctttaaaaatcaaaatacaaattctaagtataattttgtaaaaccaccttatttatatgcccctatgaataaagggggaagatttagaaaatggtatggaaataataactatgttataaaatttaatgaagatgcttttgatattatagatgccaacaaaggacatcgttcaccggaattatattttaaaatggcagtgacatggtcagcagtaacatcgggggcaccttcattccgttattcacaaccaggatttgttggtggatcagggggttatagtatttttgttgataagtctatcgatacttataaattgcttggaatattgaattcgaaggtgggaaattatattttaaatattttaaatccgactattaatatccaagctggagacgtaaagagatttccattaaagaaaaatataattgatactctaaagataaaaaattctatatcaatatctaaacaagattgggatgcctttgaaacttcatgggatttccaaaagagtccactcctaactcaaaataccgcatccctccaccaagcctacaacagttggtccaatgaagcactcacacgtttcaaccaactaaaatccaatgaagaagaactaaatcgtatttttattaatctttatggcctgcaagatgaattaactccagaagaagatgataaagaagtatccgttcgtaaagcagatcaagttcgcgacatcaaagcatttttgtcttactttatcggctgtgtctttggtcgttattcattagatcaagatggtttagtctatgctggtggcgactgggatgattcaaaatatacgacattcaagcctaacaaagaaaacattattctattaactgatcgtcaatattttgacgacgatcgtgatattattattcgtttgaaagaattcctaactaagacctttgaccctgaaacattgacagaaaatatggacttcattgctcaaacattagaacctaaaaagtttgaacggggtgcaagtgcagaagatattattagaaattatttcttgaatgacttctataaggatcatgctaagatctatcagaagcgtccaatttactgggaatttaattcaggcagaaataaaggcttcaaggcattgatgtatctacatcgttacaacactgaacagcttccaatggtgcgtcattatctgcatgagcttcagcctgcaatgaatgatctaattgaagttgatcagaacttgctcgatcaagaaacaacagctagtgctaagagtaaatatcgtaaggcaattgctactcttaataagcagatgaatgaaattatgaaatatgaccaaattttagatcacttgtcacaaagtccagttgaccttgatttggatgatggtgtactggtcaaccatgataaattgcaacaaggtgagaagttgttgtcgaagttataa

SEQ ID NO: 2318 - DNA, 2184 bp, Lactobacillus casei
ttggttgatgacattaaggaagatgattttgatgtggataaaggcgggcaggtcgagattattgggtggttgtatcagtattacaatacggaaccgaaagatgtggcagtagcgtccccaaaatcccacaaatttcgagctccggaaatcgcatcagcaacgcaaatattcacgcctgactggatcgttaaatacatggtccaaaactctttagggaaatactgggttcaagttttgcgagctcgtggggatgatcgacctgaacatcaaatcgccgattcttatggttggcaatactatatggttgatgcagaccagtctgatgaaacaaggcttgaaatcaaaaatcttaacctcagccttgagaaaacaaaaattcaagacattcagtttttagaccctgctatgggatcaggtcatattttagtttatgcttatgaactgctcatggatatttacaaatcagaggggttctcacagagagaagccgccttatcaatcattcagaacaacctttatggtatggacattgatgaacgggcatttcagctagcatattttgccgttatgatgtgtttcagaaaatataatcgccgcgctttggaccaaggcgtgactactaagcttcacttttttaattttgttttgccaactactggtcaattagatttgattaaaaacaccggatctattaacactttcaaagtcttaaaatctgttgtcaattcttttcaacacgcaacggaaaccgggtcgctcactcgtcttgatcaacaacaaagaacggcattaaaacaagttcttgatgttctttccaacaaagaagtgccgatgtacttgcatggtttgattcagtctttaacacaagttcagcaagtagcgaacattctagaatctacgtgggacgttattgttacaaatccgccatacatgggatctgcaagaatgaataagtatttatccaactatgttgacaaaacttatcgcgaaggaaaatcagaccttttctctgcgtttatggagcgcttttataaccaagttaagccggagggctactgtgcaatggtcaccatgcagtcttggatgtttttaaagagttttgaaacactccgtataaagtttttaaatcaacacacaatatcaaatttgatgcacatggagaatggcgtgatggggattgcttttggaactgctgttactgtagccaggggcaaaagaatcggtgactttgtggggacttatcaccagataaagacgcaagatgcagttaacaaagtaccaagcgctcttccgatcgctggaaatagatttaatcgtactaaacaaacgaactttgagaagattccggggagtccaatcgcatactgggcaagtcagtcgcttattcatgattttgaaataggaacgcccatgggttcaattctagaaccgcgtcaagggttagcaactgcggataataacagattcctacgccaatggtacgaagttgagccatttcggattagttttacttctacaagcacagaggatgccttaaaatcgggggcaaagtggtttccttataataaaggcggatcatatcgtaaatggtacggcaactatgattatgttgttaattggcaaaatgatggatatgaaataaaacactttacattttctaatggaaagcaacgttcagttgtgagaaatcctacttattactttcgtgaagcaataacttggtcgaaagtaacgtcgggatccttcaatattcgttttcgaaaaggtggatcgatctttgatacaggggggaattctgcttttgcggatcatacagacacactatttcaagttatggctgtcgcaaactcaccagtcggaaactatgtatttagaattcttaatcccactatcaatatgctgactgaagattttaaaaatttcccactaataaaaatcaaaaaattagatctcttgaagactattctgaatttaagtcgacagtgcactcaaattgcaaaagaagactgggatacttttgagttgtcgtgggaattcaagggactccagttactgctttatatcgctgagcatcagaaatcacctcccacaaaactcttgatcttttttgagttttgtgacaaatatgtgccaattcagtttagggggttgattttttatggtcagttatcaaaaaagaggtaa

SEQ ID NO: 2319 - DNA, 3609 bp, Lactobacillus casei
atggataaaaaagctatcaaaacattcgcgattcaggctcggcgcagtttgattgaaagtattaaattgaaacttgaaaatctcggaatcaccaaagacggcgttgctgagaaaatgtctcagtccacaaacgaaattgaatattacggtgacaaaggattgtcaataacgggccaggatattcgccgacgtcgtgaactagttgcccgacttaaaggcatggcaaaacaagaagagtggtcagatgcattaacggatttgatcgaagaagttgcatacacatggtttaacaggattattgcaattcgctttatggaagttaacgaatatcttccgagtggcgtacgggttttgtcgtcggaaacaaagctaaaagtgccagacatcttgcgagaggcttttgaaattgaagatgatcttggtggttatagtgttgatgaacatgggatcattcaaaaagcacttgatactgaagatccaactgatatggatgcggcctacgtcattctctttactaaacaagcaaatgcattaaatcactatcttcctgagctttttgagaaaactgacgatttcatgcaattattgttcactccaagctattcttcgggtgtcattaaggacttggttgatgacattaaggaagatgattttgatgtggatgaaggtggacaggtcgagattattgggtggttgtatcagtattacaacacagaaccaaaagatgctgccttcaaaaagaagaagtatctatcttctgacattccagctgtaacgcaactgtttacgccggactggatcgttaaatatcttgttgagaattcattaggtcgttattggatacgtgtgctccacgaccggggagacgagagaacatctttgcaaattgctcagtcttttaattggcaatactttatgccggaagcaaagcaagatgaaatctccacaagagccgatttgtctaagaaacgtgtggaagagataacttttgttgatcctgcaatgggatcgggtcatatcttgatctatgcatttgatgtcttattacagctctaccaatccgaaggctattcacgtcgcgaagcagctcaaaatattgttgaacgaaatctttttggccttgatattgatcgacgtgcctttcaattgacatattttgcaatgatgatgaaattgcgacgtgagaatcgccgaagtttcgagctgcaattgcatcccaatgtctttgaagtgccttcaacatctttagaattaaaggatttttcaggcgccaaagatggaagtccaatcgattcgggcaacttaagcgacgtattaggtcgatttggtgcgggaaaagaacttggatcattaatcaccttcgaaagctccatttttgatgacaaacttattaacaagattgtaagcgaacgtgaggcggggcagcttacttttgagatgtcagaccaggtgaatcatcagtgggaactaagaaatctgattcgcgttgggaaagcactgagtagtcaatacactatcagtgtgaccaacccgccatacatgggttcaggtaagatgccaaaaacgcttgctaagttcgttggaaaatactaccccgctagcaaatcggacttgtttgctgtttttatggaacgacttcaacatctgacaaaagaaaatggaatctttgcgatgattacgcaacatcaatggatgtttctttccagttttaaagccttgcgggaacgtatgagcagctggccaattatcaacatggcgcatttaggtacacgtgcgtttgaggaaattggtggtgaagtggttcaaacaacagcttttgtcgttcaaaagcagaagcttcaaggtttcattggcacctatgagcgcttagttgactttgattctcaaaaaaagaagcaacaagccttccttactgcggttcagaatccgaatttaaactatgtttatcgtactaaacaaacgaactttgagaagatcccgggcagcccgatcgcgtattgggccagcaaaaagaagttagagttattacaatatagctcctataggcttcaaaacattctttccgctcgcgaaggaatgaccaccggtaataatgctctatttatgcgttcttggcatgaagtacaattcttcaaaattagttttttatcgaccgctcatcaaatagaacgcgataagacttggttcccatataacaaggggggagcatttagaaaatggtacgggaatatttggtatgtaataaattggaagaaccacggtgaagcaattcagtctaacattgataaaaaaaccggaagaattagatcacacaactacaatggcaaatttggatttagggaagcaattacttggtccgctattagttctggcatgttttcagcgaggtattcgcccactggattccttttcgatagtaaaggcgtatcttcttttgcaaacgatcacactacgttgttgttttgtttggcttttttgaattctaacagttcaagctcctttttagaattgctttcaccaacaatggactttaaaattggacaagttttgaatttaccactcgcgaaacaacactcgcctcaagttgttgaactaacagaatcattaattagcagcagtcgggaagattggaactcttttgaaaactcctggtcatttacaaccaatattcttttaacaaatatcgctgagcatcatcgaaattggactgttgaagctgcctttcaacaatggcagaaagaggcggatgatcgttttaaccagttgaaggccaatgaagaggaactaaatcgaatttttattgatttgtatggcctacaagacgaacttagtcccgaggaggaagataaagacgtatctgttagacgtgctaacttgcctcgtgatataaaggcttttatatcgtactttattggttgtgtctttggccgatattcaattgatacacctggacttgcctatgctgggggagattgggatgccagtaaatataagacttttatcccaaacaaggacgatttgattctgctaactgacgacgattactttggtgatgatcgggacgtcatgactcgtttcaaggagttcttgacgactactttcggttcagaaaatttgaatgagaacttgaaattcattgctgatgctttaggcaaacggggagatagttctgaagaacagatccgggcttatctgcgtgatgatttcttcaagaaagatcatctatcaacttatcagaagcggccaatatattgggaattcaattcaggaagaaatggtggctttaaggcgctaatgtatttgcatcgttatgatcggaacacagtcgcgatgattcggactaaatacttgcatccccttcaagaagcttatgagcgcaagcttgtacagctaaagaaattcgaagaaaacgagcagcagacccgtcaaaaaaataaatataagaagcagatcaccacgattaccaaagaattggatgaattgattaagtacgatgaaaagttgcaacacgttgcaaacctgcatattgatctggatttagacgatggtgttctagtcaatcatgccaaagcgcaagctgatacaaaaattttgacaccattaaagtga

SEQ ID NO: 2320 - DNA, 3456 bp, Lactobacillus helveticus
ttgtcaatttcaaccgcagacaaggaatactatgttgatgataatgaagctaatgcattaactggtgcacaaattggttggcgcaaagatattatggcagaattgaatcgccatggatatcaagaagattctaagactgcatataaggattttgtagaagaagttgcttacacttggttcaaccgaattattgctattcggtttatggaagttaacaattacttgccaagtagggtgcgggttctttctagtgaagaaggtaagaatgaacctgacattatcaatgaagcaatggaaattggtgatgatcttggtggctatagtattgaagaaaaagaattgatcactaccgcattaacagagaagactcctgagttaatggataatttgtataccatgctatttattaagcaatgtgatgcattaagtgagattcttcctggattgtttgaagagacatctaactatttgaagttgttgttcactccacattatgatcgtggcgtcattaaagaattggttaatgaaattccagaagaatattttgatgtcaaaagggaaggacaagtccagattattggttggctttaccagtattacaataccattcctaaggaaaattcttttaaaaagaagaagtatcaaactgatgatattccaccagtaactcaattattcactcctgattggcttgtccgctatatggtagagaattctttagggcgttattggatagatattcttcatgctaaaggtgattctagatcagaaaaagagattgcaactgaatttaattgggaatactacatgcctagttctgaaaagaataaagttgtaattcgtccagaattagcaaataaagaagtaactgatatcaaatttattgatccagcaatgggttctggtcatattcttatttatgcatttgacatattgatgcaaatttatgaaacacaaggttattctagaagggatgctgctacatcaattatcaagaataatctttacggcttggatattgataagcgtgcatttcaactttcttactttgctttgttgatgaaagcaagagaatacaatcgtcgagtatttagaaagcatcatacagtaaatttatacgatgtacctgaagtaaaatacactactaaagattatactgatttaatttctggtgatgctttagacataaatacagttaaagatttagacagtattttaagtgtgtttcagcacggcgatgatttagggtctattattaaagttgataagaatattgattttgatagtttaagaaagctattcgctaatagccctaatcaaaataatgaacaaccagatttgtttattgacatgagaactagattgaatactgccatcaatgtggctaaagtgcttagcgatacttacgatgtgagtgttactaatccgccttatatgggtggaggtaaaatggatccaccactgaaaaaatatgttcaaaagaattatcctattgctaaaccagatctatttagtgtctttattgaaaagatgatagaacttacctctaatattggttatattgggatgattaccatgcattcctggatgtttctatctaattttgaaaaattaagaaaagaaattcagaatcataccattattaatatggctcatttagggacaagagcatttggtgatattggcggcgaagtagttcagactactacttttattttgcaaaaagcaaaaagagaagagtatttaggtagttatgaaagattagttgattatggttctcaagatgataaggaaaagatgtatcttgagatggaaaatggtaaagataataatgatgtttaccacgtagatcaattaaattttgataagatacctggcagtcctatagcctattgggcaagtgagaatttgattaaggattttgaagaaaatagaataaaagatgttggaactgtaagatctggaattatggtaaataaaagttttactagattctggtttgaagtggatattaataaaattcaattaaattctactagtatagatgatatgaaatggtttaaatggtttcctttgaatagtggtggaggatatagaaaatggtttggcttaaataaagttgttattaatttagaaaataatgcggaagatataaaaaattcaaaaacaaactatcgtttaagatcaacagatttctattttaggcctggcattacttggggaagaattacttcaggaggatcttcatttagaaaatctagaattggaaatttattcggagatgctggaccaatgcttttcttaaacgattctaattcactaaattatgttctttcgtttttaaatagtaaagttttaccagaactagaaagaattttaaatccgactcttaactttcaagttaatgatcttgcagaaattccaataaaaggagaagaaactaataaagtagaagtgttagctgataaaaatataaagatatcacagaaagatgattctttggatgaaacgtcatttgattttcttcattcttttattaaaccagctttatcttttaagcaggcctacaccagctggtctaacgaagcactcacacgttttaaccagctaaaatccaatgaagaagaactcaaccgtatcttcatcgatctctatggtttgcaagatgaactaattccagaagaagatgacaaagaagtttctgttcgtaaagctgacccagttcgcgatatcaaagcattcttgtcttattttattggctgtgtcttcggtcgttattcattagatcatgatggcttaatctatgctggtggcgactgggatgattccaagtacgttacatttaagccaaataaagaaaacattattctgctaactgatcaacaatactttgatgatgatcgtgacattattgtgcgcttaaaggaattcctaaagaagacctttgatcctgaaacattaacagaaaacatggacttcatcgctcaaacactagaacctaaaaagttcgaacgtggtacaagtgcagaagatattatcagagcttacttcttgaatgatttctataaagatcatgccaagatctaccaaaagcgcccaatttattgggaatttagctcaggcagaaacaaaggcttcaaggcattaatgtatctgcatcgttacactgttgagcagctgccaatggtacgtcattatctgcatgaactacaaccggcaatgaatgatctaattgaagttaatcagaacttacttgagcaagaaacgacggctagtgcgaagagcaaatatcgtaaagcaatcgttactcttaacaagcagatgaatgagatcatgaagtatgatcagattttagatcacttgtcacagaattcagtagaccttgatctagatgatggtgtgttggttaatcatgataagttgcaacaaggtgagaagctgttgtcgaaattgtaa

SEQ ID NO: 2321 - DNA, 3537 bp, Lactobacillus helveticus
atggataagaataagattaaaaaatatgcgattaatgcaagaacagaattaattaatgctattaaagttaaactagcaactttaggcattgatgaaaatgagattcaagacaaattgtcgatttcaaccccagacaaggaatactatgttgatgataatgaagctaatgcattaaccggtgcacaaattggctggcgcaaagatattgtagcagaattaaatcgccacggatatcaagaagactctaagactgcatataaggattttgtagaagaagtagcttacacttggttcaaccgaataattgctattcgttttatggaagttaataattacttgccaagtagagtgcgggttctttctagtgaagaaggtagaaatgaacctgacattatcaatgaagcaatggaaattggtgatgatcttggtggctatagtattgaagaaaaagaactaatcactactgcattaacagaaaagactcctgaattaatggatagtttgtataccatgctatttattaagcaaagtgatgcattaagtgagattcttcctggattgtttgaagagacatctaattatttgaagttgttgttcactccacattatgatcgtggcgtcattaaagaattggttaatgaaattccagaagaatattttgatgtcaaaagggaaggacaagttcagattattggttggctttaccaatattacaatagtgcacctcatgaagaagtagtaaatatgaatggtaaagctattcaaaaagatgaaattcctgctgctacacaattgtttaccccagattggattgttagatacatggtagacaattcattgggaaaatattatcttgaaagacatcctgatagtgcagttagacaagaattaaaatatttattaccagatgaaataaaagctattaatgaaaatcaagatattattgactataaattactggataatgcaatgggatcaggtcatatcttggtatatgcatttgatcttttcatgaagatgtatattgagcaaggatattcaaagagggatgctgctcaaaaaattattgagaataatctttttggattagaaatcgataaacgtgcatttcagttagcttacttttctatcatgatgaaggggagagagtatgatcgacgctttttaagaagaagtccaactacgaatctttattattttgaagatcttcatgtatctgatgaattttataattttatttcggataaagtggttagaggcaacttaaagaaagtagttaaggatttttctgacgcaacagaattaggatcaattatcaaaattgacgaaagcattgatttggattctattgaagaagtagttgctggattagattttgaaagtggtcttgatgtttttggctataagaaaatacaaaagcagattcttaagactctaaagataattaaagtaatgactaccaaatatgaagctgttgttactaatccaccttatatgaataagttcgataaaacattgaagaaatatttgagagataattataagaattactctaaggatctgttctctgtttttatttaccataatgtacatcaattagttaaaggcggatatgcaggctatatgacacctttggtttggatgtttattaagacatatgaaccattaagacatgatattatcaataattttaagatcgatagtttaattcagatggaatattcagctttcgaagaagctacagttcctattgatacattcgtgttaaaaaattcagatgataaaattggtacttatttacgcttgagtaattttaagggcggaatgattgttcaagagcaaaaagttctagaagttattagtgatccaactgttaagtatttgtatcatactgatcaatcaaattttgataagatacctggcagtcctattgcttattgggcaagtgagaatctgattaatgattttgaaaagggaacatccttaggagaagtagttcaagcaaaagtaggattacaaactggggataataaacgttttttacgtcagtggtttgaagtaggaatagataatattagctttaattcacatagtattaaagattcagtagaatctggtaaaaagtggtttccatataataaaggtggttcatatcgtaaatggtatggaaactatgattatgtagtaaattggcaaaatgatggttatgaaataagacattttgcttggcctaatgggaagcaacgttctgttgtcagaaattcccaagtttatttcaaagaagcggttacttggtcagatattactagcggcagttttgcaatgagatttagaaaaaacggaagtattcatgatgtaacaggtatgtctatattttcattgcagaaagataaattgtatatagtattaggaattatgaattctaagataggacaatatatcttaaaaatattaaatcctacaattcacacccaaataggaaatattgttaatataccaattttattagatgttgatcataatactactttcattcttcaaagtaatcttaacatttctaaaaccgattgggatgcatttgaaacttcatgggacttccaaaaaagtccgtttctaactcaaaatgctgcatccctccaccaagcctataatagctggtccgacgaggctctaacccgcttcaaccagctcaaatccaacgaagaagaactcaaccgcatcttcatcaatctctatggcttgcaagatgaattaactccagaagaagacgacaaagaagtatctgttcgtaaagcagatcaagttcgcgacatcaaagcatttttgtcttactttatcggctgtgtctttggtcgttattcattagatcaagatggtttagtctatgctggtggcgactgggatgattcaaaatatacgacattcaagccaaactcagaaaatattattctattaactgatcgtcaatcctttgatgatgatcgtgatatcatagttcgcttgaaagaattcttgactaagacctttgaccctgaaacattgacagaaaatatggacttcattgctcaaacattagaacctaaaaagtttgaacgaggtacaagtgcagaagatattattagaacttatttcttaaatgatttctataaggatcatgctaagatctatcagaagcgtccaatttactgggaatttaattcaggtagaaataaaggtttcaaggcattgatgtatctgcagcgttacaacacagaacagcttccaatggtacgtcattatctgcatgagcttcagcctgcaatgaatgatctaattgaagttgatcagaatttgcttgatcaagaaacaacagctagtgctaaaagtaaatatcgtaaggcgattgctactcttaataagcaaatgaacgagattatgaagtatgatcagattctagaccacttatctcaagacccaattgaccttgatttggatgatggtgtacttgtcaaccatgataaattgcaacaaggcgagaagctgttatcgaagttataa

SEQ ID NO: 2322 - DNA, 3522 bp, Lactobacillus johnsonii
atggataagaataagattaaaaaatatgcgattaatgcaagaacagaattaattaatgctattaaagttaaactagcaactttaggcattgatgaaaatgagatccaagacaaattgtcgatttcaaccgcagacaaggaatactatgttgatgataatgaagctaatgcattaactggtgtacaaattggttggcgcaaagatattgtggcagaactgaatcgccatggatatcaagaagattctaagactgcatataaggattttgtagaagaagttgcttacacttggttcaaccgaataattgctattcgttttatggaagttaataattacttgccaagtagagtgcgggttctttctagtgaagagggtagaaatgaacctgacattatcaatgaagcaatggaaattagtgatgatcttggtggctatagaaatcaagaaaaagaattgatcactaccgcattaacagagaagactcctgagttaatggataatttgtataccatgctatttattaagcaatgtgatgcattaagtgagattcttcctggattgtttgaagagacatctaactatttgaagttgttgttcactccacattatgatcgcggtgtcattaaagaattaattgatgaaattccagaagaatactttgatgtcgaaaaagagggacaagttcaaattattggttggctttaccagtattacaataatgcacctcatgaaaaagtagtgaatatgaatggtaaagctattcaaaaagatgaaattcctgcggctacacagttattcactcctgattggattgtcagatatatggtagataattcattaggcaaatattatcttgaaagacactctgatagcacagttaagccagaattgaagtacttattgccagatgaaacaaaggctgttgatgaaaaccaagatattactgactataaactattggataatgcaatgggatcaggtcatattttagtatatgcatttgacttattcatgaaaatgtatattgagcaaggatattcaaagagggatgctgctcaaaaaattattgagaataatctttttggattagaaatcgataaacgtgcatttcagttagcttacttttctatcatgatgaagggtagagaatatgatcgacgcttcttaagaagaaatccaactacaaatctttattattttgaagatcttcatgtatctgatgaattttataattttatttcagataaagtggttagaaccaacttaaagaaagtagttagggatttttctgacgcaacagaattaggatcaattatcaaaattgacgaaagcattgatttggattctattgaagaagtagttgctggattagattttgaaagtggtcttgatgtttttggctataagaaaatacaaaagcagattcttaagactctaaagataattaaagtaatgactaccaaatatgaagctgttgttactaatccaccttatatgaataagttcgataaaaagctaaaaaagtatttgagggataattataaagactactctaaagatttattctctgtttttatctatcataatgtacatcaattagttaaaggcggatatgcaggctatatgacacctttggtttggatgtttattaagacatatgaaccattaagacatgatattatcaataattttaagatcgatagtttaattcagatggaatattcagcttttgaagaagctacagttcctattgatacattcgtgttgaaaaattcaaatgataaagtaggtacttatttacgcttgagtaattttaaaggtgggatgattgttcaaaaacaaaaagttctggaagctattagtgatcgcaccgttaagtacttgtatcatactgatcaattaaattttgataagatacctggtagtcctattgcttattgggtaagtaaaaagacagccaatatatttaataagtatccaattctaaaaaactatgctgagggttctgttggtattcaaacaggtgataataataaatttattagagattggtgggaagtaatatattataaaattaaatttaattccaaaaatgttaaagatacatatttagcaaaatggtttccatataataagggaggagattatagaaaatggtatggtaatgatcttacagtgatagattggaaaaatgatggtcgagatataaaagacactagtgaaaaatcaggacatcattatcaagaatattctgataatctaaaatttcgttctatgattacttggacccgtatttcaagtaatactccttcttttagatataaaaatagtggttatttgtctgatatggcgggatttagcatttatcctgattcaaagaacataatggaaatattaggattgtgtaattcaaaagtttcattatattttttagaatttctttcacctacaataaattatatgttgggacaggtattatctttagtttttataaaaagtaataaaattcctactgaattaattgaaaacaatgtaaaaatttccacacaagactgggatgctttcgaaacatcatgggacttccaaaaaagtccgcttctaactcaaaatgctgcatccctccaccaagcatacaccagctggtccgatgaagcactgacacgttttaaccaactcaaatctaacgaagaagaactcaatcgtatctttattaatctttatggcttacaagatgaattaactccagaagaagatgataaagaagtatccgttcgtaaagcagatcaagttcgcgacatcaaagcatttttgtcttactttatcggctgtgtctttggtcgttattcattagatcaagatggtttagtctatgctggtggcgactgggatggttcaaaatatacgacattcaagcctaacaaagaaaacattattctgttaactgatcgtcagtatttcgatgatgatcgtgatattattgtccgtttgaaagaattcctaactaagacctttgaccctgaaacattgacagaaaatatggacttcattgctcaaacattagaacctaaaaagtttgaacggggtgcaagtgcagaagatattattagaaattatttcttgaatgacttctataaggatcatgctaagatctatcagaagcgtccaatttactgggaatttaattcaggcagaaataaaggcttcaaggcattgatgtatctgcatcgttacaacacagaacagcttccaatggtacgtcattatctgcatgagcttcagcctgcaatgaatgatctaattgaagttgatcagaacttgctcgatcaagaaacaacggctagtgctaagagtaaatatcgtaaggcgattgctactcttaataagcagatgaatgaaatcatgaaatatgaccaaattctaggtcacttgtcacaaagtccaatcgaccttgatttcgatgatggtgtactggtcaatcatgataaattgcaacaaggtgagaagttgctgtcgaagtcataa

SEQ ID NO: 2323 - DNA, 3612 bp, Lactobacillus reuteri
atggataagacaaagataaagaattttgctgttaatgcacgtaaagaattaatagatagtgttcggcaacgattggcaaactttgggattgataaaacaggaatagccgatgagctaccaatttccaccgcaactgttaagtactatactaatgaacacttcccattaaaggggaaggcgattgactggcgtaagcaaatagttagtcgaattaaacaggataccaaccagaaatgggatgaaaaactgaatcaatttatcgatgaagttgcttatacctggttcaaccggatcattgccatccgttttatggaggtaaatgattacctacctagtaggacacgagttctttcaagtgaagagggcagaatagagcccgatatgataacccatgctctggaaattgaggatgatttgggtggctatagtgataaagaacgtacgcagattacagatgctctaatgagtcataatcctactcaattggataaggtattcgggatgctgtttatcaagcagacagatgaattatcgaatttgctaccaggtttgtttgaaaaaacttctgactatatgaaattattgtttgtacctaactacagcaatggagttattaaagaactagttgatgaaattccagaagaagactttgatgtatcaaagtctggccaagtgaccattattggctggttatatcaggactataatactgaacctaagaatgatgcttttaaaaagaaaaaatttgcagcagaggatattcccgcagcaacacaattatttactccagattggatagttaagtatttggttgaaaattcgcttggtcgctattggataaagatgcttcaaagtcgtggtgatactcgcacggagtcggaaatagctcaaaaatatggttgggtatatttctgtccatcagatgatagcgataaggaaatagtattggtaaaaaaacaagtagaagagcttaaatttatagatccagcaatgggatctgggcatatattagtttatgcctttgatatcttaatgcaaatctataggtcggaaggttacagtgataggcaatctgtaagatcaattcttaccaacaatctatttggcttagaaatagacgatcgggcttaccagcttgcgtacttttcattaatgatgaaagcacgagaatttgatcgcagagtgttaactcgtaatttgaatttgaatattatgccagttccagttgcaagccgaatgaatcaacaatatgttaaggacattaatataacaagtaaccaaaagttaattttggataaggttgtagacttatttagatatggtaatgaatatgggtcagcaatagtcctaccccaaggcctcaatgaaaatgaagtacttactcagcttgaaaaaagagaagagacctttattggccaattaggtttaaatgatgttgctgaaatggatcagataagtagtttaagaaaaataataaaggcaactaagcttctatcgtccgaatatgatgtcggggttactaatccaccgtatatgggcttaagacggatggatgacaacctgaagaagtatataaaaaaacaatacccgtctcataatcaagacatgtttagtgtgttcatgagagttatgagtcggctagtaactaatggtcatggttatattgggatgatcacccaacattcgtggatgtttataaagacctttgagaaaactagaaagtatcttaatttgaatcagacaattattaacatggcacatttaggtgcaagggctttcggtgatattagtggtgaagtggttcaaacgacagcgtttattctacttaacaaacctgctaaaaattatgttggatcttatgaacggttagtaggtgggtcatctgaagaagacaaaaaacgtctgtatttagaatgcattaagtatcctaatagctccagtatgtatagaattagtcaacacagttttgataagatccctggttctcctatagcgtattgggctcctcaagcattaattaatgactttgaaaagggtaaaccattaggacagctcgttgatgctaaagtaggccttcaaacaggtaataataagcgtttcttacgctactggtatgaagttgattttaataatatcttttttgatgctcataatactgcagaagctaagcagtctgggaaaaaatggttcccatataataagggcggctcttaccgtaaatggtatgggaattatgactatgtggtaaattggcagaatgatggttatgagattaaacattttactgattcaagaggaaaagtacggtcgagaccccaaaataccgattattatttcaaaaatgcaattacttggccattaattaccagtggtaattttagtatgcgttttagaacattcggtagtatacatgatgttgctggtatgtctgcatttagcgacaaccctaatacattaaagcttatattaggattaggaaattcatccattatgaaacaattagtgggtttattaaatccaactattaattaccaaattggtgacattgaacgaatcccggtacttcatatggacaagactactgaaagcgcggtaattcagcaggtggatcatgctattagcttaagtaaacatgactgggatcaacaggaagaatcttgggattatggaatgccttctgtaattcagtacgaaggttcaaatctagaacaatcattgaatacttggctaagtgatcttcagtccagatactattccatgaagaacacagaacagaatatcaatggtatttttaatcgtttgtatgggttagaccaaactgaggatagtatagaatctccaatttctgttagattacctgaatctcgcgagactacagtttttgcggtcaattcactattgtcttacttcattggctgcgtatttgggcgttactccttagataaactcggattagcgtatgcaggcggtaattggaatgaatcggtatatggtagctttaaacctaatcaggataaccttattttgctaacggatcgtgattactttggggatgaacgagacatcattaaccgcttgaaggaatttctacgtattacctttgccccttcgtccttaaacgataatctacattttattgccaaaacacttgatcctaaaaagtctgaacgaggtgaaagtgatgagcagattattcgtaactatttcctcaatgatttttataaggatcatgataaaacgtatcataagcggcctatttactggcagtttaatagcggtcgtaacgatgggtttaaggccttgatgtacttacatcgatataataaagacgaattggcaatggttcgtaactacttacacgacttgcaagctgcatatagtaacaccattaaatttaacgatgaacaggaaacgaagtcctcgacagcacgcgagaagaatcagtatcgtaaagatacagttaagctaaataaaaaggtaactgaggttattaaatatgatgaagcacttcaacaccaagcgttagctcaggtttccattgacctagatgatggtgttgttgttaaccatgctaaggttcaaggtaacgaagaattgttctctaaattgtag

SEQ ID NO: 2324 - DNA, 2220 bp, Lactobacillus rhamnosus
ttgttcactccaagctattcggttggggtcattcgtgatcttgtggatgatattcgtgaagatgattttgacgtggacaagggcggtcaggttgagattattgggtggctgtatcagtattacaataccgagcccaaagacagtgcctttaagaaaaagaagtatttgacttctgatattcccccagtgacgcaactttttacgccagactggatcgtcaagtaccttgttgagaactcccttgggcgatactggatacgcgttcttcttgaacgaggagataagcgtacttctgctgagattgctgaatcatttggatggcactattttatgccagatgttaagcagaatgattcaacgccttatcccaacatggccaaaaaacgaattgaagacattacttttgttgacccagcaatgggatcaggacatattctgatctatgcatttgatgtcttcttgcaaatttatcaagcagaaggctattcgcgtcgtgaggcagctcaaaagattgttaaagacaatctttttgggtttgatattgaccgacgtgcatttcaactagcctattttgccatgataatgaaattgcgtcgtgaaaatagacggacttttgatcttcatttaaaacccaatatttttgaggtcccaactacggccttaactccagatgatttttctgagactataaatgcaagtaaaacggacaacgaacagttgaaagagtttttaacaaagttcaacaaaggtaaagaactcgggtcgctgatagatttcaacgccgatatctttaaaaatgccctgattaatgagatcattcataaccagtttactggacagctcacgttcgatacgtcaaaccaactagcacatcgacatgagttaaagagcctggttcgggtggggatgggtttaagcagtaaatatacaatcagtgtgactaatcctccctacatgggttctggcaagatgccaaaacctctttcagattttgtcggaaaaaaatatccggcaagtaagtctgatttatttgcagtcttcatagagcggctccagcatatgacaaagcaagatggcttttttgccatgattacccagcaccaatggatgtttctttcaagctttaaatccttacgtgaacggatgattaactggccgattataaatatggcacacttagggacacgtgcatttgaagaaattggtggagaggttgttcaaacaacggcctttattattcaaaagcaagcgagttcaaactttagcggcacttatgagcggctggtcgattttgattcacaggcacataaggaaaaagcttatcttgctgccgttaaagatccaaatcttaagtatgtttatcgtactaaacaagcgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggcttcgaaatacggaacttaaaagatgcaaaaggtaaactgcgatctcggccacaaaacacaaattattacttccgtgaagcgattacgtggtctgatgtaactagtggacacttcagcatgaggtatagagagtccggctcgatcttcgatgtggtaggaatgtcactcttctcattaaaaagagacattttagaaaaaatacttgcgttttccaatactaaagtgatgaactttattatgtctttgctaaatccgacgatacatgcgagcattggttatgtcagcttaatgccgataatctcttcccaagatcctagagtgaacagtctgtcaaaagaaagcgttgacgttacgagaaatgattgggatacattcgagaactcgtggaacttttcaaagtctccattggtcgaatatatcgctgagcatcagaaatcacctccagcaaaattcttgaccttatttgagttttgtggcaaatatgtgccaattcagtttaggaggttgatttttcatggtaagttatcaaaaacgaggtaa

SEQ ID NO: 2325 - DNA, 3558 bp, Lactobacillus rhamnosus
atggataaaaaggcaatcaagacatttgcgattcaagctagacgtgatctgattaaaagtatcaggttaaagatggagaatcttggtattaatgaaaatggtgttgaggagaaatcagcggcatcaaccagtgagattgaatattatggtgataaggggctatttatcagtggccaagatattaagcgtcgccgtgatttggtttctcggcttaaaacaatggccaagcaggaagaatggcgggacgcattttcagacctcatcgaagaagttgcgtatacatggtttaatcgaattattgccattcgatttatggaagtaaatgattacctcccgagtggcgttcgagtgctgtcatcgggaacaaaacttaaagtacctgatatcctgcgcgaagcttttaatattgaagatgagttaggtggttatagctcggatgagcgtgcaatcatccagaaagcccttgataccgaagagccgtccgacatggatgctgcgtacgtcattctgtttaccaagcaagcgaacgcgctaaatcaatatctccctgaacttttcgaaaaaacagacgatttcatgcaattattgttcactccaagctattcggttggggtcattcgtgatcttgtggatgatattcgtgaagatgattttgatgtagacaagggtggtcaggttgagattattgggtggctgtatcagtattacaacattgaaccgcacgataaagtagtcaacatcaatggtggtcccatcaagacaaacgacatccctgccgccacccaactgtttacgacggactgggttgtccggtacatggttgacaattcactaggccgcttataccttgaatattttcctgactcgcccattaaggaagctttaacctatttactgccagggcctatcgaaaaacgaactgatgaatttgacatcaccaagttaaaaattttagatgacgcaatgggatctggtcatatcttggtctatgcttttgatttgctaatcaagatgtacatcgaacaaggctatggtcaacgtgaggccgcaagtgcgattttggcacataatttgtatggtctagagatcgacaagcgcgcttatcaattggcttactttgctttaatgatgaaagctcggcagtatagtcggcgcatcttaaacgagtcagtccaccataatctgcatgtgttcgaaacagtcgatgatgtgccaaacgaggctttcgaaaagatgaaagctcctaaagaggtcattgacgatttaaaactgcttgccgcgacttttaaacaagccaaactactcggttcaattatgcacttcgacaaacaatttgattttgataagcttgttagtgcagtaaattccttgccagagtccacacaactggatttatttgggcttcaatcagctaaagatagtcttcacaatatcctaaagatcgctcaaatcctgcagactaaatttgatgtggtggcaactaatccaccatacctaaatcgcatgaatggcgatctcaagaagtatgtgaagaaattctacaaaccttattcaggggatcttttctcagttttcatttggaagaatattgagatgaccgcaacaaacggatatgcagcttatatgacgccgtttgtttggatgttcattaaaacctatgaaggacttagaaaagccatcttgaacacgaagcagatttccactttgattcaaatggaatattcagcctttgaagaagcaacagttcctattaacacctttgttttgaagaataaatcagatagtgaggcagaaggcacatacctgaagctttcagacttcaaaggcggtatggatgtgcagaaaaagtacgttttaaaggctgtttctgatccatcggttggatatctatatcgtactaaacaaacgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggttttgaaataaagcattttacctttgcaaatggcaagcaacgttcagttattcggaactctaattattacttccgtgaagcgattacgtggtcaaaaatatctagcggaaagatatcctttcgacatgttcctgtcggctcattgtttgatgttgcggggacaagcttattttcgaatgaaccttataaattagagatattgttagggttcttaaactcaaatactgcaatggatatattggcctttctatccccaacactgaactatgagattggacaaattgccgcgttaccagtgcttcccaacaaaagagaatttctagttcgtaatttgacgagggataatgaacaaatctctaagagtgactggaatgtttcagaagtttcttgggatttttggtatttcccatttgttgaatacatcgctgagcatcatcgaaattggacaattgaagctgcgtttaatcagtggaaggaagaagctgataaacgttttaaccaactgaaggcaaatgaagaagaattaaaccgaatcttcattgatctttacgggttacaggatgaacttagtcctgaagaagaagataaagatgtgtctgtcaggcgtgccgatctgtcgcgtgatataaaagcgtttatgtcgtactttgttggttgcgtttttggtagatactcgattgatacacctggactggcctatgcaggtggtgactgggatgatagcaactacaagacctttcttccgaatgaagatgacgtaattgtcttaactgatgacgattattttggagataatcgagacgttgtaaatcgtttcaaagaattcttgtctgccacgtttggaaccgaacatctcgatgaaaacgtgcagttcattgcagacgcattaggcaagcgagggagcagttccgaagagataatacgcgcctatcttcgagacgatttctttaagaaagatcatttgtcgacgtatcagaagcggccgatctattgggaacttaattctggccggaacggcggttttaaagccttaatgtaccttcatcgatatgacaagaataccatggcgatgattcgaacaaagtatcttcacccgttgcaagaagcttacgagcgtcgacttgatcaattgaagagcttcgaagcgaatgaacagcaaactcggcaaaagaatgctatcaaaaagcagattacaacgatcaccaagcaacttgacgagctagttaagtatgatgaaaagttgcaacatgttgcgaatttgcatatagatcttgacttagatgatggggtcttggtaaatcacgcaaaggcacaggcggacacaaagatctttacgccacttaaatga

SEQ ID NO: 2326 - DNA, 2223 bp, Lactobacillus rhamnosus
ttgttcactccaagctattcggttggggtcattcgtgatcttgtggatgatattcgtgaagatgattttgacgtggacaagggcggtcaggttgagattattgggtggctgtatcagtattacaataccgagcccaaagacagtgcctttaagaaaaagaagtatttgacttctgatattcccccagtgacgcaactttttacgccagactggatcgtcaagtaccttgttgagaactcccttgggcgatactggatacgcgttcttcttgaacgaggagataagcgtacttctgctgagattgctgaatcatttggatggcactattttatgccagatgttaagcagaatgattcaacgccttatcccaacatggccaaaaaacgaattgaagacattacttttgttgacccagcaatgggatcaggacatattctgatctatgcatttgatgtcttcttgcaaatttatcaagcagaaggctattcgcgtcgtgaggcagctcaaaagattgttaaagacaatctttttgggtttgatattgaccgacgtgcatttcaactagcctattttgccatgataatgaaattgcgtcgtgaaaatagacggacttttgatcttcatttaaaacccaatatttttgaggtcccaactacggccttaactccagatgatttttctgagactataaatgcaagtaaaacggacaacgaacagttgaaagagtttttaacaaagttcaacaaaggtaaagaactcgggtcgctgatagatttcaacgccgatatctttaaaaatgccctgattaatgagatcattcataaccagtttactggacagctcacgttcgatacgtcaaaccaactagcacatcgacatgagttaaagagcctggttcgggtggggatgggtttaagcagtaaatatacaatcagtgtgactaatcctccctacatgggttctggcaagatgccaaaacctctttcagattttgtcggaaaaaaatatccggcaagtaagtctgatttatttgcagtcttcatagagcggctccagcatatgacaaagcaagatggcttttttgccatgattacccagcaccaatggatgtttctttcaagctttaaatccttacgtgaacggatgattaactggccgattataaatatggcacacttagggacacgtgcatttgaagaaattggtggagaggttgttcaaacaacggcctttattattcaaaagcaagcgagttcaaactttagcggcacttatgagcggctggtcgattttgattcacaggcacataaggaaaaagcttatcttgctgccgttaaagatccaaatcttaagtatgtttatcgtactaaacaagcgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggcttcgaaatacggaacttaaaagatgcaaaaggtaaactgcgatctcggccacaaaacacaaattattacttccgtgaagcgattacgtggtcaaaaatatctagcggaaagatatcctttcgacatgttcctgtcggctcattgtttgatgttgcggggacaagcttattttcgaatgaaccttataaattagagatattgttagggttcttaaactcaaatactgcaatggatatattggcctttctatccccaacactgaactatgagattggacaaattgccgcgttaccagtgcttcccaacaaaagagaatttctagttcgtaatttgacgagggataatgaacaaatctctaagagtgactggaatgtttcagaagtttcttgggatttttggtatttcccatttgttgaatacatcgctgagcatcagaaatcacctccagcaaaattcttgaccttatttgagttttgtggcaaatatgtgccaattcagtttaggaggttgatttttcatggtaagttatcaaaaacgaggtaa

SEQ ID NO: 2327 - DNA, 3555 bp, Lactobacillus rhamnosus
atggataaaaaggcaatcaagacatttgcgattcaagctagacgtgatctgattaaaagtatcaggttaaagatggagaatcttggtattaatgaaaatggtgttgaggagaaatcagcggcatcaaccagtgagattgaatattatggtgataaggggctatttatcagtggccaagatattaagcgtcgccgtgatttggtttctcggcttaaaacaatggccaagcaggaagaatggcgggacgcattttcagacctcatcgaagaagttgcgtatacatggtttaatcgaattattgccattcgatttatggaagtaaatgattacctcccgagtggcgttcgagtgctgtcatcgggaacaaaacttaaagtacctgatatcctgcgcgaagcttttaatattgaagatgagttaggtggttatagctcggatgagcgtgcaatcatccagaaagcccttgataccgaagagccgtccgacatggatgctgcgtacgtcattctgtttaccaagcaagcgaacgcgctaaatcaatatctccctgaacttttcgaaaaaacagacgatttcatgcaattattgttcactccaagctattcggttggggtcattcgtgatcttgtggatgatattcgtgaagatgattttgatgtagacaagggtggtcaggttgagattattgggtggctgtatcagtattacaacattgaaccgcacgataaagtagtcaacatcaatggtggtcccatcaagacaaacgacatccctgccgccacccaactgtttacgacggactgggttgtccggtacatggttgacaattcactaggccgcttataccttgaatattttcctgactcgcccattaaggaagctttaacctatttactgccagggcctatcgaaaaacgaactgatgaatttgacatcaccaagttaaaaattttagatgacgcaatgggatctggtcatatcttggtctatgcttttgatttgctaatcaagatgtacatcgaacaaggctatggtcaacgtgaggccgcaagtgcgattttggcacataatttgtatggtctagagatcgacaagcgcgcttatcaattggcttactttgctttaatgatgaaagctcggcagtatagtcggcgcatcttaaacgagtcagtccaccataatctgcatgtgttcgaaacagtcgatgatgtgccaaacgaggctttcgaaaagatgaaagctcctaaagaggtcattgacgatttaaaactgcttgccgcgacttttaaacaagccaaactactcggttcaattatgcacttcgacaaacaatttgattttgataagcttgttagtgcagtaaattccttgccagagtccacacaactggatttatttgggcttcaatcagctaaagatagtcttcacaatatcctaaagatcgctcaaatcctgcagactaaatttgatgtggtggcaactaatccaccatacctaaatcgcatgaatggcgatctcaagaagtatgtgaagaaattctacaaaccttattcaggggatcttttctcagttttcatttggaagaatattgagatgaccgcaacaaacggatatgcagcttatatgacgccgtttgtttggatgttcattaaaacctatgaaggacttagaaaagccatcttgaacacgaagcagatttccactttgattcaaatggaatattcagcctttgaagaagcaacagttcctattaacacctttgttttgaagaataaatcagatagtgaggcagaaggcacatacctgaagctttcagacttcaaaggcggtatggatgtgcagaaaaagtacgttttaaaggctgtttctgatccatcggttggatatctatatcgtactaaacaaacgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggttttgaaataaagcattttacctttgcaaatggcaagcaacgttcagttattcggaactctaattattacttccgtgaagcgattacgtggtctgatgtaactagtggacacttcagcatgaggtatagagagtccggctcgatcttcgatgtggtaggaatgtcactcttctcattaaaaagagacattttagaaaaaatacttgcgttttccaatactaaagtgatgaactttattatgtctttgctaaatccgacgatacatgcgagcattggttatgtcagcttaatgccgataatctcttcccaagatcctagagtgaacagtctgtcaaaagaaagcgttgacgttacgagaaatgattgggatacattcgagaactcgtggaacttttcaaagtctccattggtcgaatatatcgctgagcatcatcgaaattggacaattgaagctgcgtttaatcagtggaaggaagaagctgataaacgttttaaccaactgaaggcaaatgaagaagaattaaaccgaatcttcattgatctttacgggttacaggatgaacttagtcctgaagaagaagataaagatgtgtctgtcaggcgtgccgatctgtcgcgtgatataaaagcgtttatgtcgtactttgttggttgcgtttttggtagatactcgattgatacacctggactggcctatgcaggtggtgactgggatgatagcaactacaagacctttcttccgaatgaagatgacgtaattgtcttaactgatgacgattattttggagataatcgagacgttgtaaatcgtttcaaagaattcttgtctgccacgtttggaaccgaacatctcgatgaaaacgtgcagttcattgcagacgcattaggcaagcgagggagcagttccgaagagataatacgcgcctatcttcgagacgatttctttaagaaagatcatttgtcgacgtatcagaagcggccgatctattgggaacttaattctggccggaacggcggttttaaagccttaatgtaccttcatcgatatgacaagaataccatggcgatgattcgaacaaagtatcttcacccgttgcaagaagcttacgagcgtcgacttgatcaattgaagagcttcgaagcgaatgaacagcaaactcggcaaaagaatgctatcaaaaagcagattacaacgatcaccaagcaacttgacgagctagttaagtatgatgaaaagttgcaacatgttgcgaatttgcatatagatcttgacttagatgatggggtcttggtaaatcacgcaaaggcacaggcggacacaaagatctttacgccacttaaatga

SEQ ID NO: 2328 - DNA, 2157 bp, Leuconostoc kimchii
ttgattgatggtattcctgagagtgattttgatgtgcaacttgaaggccaagttgaaattattggctggctctaccagtactataatgaagagtcgaaagataaagctatcggtcaacctaaatctcataagtttcgagatgttgaaatagcttcagtaacacaaatttttactccagattggatcgttaagtatatggtccaaaattcagtgggtaaatactggatgaacgttcttaaaactcgtccttcctttacaagtgagaaggaaatcgctcaaaatttcggttgggaatattacatggaagatgcagatcaacccatcgatgttgaaaccaatctttctgttgagaacgatatcttgaacaaagatattcagaaactaaaagtgctagatccatcaatgggaagtggacacattttagtgtatgcgtttgacttgttaatggatatttatcaatcggaaggctattcaaagaatgaagccgcaacatctattttaaataataatttatttgggatggatattgatagacgagcattccaattggcttatttcgctttgatgatgaaatacaggcaatatgtccgacgtgggttgtctgatgaaaattctgcccacgtttacgatattccaagcacttctggttttgatgctttggattttgctgcaattgaagaaacattcagcaatccggttgcattagaaattaaaaaagtactaaacaggtttgaacatggggatgaacaggggtcacttttaaacactgatgatatcgatttcaatgtgattgaagacgcattggcagatttgaaaaacagttctatccctcttgatttaattaacgtaattgatacgctggaaaactcattggtagttgggcaaacgttatcagctatgtacgaggtagtgatcacaaatcctccgtatatgggatcttctagaatgaatagttccctatctgattttgccaagaagcaatttccaaattcgaaatcagatttattcgcaatgttcatggagcattataatggacgtatcgtaaaaaatggttacaatgctatggtaactatgcagtcttggatgtttttatctagttttgaaactatgagaacgtaccttttggaaaaattcacaatttcaaatttgatgcacatggaaaacaacgttatgggtattgcgtttggtacagccgttacgattgttcgaaatgtgaaccttcccacctttgttggaacgtatcatcaaataaaaacttctgatgcttcgggtaaagtgccaaaaaatttacctgtttatggtaataggtataatcgaactaaccaagcgaattttaagaagattcctggtagtccgattgcgtattgggtaagtgctaatttgattcatgactttgaagttggcactagaatggacaaaatagtagaacctcgtcaaggtcttgcaactgcagataataacagatttttgcgccagtggtttgaagtttcattaaacaatattaagtttgacgctaaatcaatcgatgaatcgatctcatcaaacaaaaaatggtttccatataacaaaggtggttcctatcgtaaatggtacggcaactatgattatgttgttaattgggagaataacggtgccaaaattcgtaattttacagatgccaaaggaaaagtcagatcccgtccacaaaacacaaattattacttccgtgaagcaataacctggtcggatgtgaatagtggtcatttttcgttgcgatatcgcgaatttggatcgatacacgatgttaaagggatgtctgcttttagtacagataaatcagtttttgaatatatattgtcattattaaattcacccgttggggaatacattttcaaaatgctgaatccaactattagtttgcaaataggaaacttccaaacttttcctgttttaggaatccatgctgattcaacggctattaaagcatttgctcatcgcaatattagtctcagtcgcaatgattgggactcattcgagatatcttggaactttaaaatgcatccgttgattcgtcatatcgatgaacataatcgaaattggaatatcacccctatacttaaccactgtaatgtgccaaacttgagccaaaaaatatttttggaggtcaactatggttag

SEQ ID NO: 2329 - DNA, 3552 bp, Leuconostoc kimchii
atggacaaacgggcaataaataattttgccgttaaagcacgtcgtgacttgattcgtgatattacgaataagctagggctacttggtattgatgaagatggcattcaagaaaaacgtgcggaatcaacagctgaaatcgagtattatggtgagttggcttacgagattagtggtgatgatatcaggttacgccgtgaactagtgagccacttaaagtcacgtgtagctgaggattggaatacgttgcttcaggactttattgaagaggtagcatatacctggttcaatcgaattattgcgattcgatttatggaagttaatgactatttaccatctaaaacacgagttctatcatctgaaaatgggcgtacagagcctgatattttgacagaagcgtttgatattgaagacgatttgcgcggatttaacagcaatcaacgtgctttgttagctaaagcacttgatactgaaattccagaagacttggataaggcgtatacaatgctattcattaagcaagctaatgcattgaatgacaatttgccttatctgtttgagcgtaccagtgattacatgcaattattgttcacccccagctatcacgatggggtcattaaggacttgattgatggtattccagagagtgactttgatgtgcagcttgaaggtcaagttgaaattattggctggctctaccagtactataatgaagaacctcataatgcagtagtaaatataaatggaggtactgtcaaaactaatgacatacctgcagccacacaactatttactactgactgggttgttcgatatatggttgataactcattgggaaaatattatcttgaacgtaatgctcattcagagttaggaactcatctagaatttttacttcctgatagcttggagatggtttctgatgatttagacgttacccaaattaaagtaattgataacgcaatgggttcaggacacattctcgtgtacgcatttgatgttttgatgaagatgtatgctgagcaagggtattcgtctcgcgaagcatcaagcctaattcttgaaaacaatttatttggattggaaatagataaacgcgcttatcaactggcttactttgcacttatgatgaaagctcgcgagtataatcgtcgagctttaacttcgaatatttcaccaaaggtttatgtttttgaggacacttcaaacatcaatgacaactatttcgaaagtctacctgtgtctgaatctaacattcaagatttgaaatacattgtgtctcttttccatgattcacgtacgctaggatcaatcattcaaatcgataaacctgtaaaaacaggtaatttgcgaacagttctaactaacattccacaggacacttcgctagacttaaacaacactcgtgaaattacttatcaactattgcgtctgttagacatagttgaaacaatgcaaaataagtacgaagcagtcatcacgaacccgccatatctaaacaaaatgaacaaggtcctgaaagaatatgtgaaaacgcattataaagattattcaagtgatttgttttccgtttttatttggcacaacatcaacatgacagtgaccaacggatatgccgcatatatgactccatttgtatggatgttcataaagagttacgagaatttgcgaaagtcaattttgaacactaaactaatttctagcctgattcaaatggagtattctgcctttgaagaagctacagttcctatcaatacgtttgttttaaaaaattcaagcacatcggaaaatggtgtgtatattaaattgtctgactttaaaggtggcatggacgttcaaaaagtgaaaacattagaagcgattgaaaatcccgatgttgattatctatatcgaactaaccaatcgaatttcaataaaattccgggtagtcctattgcctattgggcttcagataatttgttaagagattttgagattggtcaacaaatggatacattagtcgaaccgagagttggattgcaaactggcgataattcggtatttttacgtcaatggtttgaagttagttacgctaaaattgcggtcgatgctaaaaacatccccgaatcggtctcatcaaacaaaaaatggttcccttacaacaaagggggggcatatcgaaagtggtacggaaactatgactatgtagttaattgggagaatgatggccaagacattaagaattttaaatttccaaacggcaagcaacgttccgttgttcgaaatcctaattattacttccgtgaagcaataacctggtctctaattacttcgggtggattcagcataagatataggagcgctggtagtatacatgatgtttcggggatgtctgcattctcatcaagtcatgataagttaatgaacattcttggcctgatgaacactccaatcggaaatcatgtgtttaaaatgttaaatccaaccatcaatttgcaaattggtgactttaatagtttcccagtccttgataaggctattgataatcctgaaataaatgagaaggtgactggagcagtcgcaatttctaaaaatgattgggactcattcgagacatcttggaactttaaaatgcacccattgatacgtcatatcgatgaacataatcgaaattggaaccttaaagaagcttttgaagtgtggaaaagtgaaacacaagatagatttgatcaattgaaggacaatgaagaagaattaaaccgtatttttattgatttatatggtctgcaagacgaattgacaccagacgtagcgaacaaggatgtttccgtgcgcttagcagacgaggttcgtgatataaagtcgttcttatcatatttcgtgggacttgtatttggacgttattctttggatgtgccgggattgatttatgctggtggcgattggaattctgatcaatacaagtctttccaacctaataaggataatgttctgattttgtctgatgatgcatactttaatgattctcgggacattatcaatcgtttgaaagagttcttgagagttgcatttggaaatgagaatgttcaggcaaatctagaatatatcgctcaaattgtcggcaaaggtggcggcaccgcggaagaaaagattcggcaatacttcatcaaagatttttatgcagatcatgtctctgtgtactcaaagaggcccatctactgggaatataactctggaaagaaagaagggttacgagcattgatgtatgttcaccgttatgatgccgacacaacaggaatgataaggacggactatttgttgccacttcaggaagcctatgaaaacgcactggccaatttcgaatcacttgttgaatcagaaacagtagcaaagattcgtaaggtttacgaaaagaaagtaactcgtttaacaaatcaaattgatgaaatgaaaatgtttgatcaagtattgcaacacttagcgacggcacgaattgaaattgatttagatgatggtgtggtcgaaaatcatgtaaagatccaagacggacaaaagttgttaacaaaaataaaatag

SEQ ID NO: 2330 - DNA, 3117 bp, Methanobrevibacter smithii
ttgaaagatgaaaataaattagatgaattattccgatttttatttattaagcaaagtaataaattaaatgaaattctcccaggtttatttaaaacaacagatgattctttagagttactgttaaatatttcatttacaagtgaagaaggtgttgtaagacaattaattgacacaattccagaagaggacttcacaaaacaggttgaaattattggttggttatatcagtattatatttcagagaaaaaaaatcaagtaattaacattaacaaaagcaatattaaaaaagaggatattcctgctgctactcagttatttacaactgattgggttgttaaatatatggttgataactctttaggtagatattggatagaaagaaatccaaacagttcattaaaagaacatttagaatattatcttggagaagcacaacaagatgaagaaactcaaagcaaacttgatgaaataagatctgagaatatttctgttgaagaattaacattctttgatccatgtatgggatctggacacattctagtttatgcattcgatctattttttgaaatttataaagagttaggttatttagaacgagatattcctgaattaattttaaaaaataatatttttggtttggatattgatgatagagcatatcaactagcttattttgcagtgttaatgaaagctagaaaatatgatagaaaaatacttcaaaaaggtattgttcctaatgtttatgctattcaggaatctggaaatatcactgattcaataattgagtttatacaaaaacatgatgaaaaaattgttaatgatgtaatttatttaaaagaaatatttgagtctggaaaagaatttggttctttaattcaagtgaaaaatattgattttaacaacttaagaacatcattaaatgaaataattgataattctaaatcaacactcactgatatcaatattacaaatataattagtaatgatttaatggctttaattaatcaagcagaattattatctaaaaaatattcagctgtagtgactaatcctccttacatgaataaatttgagaaaaatttaaaagattttgctaaaaaatactacaaagattattcaaaagatttattttccatgtttatttatagaaacactaaattcacaaaatcaaatgcatatttaggatttattactccttttaattggatgttcataaaaacttatgaaaaattaagagaatacattttgaaaaatcttgaaatttcttcattaattcaactagaatataatgcatttacagaagttgcaatggtcccagtagcaacatatatcttttgtaatgaaaataaaactaatggtttatacaatggaatatatataaaattatctaattttaaaggaaacatggatacacaaagaaataaagttttaaaagccatatctaatcctgttgattacaaatatatctcaaatagtaaaaaatattctaacattccaacttcccctatagcttattgggctagtttaaatgttacaaattcatttaaaaataaaaaattaattgaatatgcatatccaaaagcaggaatttccactggaaataatgataaatttttaagaaaatggtttgaagtggaattcaataatataaattttaattgtaattctatggaagaaaccaaaaatgttaaagaaaaatggtttccttacaataaaggagggaagtttagaaaatggtttggaaataatgaattaataattaattggaaaaataatggatataaaatacgtaattttaaacattcaacaataagaaatccaaaatttcattttaaaaaatcattaacatggtctacattaagtagtagtgatatctcttttagatataatgaacaaggatttttatttgattcaaaaggagcaaactgcattataaaaaatgaaatttactttaattatttatttgcattattaaattcaaaagtaacaatggaagtattatcctttttatccccaacgttagattttggaataggatcaattagtaatatacccatcatacttgataattcaaatttaaataaaatcaacaaaattgtatccgaaaatataatcattcaaaaaaataactgggataatcatgaaataagttggaattatacaatccatcctcttttaatatttggtgaaagaaaaattgaaaaatcaattgtaaaatttaataagttacaaaaagttgattttaataaattgaaaagcaatgaagaatatttaaataaatactttataaaactatacaagttaaccaatgaattagattataatatatccaaagattcaatttcaatgaatctgttatcaaagaatgatttaattacatcttttatatcttttgcagtaggatgcatgtttggacgttactcactagataaaaaaggactacaattcgctggaggtaaatttaacatcactaactacaataaatttattccagatgatgacaacataattccagttttagacactgcgtatttcgatgatgatattgtaggatattttactaaatttgttgaaacctgttttggtaaaaaaaccctagaagaaaacttagatttcattgcaggagcactatcaaaatcaaaaaaaccatcaagagaaatcataagacaatacttacttaaaaacttctttaacgaccacaaaaggacatacaaaaaatgcccaatatactggcaattctcaagcggcaaacataacggtttcaactgtttagtttatatgcacagatacgaaccatcattagttgcaagaatcagaacagactacttacataaaacccaaaaagcaatagaacagaaaataaccaataatgacaatatcattaacaattctacatcaaaacaagaagtaacccgtgcaactaaagaaaaagctaaacttcaaaaacaattaaaagaaacacaagaatatgatgaagttctagcacacattgcaaaccaaaatattgaaatagatttagatgatggtgttaaagtaaactatgcaaaattccaaaatattgaaattaaaaaagaaggttccaaaaccaaaaagataaaccttcttaaaaagatttaa

SEQ ID NO: 2331 - DNA, 435 bp, Methanobrevibacter smithii
atggataaaactattttaaagaattttgcggtaaattcaagaaataaacttattgaagatacaatttatagattaagtctacttggaataactgaagatgaaattcaagaccctattgaagctgatgggatgcaaacattccaaataggtggcacaaattttagtatttatgatgatgacataaataaacgaaaagagattattgaagatattgaatctaaaggtttcaataattttgttgaagaagttgcatacacatggtttaatcgtataatagctattcgttatatggaagtgaataattatctaccaactaaaacaagagttttatccagtgaaacagcaggtaaaatagaaccagatattttaacagatgcattagatattgatttagattacactcaagaagaaaaagaattaattttcaagttgtaa

SEQ ID NO: 2332 - DNA, 1941 bp, Methanobrevibacter smithii
atgaccccctttgtatggatgtttattaaaaactatgagaatctaaggaaatttatcattaacaataaatcaatttcatcattaattcaattagaatactcagcattttcagaagctactgtaccaatatgtacttttgtattatctaattttgatgaaaattatgcaggaacatatttgaaattatctgagtttactggtggaatggatgttcaaaaagaaaaagttcttcagattattaatggtgatgaaattcttaatgataaaaacaagtttataatgaaaaaagaaaactttaattcaattcctggaaatccaatttcatattgggtaaatgattcgattatagatatatttaagaattctaagaaattagggaaaatagtagctccaaaatgtggtttaaaaactggtattactgaaaaatatgtccgaaagtggtttgaagttgattataataatattggttttgacataccaaatagagaaatggctaaaaaatctatgttaaaatggtttcctgcatccaatggaggacaatatagaaaatggtatgggaatatcgaagatgttgttttttggtatgatgatggttatgaaattagaaatttatttaatcctaatggtaaacttaaatctagacctcaaaacatgcaatattattttaaaaaagggttaacttggtctgcattaactagtaaaaaactttcattaagactttcaccaattggaaatataataactggtgcaggttatggattatttaataatgaatttagtttattaacaattatggggtttcttaattcaaagatagcaacttattttagcagtattttctcagaaacattaaattttgaagtggggatattaaatagaatgcctattcttattaaagaaaattctgaaataaataagttagtctcagataatataacaatatctaaagaaaattgggataattatgaattttcatttgattttataaaacatccttttatgaattttaattctgatttgttaaaagaatgttatgagatgtacgcttctgattttaagttaaaattcaatgaattgaaaaaaaatgaagaacaaataaatgtattctttattcaagaatacgatttaaaaaaccatattaaaaaaaatgttcctaatgaagatattacactttttaaacctaatttaactgaagatattaaatcttttatttcttatgctgttggttgtatgtttggacgttattctttagataatgaaggtttacaatttgcaggaggagaatttaatattgataattatcataaattcattccagatgaggataatattatcccagttttagattctgaatattttgaagatgatattgttaatcgtttcgtggaatttgtaaaaatatgctttggagaagaaaccttggaagaaaaccttgattttatagctaatgcactagctaaaaataaaaaaccttcaagagaaaaaatcagagagtatatgcttaaaaatttcttcaatgaccacaaaaaaacatacaaaaaatgcccaatatactggcagttctcaagtgggaaagaaaatggtttcaattgtcttgtttacatgcaccgatatgaaccaagcttagttgcaagaatcagaacagactacttacataaaacacaaaaagctattgaacaagcaatagctaactgtgataatattataaatcactcatcatctaatactgaggttacaaaagcaactaaagaaaaatctaaacttcaaaagcaattaaaagaaacacaagaatatgatgaagctcttgcacacatagcaaatcaaaacatcaaaattaacttagatgatggtgttaaagtaaactatgcaaaattccaaaacatagaagtttcaaaagaaggaaagaaatctaaaaaaattaatttgcttaaaaaattgtaa

SEQ ID NO: 2333 - DNA, 1569 bp, Methanobrevibacter smithii
ttggaatcactagcgaatgttaaacaaggtttagctactgcagataataacagattcctaagatattggtgggaagttgattttaataatattgggttttcttcaataaactgcgaagattcaaaaaacactaataaaaaatggtttccctacaacaaaggtggggattatcgtaaatggtggggtaatcaagaatttgttgttaactgggaaaacgatggatatgaaataagaaatatcataggtcctaatggtagagttagatcaagagcccagaatactcaattttatttccataagtcattaagttggtctaaaatttctagtggaaaagttgcatttagatattacccaaatggatttatttttgatgtagcaggatgttctgtattcttagataaaaaaaatataaattatatatttgggtttttaaattctaatatttgtggagatattttagatttaatatctccaacattaaattacgaagtcggtcatgtcgcttcacttccaataatatttgatgaatctaaacaaaatgaaatagaaaacttagttataaccaatataaatattgaaaaagaagattgggatgaaaatgaaacaagttggaactttaaatcacatccatttgtttttttcaaaggagattcattatctgaaaagtataatttctggcaaaaatacaaaacgaaccaatttaattatttaaaaacaaatgaagaaaaattaaataaactattttatgatatatacaatgttgatggtgatcatgaaattgaagataaatatatatcccttaataaaaatgatttaaaaaaagatattgaatccataatatcttattcagttggatgcatgtttggtcgttataatttaaatcaaggaggcttatgtttcgcaggaggtgaatttgatttaaataagtatcataatttcattccagatgatgataacattattcccgtattagacacagcatactttgatgatgatattgtcggatatttcacaaagtttattgaaaaatgctttggtaaagaaaaactagaagaaaacttagatttcattgcaaaagtattatcaaactcatctaaaccttcaagagaagtattaagagactattttttaaagaatttctttaatagtcataaaaaaatctataaaaaacatcctatttattggcagttctcaagtggtaaagaaaacggtttcaattgtctaatttacatgcacagatacgagccaagtttagttgcaaaaataagaactgattacctgcataaaactcaaaaagctattgaacaaagaatagctaacactaacactatcattaataattccacttcaaaacaagaggttgctaatataactaaggaaaaagttaaacttcaaaagcaattaaaagaaactcaagaatatgatgaacttttagcacatattgcaaatcagaacattgaaatagatttggataacggggttaaatttaattatgaattattccagaatatagaaattaaaaaagaaggtaaaaaatctaaaaaattaaatttgcttaaaaagatataa

SEQ ID NO: 2334 - DNA, 3519 bp, Methanobrevibacter smithii
atggataaaactgcaattaaaacatttgccattaattctcgtaagaagttaatggaagatgtagaatataaaatgagtttagttggaattgataaagataacatttatgaaccaataagctcagccaatggaatagaaacatatcaacttggtggatcaactaatagtatatatgataatgatatttcaaaaagagaaagattagtaaaagaagttaagcaaaaaggttttgaaaatgttgttgaagaggtagcttatacatggtttaatcgtataattgctataagatttatggaaattaataatttcctaccaactaaaacaagagttttatcctctgaaactgcaggtaaaatagaacctgatataataactgaagcatttgatgttgatttggattacactcaagaagataaagagttaatttttaaacttaaagatgaaaataaattagatgaattattcagattcttatttataaaacaatgtaataaattaaatgaaatacttccaggtttatttgaaaaaaccgatgactatttagaactattattaaacatttcatttaccaatgaagatggggttgtaagacaattaattgatacaattcctgaaaaagactttgaaagtcaagttgaagtaataggatggttatatcaattttataacacagaattaaaagatgaaacttttgcaaatcttaaaaaacgaataaagatttctaaagagagaattcctgctgcaacacaattatttacacctgattggattgtaaaatatatggttgaaaattctgtaggaagattgtggttagaaggccatcctaataatgaattaaaatcaaaatggaaatattatgttgatgaagcgaaacaagagccagaagttgaacaacaattaattacaattagaaaagaatctgaaatattaaaaccagaagatattactgttattgatccttgtatgggttcaggccatattttagtttatgtttttgaagttcttatggacatatatgtttcagaaggattcacagaaaaagatgcttgtgaatcaatcttaaaaaacaatatttatggtttagatattgataaaagagcatatcaactagcttattttgcagttttaatgaaagctagaaaatataatcgtagaatattaacaaaaggtatttcaccattattatgctcaattgaagagacaaattcaatttctaaagagtttattgaagaattgatttcacaagacagaacaattgaagatgctttcaattatctaatatcttcttttaaaaatggaaaagaatttggaagcatattaactataaaacctattgattttgaaaaaataaataatttaatttctaaatttgaatcaaataataatttaactaaacttaagtatttagatgaaattaatcttttgaaaaatattattaatcaatccatattattatctaaaaaatatgatgttgtagtaacaaatcctccttatatgggaaataatggtatgaatccaaatttaaaagattatattaaatctaaatttcctttaactaaaacagatttatttgctgtatttttagaaaaaggtttagaaatgataaaagattatggatttaattgtatggttacaatgcaatcatggatgtttttgtcaagttttgagaagttcagaaagaaattaattgaaacaacaaccatttcaaatttattgcacatggataatatggtaatgaaaattgcatttggaacatcagcaacagtatttagaaaaataaacttgatgaactacaacagtactttttatcatgtgaaattatctgatgttgaaaatgatattgtgaatccattgttttttaatgataaaaacaagtacataataaaacaatttaattttgataaaatccctggaagtccaatagcatattggattgatgataatttaatagcttgttttaataatacaaacttaagttcattaggagatattaaagttggattacaaactggtgaaaatacaagattcctaagatattggtgggaagttgattttaataatattgggttttcttcaataaactgcgaagattcaaaaaacactaataaaaaatggtttccttataataaaggtggatcatttagaaaatggtggggaaatcaagaatttattatcaattgggaaaatgatggtgaggaattaagaaactttaaaaaatctgttttaagaaattcccaattttattttcatcaatcattaagttggtctaagatttcaagcggaaaaattgcatttagatattatccaaatggatttctttttgatgtagcaggatgttctgtatttgttgatgattatttgaattatatttttggttttttaaattcaaatgtttgtggaaatattttagacttaatttcaccaacattaaactatgaaataggccatattgcttcattacccattattattgatgaaaataaagttgaagagataaataatattgttttggaaaatattaagatttgtaaagatgattgggatgattatgaaacttcatggaactttaagaaacatccattattaaaatttaatgaaaataatcttaagaactcatttaaatcttgggaatcttataaaaaagaacaatttaatcaacttaaatcaaatgaaacaaaattaaataatatttttagtgaaatatatgatattgattcaaattataatgttgaggataaacatgtttcaataaatagttcaaattatgaaatggatataaaatcatttgtttcatatgcaattggatgtatgtttggtagatatagtttagatgatgattgtttaatatctacaaattcaaattttaatattgagaattattctaggtttattcctgatgatgacaatattattccaatattggatactgaatattttgaagacgacatggttggtcgttttgttgaatttgtaaaaatttgctttggagaagaaactcttgaagaaaacttggagtttatagctaatgcattaattaagaataataaaacaagtagagaaaaaataagagaatatttacttaaacattttttcaatgaccataagaaattatataaaaaatgcccaatctactggcaattttctagtggaagtaataatgcatttaactgtttaatctattctcatagaattgattcacaaataattgctagaattagaacagaatatttacataaaacccaaaaagcaattgaacagagattattagattgtgaaaatttgctaaatacttctgattcaagttctgaaaaagcaattatcacaaaagaaaaaaataaattaattaaacaacttgaagaaacaattggatatgatgaagcattaaaccatgtttcaaatttaaatttatcttttaatttagatgatggaataaaagaaaattattcaatgcttcaagatattattatttcaagagaaggaatgaaaaataaaaaaattaatcttctaaaaaagatttaa

SEQ ID NO: 2335 - DNA, 2124 bp, Methanobrevibacter smithii
atgaaaaatattatccaacaatcaaaatttcttgttaaaaattatgatattgttgccacaaatcctccatacatgggaaatagtggtatgaatccaaatttaaaagattatttaaagaaaaattatccaaattcaaaatcagatttgtttgcagtatttattgaaaaatgtcatgatttctgtaatgaaaaaggttttgttgcaatgattactcaacaatcattcatgtttttatcaacatttgaaaaattaagggttgaattaattaataatcacaccataattaatatggctcatttaggagctcatgcatttgaagaaattggtggtgaagttgtacaagcaacaacttttgttaataaaaataatttaattgaaaattacaaatcaacatttcacagattaactgagtttaattcagaaagcaaaaaagaagaagagtttcataatgatgaaaataaatttatattatcacaaagtattttcaatttagcaccttcttttgaatttattttttgggaaaatcacaatatcttaaattcatttaaattatatcctccattaagtaagtatggtaaaccttcaagaggtttagcaacatataatgacaataaattcttacgatattggtatgaagtatcttttaataaaataggttttgggtgttcttctgttgatgattctataaaatctaaaaaaaaatggttcccttacaataaaggtggggattataaaaaatggtatggaaacaataactttgttgttaatttctataatggaggtgaagaaattaaaaaatctggaaagggtgcttttagtaatattaattattattttaaaaaaggattaacatggtcaagaatttctagtagttattttggagtgagatatcatgatgttggttttataattggtgatgctggaccgtctgttttaatgaatgatgattcaaatattttttatatttttggaatattattgtctaattttacattaagaataatatctgctttaaattcaacaatgacttttcaagttggtgatttaaataaagttccaatcaatatgaataaccatgaaaaagaaaatattgaaaaattagtaaaatcctgtatttatatttcaaaagaggaatgggatgaatttgaattatcatgggactttaaaaaccattatgcaataaaatttagtcaagattcatttgaaaatactttttttaaatatatggattttaaaaataatcaatataataaattaaagaaaaatgagtttatattgaataatttaattaataaaatttataatattactgatattcaagatagtgtagtgtctattaaaaatgaaattacattaactaaaatacatttagaagaatttgtaaaatcatttatttcatatgctgttggttgtatgtttggtcgttactctttagacaatgaaggtttacaatttgctggaggtgaatttaatattaataattactctaaattcattccagatgatgataatattattccagtcttagattctgaatactttgaagatgatattgttaatcgttttgtagaatttgtaaaaacatgctttggagaagaaaccttagaagaaaaccttgattttatagctaatgcactagctaaaaataaaaaaccttcaagagaaaaaataagagattatctccttaaaaactttttcaatgaccacaaaaaaacatacaaaaaatgtccaatttactggcaattttcaagcggcaaagaaaacggattcaattgtctagtttatatgcacagatatgaaccaagtttagttgcaagaatcagaacagattacttgcataaaactcaaaaagctattgagcaggcaatagctaactgtgataatataattaatcactcatcatcaaaacaagaagttgtaaaagcaacaaaagataaagctaaacttcaaaaacaattaaaagaaacacaggagtatgatgaagcactatctcacatagctaatcgaaatatagaaattgacctagatgatggtgttaaagttaattatgctaagttccaaaatgtccaggtttcaaaagaaggtaaaaaatctaaaaaaattaaccttctaaagaaactttaa

SEQ ID NO: 2336 - DNA, 3279 bp, Methanoculleus bourgensis
atgacggtgctcacccgggaagaacgtaatgcccttgatggagcggtacaggaggctcgcaggaaggccgaactcggcgcaaagaatgctctttcggcgctcggtgttcgggaggagaggaagccggcatacctcaccgcagagcaggcggagctccgcaggcggttgcgggctgaatgccgcaggctcgggtcgtttgatgaccttgtcaggtcggtggcctacgagcagtggcaccggatgctctttgcacggttcctggcagagaaccgcctgttgatccacccggagtttggagtgccggtcactcttgctgagtgtgaggagatcgcccgtgaggaggggcgggatctctgggaggtcgcggcgggctacgcggccaagatgctcccggggatcttccggcaggagagcccgctcactcaagttcggtacgcgaccgaggataccgccgcgctcgaggcgatccttgcggggatacctgaggagacgttccgcgccgaggatgcgcttgggtggacctaccagttctggcagacggagaagaagaaggaggtgaacgcatcggggaagaaggtggaagggtatgatatctgtgcggtgacccagctcttcaccgagccctatatggtgcagttcctgctccagaacacgctcggcgcctggtggcttcacctccatcctgatagctcgcttcgggaggagtgggtctactacaaggagcaagtgcagcacgatttctccgcctggccggagagcccggctgagttgaagatccttgacccctgctgcgggagcgggcacttcctggtcgcggcgttccatatgctgcttgctatgcggagggaactcggcgaggagaccgaggacgcgatcagggatattgtaagggacaacctccatgggctcgaacttgacccgcggtgcatccagatcgcgacgttctccatcgcgctggaggcgtggaaggcggggttctcgccgacggagtcgtacctgccggtcccgaaccttgcctgtacggggataccgatccgggcggagaaggaggagtggctgaagctggcgggcggggacgggttgctcgagggcgtgcttgagcagtactacgacctcttcaagaacgccgataccctcgggagcctgatcaaggtagagaacccacagaccctcgtcgaccgggccgccctggcgaagaagtttgagcaggcgttgcggcgggagaaggaagcgggcgatccggttgcagagacgttcggagagacggggcacggcgtgctgaaggcggcggggcttcttgccgggcggtatgattacgtcatgacgaatgttccctacctgtcgagcggaaatcaaggaaacctcctgaaatccttcatcgaggagcaccatccctgtggaaagaacgatattgcaacggtgtttcttgaacggtgcctctccttctgccggccggggggcaaggtcagcatcgtcctgccgcagaactggctcttcctggtatcatacaggcggttcagggagtacctcctgaagaacgagcgctgggacctgctggcgagattgggcccgggtgcattcgagaccatctccgggcatgttgttaatgccattctcttgaacatcacccatacgaaaccaccggcgggccatctgctctgcggtttggatgtctcggaggagcgcgacgcggcggccaaggcccggtctctgctagatgcagagatggcatgtgtggagcaggcggcgcagctggagaatccggatgcaaggatagtagcagatgatcagggcacttctacactattatccgaatattctaacggagttcatggttttggaagtaaagattctcctcgatatttccgtcaattttgggaaatgttcgctcctaacgaggattggcagataatgtcaacaactgttggtcgtacaatcgattttggtggcaaagaacaacttgtctattggcaaaatggcaaaggcttgcttgcggagctgggaagaaaaggattagcaatccctgccggggggctggcatggaggaaaaaaggtgtccaaatcagtcagatgagtgaattacccgcgactttgtattttggagaaatattcgataaaaataccgcagttgttctcccccacgatccctcccatcttcccgccatctggtgcttctgctcctctcccgactacaacatagccgtccggaagatcgaccaaaaactcaatgtcaccaacgccaccctcgtcaaagtccccttcgacctcgatcactggcaaaaagtcgccgccgagaagtacccccacggccttcccgagccctactcagacgaccccacccagtggatcttccacggccacccctgcgggagcgtcatctgggatgaggagacgaagatgctcgcccgcgggccgctccgcaccgatggagccgtcctccatgtcgccatcgcccgcctcctcggctatcgctggcccgccgaactggatccggagatggaactctcgaaagaggccagggaatgggtggcagagagcgaaaaactcctctccttcgccgaccaggacggcatcgtcgccatcccctccatccggggtgaaggaaggctcgtggaccggctcagagaactcctcgccgccgcctacggcccggcatggtcaccaaatacggagaacgaactcctccgagggatcggatacacaaagaaagacgggaacctcaaaggcgacctcgaagggttcctccgcgacgagttcttcgcctcccactgcaaactcttcggccaccggccgttcatctggcaggtctgggacgggacaaaggacgggttctcggtgctccttaactaccataacctcgacaggcggaacctcgagcggctgacctacacctacctcggcgcctggatcgcccagcaacgggccgaagtgcagaacgaggtgccgggtgctgaacgacggctcgcggccgcagaggacctgaaggaacggctcgcaaagatactcgaaggcgaagccccgtacgacatcttcgtccggtggaaaccgctccacgaacagccgatcggctgggaccccgacccgaacgacggggtgcggctcaacatccgcccgttcgtcgaagccggggtgctccggtcacaaccgaggattaactggaagaaagaccgcgggaaagacccggtgccgaacgcgtccgggacccaggagcggcataacgacctacacctcgcgctcgacgcgaagcggaaggcgagagcggcggtgaaggacgcatga

SEQ ID NO: 2337 - DNA, 1860 bp, Methanolobus psychrophilus
atggataaggcacgcatcattaagttctcggatactgtgcgggataagctccaccaggaagtaagggagcgggcggcattctatggcatagagcctaaagagatccttcctgtggattccgagcacacggattcgatggtaatcgggggcaaggtcttcaataagaagatcaaggcccagagggagcagcttgtgaaagaggtcagacgcaagggctatgagcaggtgatggatgaggtcacttatacctggttcaatcggtttgttgcgctgaagttcatggaggtcaacgattatattccggtgaaggtgttcacttcggatgattctgagaggaccgagccgggaattattacacatgctcttgaactggatctcctggagcttgatttggaacttgtgcttgatctgaaggctgagaacgaggatgaggagctgtacaagtacctgatattgcggttgtgtaactacctgaaccgcacaatgtctttcctgttcgaggagatcgcagactatactgagcttctgttccctgaaaaattgttgcatatcggttccattgtaaaggatatgaacgggatcattgccgaggacgactggagagaagtggaggtcatcggctggatataccaggactacatcgctccgaaaaaggataaggtgttcaaggacctgcagaagaatgtgaagataagcaaggagaatatccctgcagcgacccagttgttcacaccgcactggatcgtccgctacctggtggagaattccctggggcgattgtggatgctcaaccgtcccggctcgcggctggcagagaagatggactactatatccgaccggagcaggctgagaaggattacctgaaggtgagttcgccggaggatatcagggtgtgcgaccctgcctgtggctcgggacacatgctggtctatgcctttgacctgctgtatgccatctacgaggaggagggctacgaccattccgagatccctgagatgatactgacacacaacctcttcggggtcgagatagacaagcgcgccggagagctggcagcctttgcgctggttatgaaagcgcgtagaaagaaccgcaatttcttccgcaagcctgtccagcccaatatttgcgtgctggagaacgtttcatttgaggaaggagagcttaatgcctatatcacagccgttggccgggaactgttcaccaatgaggtcagggccacgctgcttcagttcaatgaggctgacaatttcggttccctcatccgtccgaaagctgcggatgtttcgactatcctgaaaatgccgaaaccaaaggttctttctgaaaatctcactcttctttccactcaccagaaggtactgcaggccctgaagcaggcagatcacctcagccctaaatatcatgtagtggttgccaacccgccgtatatgggtggcaaggggatgaatgacagacttaagagctttgcacaggacaattatcctgagagcaagtcggatttctttgcgatgttcattgaccgcaatcttgaccttgcaatgaagaaaggaatggtggctatgatcaccatgcagagctggatgttcctttcttcctatgagaaactccgggcaagcattctggacgaccgtaccataatatccatggcgcatcttgggccgagggcctttgacagtatcggcggtgaggttgtctctaccacggcctttgttatcgagaatacacagcatccggagtataagggagcttatatccggcttgtagatggcaactgcgaagccgaaaaagatgcatggctgcgcgaagcagtgatgcaggccagaaatgttgctattcatcgaatggaggcacaatga

SEQ ID NO: 2338 - DNA, 1335 bp, Methanolobus psychrophilus
atgaaaaagttcaaaggatctgtaattcgtaatccaaattactattttaaagaaggaatgacttggtctacaatcagtagttctaaactttcgatgagatattcatcaaagggttttttatttgaaactaaaggttctgtctgttttcctcttgatgatgattcttttaaatattgtttaggctttatgaattgtaaagttgttgaagaacttctgttagcaatttcaccaacgttagattttcatgaaggtcctattggaaaaactccattaataatttctcaagaagatcagatttcaaatacagtatcaattttaataaaaaatgctaaatctgactgggattcctacgaaaactcttgggatttcaccactctcccattcctccaacccgaataccaccatccaaccctccgcaaaacctacatcaaacttcgcgcccagtggaaagaaatgacacttgagatgcaacggctagaggaagagaacaaccgtgttttcatcgaagcctacggcttgcaggatgaacttacacctgatgtgccactttcagagattacactgacatgcaatccacattatcgctataatggaaacagaagcgaagaagaactggaagcattgctgctcacagatacaataaaagaattcatctcctatgctgtgggctgcatgttcgggcggtattcgctggacaagccggggctgatgcttgcgaaccaaggtgagaagataggagattatctggagcaggtgccggagccgagcttcatgccggatgtggataacatcatacccatgcttgaggatgagtactttgaggatgacatcgtaggcaggttcaaggagttcctcaagctgacctttggagaggataagctttccgacaatctggatttcattgcggaggctctgggcggtaacgggaagaagtcttcggaggttgtgataagggactatttcctgaagtcgttttacaaggaccatctgaggatgtacaagaagagacccatctactggctgttcagctcaggtaagggcagagctttcaatgcactcgtttacatgcacaggtacaataaggaaacgctggcgatgatgaggacagattatttgctggagcttgaggggaagctggatgctaagagggagatgatcaagtcggatattgggaaggatgctcaggagaaggcgcggctggggaagatgattgaagagctcatggcttatgatgaagtactgaagaataaggccgatgcgtacattgagattaatctggatgatggggttgtggtgaattacgggaagtttgaagggttggtggagaagatatga

SEQ ID NO: 2339 - DNA, 2397 bp, Methanomethylovorans hollandica
atggccttgaaaaaatcagaactttattcttctctctggtccagctgtgatgaactgcgtggaggtatggatgccagccagtacaaagactatgtgctggtgctattgttcatcaagtacgtaagtgacaaatacgcaggtgttccctatgcacccatcactattccggaaggtgcaagctttgcggatatggttgcacttaagggtaagccggatatcggcgaccagatcaacaagaagataattgctccattagtcagtgccaacaaactgtctgatatgccagacttccacgatgctactaaacttggcagcggtaaggagcaggtggacaggctgaccaacctcatcgccatcttcgagaacccggcccttgatttctcaaagaaccgcgctgaaggcgatgatatcttgggtgacgcttacgagtaccttatgaggcacttcgcaacggaaagcggtaagagcaagggccagttctatactcctgccgaggtaagccggatcattgcacagatacttggaatacgtcaggctgataccacaagttccaccacggcctatgatcctacatgcggttcaggctctctgcttttgaaggttgcagatgaggcgaggaccaagataactctctacggtcaggagaaggacgctgctacatcgggtcttgctcgcatgaacatgatcctgcataacaatcctgaagctcttatatggcagggtaatacccttgcagaccccaagttcgttgaggacggtatactcaagaccttcgattatgtggtcgccaatcctcctttcagcgataagcgctggagtactggtctggaccctctacacgatacttatgaacgtttcaagccctttggcattccgcctgccaagcagggagattatgcttatctgctgcatattgtccgctcactcaagagtacaggcaaaggtgcttgtattctgccccatggcgtgctgtttcgtggcaatgcagaggcagacattcgccgtaatctgatacgcaaaggatacatcaagggtatcattggcctgccagccaacctgttctacggtaccggcatccctgcatgcatcattgttatcgataaagaggaagcccataaccgcaagggtatctttatgatcgatgccagtgcggattttatgaaagatggtcccaagaaccggctgcgtgcccgggatatccataagatcgtggatgttttcacaaagcagacagacatcccgaaatactcgcggatggtgagctttgaggagatcgggaagaacgagttcaaccttaatcttccgcgctatattgacagccagcaggctgaggacctgcaggatatcgaaggccatctgcatggtggtattcccactgctgatgtggatgcattacagcgttactgggatgtctgtccagagcttcggcaaaccctgttcaaagcgaatagacccaattatctggcccttgcagtggataaagctgctattaaatccactatctacgagcatcctgagttctctgcttttatctctggcatgaatgcgcattttgctgtgtggcaggagcaagcttcggctatgctgcgagaattgcaggcggacagccatccgaaggaagttatagccaagttatccgaagacctgcttgctcattacgcagataaaccactcatcagccaatacgatgtgtatcagcatctgatggattactgggagacaacgatgcaggatgactgttaccttattgcagatgaaggctggaaagctaagacctatcgtatcatcgagaaggataagaaaggcaaggagaaggacaagggctggacctgtgaccttgtgccaaagtccttcatcgtagcccgtttcttcgccaaagagcaggagattgtggataagcttacggctgagctggaaagtgtcacagcccgcagcacagaactggaagaagaaaacagcggtgaagaaggtgctttttcagaacttgataaggtgaacaaagctaatgtaacagctcgcctgaaggagatcaaaggcgacagggaagctcaggaagaagctgctgtacttaatgactggctgcaacttgccaatgaggaagctgacctgaagaaacacctcaaggatgccgaaaatgcacttgatgccaaagcttatgctcactacccacagcttaccgaggacgacatcaagacgctggtagtggacgacaaatggctcactgcactggatactgccatccatggcgaaatggaccgtatcagccaatccctcacccagcgtgtgaaggaactcgcagagcgctatgaaacccccatgcctctgatgacagaacgtgtggctcaactggaagcaaaagtgaatgggcacttggagaggatggggtttaggctatga

SEQ ID NO: 2340 - DNA, 1746 bp, Methanomethylovorans hollandica
atgacaattgctaacactttatcaaccaatcccgtccccaacttctaccgcgcctctgcagctgatttcaagaagattcccggaagtccgattgcttattgggtgagtgacaaaatgcgaaacacgtttttagcaggagcttcactgggttctatcgctaaaccaaaactaggtatgagaacagggaacaatgagcgttttgtaaggtattggtttgaagtatggcacaataaaataggcttcagttttaaaaattcacaggaagctaaagattctggtttaaagtggtttccgtacaacaaaggtggcgattttcgaaggtggtatggaaacaatgaaaatgtagtaaattgggaaaatgatggatatgatattaaagttgaaaccttaaagaactatcctcaattatcttgggataacttgggctggaagatatctaacgaaaaagacttttttaaaccatgccttgagtggtcgagaattagttctacgtattttgctgtgcgttattctcctgggggttttctttttgatacaaacggaagctctgcatttcctaagcaagaacacttaaagttcttaattgcatttttatgcactaaaattagctcgaattttgcaaaagtaataaaccctactttagcatttcagccaggagacttatctgttttgcctattcttgggatcgatataatagcggattcaattgacactatttgccacaatataattgaaatctcaaaatccgactgggactcctacgaaacctcctgggatttcactactctccccctcctccaaccagaataccatcagccaactctccgtgaaacctataccaaaatccgtgctcactggaaggaaatgaccctggagatgcagcggctggaggaagagaacaaccgtattttcattgaagcttacggcttgcaggatgaacttacaccagatgtgccgctgtcggagatcacgctgacctgcaatcctcattaccgctataatggagggaagagcgaggaagagctggaagctttgctgcttacggatacgataaaggagttcgtctcctattccgtggggtgcatgttcggaaggtattcgctggacaagccggggcttgtgcttgcaaatcagggtgagaagataggggattatcttaatcaagtgcctgagccgagcttcatgccggatgccgataacatcatacccatacttgaggacgaatactttgaggatgatattgtggacaggttcaaggaattcctcaaggtggccttaggaaaggagcaactttcagagaacctggatttcattgccgaggctctgggtggtaatgggaagaagtcctccgaggctgtgatacgggaatatttcctgaagtcgttctacaaggaccacttgaagatgtacaagaaaaggcccatctactggctgttcacttcaggtaagggcagggctttcaatgcgcttgtttacatgcacaggtacaacagggaaatgcttgccaaaatgagaacggattacctgctggagcttgagggtaagctggacgccaagaaagagatgatcaagtcggatatgggtaaggatgcgcaggagaaggtgcggcttaagaagatgatcgctgagctcatggcttatgatgaagtgctgaagaacaaagccgatgcgtatattgagatggatctggacgacggggttgtagtgaattacgcgaagttcgaggggctggtggagaagatatga

SEQ ID NO: 2341 - DNA, 1854 bp, Methanomethylovorans hollandica
atggataaggcaagcattatcaagttctcggatactgtgcgggataagctgcttcaggaggtcgctgacagggctgctttctacggtatccaccccaaggagatcctgcccgtggattccgaacatgaggattccatagttatcggcgggaaggtccataataagaagctcaaggaccagagggagaaactggtcagggagatcaaacataagggctatcaacaggtgatggacgaggtcacttacacctggttcaaccgttttgttgccctgaagttcatggaggtcaatgattaccttcctgtgcaggtgttcacttctaaagatgctgacaggaatgagcctgggatcatcacacacgctcatgaactggatttcctggaccttgatgctgatcatgtgcttgacctgaggtctgagaataaggatgaagagctgtacaagtatctcatcctgaagttgtgtaattacctgcacagcactatgcctttcatgttcgagaagatagaggactacactgagctattgttccctgagaagctgctgcatgttgattctattgtgaaggacattaacgggatcattccggtggatgactggagggaagtggagataatcggctggatataccaggattatattgctcccaagaaggacaaggtgttcaaggaccttaagaagaatgtgaagatcagcaaggagaacattcctgcagcgacccaattgttcacacctcactggatagtccgctatctggtggagaattccctgggccgtttgtggatgctcaaccgtccaagttcacggctgtgcgagcagatggactattatatcagacccgaggagaatgaaacggatttcctgagaataaattccccggaggacatcagggtatgtgatcctgcctgcggttcaggacacatgctggtgtatgcttttgatctgctgtatgccatctacgaggaggagggctacgaccattccgagatatccgagaatatcctcacccgcaatctctttggtatcgagatcgacaagcgtgccggggacctggcagcctttgccctgaccatgaaggcaaggggaaagaaccgtaacttcttccgcaagcctgcagtgcccaatatatgtgtactggaaagcattgcttttgaggatgatgagctcaatgcttacataactgcaattggaagcgagttattcaccaatgatgttcgggatacactgcttcagttcaatgaagctgataacttcggctctcttatccgcccgaaggctgaggatgtatcaggcatcctccaattaccaaaaccgaagatcctttcagagaacctcactcttctttccactcatcagaaggtcctgcaagctctgaagcaggcagattaccttatccccaagtatgatgtggtggtcgccaacccaccgtatatgggtggcaaggggatgaatgcgaggctcaaggacttcgctcaggataattatcctgacagtaaatcggatttctttgccatgttcattgatcgtaatcttgaccttgcgatgcagaaaggcatggtggcgatgatcactatgcagagctggatgttcctttcttcctatgagaaactccgagcgggcattctggatgaccatactatattgtccatggcacatttaggacctcgggcttttgacagtatcggcggcgaggttgtctctactacggcttttgttattgagaatgcacagcatcctgagtataagggagcttatatccggcttgtggatggaaactcggaagcagaaaaggatacatggctgcgtgaggctatcatgcaggtgaggaacattacccagcaaacggaggcttaa

SEQ ID NO: 2342 - DNA, 3486 bp, Methanosarcina acetivorans
atggacaaatcagcaataatagaattctcaaacaaggttcgcaacaagttaaatgaagaagtaaaaagccaggcagcctattacggaatctttcccaaagaaatccactccgtagaagagcacccggactcagttgtcatcaacggcagcgtctttaattcaaaaatcaaaaaccagcgctctcagcttgtaaagcagatcaaggaaaagggctacgaacaggttatggaagaagttacctatacatggttcaaccgccttgttgccctcaagtttatggagatgaacggctgccttcaagaccagatcaaagttttcacttcaaccgacccgaataaacccgaacccgacctcctcacaaatgctctgaaacttgacttcctgaaccttaaccgagatttagttcttgaccttaaagccgaaaacaaagacgaagagctctacaaatatctgattctgaagctctgcaattacctgaacaaaataatgcctttccttttcgagaaaatagaagactataccgaactccttttccctgacaagcttctgcatacaggttcagtcctgcatgacctgaattcaattattccggacgaggactggcaagaagttgaaatcataggctggatctaccaggactatattgccccgaagaaggacaaagtctttgccgacctgaagaagaatatcaaaatcagcaaggaaaacatccctgctgttacccagcttttcacccctcactggattgtccgatatcttgtggaaaattccctgggccgcctgtggatgcttaaccgcccggaatccagcattgttgacctgatggagtattacgtaaaaccggaacagcaggaaaccgattttctgaaaatcaattctccagaagagctcaagatttgcgaccctgcctgcggttcggggcatatgcttgtttatgcttttgatcttctgtatgcgatttacgaagaagaaggctacaccccttccgaaattccggaaattatcctgacccacaaccttttcgggatcgagattgataagcgtgcaggggaacttgcaggttttgcactgaccatgaaggcaagaggtaaagaccgtcactttttcaaaaagcaggttcagcccaatatctgtatgctggagaatatcacgtttgagcagagtgaactcgatgcttacatagatgctgtcggaagtgagcttttcactaacgcccatagagccactctgctccagtttgccgaggctgataattttggatctcttatacgtccggctgcgatggaagtatcgggtctcttaagcctgctggaatctaagaacctttcaggcaacctttcccacctttctactcatcagaaagtcctgcaagctctgaaacaagctgactacctcagccctaaataccatgtagtcatcgcaaatccgccatatatgggcaataaagggatgaataacagactgaagacattccttcaaaataattatgctgatgtgaaatctgacctattctcagcatttatagttcgtaatacagaacttgcttttcccaaaggtcaacttggattcatgtctccttttgtgtggatgtttatttcttcctacgaaaaactgagagattttttgatcaatgaaaaaactataacttcactgattcagcttgaatactcaggtttcgatggagcgacagttccaatctgcacttttacaagtgagaatgcatatcatcctgaattcaagggtggatatgtacggctatctgattttcgaggagcagaaaaccaaagcccaaaaacgcttgaagctatcaaaaatccgaaatgtggctggttctaccgtgcctccgctacagattttaagaaaattcctgggaatccaattgcgtattgggtgagtaacaaggttcgcgatctatttggaaatataactctaggggacttttttgacacagagggacagaacaagactactgataacgataaatatcttaaatatcattgggaattaagggagaaaacaataggtgtagataaaaagtgggttctctgtgcaaaaggaggatctttccgtaagtggcaaggcaatattgaatatgtaattgattggtctccagaagcaagagccttctatcgtaaggatcatagtgctcgtatagttgaagaggagttctggtatcgagaaggaattacatggactggaattacatcttcattgtctggatttagatatttggagtatggatgcacatatgaaacagcaggcccaactatttttgtgaaaaatgcaaataaatatgttattctgggttatttgaatacaccgattgttgctaaatttatcaatataatgaatccgacattgaatacaaagataaaagacgtacaagctttgccgattattcaatcgatcctatttgataatcaagtagagagtgtctctttgagactagtaaatctctccaaatccgactgggactcctacgaaacctcttgggatttcaccaccctccccttcctacaatccgaattccgccagccaaccctctcagaaacttacactaaactacgtacccactggaaagaaatgactcttgaaatgcagcggctggaggaagaaaataaccgtatttttattgaagcctacggcttgcaggacgagataactccagaagttcctctttctgaaatcacactgacctgcaacccatattaccgctacggcaacaacaaaaccgaagaagaactcgaaacactgctgatgaccgataccgtaaaagagctggtttcatacgctgtaggctgtatgttcggaagatattcgcccgaaaaagaaggactgatccttgcaaatcagggagaaaagcttggtgattttaaagaaaaagttcccagagctactttcctgccagatgaagataatatcatcccgatccttgatgatgaatattatacggatgatatcgtaggcaggttcaaagagttcttgaaacatacttttggagcggaaacgctctctgaaaaccttaactttattgcaggggcaatttcgaagaaaaatgaatctcctggaaaagtcataagggattatttcctgaaggatttctacaaagatcacgtgaaaatgtataagaaaaggccaatttactggctatttacttcctcagaaaaaggaaaagcgttcaatgcgctcgtttacatgcacaggtacgataagactaccttagcaaagatgagaatcgattatttgcttgactttgagtcgaagctggatgctcagaggtcgcttctgaaaaaggaaattactgagaattccaagaatagtggaaaagccgaatcagaacttgctaaacttaataaaaagatcaatgagctcgttaagtatgatgaactgctaaaaaataaagcggatcagatgattgagattgatctggatgatggggttaaggtgaattatgagaaatttaaagggttggtggggaaaatataa

SEQ ID NO: 2343 - DNA, 3498 bp, Methanosarcina mazei
atggacaaatcagcaataatcgaattctcaaacaaggttcgggacaagttaaacgcagaagtaagaagccaggcagcctattacggaattttacctgaagaaatccatgccgtggaagaacatgccgattcagttatcattaacggcaaagtcttcaattcaaaaatcaaaaaccagcgctctcagcttgtaaagcagatcaaggaaaaaggctacgaacaggtaatggaagaagtaacttatgcctggttcaaccgccttgtagctctcaagttcatggagatgaacggctgccttccggaccagataaaagttttcacctcaaccgacccgaataaacccgaacccgacattcttacaaacgccctgaaacttgactttctgaatcttaaccgagatttagttcttgacctcaaagccgaaaacaaagatgaagaactctacaaatacctgattctaaagctctgcaattatctgaacaaaataatgccttttctcttcgagaaaatcgaagactataccgaactccttttccctgacaagcttctccatacaggctctgtcctgcatggccttaattcaattattccggacgaagactggaaagaagttgaaatcataggctggatctaccaggactatattgccccgaagaaggacaaagtctttgccgacctgaagaaaaacatcaagatcagcaaagaaaatatcccagcagtcacccagcttttcaccccccactggattgtccgctatcttgtggaaaactccctgggacgcctgtggatgctcaaccgtccggaatccagccttgttgacaggatggagtattacataaagccggaaaagcaggaaaccgattttctgaaaatcaattctcctgaagaaatcaagatctgtgaccctgcatgtggttcggggcatatgctcgtttatgcttttgacctgctgtatgcgatttacgaagaagaaggatacactccctccgaaattccggaaatgatcctgacccacaatcttttcgggattgagattgataagcgtgcaggagaacttgccgggtttgcattggcaatgaaggcaaggggaaaagatcgccgctttttcaataaacaggttcatcccaatatctgtatgctggaaaatgtcgcttttgagcaaggagaactcaatgattacattgagacagttggacgtgagcttttcaccaatgctcatagagctactttacttcagttcgcagaagccgataattttggttctctgatacgtccggttgcaaaagatatatcagaccttttgcatttattggaatcaaaaaatctttcaggcaacctctctctcctttcaactcatcaaaaagtcctgaaagctttgaagcaggcggattatctcagtccgaaataccatgtggttgttgctaatccgccatatatgggtggcaaggggatgaacaataggctgaaaacttttgctcaggataactacccagacagcaaatccgacacttttgccatgttcatcgaacgcaatcttgaccttgcagtgaaaaaaggcatggttgccatgatcaccatgcagagctggatgttcctttcgtcttttgaaaaacttcgcgaaaacatcctgagtaacgacactatcctatccatggctcattttggagcacgggcttttgacagcattggtggtgaagttgtttcaacaacggcatttgttctcgaaaatgctcaacaccctgattacaaaggatcttatctgcgactggttgatggaaactgcgaggcagataaggaagccgaattgaaagcaaaaaaatctgaacctttctgcgcctccgccgccgccttccagaaaataccagggagtccaattgcgtattgggtgagcgaaaatgttataaatgtatttactggtaacaagtgcatcgaagattttgctgaactaagacaaggaattgctacaggggataatgatcgttttttacgtttctggaatgaaataaatttttcaaaaataggatttgagtgtgaagatagagaaagtttttggtttaatgaatttgactatgctccttacaacaaaggaggaggatatcgaaagtggtatgggaataatgagtatgtaataagattttctagagtaaattacgaaatattaaaacaaatgggaaatcattgtcctagtgaacagttttactttaaggcaggagctacatggtctgccttatcatcatcccccttatccctcaggttatttccaacgggatttattttctctgacaaagggcaagcattatttacaaataaatatgaacatttgataaaaataatatcttttttaaattcaaatgtatgtggaaaccttttgaaatgtatatcaccaactttagactaccattccggatatttaagaacacttcctttatgtattaaggatattcctattaatgattcacttatttctcttagtaaattcgactgggactcctacgaaacatcctgggatttcactacccttccaattctccaaccagaataccaccatccaaccctcgctgaaacatacacaaaactccgcgcccactggcaagaaataactcttgaaacacagaggctggaggaagagaataaccgtattttcatagaagcctatggtttgcaggatgaaatgactcctgatttacctctttctgaaattacgctaacctgcaatccatattaccgctacggtaacgacaaaacagaagaagaacttgaagcactgctgttgaccgatacagttaaagaatttatatcctacgctgtcgggtgcatgtttggaagatattcgccggaaaaggaagggctgatccttgcaagtcagggagaaaagctggctgattttaaagaaaaagtacccggagctactttcctgccggatgaagataatatcatcccgattcttgatgatgaatattacatggatgacatagtaggcagattcaaggaatttttgaagcttacatttggggcggatacgctttctgaaaacctggacttcattgcaggggcgctttcaaagaaaaatgaagctcctgaaaaggttatccggaattatttcttgagagacttctacagcgatcatgtgaagatgtataagaaaaggccaatttactggctctttacttcttctgaaaagggaaaagcgttcaatgcgctcgtttacatgcacaggtacgataagactaccctagcgaaaatgaggatagattatctgctggattttgagtcaaaactggatgctcagaggtcgcttctggaaaaagaaattactggaaattctaagaatagtggaaaagctgagtcagaatttgctaaacttaataaaaagatcaatgagctcgttaagtatgatgaactgctaaaaaataaagcagatcagatgatcgagattgatctggatgatggggttgtggagaattataagaagtttgaggggttggttgggaagatatga

SEQ ID NO: 2344 - DNA, 3324 bp, Methanospirillum hungatei
gtgaccaccctttcaaaatctgaccggaacgctctagataaagcagttcaaaaagcccgtgatatctcggaggaaggagcacggaaagctcttatctcacttggggtatcggatgagaagaaaccagaacacctgagtgatgagcaggctgaacttcgtcgccgggtacgggtggtattgcgtcggcttggtacggaagaggaatttatccggtcggttgcgtatgaacaatggcaccggatgctgtttgcccggtttcttatcgagaatgatctcctcatccatcctgaacatcaggtatcggttagttttgaagatctggttgaactcgcccatgatgagcaggttgacccctgggaacttgctgcccggtatgcttcggacatgctccccgggatattcaagcaggatgatccgctcctgaagataacctatgccccggaggataggaatgctcttcgtgatatccttgcacagattccgggagatacgttcagaacttcagatgccctcgggtggacataccagttctggcagacgaagaagaaagatgaggtgaataagtcaggtgtcaagataggagctgcggaattgccttcccaaacccagctctttactgaaccatacatggtccattttctccttgataattcacttggagcctggtgggcagggaagaggttgaaagaagaggatctcaagactgccacttctgaagaggaattgagacaaaaggcgtctctccccggtgttcccctgacctatctccggtttgtacaggatgaaaatggagtctggactcctgcttccgggacattctccgagtggcctgaccagctttctgaactcaagatgcttgatccctgttgtggttcagggcattttctcgtggctacgcttctcatgctggtcccgatgcggatggagatggaagggttatcagcaggaaaagcggtagatgccgttctatcagaaaacctccatggacttgagattgatgagcggtgtgtcgagattgcggcatttgctcttgctctggctgcctggacctatccggatgccgggggataccatctgctcccggatatgccggttgcctgttcaggtcttgcgataacgtcgaagaaagaggagtgggtggctcttgccggtgataatcaggatcttgcttttgccctggatctcctgtatgatgagtttgcccaggctccggtccttgggagtttaattgacccgatgcgacggtttggagaagggaaaatcattccgattacttgggatcagattgctccgatgctcgataaagtcctagcgacaaagagggatgaggaacgagagggaatcggagttgtagctcatggattggcacgggctgcaggaatgctggcagggagataccatctgattgcgacgaatgtgccatatttagtacggctgaaacagcatgaaggcattaaggatttctgtgcaaattattatccactctctaaaaacgatctagcaacagtatttttagagaaaggtttggaattttgtaaaaagggagggacaacaaccattgtaattccacaaaattggttatttctttctacatattccaaattgcggataaatttgttgaataattcggtttggaatatgattgcacgtcttgggcctaaggggtttcatactccaatgtgggattttaatattcaattactaataattagtaaatttcataaaaaaaaccattatatagaaggattagatgtttctaaattaaataatccaatggaaaaagagcaaaaattaataacaggaaaaattacaaaaatctctcaaagaagccagattgataatcccgatgcaagaatatcttttgataatattcaaggaatattattagagaaattcggatttgcatatatgggtcagagaactggggatggattacgctttattcaaaatttttgggagcaaaatgaaaaaggtaaagagtgggtctattttggatctacagtagaaaaaacctctctttattcagggaatagtcaaattttactttgggaaaatggagaaggccaactagctgaatatcaaagaatattagctgaaaaacaatacgcaagtggtggatggaaacaaggttggcaagcatgggataaaataggtgttcgtatatctcaaatgaacaatcttccagtgactattcattgtgggccacattatgataacaatactgccacatttattccctataatccagatcatctaactgcaatctggtgtttctgttcatcttctgaatatcacgatgcggttcgaaaaatcgatcaaaaactcaacgtcacaaatgcaacccttgtgaaagtccctttcgatctcgaatactggaccaaagtagccgccgagaaataccccaacggcttgccaaaaccctactcctccgaccctacccagtggatctttcacggccacccggccaactccgatgatccgattcaggtagccgtcgcaaaacttctcaaataccagtggccggcagaactagacccggagatggaactctctgatgaacaacgggaatgggtcgaaaaagcaaaggaacttcagccatacgttgacgacgacggcattctctgtcttcccccggtgaaaggagaaacaaaactggtcgaatatgtcagggctatgcttgctgcagcatttccagactggtcaattcagaaggagcaggaactcctcatcaaatccggatataccacaaaagagggagcggtaaagggagacctggaactctatctccgggatgaattctttactgctcactgtaaacttttccaccagcgaccattcatctggcagatctgggacgggagaaaagacggattctcggtcctcgtcaattaccatctccttgaccggaaagcattagaaaaactcatctattcatacctcggtgcctggattgcccagcagagggaagaggttgcagctgaaaagaccggagcggaactccggctcaaggctgctgaagacctcaagaaaaaactcatcctcatcctgaacggagagtctccctatgatatctatgtgagatggaaaccgctccatgagcagccgattggatgggaacctgatttaaacgatggagttcggatgaatatcaggccgtttgttactgctggagtgctccggagtcagccgaagatcaactggaacaaggaccggggaaaagatccggtgccgaactgttccgggaccacggatcggctcaatgatctgcacttcacactggcagagaagctgaaggcgagagaagaggcaggggaacacggatga

SEQ ID NO: 2345 - DNA, 1839 bp, Methanospirillum hungatei
gtggataaggcaaagatacaacttttttctgattctctccggaagaacctccttgaagagacgaagaagcgggctgctcattatgggattacggggaaagcaatagcaacggtggagcaggagtttgaggattcgatcatcatcggcggagaggtctatccccggagtattcgggatcagcgggcgtatttagtcaaagaaatcgagaagaaagggtacgaccgggtgatggaggaggttacctatacctggtttaaccggtttgttgccatccggttcatggaggtgaatgattacctgccggttcgggtcttctcctcaacctcatccgggaagactgatcctgatattctgacaaaggctctggatctcaccttcctggatatcgatcgggagcatgtcctggatctgaagtcggatggccggcatgaggaactctttcggtatctcttccttcggctgtgtaattatctgcatacaacgatgccgtttctttttgaaccaattcaggattattctgagctgctcttccctgaccggctgctccataccgactccatgctcagagatctgaatactatcatccccgaggatgactggagggagacggagatcatcggctggatataccaggattatatcgccgagaagaaggatgtcctgattaaagcgaagaaacagtacacggcagaccagattccggcagtgacccagctctttacgcccaagtggattgttcagtatatggttgagaactcccttggccggctctggatgctgaatcgcccccactcacggctatatgagcggatggagtattacatccggccggatgagcaggagaccgattttctgaagatttcatctccggaagagctgaaggtctgtgatcctgcctgtggttcagggcatattcttgtttatgcctttgacctgctctatgagatctacaaggaagaggggtacctggagcaggagatcccggagtttattctgacccataatttatatgggatcgagatagacaaacgggcgggatctcttgcagcattcgcattggtgatgaaagcgaggaggatggataagaagttctttgatcacccggttcagcctcatatctgtgttcttgagaatatcgagctggatgaagaggatattgattcgtacatatctgccgtggggagtaatctctttccgaccggcctgaaagagactctcatgcagtttacggaggcggagaacttcggatcgctcatccggccaatggtcggtgatgtaacggatatcagaaaaattctggcggagaagaatatgtcctcaaatctgctcctgtttgatacgcatcagaaagttctgaaagttttggaacagactgagtatttacagcccagatatcatgtggtaattgcaaacccgccgtatatgggcaataaagggatgaataatcagcttcgtgattatgcaaaaaaattctacccgaatagcaaatcagatctttttgcgatgtttatcgaaagagggtttgatcttcttgtccatcagggatatagtgcaatggttaccatgcaaagttggatgttcttgtcttcatatgaaaaaatgaggcagaatattcttgacaatgctacaattatttgcatgtctcatatggcgaatggagtgatgggtattgcatttggaacggctgctaccgtatggtgcaatgcatacattaaggactataagggttacttctgttatgtagagtatgaaaacatcggttctgatggaaaacccatatcatttccaccatacaatgagagaaacaaaggtgcaggcctttcaataacgggggcataa

SEQ ID NO: 2346 - DNA, 1899 bp, Microlunatus phosphovorus
atgaacaccgcaccgctgaagagcttcgccacctgggccaggcgcgaactcatcactcaggtcagcgctcgcctgaccgccgtgctcgcgcccgcatcaccggagcgagtcgagaaccagcgtgccgtgtccgcactcgaacgcgatatcgcgtccgccggcggcggagccaagggcaaggacgcgatcaccgacagagtcgcgtacacctggttcaaccgcatcatcgctctacgcttcatggacgccaacggctacaccggaatcggcgtcgtctcacccgcccacggccagcagactgggcaaccagagattctcgccgacgccaagcgtggcagcatcgaccctgccgtcgtcagcaacaagcgcaccctcgaaacgatcaccgggctccttgacggcacccgccccagcgcagatgcccaaggcgaggcctacacgctcctgctcgcggagtactgccgctactggcaccgcccaatgcccttcatgttcgagcgcgagggcgactacaccgaactcctcatccccgcgaacctcctcgccgcagactccatcctcaccaaagctgctgcggcactcaccgaggagatctgctacgacggcggagacggggcgggtggcgtcgaagtgattggctggctctaccagttctacatctcagagcggaaagacgaagtcttcgccggattcaagaaggggaagaaggccggtgccgtcgagattcccgccgcgacccagctcttcaccccgcactggatcgttcgctacctcgtcgagaactccctcggccgcctctggatgctcaactatccctcatccagactcatcgagcagatggactactacattgcgccggtcgacgaggagaccgacttcctcaagatcagcagcccggaagaactgaagatcatcgacccggcctgcggctccgggcacatgttgacctacgcattcgacctgctctatgcgatctacgaggaagagggctacgccccctccgagattcccgggctgatcctcacgcacaatctctacggcaccgagatcgacccacgcgccggagcgctggcggcgttcgcgctcacgatgaaggcccgtgcaaagcagcgcaggttcttcagcaagcgggtcgtgcccagcatctgtgtgctggacccgatcacgttcagccccgacgagttggattacctcgtcaccaagaacggcgaccggcacgcagagaaagcgttctggaaccagttcgccgaggctgacaccttcggttccctcatccaggcagatcctgacctaaccgtccgcctggcgcgtcatctcgcaaccctcgatgacgaaggcgacatgctccgcgccgacgcgctcaagtgggcccagcgcgtcatcgaccaagccgagtatctcacccgggcatacacggtggtggtcgcgaacccaccatatatgggtagcaaacagatgaacgcccgcctttcacagttcatgaaggacgagtacccggacaccaagaccgacctgttctccggcttcatcgaacgctgcaccgccttcgcaggtccgcgaggggcggtggcgatgatcacgatgcagtcgtggatgtttcttagctcgtacgagaagctccgggcctccctcctcaccaatcagcggatcacctcgatgctgcaccttggtgctcgcgctttcgactcgattgggggcgaggtcgtctcctcgactgcgttcgttctgaacagccgaccaggcgggagtcgaggcacgatcactgcccagaagggagtcttcgtccgcctggtcgagggctcctcggaggccgagaagatcgctgcgctccgcaccgcgcttgttggccgcgacaaggggtcgggctatcatctggcgtcgggcgaagtccgcctgtga

SEQ ID NO: 2347 - DNA, 795 bp, Microlunatus phosphovorus
atgaaggacgagtacccgaccgggaaggccgacctgatgacggcattcatggttcgtgctcaggaactcacggttcgccgcggcacctgggcgatgatcaacctcccgtcatggatgtccttgaagtcgttcgaagacctgcggcacgacctgcttggaagccaacgaatcgcgtccatggcgcacctgggacgcgggatcttcgggtcggacttcggaaccgtcgcattcgtgatcgacaacgcccgggccaccaagtcagcgcctagcgtgtatcgacggctcttcgagcagcacgttgatgtcaggccggtgtctgcgatcgaggcgctgttccgtgactcggcgtacaaccgctacgaggtctcacaggcggacttcgcccgacgccagatgatagcccgaccccttgtcgcggccaacaagcgcggtgcggagcgcagcgatcttctcggcctccgaggagccctcgaccaggcggacgaagactcccttctgggcagtgatcgtgcctcgactcccgcctggtcggctgttcagaacgaacgcagtcgaggagacgacctcgcccccaatcgagtcgaaagcgcgagcaccaaggtgcagcatcgaggtgatccgctgattggtgaggagggaggcccggagcttctcgtacgagctaagaaacatccacgactgcatcgtgatcatcgccaccgcccctcgcggacctgcgaaggcggtgcagcgttcgatgaagccggagaacaggtcggtcttggtgtccgggtactcgtccttcatgaactgtga

SEQ ID NO: 2348 - DNA, 975 bp, Microlunatus phosphovorus
ttgaagacgcttgagcaggtggttgcgcagcatcgagcagaatgggcggcgcgctcgcgcactcagcaacagttggagatcgagaacaacgaggccgtcgcgaggctctacgggctcgaagacgaggttagctcgcatgtaccgctcgagcgcgtgtcactcaccaacaactccgccttccggtggccgaacaagacgcccgaggagcgcgatgtcctcttcacagagtccgccatcgtcgacctcgtctcctatgcggttggctgcatgttcggtcgatacagcctcgacgagccgggcctgatcctggctgaccagggcgcgacagtccaggactacctcgcgaaggtgccgacaccgacgttcaagcccgatccagacaacgtcctcccgatcgttgatggtgactggttcgaagacgacatcgtggcgcggttccgccaattcctgcgcacggccttcggagagcagcacttcgaggagaaccttcggttcgtcgaggagtccctgggagccgggtcgctgcgggagtacttcatcactcgcgccgggcgatcgaagttctacgacgatcatgtgaagcggtacaagaagcgtccgatctactggctgttctccagcccgaagggctcgttcaacgcgctgatctacatgcaccgctacacgtcgtccacggtctcgaccgtgctgaacgagtacctgcgcgagttcgagtcaaagctagaggcgaaccttcaacaccaggagcggctcgccgccgggaacggcactcctcgcgagaaggctgccgcgctgaaggacgcagagcggctccgcaaggtgctgctcgagttaggtgagtatgagcacgacgtgctctacccgttggcgtcacagcagatcgcgatcgacctcgatgatggggtgaaagctaactacccgaagttctacccggccctcaagaagatcacggggttggaggctgccgatgagtga

SEQ ID NO: 2349 - DNA, 1170 bp, Moorella thermoacetica
atgcgtgatctgccagccaccttatatacaggggaactgttctctaatactgctccagtaatcattccgagaaagtatgaatatctccctggaatttgtgctttctgtatgtccggcgaattcaccaaagctttgcgagcgattaatcctaatgttgcagttgaaaatggttatgttagtaaaatccattgggatccaggcaagtggctatattccgatacaacaatacctttgcctaaagcttatgcagatgcaccaacccaatggatctttaaggggacaataacatcgtccattgctccactccatgtcgctatagcccgacttttaggttatcaatggcccgaacatgaactggatgaattagatgaattgagcaattcagacggcatagtgtgcatccctgccgttcgcggagaagacccggctgccgaacggctgcgggcgttgctcgccgccgcatatgggaatgactggtcgccaacaaaagagcaggaacttatcgcagcaacgggttcagaagcaaaggatcttgacgagtggcttcgcaacgatttctttgaacagcactgtaagctattccaccaccggcccttcatctggcatatctgggacgggcgccggcgcgacggtttccatgccttggtcaactaccataagcttgccgagggcaatggcaaaggcaggcaggttttagaaagccttacttatagttatctcggtgagtggattacccggcagaaagatggggtgaagcggggcgaaggtggtgctgaggatcgactggcagcggcattggaattgcaaaaacgccttattgccatcctcgaaggtgaacctccattcgacattttcgttcgctggaagcctatcgaaaagcagcccatcggctgggaaccggatatcaacgacggcgtgcgcatcaacatccggccgtttatggcttctgacattcccggcggccggaaaggtgccggcatcctccggtggaagcccaatattagctggggcaaagaccgtggcaaagagcctgtgcgcccacaagaacagtttccctggttatggaagaatggtaagttcaccggcgatcgggtcaatgatgtgcatttaaccagtgaagaaaaaagaaaagcacgtgagacaatgaacaggaagacgaggagtaaatag

SEQ ID NO: 2350 - DNA, 2196 bp, Moorella thermoacetica
atgccgatgccggtactatcagtagaacagcgcaataaacttgaacgtacggttgtcgaggcccgggatgttgccgaagccggggccaaggcggccctggaggccctggccgtgcaccatcacgagccttacagccatatgaccccagaacagcgccggcttcgcaatcacctccgggcccgggcgcgccagctgggggacaggcaggaccaaaggggaaaaatggaaatcacccacctgatccaggagtgggcttacgagcactggcaccgcatgctctttgcccgtttcctggcggaaaacgacctcctgatcgagccggagatgggggtggctgtcagccttgaggagtgtggggaactggcccaggaggaaggtaccgatctctggaccctggccagccgttttgcccagcagatgttgccgcagatctttcgccccgatgacccggtgttgcaggtcacctttgcgcgcgaatatcaactgaagctggagcagttgctcaacgacctggagccgggtatctttaaagccagcgatgccctgggatgggcctaccagttctggcagagcaagcgcaagaaacaggtgaacgaatcgggcaataaaatcggcgccgatgaattgccggctgttacccagctctttacagagccttatatggtgaatttcctcattcacaacaccattggcgcctggtacgcgggcaaggtgctggcggagaacccgcagcttgccgggcaggcagaaagtgaagaagagcttcgcagggcggttgcgttgcccggtgtgacttgggattacctacgcttcgcccgtagcggcgatggggaggggccgtggcgtcccgctgccgggaccttcgagggctggccgcagcgggcagcggagcttaaaatcctggacccctgctgtggttcgggccatttcctggtagcgacattttatcatttagttccgattcgaatggccgaggaaggccttacggcccgggaggcatgtgacgccgtcctgagtgataacctccacggcctggagatcgatgagcgctgcacgcagatcgccgcctttgccctggcgctggcggcgtggacctaccccggcgccggtggctaccgccccttgcccgggttgcgaatagcctgttccggcatcgctcccaatacgaaaaaggaaaactggctggccctggcgggggatgacgagcgcctccgtaacggcatggcccggctttatgaccttttccgggaagcgcctattctaggaagccttatcgatcctggttccgctctagaaaacaatctgatagaagccgggtttgatgaactccgtcccttgctggaaaaagtaatgtccgcggagaaagacgattacgagcagcacgagttaggggttgccgcctgtggtatcgctgatgcagttcaaattcttagtggtcgttatcatctagtgattaccaacgtgccgtatcttgcccgcggaaaacagggagccggactcaagaattaccttgatacccatcatgcccgttcgaaacaagacctggccactgcctttatcgagcgcaatctaatgttgtgcctagaaggtggttctactgctttagttactcctcagcagtggctgtttcaaactgggtattcgaagattcgtaagaagctgcttagagatttacgatgggaactcttagctatacttggtgaacacgcattccgaagctctgaagctgcaggggcatttcctgcaatatatgtttgttctaaattgcttccgaaagacaatcatcttttctttagtattaacgtttcagagaggtcttctgcctgtgacaaagacttatatctccaacacgcttccttaaacaaaatgcaacagataagtcaacttaaaaacccggaacacattatcattacaaacacgttttctgggtttagagtctttggtgattatgccgattgttaccaaggcatatcaacaggcgataatcctagattttgtataaagttttgggaactcccatctattttaccaggttgggaaaggtttcaaacaccaccagaggaaacccagtactatggtgggcgagagcatctaatacgttgggaagaacgtgctagtattcaagagctaggtgctattcgagggaaaaatgcttggggaaaatggggcattgtcataggtgttgattgtcaatag

SEQ ID NO: 2351 - DNA, 3495 bp, Parvularcula bermudensis
atggagacaaacgccctcaagaaattcgccccggcagcgcggacccttctgatcgatcaggtcaccgcgaaactggacctcgtcctcgatccggcaagtgcggcgcgacgtgaggccccgaaagccgtgcaggagcttgaggcggcgatcaaacgcacctcgaaacgccagatcatcgaacaggtggcttatacctggttcaaccgcttcaccgcgctgcgcttcatggacgtgaacggatacaatcaggtgcgtgtcgtctctccggcggagggacagacgcggcctgagcttctttcagaggcgatggcgggtaacctgccggacggcgcgcctgccacaatccaaaccctcctcgatgggcgcacgccgtcgaacgatccgcagggcgaggcctaccgcctcctgctcgtccacgcctgcaacggctggcacaagcacatgccgttcctgttcgagaagatcgacgactacaccgaactgctgatgcccgaggatctgctgtcgcaatcctcgatccttgctgaactgcgcaaagtcatgaccgaggacgcctgtagggacgtcgagatcatcggctggctttaccagttctacatctcggagaagaaggatcaggtcttcgcgggcctcaaaaagaaccagaagatcacggctgagaacatcccggccgcgacgcagctcttcaccccgcactggatcgtccgctatctggtcgagaactctctgggacggctctggctgctgaacaatccgcacagcgggctggcggccaagatggactattacatcgcccccgaagagcccgagacggacttcctgaaaatcaccaaaccggaagagatccgcatctgcgatcccgccgcaggctcggggcacatgctgacctatgcctttgacctgctctacgccatctacgaggaacaaggatatgacgcgaccgagatccccgcgctgatcctgaggcacaacctgaccggggtggagatcgacgaccgcgcgggggcactggcggcctttgcgctggcgatgaaggcggcgggaaagctggggcggcggcggtttctgcgaatggaggcaaagcccgacatctgcgtgttgcaggacgtggcctttaccgaggccgagatgcaggacgtggccgccgtagtgggcaaggatctgttcaccgatgagttgcgcgagacgctgttgcagttcgagcaggccaaaaacttcggctcgctgatcgtgccgaaactgcgcgacccggcagagaccctgcgggtggtcgaggcgtgggattttggcggcgacctgctgctgaaagaggtgcaagagcgcgttatcgccgtgctgcgcatggccgaggcgctgtcgccgaagtatcatgtggtcgtggcaaacccgccgtatatgggcgggaaaggcatgaatgacgtccttagtgaaatgctaaaggctgaatattcaaactcgaagtacgatctgtttgccgccttcattgagcggtgccaagcactcaacatgggaaaggcattcagcgcgttggttacaatggaaagctggatgtttatctcacggtatgagaaatttagaaccagctttttcgatcgatcagcgatccaatcgatggttcacatgccttaccttggcaaaggtggaaccagcatgggaatcaatttcgggaccactgcgtttgttgcagagaaatcccggaaagagaattatcccgggaactaccagtgcatacgctactatgaatgcgacgagagaggtgttccgaattcatttccaatggagaatgaaaggacctcagctaccacaacggcagattttgaaagtctaccgggaactcccgtcgtgtattggtgctctggtcaggtaaaagcactctttacagaaacccccgcggtctccgagttttctgaaaccagagaaggcttaacaacaggtagcaatgatcttttccttcgtgaatggcacgaagtatcttttggcaaagcaggtatagggatcacctcgacggaagaggcttctgccacagattatcgttggttcccgtatgtgaaaggcggggagtatcggcgttggtccggaaactttgagcacttcgtaaattggtatgatgatggacaggaacttaggaagtttgctgatcctaagactgggcgaattcggtcacacaattacaatggtgactatggttttcgcggagggttcacttggtcggggatgtcgagtggtagtttctccgtaagacatgtccctgaaggatttatgttcgatgcaaaggggccaatgggcttcccgacaggaacatccacaactgctgaccttacagcgtttctgaatagccgtgtcgcggatcaccttcttaaaatgctcgctcctacgatggattttaagcttgggcacgtcctaaacctaccccttgtgtcagattttggccccagtgtttctcaaactgcagatcaattggcagattgggtgaaatccgactgggacgcctacgaaacctcctgggatttcaccacgctcccgctgctctcacccgagcatcgtggcgagtcgctggcggacagctatgccacactgcgcacccactggcagtcgatgacggacgagatgcaggccctcgaggaagagaacaaccgcatcttcatcgatgcctatggtttgcaggatgaactgacccccgaggtcccaatcgaggagatcaccctcacctgcaaccccgcctatcgctatggcgtgaagggcaccgaggaagaccgcgaaatccgcctgcgcgccgacaccatggccgagttcctcagctatgccgtgggctgcatgttcggccgctacagcctcgacgcgccgggcctgatcctcgccaatcagggcgagcggctggaggactacctcgcccgcatcccagaccccagcttcatgccggacgaagacaacgtcatccccgtgctggacggtgactggttctccgacgacatcaccgaacgcttccgcctgttcctgcgcgtgaccttcggcgaggcgcatttccgcgagaaccttcgctatatcgaggaggcgctcggcaaggacatccgcaagtatttcaccaaggatttctatgccgaccacgtgaaacggtataagaagcgcccgatctactggatgttctccagccccaaggggacgtttaacgcgctgatctacatgcaccgctaccgcgccgacacggtctccattctgctcaatgactatctgcgcgccttcatcatcaagctggaaggggagcgtaaacgcctcgaacagctttccgatgatccggacgcgactcagggcgaacgcacaaaagcgcagaaagacgcggcgaaggtggcggcgcagatcaccgagctgagtgactgggagcgcgatgtcatcttcccgctggcgcagcaaaagatcgagatcgacctcgatgacggcgtgaaggcgaactatccgaaattcggcagtgctctgaaaaaagtgacggggctcagctga

SEQ ID NO: 2352 - DNA, 1710 bp, Pectobacterium carotovorum
atgaacaacgccgaacaacagttcctgaacgagctggataacaaattctggaaggccgctgacaagctgcgcgccaatatggatgccgccaactacaagcatgtcgtgctggggcttatcttcctgaagtatgtgtccgatgcctttgaggcccgtcagcaagatctgatcactctgttccgcgatgtcggcaacccggacaatatctacgcgatgtcgcgtgacggttatgattctgatgaagagtatgcgcaggcgattgttgatgaactggaagtggaagattactacgcagaaaagaacatcttctgggtgccaaaagccgcgcgttgggaaacgctaaaaaacaaagccatgttgccgaccggtactgtgctgtgggtggacgaaactaccgggcaggacgtcaaactgcgttctgtctcctggctggtggacaatgcgttggatgaaattgaaaaaaccaacccgaagctgaaaggtatcctgaaccgaattagtcagtatcagttaggcaacgaggtactaaccgggctgattaataccttctctgatgcaaacttcagcaacccggaatataacggcgagaagctcaacttaaaaagcaaagatattctcggccacgtttacgaatatttcctggggcagtttgcgctggcggaaggcaaacagggcggccagtactacacgccaaaaagcatcgttaccctgatcgtcgaaatgctgcagccgtataatggccgcgtgtacgacccggcgatgggttctggcggcttctttgtgtccagcgaccgctttattgaagagcatgcgggcgaaaagcagtacaacgccgccgagcagaaacagaaaatctccgtctacggtcaggagtcgaacccgaccacctggaagctagcggcgatgaacatggcgatccgtggcatcgactttaacttcggcagcaaaaacgccgataccctgctggacgatcagcacccggatctgcgcgccgacttcgtgatggctaacccaccgttcaacatgaaggagtggtggagcgcgaagctggaaaacgacgtgcgctggaaatatggcacgccgccgcagggcaatgccaacttcgcgtggatgcagcacatggtccatcacctggcaccaaaaggttcgatggcgctgttgctggctaacggctcgatgagctccaacaccaacaacgaaggcgagatccgccgcaacctgatcgaagcggatctggtcgagtgcatggtggcattaccgggtcagctgtttaccaacacccaaatcccggcctgtatctggttcctgaccaaagacaaaaccggcggtaacggcaaagcgcaccgcaaaggcgaagtcctgttcattgatgcccgtaagattggctttatgaaagaccgcgtgctgcgtgatttcagccgcgaggatatcgccaaaattgccgataccttccacgcttggcagatggataaagagtatgaagacgaagccggattctgcttctctgcaacgttggaagatattcaaaaaaatgactttgtgctgacccctgggcgctacgtgggtgccgccgagcaggaagaagacgatgaaccctttgccgagaagatggcacgcctgacggcacagctgaaagatcaactagaagatagcgcgaagctggaagaacagattaaggcgaatctgggggggctgggttatgagttctga

SEQ ID NO: 2353 - DNA, 3645 bp, Pectobacterium carotovorum
atgaataccaataatatcaaaaaatacgctccacaggcccgtaaccagttccgcgatgcggtgatccagaagctaaccacgctagggatttccgtcgataaaaaaggcactttgcaaattgcagatgccgagatcgttggcgagaccgtgcgctatggccagttcgactaccccaaatccaccctcacccgccgcgatcgtctggtcaaacgtgcccgcgagcagggctttgacgtactggttgaacactgtgcctacacctggtttaaccgcctgtgtgccattcgttatatggaaatccacggctaccttgaccacggcttccatatgctctcgcacccggataacccgaccggctttgaagtgctggaccatgtaccggaagtggcggaagcactgctgccggagaaaaaggcgcagttggtcgagatgaagctttccggcaaccaggacgaagccatctatcgtgaattgctgctggcgcagtgtcacgccctgcaccgcgcgatgccgttcctgtttgaagtggttgatgatgaagccgaacttctgctgccggataacctgacccgtactgactctattctgcgcggtctggtggacggtattccagaagaagactggcaagaagttgaggttatcggctggctatatcagttctatatctctgagaaaaaagatgccgttattggcaaggtagtaaagagcgaagatattcctgccgccacccagctgtttaccccaaactggattgtacagtatctggtgcagaactccgtcggccgccagtggttgcagacctacccggactcgccgctgaaaggcaaaatggactactacattgagccagccgaacagacgccagaagtgcaggcacaactggcagtcattacgcctgccagcattgaaccggaaagcattaaggtgctcgacccggcctgcggctcagggcatattctgattgaagcctataacgtgctgaaaaatatctacgaagagcgtggctatcgcgcccgcgatattccacagctgattctagaaaataatatttttggtctcgatatcgacgaccgcgcttcccagctttccggttttgcattattaatgatggcccgtcaggatgaccgccggatattcacccgcgacgtgcgcctgaatattgtctccttgcaggagagcctgcatctagatattgctaaactgtggcagcagcttaacttccaccagcagaaccagaccggcagcatgggggatatgtttgccgaaaatacagcgttagcgcataccgacagcgcggaatatcaactgttgatgcgtacgctgaaacgctttgtgaacgccaaaacgctgggctcgctgattcaggtgccgcaggaagaagaagcggtactgaaggagtttctcgatgtgctatatcgccttgagcaggaaggtgatttccagcagaaggctgcggcgaaagcgtttattccgtatattcagcagtcgtggatactggcgcagcggtatgatgcggttgtggcgaacccgccgtatatgaatggtaaaggtatgaatggtgaactgaaggagtttaccaaaaatcattttccggacagtaagtctgatttgtttgcggtatttatgcagtatgctttttctttacttaaagaaaatgggtttaatgcgcaaattaatatgcagtcatggatgtttttatcaagctacgaagcacttcgtggctggttattggataacaaaacacttattacaatggctcatttgggagctcgggcatttggacaaatttctggagaagtagtgcagacaactgcatgggttattcaaaaccatcatacaaaattttataaacaagtattttttcgtttgattgatggtaacgaagaacagaaaagaaatgcgttaaatgcacaaaaaaatcgttttgaaacaaaacaaaatgattttgacattcttccgtttaaacaaattggatatgatttaccacaacaagtaataacatgtttttcttcatctaaaactctggcttcagttgcatccgctaaagctggacttacaactggtgataacaatatatttcaaagattatggtttgaaatagatataaaaaaaatatctgttctagatagcgagaaaaaaaagtggttcccctgtaatagtggtggtgaattcagaaaatggtatgggaataatttagttgtagttaattgggaacatgatggctatgagattaaaaatttctttgacgataatggtagaagaaaatcaagtcccagaagcacagacaaatattttcatgagggtgtaacttggtcaaaaatcggttccgggaaattttcggcccgttactttccacacggatatatctttgatgatacaggtcaatcaatatttcctaataaaattgacatattctctctgactggcattttatccagtgttgtaggaggttatttcttaagcaagataagtcaaactttgtcctttaataagggtgaagtagaaagcattccttttataaaaccattgcatgacatatccgaatacgcaaaagaagcgatccaaatatcaagggaagattgggattccagagagttaagttgggatttcaaaaaaccatatgttttaacttatagctctgagaggataaagaattcgtatgaaaaattactcgaacaaaacgatatttcaatttcaaaaattaaagaaattgaggaaaaaataaattctattttaatacaaacttacaagcttgagaatgtaatatcatctgagtcattgctcgaagatataagcctctttaagaatccaaattatttatatggtccctctcactattcccatgaaattaaaaaaagatatcgaagtgaagcaatattcgaattaacagcttatatagtaggctgcatgatgggccgctactccctcgatcgcgaaggcctagtctacgcccatgaaggcaacaaaggatttgccgaacttgtcgctgaaggcgcatacaaaaccttccctgcggacaatgacggcatcctgccgctgatggatgacgaatggtttgacgatgacgtcacctctcgcatcaaagagtttgtccgcaccgtctggggcgaagaacatttgcaggaaaatctcgaatttatcgccgaaagtctctgtttatacgcgattagtcctaaaaaaggcgaatctgcgctggataccatccgtcgctatctttccacccggttctggaaagatcatctgaagatgtataaaaagcgcccgatctactggctgttcagctccggtaaagagaaagcgttcgagtgcctggtctatctgcatcgctacaatgacgcgacgctggcgagaatgcgtaccgaatatgtggtgccgctgctggcacgctaccaggccaatatcgatcgcctgaacgaacaggtcgatggtgcctccggcggcgaagccacccgtttgaagcgcgatcgcgacaatctgagcaagaaattcaacgaactgcgcagcttcgacgatcgcctgcgtcactatgctgatatgagaatcagtattgatctcgacgacggcgttaaggttaactacggtaaatttggcgatctgctggcagatgtaaaagccattaccggcaatgcgcctgaggtgatgtaa

SEQ ID NO: 2354 - DNA, 3483 bp, Pelobacter propionicus
atgaacaaggcaaaactcaaatcctacgccccggcagcacgtcgggatttcatacaggcagtcaccgatcgtgcccacttcttcggtctttctgaatcaaatattatcccagtcgaagaaagcggagatgtcgccattatcggtggtcgtccattcccgctcaaagttgcagcccagcgaaaaaaactggaagagcgggtcaagcgggaaggtttcaatcaggtcatggagacggttgcctatacttggttcaaccgctttctcgctctacgtttcatggagctgcacggctatctggagcatggtttccgtgtcctcagcaactctggcaacagtaccgttccggagatccttgactatgcttccgagctggacctaacggggctggacaagcaaaaggtggtagaactgaagctggacggtagcaaggatgccgagctgtaccgtctgttgctggtggcccagtgcaatgctctgcataccactatgccgtttctgtttgaaaagatcgaggacgaaaccgaactactgctccccgataacctactgcactccgattcgctcatccgcaagctggtgacagagatcgaggaggaagactggcaggaggtcgaaattatcggttggctctaccagttctatatctccgagaaaaaagaccaggttatcgggaaggtggtcaagagcgaggatattccggccgccacgcagcttttcactcccaactggattgtgaaatacatggcgcagaacagcctagggcgaaaatggttggccacgtaccccaattctcctctcaaggcaaagatggaatattacatcgagcctgccgagcagaccgatgacgtgaaggctcagcttgccgccatcaccccggattcactcgacccggaaacattgaccctgcttgaccctgcctgcggttccggtcacatccttgttgaagcatatgatgtcttcaaggaaatctacctggagcgtggttacagtaaccgggactttccacgcctgattctggaaaagaatctttatgggttagacattgatgaccgtgcggcacagatggcagggtttgctctgctgatgaaggctcgtaaggatgatcggcggatattgcggagtgacaatccggtcaaactgaatgtgatggcgattcaggagagtggagacattgccattgataattccgtttttggcgagcatgcaaacgctctacgtgatgttgttgacctgttcaagaacggaaaggcatttggttcattaattcaaataccagaagctctggcagcaaaacttcagacccttgaagaggctctgatgcaaacaatgaccaccggcgatttgtatgcggtgcatgcagcaaatatgttgttaccattggtggaacaagcaaaaatatctgctgggagatacgattgcgtggtggcgaatccaccttatatggggagtaaattcttttgtcctgttttaaagaattttattgaagttcaatataaacctgctaagggtgacctatatacatgctttatgatgcgtaacactttatttacacataaaggtggattaattggaatgataactattccaaattggatgttcctatcaacttttaaagatcttcggaaatggttacttgacgaaacaacaattgaaacatttattcataatggaaggggtgtttttggctctgactttggaagctgtgcatttacattttcacatactacaatgccaaattattatggcagctataaacgactttttgaaaagcagggcagtgtcgcttccaatgaggaattaaatgagcgttttgcgtcttcacaaattaagacttcctcaactgctaattttagaataattcctggaagcccaattgcgtattggttaagcaatagtatgctttctacgtttttgaataagaaggttctaggtgaaattgcggtaggtaaacatggaatgtcaaccggtaataacaatagatttgtaagactctggcatgaagtgagtaataaacaaattggtttttcatttgctgataaagtttccgcatcagattcaaatgtacgatggttcccttacaacaaaggtggtgcctatagaaaatggtatggaaatcaagagtacgttgtaaactattggcatgatgggtacgatatggtaactggggctaaagatggctccaattccggttttcgtcacgatggtagagacagttattttaaaccatgcgtaagttggtcatttataagtgcatcatattttggtgttcgattttatccgaagggcttcatctttgatgttgcaggttctgcagtatttccttcagagaaggacctgttttctgtaactggttttttgtgttcaaaagtagctccaaacctcatggctgcactaaatccaaccataaatttccaagttggaaatgttatatcgctaccctacataagtgtcgatgcagataaaatagtgagtaatattatctctattgccaatactgattgggattttttcgaaacatcatgggatttccaatcattgccactactcactaatcatctcaaatcagccacactcgaaacgtcttggaaaaactggcaaacccactcatcttcccaaataattctaatgcaggaacttgaaaaagagaataaccgcttattcattggagccttcggcttgcaagatgaactttccccagaagttcccgaagaccagataactctttcccgtgctgaccgcgaagcagacatgaaacgtctcatttcctacgcaatcggctgcatgatggggcgctatagccttgataatcacggccttatttacgccaacagtggcaatatcggctttgacccaattaaatacccaatattccctgcagacgatgacggaattgttccagtcatagatatagactggttcccggatgatgcagcctgccgctttgaagagtttctgaaagtcacctgggcaccggaaacactggaagaaaatctgaaattcgttgccgatagcctgtctcccaaaggcagtgaaacaccacgggaaaccatccgccgctacatcagtacccagtttttcaaggaccacctgcaaacctacaagaaacgcccaatctactggctcttttccagcggcaagcaacgggcattcgagtgcctagtctacctgcatcgctacaacgaagctacgctttcccgtatgcgtaacgagtacgtcactgtcctgcaaggcaagttctccgcccaatttgactacctgacaaatgaggtaaatgccgcaacatccactgccgagcgcaaccgcctgcaaaagcaactcgatacactacgaaagaagcaggttgaacttgctgctttcgatgatttgttgcgtcactatgccgaccagcgtatcagccttgacctggatgatggggtgaaggtgaattatggaaagtttggagcgttgttagctgaggtgaaggtggttactggtagtgagtaa

SEQ ID NO: 2355 - DNA, 3726 bp, Pelodictyon phaeoclathratiforme
atgaaactttccgaccacgtcaagagtatccgtgagctgatttcgtcagcctttgcgaaccagtttgcccggctcggtatcacagcagagcgccagagtgaacctgccaccctcgaccagccacagcaagagcttcgggcaacgcttgatgccatccttgaaagccacaacaaagagaccggcacacctgccgcagcctaccagaaagcgcttgacgactacacctttaccctcttcaaccggcttgccgcgctcaaggtgatggaggcacaccggatgttccccgaagtgctcaccaaacgggctgaaaatggcggtcactcttttggccaccgtgcatggctggaacaaaacccgttcatgtcttccgaagagcttgagggattgctcttctatatccgctttgccttcgacaccctcagcgacaaaatccgactctactcccgtgagagcacctacgacatgcttccctacgtgctcgacctgaacgccattatcggcgcattcaatgccgttgaggaggacagtgatgttggctctgaaatctggctctcggacgacattatggggtggctttacgaaagctacaacctctccaaaaaacaagcatttaaggagtctggcgacaagatcgagttcgacaaggttgccctctcctcccaggtctatacgccgcgctgggttgttgagtttctggtgaacaactccctcggcaaactctatctggagatgtacccagattcagagattgggcgaaagtacaaaattgccaacatccccgccacacgggtgcgcgagccgaaacccttgactgaaattcggctgattgacccggcaacaggctccgcaaactttctgctctacgccttcgacctcttttatgacctctacctcgaccagattgagaactatggcgctgagtatgacgaagaggagatcgggaagctcattattgagcacaacctctacggtgttgacctcgatgacagggcaatccagattgcgcagttgggtctctacattaaggcattgcgacggaacagccgcatccatatcgagcgcttcaatgtggtctcctccgatttttacctgcccgattttgatgtggtggcaagctccttctccggcagtctggctaccgactcccagcagatgagtttgatcaaggcaatctgggccgacctgcagcgagcataccagtttggctcactcatcaggattgaagaacgcttcaatgccaattttgcatcactctttgaaaaggcaaaagctgaccagcaggatctttttgccacggctgaatttgagagccaggaaaagttcaaagcggagctgttccgtgatttgcacaacgccgtatcggcatacagccaaagcagcggcaacagctttttgcggagcaagagtaatgatgccatcacctttctggagatcatgacccggaagtacgatgtagcggtggcgaatccgccctataccgattcaagtgatttcgggaaggagttgaaagcttttattgaagggaattacaagaagccttatggatttcactcaaacctctatgcgacttttataaaacgatgtgcggagattatcactgataccggcaagattgcgatgattcatccgctcaccttcatgtatatcaaaacctttgagggggttcgggaatatatccttaacaatttgcatatcaatatttttgtcgattatggcttgagcaacctctttggctccataatggttgaccctgcgttttatgttctggaaaaagggataacgaccaatgacaaatcactctttatttcactggatcagtatacccgtactccacaggagaaattcaagaaagattatgctctcacagctctggagaattttgtttcaggaaagacggataaacataatattctcattaatcaagacaagctgaaaatcatcaagtcatggccatttatttactggattagtgatgcttttcgggagaagtttggaagtaatgctcttcaagattcattttatgtcgctcaaggtttagttacttcaaacaatgagagattcttgaggtacacatgggaggtttttaatgattatgcagaagaaaatattttagcgaatcaaaaatggttcttttatcctaaaggaggtatatactgtaaatggcttggaaataattggttattggtaaattgggaggacaatgggtatgagattaaaaatttttgtgatgatcaaggcaaacaaaaatcacggcctcagaatgaatccttgtattttaaggcagggataacatatggaagcagtggctcgaaaggcatatgttttaggtatatgcaaacagggcaaatattttcaggcggcggccccggaattattcctaaagcttttaacaacattccttatgtgattgcttttttaaattcaaagctttccgcataccttcttgggtctcttaatcctacagtaaatactacacaaggggatttaaatagggttcctttttgtcttccaacaaaaaagcttgaggactctattacgtatttttcaaatacggcgattgacgtaaaaaaacggttatattcattttctttggtggaatcaaactatgaagctaatccttttttgattggcatttcaaatatagaccttcgagaaaagatcaaatcttttttcacctacgaaaaccacctcctcacccaagtcctgctcaacgaagccatcatcaacgaaaagatcttcgaagtctacgaactcacccctgaagacaaggcaatggtgcttgccaaagagggcgaatccatcggtggtctccctgtatttcccgaagcccgcgcagcatatctgactgaaacagaggtcacggcagagttcccgcttgataaaatctttactttcattgaatccctgcccaccatgaccatgagcgggcaggagattgccgacctcactgcaaagttcgagacgctctaccagagcaacaacgacctcgaagagttctgcatcaggaacaagatcaacccgattaacgtctggtacctcttcaagaaaagtggagtgctgccgcagcagcgggccaaaaccattgcgatggagttcctcgccgacctgatccgcgaaattctcaatgaggacgacgacggtattgtccctctggtacgtaacaccggcgaagagatattgattgaccgcattgaaaagaagtttgaggagaaggggctcacttccgcgcagtttgccgctttcccgaccgttcttggcaaggagatcaacgactacatcaacaacaaaaacttttttagcgacctctccgatcacctcaacctcttcatgtacctgccaaagacaccatttatctggcatatcacctccgggccacgtcagggatttgatgccttcatcatcatctacaaatggagtcgcgacaagctctttaccctgaagtcggtctatattgaaaagcgtgagacggcgctgcgcaaccgccagtcagacctgcttggcgagaaaagcgcacaggcagaagaggagaaggataccattttccatcagctcaaggagattgagagcctccggaaaaagattgacgaactgctctccgaaggctacgaccccaagctcgacgacggtgtcggcaaaaacatcgctcccttgcagaagaggggtatcatcgcttatgaggtgctgaatccgggacagctcaaaaagtatctgaatgcagagtggtaa

SEQ ID NO: 2356 - DNA, 3543 bp, Polaromonas sp.
atgaacaaaaccaaactcaagtcctacgccccccaggcccgcaaggacttcatcgccgccgtcaccgcccgcgccaacctgctgggcctgtctgagaaaggtggcaaactcgaaatcgctcccagccagactcagggcgatgtcaccgtgattgctggccaggcttggcccgtcaaggtccacgcccagcgcgaccagctgatcgagcgcatccagaaagacggctttgcccagacgatggaggccatcgcctacacctggttcaaccgctttgcagcgctcaggtacatggaactgcacgactatctgggccacggccaccgggcgctgtccagcagtgcagggggcctgcccgacatcctcacccatgccaccgatctggccaacagcgatgccgccaacgccctccgaggcctgaacgcagccaaagtcaccgaactccaactcgccggcaaccgcgatggcgagttgtatcgcatgttgctggtggcccagtgcaacgccttgtcccgcgccatgccgtttctgtttgagcgcattgacgacgactccgagctgctgctgcccgacaacctgctgcgcagcgactccgtcattgccaagctggtggaggaaattccggaagaagactgggccgaggtggaaatcattggctggctgtatcagttctacatctccgagaagaaggaccaggtcattggcaaggtcgtcaaaagcgaagacatccccgccgccacccagctcttcacgcccaactggatcgtgcaatacctggtgcaaaacagcgtcggccgcctgtggctcatggcaaacccgcaaagcacactggcccaggcgtggccgtactacatcacccccgccgagcaaacgccccaggtgcaagcccagcttgatgccctcatccagacccgcgtgcgggaggacgacgacaccctcaaccccgaaacgattaccgtgctggatcctgcctgtggcagcggccacattctggtggtggcctatgacgtgctcaaggccatctacctggagcgcggctaccaacccagagccatcccgcgcctgatactggaaaagaacctttacggcctggacattgacgaccgcgctgcccaaatggccggttttgccttgctgatgaaagcccgtgccgacgaccgccgcctgttcaccgccacggacgatgccggcaacctgcagccgcccaagctcaatgtgctgagcctgcaagagagcaaaggcctgagcgtggacgagctcgccacccacctggccccgttcaaggtgcagcgcgccaccatcaccgcgctggtggaaacctttgagcacgccaaaacctttggctcgctgatccaaattccctatgcgctcaagaagcatttagcggtgttgccggaggtgctggccttggtgaaacagagcggggacatgtatgccaatgcggcttcggatgatttgctgccgctggtgcagcaggcgcaagtgctggcgaggcagtttgatgcggtggtggcgaatccgccttatatgggtggcaggggcttgcctcgctccgtcacagactttatgtctgctgagttcccgtccagcaaactagatctctactccgtctttatggaacggggatttcaactttgcaaggcgaccggaatcaatagcatggttaccatgcaaggctggatgtttctttcttcctttgccacttttcgggagaagctacttgatgagcgatctattaccagtctcatccagatcggatacaacagcttcccagaaatgaattcgaaggttgcccaagcctgcgccttttcatttttggcgagcaaagtggacggcttgcttggcaggtatgtggatctcaattctgcgccgcagtcctcagacaagagtgagatcctgcttaatagagattctgaaattgtttacgatgtatttcccgatgattttagaaagatgccgggcagtccactctcctacacaatcgcccctggtctattgaaggcatttagcttcacgaaattgggtgaactgacgaagggtgagggaaaaaatgttacagctgataacgagcggttcttgagacttgtttgggaagtcagtgccgaaactgttggaaaagggaggaagtggatcatttacgccaaaggcggcgattatcgaaggtgggccggaaatttagactacgtatgcaattggagtgaagcggcgcgaaagcactatcgtttcaacaattcatctcgcattattagcgaagagttttggtacctccctggattaacctggacagtaatcgcaacaagtggtgttggtttcaggtatctgccgtgtgatacaacctttgatacgaaggggttggctctattttttgagcgagacgaaaacattgtctcaatgcttgcattgctaaactccactgtcggccaaaaactgatctctctcgtgaatcagacaatgtcgataaataccatcgatataaaatcaatacctgtttgcccatcgttccctgaaatatcatcggaagcgacggagttgatcaatagtgcgttggaagactggaattctgaggagcggtcctttgatttctcgatgccgcagttattgaggcatggcgaacaggagaaaagtctaagtagcgcctttgcagcccacttcaaggctatcgcaagcagtatttctcgaacaaggcagcttgaggaaacgatcaacagcacgctgatcgaagcatatggactccgcggtgaactctctcccgaagtccccgaatcccagatcaccctggcccgcgccgaccgcgagaaggattgccagcgtctgatttcctacgccatcggctgcatgatgggccgctatagtctgggcgcgccaggcttgatttacgcccacgccggaaacatcggcttcgacgccagccgctatggcacattccccgctgatgccgacggtatcgtgccgctcactgacgaactctggttcgaagacgatgccgccagccgcatccgcgaattcctgctcgccgtctgggggccagacaccctggaagaaaacatggcctggctggcagaaagcctgggctccaaggccagcgaaacgacggacgagactatccgacgctacctggccgacaagttctacaaagaccacctgcaaacctacaaaaagcgccccatctactggctcttcagcagcggcaaacaaggcgccttccaggccttggtctatctgcaccgttaccacgaaggcacgctagcccgcctgcgcgccgaacacgtcgtgcctctcaccggcaaaatccagtcccgcatcgacatgctgcaaaaagacgccacaaccgcctccagcactgcagcccgcaacaaactggccaaggaagtcgataagctcaaaaagaaacacgtcgagctcctggcctacgacgaacaattgcgccatcacgccgacatgcgcatcacactcgacctggatgacggtgtgaaggtgaactacggcaagtttgggaatttgctggctgaggtgaaggccgtcacaggaggagcaggggatgactga

SEQ ID NO: 2357 - DNA, 3807 bp, Pseudomonas brassicacearum
atggctttcgatcaatccacacgaggccgcctgcaaaagctggttaacacttgtcgaagtctgttgtccgaggagtttagcatccagcttcagcaggcctatggcctagaccccaagaccggtgatgtcacgcccatggcgcggctcatccatctggacgatcgccagcgccacacggctcaagtgctgcgccaaactctggcgcactacctgggcgcggatgccgacgacaccgatcaccgcatcgcagtgctcgaccgtgtggtgcgcgagcaggcgtttaccgtgctcaaccgtttggcagcactgctaatgatggaagcgcgcgggcaactaattgagtcggtcagcaaaggctaccaatcgcgtggctaccagctctacagtaagatcgccggtaacgccctgggtgaaaccggccaggcgtaccaggtttatctattcagcgtgtttgatgagctgacacaagagctgcccgccctatttgatcgctatgccgccaatggtttgctattcccgcgcgagaccgccctacgggcggtgctgggcgagctcaaccactttgaaattgagccactttgggccgaagacgaaaccattggttggatctaccaatacttcaattccaaagaagagcgcaaggccatgcgtgatgccagtcaagcaccacgcaatagccgcgagctggccgttcgcaaccagttcttcacgccgcgctatgtggtggagtttttggtggacaacaccctgggccgcctatggttcaacgccacaggtgggcaaaccgaactgcgcgaccgttgccaatacttgctggtaaaacctgatgagcaaccgcaggcttcaagtaaagtgcgcgacccgcgcacacttaagctgctggatccggcttgcggctccatgcactttggcctgtatgccttcgatctctttctggagatttaccgagaaacctgggcttgggagcagcaaaacggcccgggctcgttggatgtttccacgcaaccccaagctgcgctcaagccactctgccgtacctacgaagacgaagcggcttttacgcgcgatttacctcgtttgatcatcgagcacaacatctacggtgtggacattgatccgcgtgccgcccagatcgcttccttggcgctatggctgagggcgcagcgtgcctggcatgaagcaggtgtcaaagccaaagaccgtccacgtatagggcagggccacgtagtggcggccgttgcgccgccagcagagcgtgaattgcgccatcagtttgcagctaatctggatcagcgtgacgccgaactgttcgagaagaccctgcaattgctcaagggcctgccagagctgggagtgctgctccaagttgaacacgagttgccgagcctgatccgtcaggtttatgtgggcaagggcactggcctgtttgccgagcaggaacaggagagctggctgaatgccgaggctcgcttgcgtgcggcgctgaccgagtttacccaggcctcccattcaacttatcaagggcgtctatttgcgcaggatgcccttcagggattgcggctgatagatctatgtagtgaggtgttcgatgtagtggttatgaatcccccttttggtgatggttccactgaatggtctggctacttaagcaaccgatatggaaaacatgcaaataatcttttttgtactttcattgcacgagcgatttcgctgtctaaactaggctttgtcggcgctataactgacaatacatggctgaagaagactgattacgaagaccttcgggagcttgtactggatggcgatctgcaattggctaatttagttgatctaggttggggagtgcttgatgatgcgaatgttgctgcttgcgcattcacattaagtgcgttgagcaccgacatcgtgaatacgctcgacttgcaagaatcgccattagatgggaaaggagacttgctacgcactgtagttagtcagttctccaatcctttttctttgaaagaacaaccctctgccccgcagatcaattcagtagatagaaggtttttcgacaatttcccaggaaaggctatcgcccatgaagctccgcccgcatttgtttcgttgttcactttgtggcctggtatagatccatcgttctgtaagacccgtcgtgggtacactccaggcgacacatttaggttttttagattgtggtgggaggtgagctcggacttgggggcacaaaagtggtggactttgaacaacgggggggcatattcaccaataattactgatgggcttttggttggttatcgtgatgacggctggtctcaataccgcccgctttctgggttcagacttgaatctgagcaatggttcggaaagccgggaattggttggggcaaaagaaccgactatatgtatgcttaccctttgccggccggaagtatattttcccatgaaggacattgcgcatttcctactgatgatgtgtatctttggcctttattggcttatttaaactcatcgctaggtcagcaactgctcaatctattctgtgggcagcacaaattggcaggttacgtctccaacctgccttgcccaccgcttaattctgaagagttgcgactggctggagatgcggctaaagaatgttgggaagcagcgtcgaaaatttctcgcacttctgaacagtcagaaatatataattcaccatttagccaaataacgaagccgtgggaagtaaataaactactaagcggttgggttgacatatattttaaaaaaattgctgaaatagaccggttggttgataagtgtgcggcgaaggctacgaatatttcaagtttttcctcatctggagatgaccggccaagagcgtttgttgagaaattttgtacatcatatgactgggcgcgagaacttgtttcgtacctttttggctgcgctgtaggacgttggtcagttggcgagtttgattctgatcttgaaaatttatgcgctggaaatcctttcgagaagattaattaccattttttagatgttgatgctcgcaatgtggttcttgttgatgacccgggtgcgccgcttgatgcatctgggttgatacgatcatatttgagaaagatatggaatgaagatgctgatgtcatcgagtccgctatattggagcatattggtgaggagagtcttcgttcgtatttggtaagaccaaatgggttcttcgcggatcatcgggataggtattcaaaaggaaggcgatcagccccagtctattggccgctttctactgcatctggtagttacacgttgtgggtctattatccatccttgagtaatcaaacgctgttctcagcggtgaatgatttcctcgacggccccaacgggaagctgacgcaagtcagccgtgagtgcgcagagttgcgcattacgggcagcggccgttctcgtgatgaggaaaagcagtacgaaacgttgcaaaccttcgagcaagagttgaccgatctgcgcgacaacttgctcaagatcgcgccgaccttccagcccaaccacaacgacggtgtgcaaatcaccgccgcgccgctctggccgctgttccgccacaagccctggcaaaaggtgttgaaagacacctggggcaagctggaaaaaggtgattacgactgggcgcgcctggccgccgcctactggcccgaacgagtgcgcgagaagtgcaagaacgacaaatccctcgccatcgcgcatggacttgaagagctgtacgtggagccagaggccgctcccaagaaaacgcgcggaaaaaagaaggctgggggtgaggaatga

SEQ ID NO: 2358 - DNA, 1071 bp, Pseudomonas stutzeri
atgattacgaaggtgcatcgagcagattgggacagttatgaaacttcctgggacttcactagcctcccgctgctgcattccgactactgcctccccaagctgaaggatagctaccagaagctccgcgcccactggcgggagatgacgctggagatgcagcggctggaggaagagaacaaccgcatattcatagaagcctacggtctgcaggatgaactgacacccgaggtgccgctcaacgagatcaccctgacctgcaacccgcattaccgttacggcaacgacaagagcgaggacgagctggaggcgctgctgctggccgagaccatgcgcgaactggtctcctatgccgtgggctgcgtgttcggccgctacagtctcgacaagccggggctgatcctggccaaccagggcgagacactggccgactaccttgcacaggtgccgcaaccgagcttcccggccgatgacgacaacgtcatccccatgctcgatggcgactggttcaccgacgacatcgccgagcgattccgcaggttcctgcgcgtggcctttggcgaggaacactacgaggaaaacctccggttcgtcgagcaggcgctgaacatcaagggcaagcgcaactacagcatccgcgactacttccttggcgagttctacaccgatcatgtgaagcgctacaaaaagcggcccatctactggttgttctccagtcccaagggcagcttcaacgcgctgatctatatgcaccgctaccgcccggatacggtgagcgtggtgcttaacgactacctgcgcgagttccgcaccaagctcacctcccacaagaaccatctggaggcggtcagcatcagcgccagcagcagccagggcgagaagaccaaggccctgaaggagatcgagaagatcaccaagatgatcgccgaaatggaggactacgagcgcgaagtgctttacccgctggccaccgaacaggtggagatcgacctcgacgacggcgtcaagctcaactaccccaaactcggcgcggccttgaagaagatcgtcggcctggatgcgaaagaggattaa

SEQ ID NO: 2359 - DNA, 1809 bp, Pseudomonas stutzeri
atggaaacaggaaaactgaagaagttcgcccagttcgcccggcgccagctgattgaacaggtatccgccaagctgaagctggtgctggccgagaacagtgccgcccggcgtgaaagccttgacgccatcaaaaaactcgaaaaggcgatcacgagaaccggcacggaacatgtcattgagcgggtggcctacatctggttcaaccgcttctgcgccctgcgcttcatggacgtgaaccgctacacccgcatcggcgtggtgtcacccgccgaaggacagtttcagcccgagcttctggccgaagccaagatggggcacatcgacgaagagatggtgccagaaaagtcacggcagcagatcttcgccctgctcgacggtaaagcgcccagccgagacccgcaaggcgaggcttaccgcctgctgctggtggccgcctgcaacttctggcaccagtccatgccatttttgttcgagcgcatcgacgactacaccgaactgctgatgcccgacgacctgctctcgggcaacgccatcctcgcctatacccgcgaggcgatgacaccggatgcctgcgaggatgtcgaggtgatcggctggctctaccagttctacatctcggaaaaaaaagacgcggtgttcgaggggttgaagaagaaccagaagatcactccggaaaacatcccggccgccacccagctgttcactccgcactggatagtccgctatctggtggacaactctttgggccgcctatggctgctcaaccgtcctggttcgaagctggtcaagcagatggagtactacatcccgccggaaaaaccggaaaccgatttcctcaggatcagcggcccggaagacatcaaggtctgcgacccggcgtgcggttccggccacatgctcacctacgcctttgacctgctctacgccatttacgaggaagaaggccacgatccgaccgagataccggaaaagatcctcacccacaacttgtacggcatcgagctcgacgaacgcgccggggaactggccgccttcgcgctgaccatgaaagcccgcgcccgccagcggcgcttcttcaacaagcgcgtcaagcccaacatcacggtgctggagaaggtgagtttcagccgcgaagagctggacgaatacatgggccacgttggccgcgacctgttcacccacggcctgcgtgggacgctgccgcagttcagcgaggccgacaacttcggctcgctgatcgtgcccaaggtgggcaacgtggccgatgtgctggcgacgttggaagccaaggacatggccggcaacctgttcctggcggagactcatcagcgcgtgctgagcgtgctgcgcatggtcgaagccttgagcccacgctacgccgtggtcgtggccaacccgccttacatgggcggcaagggcatgaacgggcgcttgagcgcctgggccaaagagacctaccccaacagcaagtccgacctgtttgcgatgttcatcgagcgcaacctggaccttgcggtgaaaggcggcgcggtcgccatgatcaccatgcagagctggatgttcctgtcctcattcgaggcgctgcgcagccgtatcctgaaccagcacaccattctgtccatggcgcatctgggcgcgcgagctttcgacagcatcggcggcgaggttgtctcgaccacggccttcgtactcgaaaacgcccacaagccagattaccgaggagcctacatgcgactggtggatggcaactcggaggcggagaagatggaaatgctggccgaggctatcgcacaaggcagtgcggcatga

SEQ ID NO: 2360 - DNA, 3549 bp, Psychrobacter cryohalolentis
atggaaacgaccaaactcaaaaaatttgctcaacaggcacgtgtcactttgattgagcaagtcgctactaagctcaaatttgtacgcgcagaagaaagtttagccagacgtgagaatcctatcgctgttaaaaagctagaggagctaatcaagcagcagtccgaacaggaaatcgtcgagcgtatcgcatacatctggttcaaccgtttctgtgcccttcgcttcatggatatgaatcgctataaccgcagcctcgtggtctctgctgctgccgatgatactcaacctgaagtactggcgctggcaaaggctggagacattgatgagcgagtggtatcagaaccagtccgtgagcaaatcctcaatctgttaaatggcagagcgcccagtcaaaatcctgaagcagaagtttatcgtctgctactggtcgcatactgtaatcaatggcatgagtccatgccattcttattccagcgtatcgacgactatacagagttgctaatgcctgatgacttgctgtccagtagctcagtattaactgatatgcgtgaagccatgccagcaagcgcttgtaaagacgttgaagtcattggttggttgtatcagttttacatatcagataaaaaagatgatgtatttgcaagattaaagaaaaatgagaaagtgacaccagaaaatattccagcggctactcagctattcacgccacattggatcgtacgttatttggtagagaactcgcttgggcgattatggttgcttaatcatccagagtccaagttagcagacagcatggaatactatataaagcctgctgatgataatgatgactctgattatctcaaggtagcgcgtccagaagatcttaaaatttgcgatccagcatgtggctcaggtcacatgctgacttatgcgtttgatctgctatacgcgatctatgaagagcaaggctatggtgcagcagacataccttcgcttatcttaacgcataacttgtacggtattgagattgatgaacgagctggtgagttggctgcttttgcattgactatgaaggcaagagatcgtcatcgtcgattcttcaatacagatgtgcgtccaaatatctgtgtgcttgagcccattagttttgatgacgatgagttagatgagtatatggactttatcggccgtgatatatttaccgctgacttagaggaaacgctgcgccagtttgatgaggtcgataattttggttctttgatcagaccaaagctaaaaaatgttgctgaaattttagagcagttggaagcgactgatgtctcagggcagttatttttaggtcatacgcatcaaaaagtgcttaagctgttaaagcaggcagattatttaagtccgcagtatcatgtcgttgttgctaacccgccttatatgggtggcagtggcatgaataatcgattaaaggcatgggcaaagaaagagtttccaaatagcaagtctgatttatttgctatgttcattgagcgaagtcttgatttagtttgtaatcaagggttagtagctatgataactatgcatagttggatgttcttatcttcatttaaagagttgagagaacagcttcttaatcaagttacgataacttctatggctcatttaggctcgagagcatttgatagtattggcggagaggtagttcaaacaacagcttttattatgaaaaaattgagtgaccttgactataagggaaattacttacgtttagttgatggtaattctgaatttcaaaaaaacaggatgatacttgaaattagcgaggaaaagaaatttaataacctatatcaatcttcagccaacgattttaagaagataccaggaagacctataacttactggatcagtaagccatatatagactgctatgataatggtgaattaattaaggatgtttttcctgcaaaactaggcatgcgtactggcgataatgccaaatggttacgactgtggtatgaaacatctttaatcaaatgtagcttttctgatcttaattctgaccaagatattcaactaccaaaaagctggtttccttataacaaaggtggtgagtttcgtcgctggtatggtaacaatgagtttttagttttttgggaaaatgatggttatgatattaaagaagaaacacttatcaagtatccgcagcttagctgggataatctaggatggaaaatcactaatgagtcagatttttttaaaaaatcattaacatggtcattcattagctccaatagttttggtgttcgatgttcgttaggtggggctatattcgatgtaggtggatcaagcatttttccagaaggtgataactattatttagcagcaggttatttatgttctaaaatttgttttgaatttcttaaagcaactaatcctactcttaattttcaggtagttaatataaataacttaccttggattcagttggatgaagagaattgtaaaagagtaaatgagttagtgaaaaaattagttgaatatagcaagtttgattgggattcttacgaaacctcatgggactttactacattaacactgctcgaagaaaaatatcgcaagtcaaatttagcagacacttataaaggactacgcactcattggcaacaaatgaccaatgacatgcaacacttagaagaagagaataaccgcatttttatcgacgcttatggcttacaagatgagcttacgccagatgttccgctaaaagaaatgactttgaccagtaacccatactatcgttatggtggcgtcaagacagacgatgagctggaggcgttattgctagccgataccatgcgtgagctgatctcttatgcagtcggctgtatgtttggtcgctatagcttagacaagcctgggctgatacttgccaatcaaggtgacaaaatagagcagtactttgaacagatacctgatccaagcttcatgcctgataaaaacaacgttattcctatcttagacgatggttggttcagcgacgatattgttgagcgcttccgtaaattcattaaggtagcttttggcgaagagcagtatgagagcaatatgcaattcattgaacagtcgcttggcaagaatgacaagccacgtgatattcgtgactatttcttaaaagacttctatgacgatcacgtaaaacgttataagaaacgtccaatatattggctatttaccagtggtaacttcagtgcgcttatctacatgcatcgctatcagcccgatacggtaagtatcgtgctcaatgactatctacgtgagttccgtactaagcttaatgcttataaagaccagcttgatacgatcaaaattagtagtagtcaaagccaaagtgaaaaaacaaaggcaataaagaagctagaaactactaccaaaatgattactgagatggaagagtatgagcgcgatgtactctatccattagcgaccaaacagatcgacatagacttagatgatggcgtaaaagtaaactatcctaaatttggtaaagcattaaagaaagtaacggggcttagctaa

SEQ ID NO: 2361 - DNA, 3501 bp, Rhodococcus erythropolis
atggaaaccgctccgctgaagtccttcgccacttgggcacgcaccacactcatctctgaggtcacggcccgcatcgcagtagtgctcgcgcctggatcgtccgcgcgggtggagcgatcaaacgtagtcacaacactggaaaaagtcattcaatctgcgggcggcggcgagctgggtcgcgcctctgtcgcagacatggtggcatatacctggttcaaccgcatcatcgcgctgcgattcatggacgccaacagttataccggtatcggtatcgtctcacctgaacgaggccgcgacagcggtcagccggaaatccttgctgaagccaagcgagggaacatcgatagctcggtcgtcagcaaccagcacaccgtagagactgtgacgaacctgctcaacggcacgcgccgcagcgaagacccacagggtgaggccttctcactgctgctcgcgaactactgtcggttctggaatcgctctatgccgttcatgttcgaacgcgacggtgatttcactgagttgctgatgcccgggaatctgctcgccgacgactcggtgatggccagcgcagtgacggtactcaccgaagaggtctgcaaggacgtcgaggtgatcggctggttataccagttctatatctccgagcgtaaggacgaagttttcgcggggttcaagaagaacaagaaggccggcgccgccgagatccctgccgccacacaactcttcacacctgactggattgtccgctacgtcgtcgagaactccctcggacgcctctggttgctcaaccggcctacgtcccggatcgccgaccaaatgaagtattacatcgctcctgtcgacgaagagatcgacttcctgaagatctccagccctgaagatttgaagatcattgaccccgcatgtggctccggccacatgctcacttacgcattcgaccttctctacgcgatctatgacgaagaaggaactgatcctgccgacatccccgggttgatcctcgccaacaacctttttggtactgagatcgatccgcgcgcgggggccttggccgcattcgcacttaccatgaaggcccgctcgtaccagcgcacgttcttcaccaagcaagttaagccgaacatttgtgtaataaagtcgatatccttctcaccggccgaacttggcacacttgcaatccccggtggcgaccccgctgatgaggaggcgttctggaaccagttccaatacgcagacattttagggtcactcatccagccagaagagaaattaataggggcgctcaagcggcacataaacacacaggaggagacctataaaggacgattagtgggggatatctacgcacgcgccactcaggcattgactcaagccgaatatttatcgtctggatatcatgtagccgtcgcaaatccaccgtacatgggccgcaagaacatgaacaatattctcgccgcgtttgcaggtcaaaaatatccagataccaagactgacctattttcgatgtttatcgagcgatgctgcaatttatgtctagatcggggacaacttggattcatgaccccttttgtgtggatgttcatctcatcgtacaacaaactgaggcagaaacttactcaacatgccacgatcacaagcctaattcagctagaatattctggattcgaaggtgccactgtaccaatctgcactttcacaatcgagaattcagcacatcctggatacagtggaagctacataaaactttcagattttgttggatcagaattacagaaaccgaaagctctggaagccatacagaatccagatgtaaactggttctatcgagcaaagtctcaggattacgaaaatatccctggtacaccgatcgcatactcactgccaaaaaacgcaattcgcgcatacagagaatttgacaatttcggaagccattcctacgggcaaccgggacttcaaaccagcgacaacgctagatttgtgcgtctttggcatgaggtcgatacatgcagtttcaactacagagccctgtcgtccagagaagcacaatcatcaagagcgcgatggtttccattggttaagggcggtgaattcaggaagtggtacggaaatcttgagtacgttgtagactgggaggattctggtgccagaatcaaggattcgataaacaaaaaatatccatatctaaacggaaatatcgactatgtcgtaaaggatagagggtactttttccgtccatctataaattacaacaaaataacatctgggcgtttcacagcaagatatgctcccgccggcacaatcttcgacgtggccggttccgcagtgtttccgtatggtaatccgatgcttgcgcttgcctttctgggatcaaaaacaggcgacttcttcgtccgcgcccagaatccgacactaaatgttcaatcaggcgacatagcgcgactaccttacccagaatctgcacttacctccagagctgccaccctgacgactttggtccagaatgcaattgacatctcccgaagagactgggattcggcagagaccgcttgggaattcacgtgctcaccgctcgtccactcgtacagcgcgcaggttcctctcggtaatcgcgttagttcagtaatcgagaacatccaaggagaacacgtaaggctttccgaagttgagacgctgatcaactatgaagttgcaaaagcctacgggcttgaccaggatattaatccatacgtctcacccgaagaagtgactcttcgtccaaataataagaacttgatcgttcgagatctagtttcatatgctatcggctgcatgttcggtcgttacagcattgatgagccgggtctgattctcgcgaatcatggtgacaccctccagaattacctggcgaaaataccggatccatcgttcatgcccgatgcggacaacgtgattccgatcatcgatagcgactggttcgaagacgacatcgtggcactattccgccagtttctaagagtggcgttcggaaaccagcacttcgaggagaacctacggttcatcaccgaggctctcggcgttaagaacttgcgcgactacttcgtgaagtcgttcttcaaagatcacgtacaacggtacaagaaacgcccgatctactggctgttctcgagcccgaagggatcgttcagcgccctcatatatatgcaccgctacacgacatccacggtctcgaccgtactgaacgagtacctgcgcgagtttaaggcgaaattggaggcgagccgccagcaccaccaacgcctcgccgcgggcacctgcactgcgcgggagaaggctacctcgcagaaggaggccgatcgtctgcggaaagtgcttctcgaactcgacgagtacgagcacgatgtgttgtatccgctggcgacccagcaaatacagatcgacctcagcgacggtgtgaaggcgaactatccgaagttcggcaacgcgctaaagaagattcccggtctcgaggccaaagatgactga

SEQ ID NO: 2362 - DNA, 3981 bp, Rhodopseudomonas palustris
atggacaaggacacccgaaacgccatcgaacgtgcgacccagaagatccggcggatcctccaggaggatttcgccgaacagttggacggcgtgttcgacgtgcgctccgacggtcgggtcgccgaagagggcggccgtcacctctctggacgtcaactcctgctgcgcgatcggatcgtggcggccgtcgaacacaagcgccgagccggtatgcagccgaccgacgccgtgcgggactacatccgtgacgccgccttcaccactctgaaccgcttcgccgcgctcaagatgctcgagccgcgcgggcttgtgcaggagtgcattagccgcggcgaaaattcgatcggatttacggagttctgcggcctggcgccggggctgaagaccgtcgacggagccggctatcggctctacatcgagagcattttcgacgaactgtctacggaggtgaaggttctgttcgacagacgggatccggcgtccgcgctttggccgagaaaggccgctttcgatgaaattctcgaaatcctgaacggctccggcctagttggagtgtggaacgaggatgagacgatcggctggatctatcagttcttcaattcgggcgaagagcgtcggcagatgcgtgaggaaagtcagacgccacgcgacggtcgagaactcgcgatccggaaccagttctttacgcccaactatgtcgtccgctttcttgctgaaaacagcctggcgcgcatctggtgggagatgcgccgtggcgacacacggattctcctagaaagcgaatatctagtatgcgaatcattcgacctcgatcaagcggccggaatgtctgccgatcaacctcgtacgaagaaggatcctcgatcgctcggcgcgattgatcccgcatgcggttcgggtcacttcctgctctatcttttcggccttttcttgatgatctacgaagaggcctggcacgatcttgatgctccaacgttccagggaagtggccgcacgttgcgagaagatttccccgaactcgaagaattccggaaggcgatgccaggccttatcctgcgatacaatcttttcgggatagatatcgactttcgctgcgctcaaatcgctcaactcgcgctttggatgcgagcccaacgggcgttcaaggagatgaatgtctcgagggcggcacgtccgcgtatacgccgcgcgaatatcgtgatcgcagagccaattccgggcgatgcacctctgatcgaaaactttgcctcgaccctcaagccggccgccctcgggacgctcttcaaggggatcgtcgccgagctgaatcacgccgatgagatgggagcgcttcttcctctcgatcgtacactcgcgtcactcattgacgaagcgaacaaatctatttcgcaggctcgggagaagggaaagcaggcgacgcttcccggtttcgacgaacaacgtgctgaatccgttcgttacgtggatttgcggggattctcttcatttcaagaagcggaagccctactgaaggagtcgctcgaagagttcttgatcaatgcggtgaacggcatcggagtgcggcgtcgcctttttgtagacgacgcagagcaggggctcgcgttagtggatcttatgaatcgtcattacgacgtaatcgttatgaatccccccttcggcactccttcggacggggctcgagagcgcatagcggctgagtacccgcaaactaagtatgatttgggggcagcgttcgtagacgagtggagaaatcgcctcaccccccgtggacgccttggcgtcatattcaaccggacaaattggttcttaagccggctgcagcactttcgctctcgcctgttggaaagatcatggttggcctgcaacgcggatcttggcttgggtgtgctggacgcgtttgtcgagacggccatgacagtcatcgaaaatgggccgcaagaaaaaaggcagtctatctggtttcggcttacagaagggggagatcgcgaagggaatctccgccgcttcgtccgtgacgtaaactcacgttcagtgacatcgaacacatttatccacccgcagagcgcgttcgagaacatcgccggcaaggcgttctcatattggctgtcgccggctctgctgcacattaaagagctcacgccgctcaccgcttctggaatcgaagctaaacaaggattggccaccaaagataactttcgctttttgcggctacactgggaactcaagcagaatggcgagcgatggaagttatactcgaaaggaggagcttatgctcctttggtcggcctctatcatctagttattgattggggtgcggcggcttctgccgcatacgcaaatcgagacgggcagttctgttgccttctgaccggacaggcccataagtatgctttccggccatgcataacttattctcagcggacttctcgtttttcagcgagagtgtttccggctaaagggctgtttgacacgaaaggatccgcggtcttttcgccaaatgtgacgacagagagcgacgacgcagaacaactcgtcgcgctttgcctgttgctaaacacgtccctgggtcaatttcttttcgactcgtctggaggggcgtctgacgaaggaaaagcgcgagactactcgcaaggtatggttggagctcttcctggcctagcggacatcaagcgtgcaatgaatcctgtcttgcaggaagctaaggatgtgatcggtgagcttgtacgacttcagggtagtgatccaacgtcgatttattacacgggcttgccatccgcgtcgtggatgaatagctcgcgccctgaagatattgtcgagcaagctacaaatctgcagaagcgtttgagtgggctccttcgagaggccggcactcgatattgtgacgctcttggcttggatgccggatcccaagcgttcgtcgatgaaacagttcgggggatgcatcgcgaagccgtgcacgaagcgctggctatcgaccccgcggatatctcatctcagattcggcaatcgattcttctgagcgtctttgctccgcggaaggtcggaggtggaatcgtgcagcaggtcaaggataatccattgctggccgtcgcctggagccctcattctctcagcgagtcacctgttcgagtgctcgtcactgactccggccatgaactcgatcttgctcgaaggatgtccaagttctgtcaagaacataaactcagcgacgattgcgttcgaacttggtgcggtttcgatgattttgaagagtggacgaaacttgatgccttcgcagagcacgtttcgatgttctcgaaaagccagcggatcgcccccgtcctttggcaaatcggaacggccgacggccgctactccatttggctgcttagctacatggtgaatcgcaatacccttctagatgtcgaaaatgatctggtcgtaccgaagatcgccagcgtcaagcgagaactggaagcattccgggtggagaccggcgccgctccaactgcggatcaacgcaagaggctggaaagcttggagagtttctctgaaaatctcgcccggtttcgggacgagattgtgaaggtggcacttcttttcgatcctcatgaagaggatggagctacgatctgcgcggctcctttgtatcggctcttcccgcaaaacaagccttggcaggctgaactccggaagacttggaaggatctttgcgatggcaagctcgattggtccaacgtggccatgaggctgtggcctgaacgggtgattccaaagtgcgcagaggacctcagctttgccatcgcccacgatgtcgttgatgtgttctggttgaaaaactcggaagggaagtggcaagtccggaaggtgccggtccagtcaattgagagtttggtggatgaacggacttcgttgaatgtaaagactgcgctcaagaatttcatcgagtcgtcggatgctgccggctccgtgaagcgcgcccgaaaatcaaaggcggcatag

SEQ ID NO: 2363 - DNA, 3489 bp, Saccharophagus degradans
atgaaccatttacaaccactggataaaaagctgcgcagtcagctggaaaacacggttaaaaaggcccgcgatattgccgaagaagcggcgctggctgtgttggaacaactgggcgttggtgaaaaaactaagcccaattacttagatgctgcccaacaaaacctgcgggttcgcctgcgtgcccatgcccgtagcctgggtgatgcgcgcaagccagacggcgagcaaagcatcgagcgcttgcaagaggaagtggcctacgagcattggcaccgcatgctatttgcccgctttttggcagaaaacaacctgctgatgtaccccgacccggacgagccggtggccatcaccctggaagaatgtgaagacctggccgccgacgaaggcgcggccaacggctgggaactggccgggcgttacgcctcacagatgctaccgcaaatcttccgtgtcgactcgcccgtatttgaactcaagctcgcccccaaccatcaactggatttggaaaaactgctgattagcctgccgaccgaagtcttcaccgcgtcggattctttaggctgggtgtaccagttctggcaagccaacaacaaagagcgcattaataaatctgaagtcaaaattggtgcgcgcgagctgccagccgttacccagttgtttaccgaaccctatatggtgagctttctgctcgataactccctgggcgcgtggtgggcagcacgtcgtttaagtgaagaccacttgaaaaacgcaagcagcgaggaagagctgcgccaaaaggcagccattgatggcgtgcctctggaatatttgcgttttgttaaaaacgaagcaggtgtgtgggagccagcctctggcaagtttgaagcctggcctaatgaattaagtgagctttctaccctcgatccaagctgtggttccggccattttttggtggccgcctttaatatgctggtgccactgcgtatggaatttgagcagctgaatgctgagcaagcggtggatgccgtactgcgcgaaaacatccatggcttagagctagatcagcgttgtgtcgaattggcagcctttgctattgccatcagcgcctggaaataccccaatgccggtggctaccgcactttgccggaagtccaggtggcctgttccggtttggcgattaacgccgccaaagaagaatggaaacaactggccgcgcacatgggcggcaagcaaaacctcagcatcgctttggattggttgcacgacaaccttaaaaatgcgccggtactcggcagtttaatgaacccggccaaaagcaaagccgcaggcttggtgagctggcaggaactctccgaagcgctcgataaagccctcgcaaacgacgaggctgaagtagcgcagactaacgagcagcatgaaaacgccgtggtcgcccaaggcatggccaaagccgccaagttgttagccagccaataccagtgggtaattaccaatgtgccctatttggcgcggggcaagcaggaagacacactcaaagactttatcgaacagcattaccccgccggtaaaaatgatttagccaccgcctttttagaccggtgtctggagttttgtgtaaaaggtggcaccagcagcatagtgctgccgcaaaactggttgttcttaaccagctataaaaagtttcgggaaaaattactcacgcaagatacctggcatttgattgcgcgtttggggcccggtgcgtttgaaaccattagcggcgaggtcgttaaagctatattgattaacctcagtcgtggcaattccgctggcgaatcgggcgggttgtttggcgctgctgaacacagtcaactgattcgaggggtggatgtgtcggaaccgcgcacagcggcggaaaaagccgagcagttgattacggtggtagtgaaaagcgttgagcaagctaagcagttggagaatccggatgcgagggtggcactagaaagttcgctagagggagagcttattgaaaaatatgggtattcacatcatggattaacatccggggatacaccacggatgaagtttgcgcattgggagatttgtgacacatcagctatttggattccatttcaaagtacagttcgggattcggagcattacggtggtaatgaatctattttgcgttgggataacggcgaaggaccaattctggaacttcaaggcgccaggaaagatggcacaggcgcttggggaaaacatggaattctgataagtcaaatgggcgtgctcccagttactttctacactaagtctgcatttgacaacaacacggccgtatttgtaccaaacaacgaaaatgagattccagcgatttggtgttattgctcatcgacagaatataacgaggcagtgcgtcaactcgatcaaaagatgagcgttacaagcgctactctggccaaagtccccttcgacctcgaccactggaccaaagtcgccgaagaaaaataccccaatggcctgcccaagccctacaccgatgacccgacccagtggattttccatggccacccttgcggctcggtggtttgggatgaaacgcaaaaatggacagctcacggcgcgctgcgtaccgatgaatccgtattgcatatagcagtagcccgtttactcggctaccgctggccagccgaactagacgcatccatggagctggccgacgaacagcgcgaatgggtaaagcgttgcgaagcgttgctgccactggccgatgacgatggcattgtctgtattcccgccgtgcgtggcgaggctttggcctatgaccgcttaatcaatctgcttgctgctgcctatggcgatgcttggacgccgtcgacgatcaaccagctgctctcgtctgtgggttatgccggtaaaaccctggatgcctggctgcgtgataagttctttgagcagcatgtcaaactgttccaaaatcgcccctttatttggcacatttgggatggccttaatgacggctttgcggtgctgattaactaccacaagttcgaccaaaaactgctcgaaaccctcatttacacctacttaggtgattggatcaaacgccagaaagacgaaatcaatgcaggcgttgatggcgcacaggagcgcctggccgccgccgaagcactgcgtaaacgcctgattaaaatccttgaaggcgaagccccgctggatatttttgtacgctggaagcctctggaacaacaagccatcggctggaacccggatttaaacgacggcatacgcctgaacatccgccccttcattttggtggatgacgtgaaagtcaaaggtgccggcgtactgcgccataaaatccccagcatcaaatggaccaaagatcgcggcgccgatgtcgaaagcgccccctggtaccacctcggcccgcactacggcggcaaagaaggcgaccgcattaacgaacaccatttgagcctggctgagaaaaaagcggcgcgcgaacaactaagcgagagttcttaa

SEQ ID NO: 2364 - DNA, 3678 bp, Salmonella enterica
atgaataccaataacatcaaaaaatacgctccacaggcccgtaaccagttccgcgatgcggtgatccaaaagctaaccacgctggggatttccgctgataaaaaaggcaatctgcaaattgcggatgccgagctcgtcggcgaaaccatgcgctatggtcagttcgactaccccaaatccaccctcacccgccgcgatcgtctggtaaaacgcgcccgcgagcagggctttgacgtgctggttgagcactgtgcctacacctggttcaaccgcctgtgcgccattcgttatatggaaatccacggttatcttgaccacggcttccacatgctctcgcacccggataacccgacaggctttgaagtgctggaccacgtaccggaagtcgcggaagcattactaccagagaaaaaggcgcagctggtcgagatgaagctttccggcaaccaggacgaagccatctaccgtgaactgctgctggcccagtgccacgccctgcaccgcgcgatgccgttcctgtttgaagctgtggacgatgaagctgaactactgctgccggataacctgacccgcaccgactccattctacgcggtctggtggacggtattccggaagaagactggcaagaagttgaggttatcggctggctgtatcagttctatatctctgagaaaaaagatgcggttatcggtaaggtggtgaagagcgaagatattcctgccgccacccagctgtttaccccaaactggattgtgcagtatctggtacagaactccgtcggccgccagtggttgcagacctacccggattcgccgctgaaaggcaaaatggactactacattgagccagccgaacagacgccagaagtgcaggcgcagctggccgccattacacctgccagtattgaaccggaaagcatcaaagtactcgacccggcctgcggctccgggcatattctgattgaagtctataatgtgctgaaaaatatctatgaagagcgcggctatcgcgcccgcgatattccacagctaattctggaaaataatatttttggtctcgacattgacgaccgtgctgcccagctttccggctttgccttattaatgatggcccgtcaggatgaccgccggatattcacccgcgacgtgcgtctgaatattgtctccctgcaggagagcctgcatctggatattgctaagctgtggcagcagctgaacttccaccagcagaaccagactggtagcatgggggatatgtttgccgaaaatacagcattagcccataccgacagcgcagaatatcagctgctgatgcgcacgctgaagcgctttgtgaacgccaaaacgctgggctcgctgatccaggtgccacaggaagaagaggcggaactgaaggcgtttctcgaagcgctatatcgcatggagcaggaaggcgatttccagcagaaggcagcggcgaaagcgtttattccgtatattcagcaggcgtggatcctggcgcagcggtatgatgcggtagtggcgaatccgccgtatatgggtggcaagggaatgaatagtgagctgaaagagtttgccaaaaataacttcccggatagtaaagctgatttgtttgcaatgtttatgcagaatgcattttctttgcttaaagaaaatgggtttaatgctcaagtcaatatgcaatcatggatgtttttgtcaagttatgaagcactacgtaactggttattggacaataaaacatttattacgatggcacatttgggagctcgggcttttgggcaaatttctggagaggttgtacagacaactgcctgggtgattaaaaaccaacactccgaacgttaccaacctgtattttttagacttatagatggtagggaagaagtaaagaaaagcgatctacttctaaggaaaaatatatttgataaatttacacagcatgattttaaaaacataccaggaatgccaatagcatattggatagacttaccgagtctattatcttttcgccaccataaaaaacttggagaaaaaatagcattaaaagcaggcatgtccaccggtgacaatattaaatttcaaagatattggtacgaggtttcaataaaaaaaacccttatcacaaataaagaatcaaatacaaaaatcgacattcataatatcaaatggtttccttgtagtagtggaggtgaatatcgaaagtggtatggtaataacgaaatagttgtaaattgggaaaataatggttacgaaatacgaaattttaaatttgagaatggcaaaactcgctctgccgtaagaaatgatgagtattactttagagaaggcataacatggtcaaaaataagccaaggtaatttttgcgtgagatatcgtccaaaagggtttgtttttgatgatacaggccgttgcggcttttcaaataacaaaaatgagttgctttacgctgcgggattaatgtgcactccggttgtaaaccattatttatcaatactagcccccacacttagctttactagtggtgaattagcctcagtaccatatccagaaattgaagatgaaattatcgaattagtcaccaatgctattgaaatagctaaaaatgactgggactctcaagagcaatcatgggattatgtttgttcaccattgcttgaacacaattcaactcaattgctacggaatatctacaaacaaaaaatcaatacaaatatcaagttagtcgaaacacttctcctaatagaaaatactataaataatatttttatagataaattacaacttgacaaaactataattaaagctgtattgcaaagtgaaataactctactatgtaatccaaactatcgatataaaaatattcaagatcataccgatctaaccaataagtattacactgatatcactatagatatcttaagctacatcatcggctgcatgatgggccgctactccctcgatcgcgaaggactggtctatgcccatgaaggcaataaaggctttgccgaactggtcgctgaagacgcgtacaaaaccttcccggctgacaatgacggtatcctgccgctgatggatgacgagtggtttgacgatgacgttacctctcgcgtcaaagagtttgttcgcaccgtttggggcgaagaacacttgcaggaaaatctcgaatttatcgccgaaagcctctgtttatacgcgataaaaccaaaaaaaggcgaatctgcgctggataccatccgccgctatctttccactcagttctggaaagatcatatgaagatgtataaaaagcgtccgatatactggctgttcagctccggtaaagagaaagcgtttgagtgcctggtctatctgcatcgctacaacgatgcgacgctggcgagaatgcgtaccgaatatgtagtgccgctgctggcgcgctatcaggccaatatcgatcgcctgaacgaacaggtcgatggagcctcaggcggcgaagccacccgtctgaaacgtgagcgtgatagcctgagcaaaaaattcaacgaactgcgcagcttcgacgatcgcctgcgccactatgctgatatgagaatcagtattgatctcgacgacggcgttaaggttaactacggtaagtttggcgatctgctggcggatgtgaaagccattaccggcaatgcaccggagattatttaa

SEQ ID NO: 2365 - DNA, 3678 bp, Salmonella enterica
atgaataccaataacatcaaaaaatacgctccacaggcccgtaaccagttccgcgatgcggtgatccaaaagctaaccacgctggggatttccgctgataaaaaaggcaatctgcaaattgcggatgccgagctcgtcggcgaaaccatgcgctatggtcagttcgactaccccaaatccaccctcacccgccgcgatcgtctggtaaaacgcgcccgcgagcagggctttgacgtgctggttgagcactgtgcctacacctggttcaaccgcctgtgcgccattcgttatatggaaatccacggttatcttgaccacggcttccacatgctctcgcacccggataacccgacaggctttgaagtgctggaccacgtaccggaagtcgcggaagcattactaccagagaaaaaggcgcagctggtcgagatgaagctttccggcaaccaggacgaagccatctaccgtgaactgctgctggcccagtgccacgccctgcaccgcgcgatgccgttcctgtttgaagctgtggacgatgaagctgaactactgctgccggataacctgacccgcaccgactccattctacgcggtctggtggacggtattccggaagaagactggcaagaagttgaggttatcggctggctgtatcagttctatatctctgagaaaaaagatgcggttatcggtaaggtggtgaagagcgaagatattcctgccgccacccagctgtttaccccaaactggattgtgcagtatctggtacagaactccgtcggccgccagtggttgcagacctacccggattcgccgctgaaaggcaaaatggactactacattgagccagccgaacagacgccagaagtgcaggcgcagctggccgccattacacctgccagtattgaaccggaaagcatcaaagtactcgacccggcctgcggctccgggcatattctgattgaagtctataatgtgctgaaaaatatctatgaagagcgcggctatcgcgcccgcgatattccacagctaattctggaaaataatatttttggtctcgacattgacgaccgtgctgcccagctttccggctttgccttattaatgatggcccgtcaggatgaccgccggatattcacccgcgacgtgcgtctgaatattgtctccctgcaggagagcctgcatctggatattgctaagctgtggcagcagctgaacttccaccagcagaaccagactggtagcatgggggatatgtttgccgaaaatacagcattagcccataccgacagcgcagaatatcagctgctgatgcgcacgctgaagcgctttgtgaacgccaaaacgctgggctcgctgatccaggtgccacaggaagaagaggcggaactgaaggcgtttctcgaagcgctatatcgcatggagcaggaaggcgatttccagcagaaggcagcggcgaaagcgtttattccgtatattcagcaggcgtggatcctggcgcagcggtatgatgcggtagtggcgaatccgccgtatatgggtggcaagggaatgaatagtgagctgaaagagtttgccaaaaataacttcccggatagtaaagctgatttgtttgcaatgtttatgcagaatgcattttctttgcttaaagaaaatgggtttaatgctcaagtcaatatgcaatcatggatgtttttgtcaagttatgaagcactacgtaactggttattggacaataaaacatttattacgatggcacatttgggagctcgggcttttgggcaaatttctggagaggttgtacagacaactgcctgggtgattaaaaaccaacactccgaacgttaccaacctgtattttttagacttatagatggtagggaagaagtaaagaaaagcgatctacttctaaggaaaaatatatttgataaatttacacagcatgattttaaaaacataccaggaatgccaatagcatattggatagacttactgagtctattatcttttcgccaccataaaaaacttggagaaaaaatagcattaaaagcaggcatgtccaccggtgacaatattaaatttcaaagatattggtacgaggtttcaataaaaaaaacccttatcacaaataaagaatcaaatacaaaaatcgacattcataatatcaaatggtttccttgtagtagtggaggtgaatatcgaaagtggtatggtaataacgaaatagttgtaaattgggaaaataatggttacgaaatacgaaattttaaatttgagaatggcaaaactcgctctgccgtaagaaatgatgagtattactttagagaaggcataacatggtcaaaaataagccaaggtaatttttgcgtgagatatcgtccaaaagggtttgtttttgatgatacaggccgttgcggcttttcaaataacaaaaatgagttgctttacgctgcgggattaatgtgcactccggttgtaaaccattatttatcaatactagcccccacacttagctttactagtggtgaattagcctcagtaccatatccagaaattgaagatgaaattatcgaattagtcaccaatgctattgaaatagctaaaaatgactgggactctcaagagcaatcatgggattatgtttgttcaccattgcttgaacacaattcaactcaattgctacggaatatctacaaacaaaaaatcaatacaaatatcaagttagtcgaaacacttctcctaatagaaaatactataaataatatttttatagataaattacaacttgacaaaactataattaaagctgtattgcaaagtgaaataactctactatgtaatccaaactatcgatataaaaatattcaagatcataccgatctaaccaataagtattacactgatatcactatagatatcttaagctacatcatcggctgcatgatgggccgctactccctcgatcgcgaaggactggtctatgcccatgaaggcaataaaggctttgccgaactggtcgctgaagacgcgtacaaaaccttcccggctgacaatgacggtatcctgccgctgatggatgacgagtggtttgacgatgacgttacctctcgcgtcaaagagtttgttcgcaccgtttggggcgaagaacacttgcaggaaaatctcgaatttatcgccgaaagcctctgtttatacgcgataaaaccaaaaaaaggcgaatctgcgctggataccatccgccgctatctttccactcagttctggaaagatcatatgaagatgtataaaaagcgtccgatatactggctgttcagctccggtaaagagaaagcgtttgagtgcctggtctatctgcatcgctacaacgatgcgacgctggcgagaatgcgtaccgaatatgtagtgccgctgctggcgcgctatcaggccaatatcgatcgcctgaacgaacaggtcgatggagcctcaggcggcgaagccacccgtctgaaacgtgagcgtgatagcctgagcaaaaaattcaacgaactgcgcagcttcgacgatcgcctgcgccactatgctgatatgagaatcagtattgatctcgacgacggcgttaaggttaactacggtaagtttggcgatctgctggcggatgtgaaagccattaccggcaatgcaccggagattatttaa

SEQ ID NO: 2366 - DNA, 3678 bp, Salmonella enterica
atgaataccaataacatcaaaaaatacgctccacaggcccgtaaccagttccgcgatgcggtgatccaaaagctaaccacgctggggatttccgctgataaaaaaggcaatctgcaaattgcggatgccgagctcgtcggcgaaaccatgcgctatggtcagttcgactaccccaaatccaccctcacccgccgcgatcgtctggtaaaacgcgcccgcgagcagggctttgacgtgctggttgagcactgtgcctacacctggttcaaccgcctgtgcgccattcgttatatggaaatccacggttatcttgaccacggcttccacatgctctcgcacccggataacccgacaggctttgaagtgctggaccacgtaccggaagtcgcggaagcattactaccagagaaaaaggcgcagctggtcgagatgaagctttccggcaaccaggacgaagccatctaccgtgaactgctgctggcccagtgccacgccctgcaccgcgcgatgccgttcctgtttgaagctgtggacgatgaagctgaactactgctgccggataacctgacccgcaccgactccattctacgcggtctggtggacggtattccggaagaagactggcaagaagttgaggttatcggctggctgtatcagttctatatctctgagaaaaaagatgcggttatcggtaaggtggtgaagagcgaagatattcctgccgccacccagctgtttaccccaaactggattgtgcagtatctggtacagaactccgtcggccgccagtggttgcagacctacccggattcgccgctgaaaggcaaaatggactactacattgagccagccgaacagacgccagaagtgcaggcgcagctggccgccattacacctgccagtattgaaccggaaagcatcaaagtactcgacccggcctgcggctccgggcatattctgattgaagtctataatgtgctgaaaaatatctatgaagagcgcggctatcgcgcccgcgatattccacagctaattctggaaaataatatttttggtctcgacattgacgaccgtgctgcccagctttccggctttgccttattaatgatggcccgtcaggatgaccgccggatattcacccgcgacgtgcgtctgaatattgtctccctgcaggagagcctgcatctggatattgctaagctgtggcagcagctgaacttccaccagcagaaccagactggtagcatgggggatatgtttgccgaaaatacagcattagcccataccgacagcgcagaatatcagctgctgatgcgcacgctgaagcgctttgtgaacgccaaaacgctgggctcgctgatccaggtgccacaggaagaagaggcggaactgaaggcgtttctcgaagcgctatatcgcatggagcaggaaggcgatttccagcagaaggcagcggcgaaagcgtttattccgtatattcagcaggcgtggatcctggcgcagcggtatgatgcggtagtggcgaatccgccgtatatgggtggcaagggaatgaatagtgagctgaaagagtttgccaaaaataacttcccggatagtaaagctgatttgtttgcaatgtttatgcagaatgcattttctttgcttaaagaaaatgggtttaatgctcaagtcaatatgcaatcatggatgtttttgtcaagttatgaagcactacgtaactggttattggacaataaaacatttattacgatggcacatttgggagctcgggcttttgggcaaatttctggagaggttgtacagacaactgcctgggtgattaaaaaccaacactccgaacgttaccaacctgtattttttagacttatagatggtagggaagaagtaaagaaaagcgatctacttctaaggaaaaatatatttgataaatttacacagcatgattttaaaaacataccaggaatgccaatagcatattggatagacttaccgagtctattatcttttcgccaccataaaaaacttggagaaaaaatagcattaaaagcaggcatgtccaccggtgacaatattaaatttcaaagatattggtacgaggtttcaataaaaaaaacccttatcacaaataaagaatcaaatacaaaaatcgacattcataatatcaaatggtttccttgtagtagtggaggtgaatatcgaaagtggtatggtaataacgaaatagttgtaaattgggaaaataatggttacgaaatacgaaattttaaatttgagaatggcaaaactcgctctgccgtaagaaatgatgagtattactttagagaaggcataacatggtcaaaaataagccaaggtaatttttgcgtgagatatcgtccaaaagggtttgtttttgatgatacaggccgttgcggcttttcaaataacaaaaatgagttgctttacgctgcgggattaatgtgcactccggttgtaaaccattatttatcaatactagcccccacacttagctttactagtggtgaattagcctcagtaccatatccagaaattgaagatgaaattatcgaattagtcaccaatgctattgaaatagctaaaaatgactgggactctcaagagcaatcatgggattatgtttgttcaccattgcttgaacacaattcaactcaattgctacggaatatctacaaacaaaaaatcaatacaaatatcaagttagtcgaaacacttctcctaatagaaaatactataaataatatttttatagataaattacaacttgacaaaactataattaaagctgtattgcaaagtgaaataactctactatgtaatccaaactatcgatataaaaatattcaagatcataccgatctaaccaataagtattacactgatatcactatagatatcttaagctacatcatcggctgcatgatgggccgctactccctcgatcgcgaaggactggtctatgcccatgaaggcaataaaggctttgccgaactggtcgctgaagacgcgtacaaaaccttcccggctgacaatgacggtatcctgccgctgatggatgacgagtggtttgacgatgacgttacctctcgcgtcaaagagtttgttcgcaccgtttggggcgaagaacacttgcaggaaaatctcgaatttatcgccgaaagcctctgtttatacgcgataaaaccaaaaaaaggcgaatctgcgctggataccatccgccgctatctttccactcagttctggaaagatcatatgaagatgtataaaaagcgtccgatatactggctgttcagctccggtaaagagaaagcgtttgagtgcctggtctatctgcatcgctacaacgatgcgacgctggcgagaatgcgtaccgaatatgtagtgccgctgctggcgcgctatcaggccaatatcgatcgcctgaacgaacaggtcgatggagcctcaggcggcgaagccacccgcctgaaacgtgagcgtgatagcctgagcaaaaaattcaacgaactgcgcagcttcgacgatcgcctgcgccactatgctgatatgagaatcagtattgatctcgacgacggcgttaaggttaactacggtaagtttggcgatctgctggcggatgtgaaagccattaccggcaatgcaccggagattatttaa

SEQ ID NO: 2367 - DNA, 3678 bp, Salmonella enterica; identical to SEQ ID NO: 2365

SEQ ID NO: 2368 - DNA, 3678 bp, Salmonella enterica; identical to SEQ ID NO: 2365

SEQ ID NO: 2369 - DNA, 3678 bp, Salmonella enterica; identical to SEQ ID NO: 2364

SEQ ID NO: 2370 - DNA, 3678 bp, Salmonella enterica; identical to SEQ ID NO: 2364

SEQ ID NO: 2371 - DNA, 3576 bp, Selenomonas sputigena
atgaataagaatgcgataaagaaatatgcggtatgggcaaggcgcgagctgatcgaccgtgtgtcgaagaaggcgatgcgctatggcattgcccctgaaatccctgctgaccccgaagcggacagcgttgaaggtcgccttctctccgataccgagaagaaagagcggcgtgcgctcatcgagaaagtggcagcgcacggctacgagcagacgatggaagaagcggcctacacttggttcaaccgcttcgccgcgcttcgcttcatggaggtcaacggctatctgccctcgcatgtgcgggtattcaccaacgatgccggagagttcaagccgcagattctcgccgaggcgatccatctggacttgccggggctggacaaggaaaaagtctatgccttgaaggaaggcaatgacgaggaggcgctctttcgctatcttatcatcgtgcagtgcaatgccctgaatgaaatcctgccgggaatgtttcagcgactggaggatttcacggaattgctgctgcccgacaatctgctccgcgaaggcagcgtgattgagcgtcttgtcaagcagggcgatgcgggaagcattcctgaggaggattggcgcgatcaggtgcagatcatcggctggctgtaccaatactacaacacggctttaaatgaattggtatatgacggcaatctttctaaagagaagattccaaaacatttgctccctgcggcaacaacaatttatacaccagattggattgttcgctacatggtggaaaattccctaggccgcttgtggctcgaaggacatccgaacgaaaacctgcaaggcgaatggaaatactatctgcctgaagccgagcaggaggagtctgtgcagaaacagcttgccgagatgcgcaaagaatctgccaaccgcaagccggaggacattcgctgcatcgacccctgcatgggcagcggacatatcctctgctacatgtttgacgtactggtgaagatctacgaggactatggatatacggctcgtgaagccgcagcatccatcgtgcaaaacaatctctatggcctagacatcgacgaccgtgcggcacagctttcctattttgccgtgatgatgaaggcgcggcagtatgaccgtcgctttttcagccgtgggattcagccgaatgtgatggcgatagaggagagcaacggacttgcgacttgggcggaaacggcaggggacagcctcgtttccgggcagctcacctttgaggacgatttcatccgtatggcggattatctgattgaaatattccaagatgccaaggaatatggctctattctgacggtgcaggcagatcgctatgatgcactcgtggactttatcgagaaaactgggcaggagacaggaaatctcctctttcgggcgtggatcgatgaagtcgaacgaaggattctaccgctgattcaacaggcaaaggtattctcgcaaaaatatgatgtgattgtgactaatcctccataccttggaagtacgcgttttagtttcaagcttaacgagtatgtgaagaaatatttcccaaatgagaaaagtgatttgagcatggttatgctcaaaaaatcgcttcaagaaactgccaaaacaaatggctatgtggcatttgttaccacggcatcttggatgagtttgtcgagttttgaaaaactgcgttcttatatgtataaagattgtgctattgacacgttagttgattgtggcacagagctttttgaaggaaaagtagggcataattctatagtttcatgggttgttcgcaaaacgaaattcaattataggatgactgctgtccgattggttgattattgttattcaagacgggatgaaaaagaggtggaattttttaataagaaaaactattttgttgccacacaggaaaacttttccaagattccgggcagcccagtggcttattgggtgagtgaggcaatgcttcgttgctttggagaaaaatgcataaaggattatggctttgctggcatcggtatgcgaactggtgacaacgaaagatttttaagattatggtatgaagtgtctgcaaacaattttagtattacaagcaaaggcgttataaaatggattccatataataagggaggaaattttcgcaaatggtatggtaataatgaatatgtagttaattgggagaatgatggagaagaaatcaaagataatacacggctaaattatcctgaactcggagataatttgggttggaaaataagtaatgaaaaatactattttaagcctggtataacttggacgggtgtaactatggcaaagtttagttgccgaatatatccaagtggatttatttttgattcaggtgccaatgggcttttcccttacaaaaagcaggatgaatcatatttggcaggttttcttaatacgaaaattgcaaatgacatattgcgaataataaaccctacaataaacacaggctctggaactgtaaagtctataccggtaatcaaaagcaagactcaacaaaaaaaagttgatgaattaaccaaccaaaacatctccatctcccgcgccgactgggatgcttttgaaacctcatgggatttccagtcccatcctcttgcacctacggcttacgaacgccgcgagcagctttcctatggcatccactctgccgagcgcaaaaaatcggtctcacttctgacggatcgctatgcctactgggagcaggcttgcaatgatcgcttttccgcattgaaggaaaacgaggaagaactcaaccgcatctttattgacatctacggcctcgcggatgaactcacgcccgaggtcgaggacaaggatgtgactgtgcggcgagccgatcttccacgcgatatacggagcttgatttcctacgccgtcggctgcatgtttggccgctattccctcgatacgccggggcttgtctatgccgggggtgaatgggatgacagcaagtataggacgttcctgccggatgaggatgccatcatcccaatatgcgacgatgaatatttcgatgatgatattgtcggtcgtttcgtggagtttatcgcgacggttttcggcaaggaaaccttggaagagaatctgcaattcatcgccgatgcccttggcggcaggggcagttcgcgcgaggtcatccgaagctacttcctcacgggtttctatgccgatcacgtcaagacgtatcagaaacgcccgatttactggctctttgacagcgggaagaaaaacggcttcaagtgcctcgtctatatgcaccgctactgcccggacaccatcgcccgcatccgcacggactatgtccacgaacagcaatcgcgctaccgcaccgccatcgagagtctggaacaagcgcgggataacgccgccaccgcaggggacaaggtgaaagccggaaagaaactggcggctgtggaagcccaagccaaggaactcctggaatacgaggaaaaaatccaccacctcgccgaccagatgatcgccatcgacctggacgacggcgtgaagcacaactacgcgatttttcaggatgtattggcgaagatcaagtga

SEQ ID NO: 2372 - DNA, 3465 bp, Shewanella sp.
atgcgtcaagccctggataaaaccctcagaaacttgctggaaaaagccgttgtccgtgcccgagagctgactgagattgccgcactcgaggccttaacccgcttaggcgttggcttaggcgaggcgccgtcgtacctaaacgatgatgagcgagcgctgcgtaactgcctgcgcgcccatgcccgccagctcggggataggttgcacaccaatggcaagcaagacatagcgcacctaagcgccgaaatggcctatgaacattggcaccgcatgctatttgcccgctttttagagcaaaaccagctgctcatgtatgaccaatacacagccgtcaccctggccgagtgtcaggagctggctgccgatgaaggcgtaaaagatggctggcagctcgctggagtattggccgagcggatgttgccgcagatatttcgcactgactcgccggtgtttgccttaccgctcgccattgatcgggtgcgcgagcttgaagacctcattctcaccctgccaacggcggtgttcacggctcaggatagtctcggctggtgttatcagttttggcaaagcaagcgtaaagaagaggtgaatgccgccggtgtccccattggcgccgatgagctaagtccggtcactcagctctttaccgagccctatatggtgagctttttgctcgacaatagcctgggcgcctggtgggcgaaaaaacgcttaaccgatgccgacctgcgtagcgccagcgacgaggcgactttgcgccgcgccgccgctattcctggcgtaccgctggagtacctgcgctttgtgaaaaccaaggatagccaaggcgtgctgtggcaagcggcgggtggctggtttgaggcttggccagaggatatcgctgcgcttaaaaccctcgacccttgctgtggctccggccactttttggtggcgctgtttttgatgttggtgccgatgcgtattgagcttgagggaatagatgccaaaaccgccatcgaccggatactgcgtgacaacctccatggtttggagctcgatagccgctgcgtcgaaatcgccgcctttgccctggcgctggaggcctggcgctatcctaacgccggcggttatcgcagtttgccggctcttaatttggcttgctcgggcctggatgtcagtgcccttggcagcgagtggcaggcgctggccaaacagcgcccagagataagcgatgccttaagctggtttgcccgcacctttaaagacgcgcctgtgttgggtagcctgattgatgtcaatagtgcttactaccacggaaaaacagagggagagcccgcaccttggcaagtgttgctggatgcgcaggctggtatgcaaaacctgggtgacgaagcgcaaatcgcccaagtcaccgcccagggcctggcgatggcggctaagcttctggccaatcaatacaccctggtggccaccaatgtgccgtatcttgcccgaggtaagcagtgcgacaccctaaaagatttctgtgaaaactattaccccgaagcaaagtccgatttagcgaccgtgttcctcgagcgttgcctcgatttcagccccaaaggtggcagctcaaccatagtgctgccacaaaactggctgtttcttaccagctataaaaagttccgcgagaagctgctcactcaagacacctggaacctggtggcgcgcctggggccaagagcctttgaaaccatctccggcgaggtagtgcaagccatattgatcactctcagcaagggcgaggccgcccaaggggccttgctccatggtctggatgtctccgcccccaaaaccgccgccgataaagccgagcagctgctgattgagccgctgaagagcgtagagcaagcgaagcagttggagaatccggattttagagtggctctaaatgagactaatagtaccgctttagtaaatagtcatgctgatacagcaacagggatgcaatcatttgaccgaccaaggtttatatatcaattctgggaaatagttagtttttctaatggatgggagccatgtcagtcgacggttcgttctacaacccacatgggggggtgtgagtttaccgtccgctgggagagtggtgaaggacagttgtatgccatgatggaagataaaaggttacttgagaattatacaagcgccatttggaaagcaggctcccagtattggggggcaaagggagtcatggttagtttgatgggagatctgccggtaagtctttatcttggaaagccttatgaccaaaacgcgggtttgattaaacctaatagtgatgaatcattgttatcaatttgggcctattgttcatctggggattatggctcaacggttcgtgaagttgatcaagcacttaaggttactaatgctactttaggaaagatagaattcgaccacgagtattggcttagtgtggccaaagagaaatacccccacggcctaccaaaaccttacagcaatgaccccacccaatggatcttccatggtcatccctgcggcgctgtggtgtgggatgaacacaaaaagtggactgccatcgccgagaagcgcaccgacgagaccgtgctgcaagtggcagtggcgcgcttgctcggttaccgctggccggcagagcttgatgaaaaaatggagcttgccgatgagatgctcacctggctttccaagtgtgatgacttgttagcgctgcaagatgacgatggcatcgtctgcttgccggccattcgcggtgaaaaggcggcggcaagccgtttggaggccatgctgcaggccgcctacgagaacgactggtccgccaaggtgctcaccaatcttcttgccagtgtcggcagcaagagcctggagacctggcttagggataagttttttgagcagcactgcaagctcttccagcatcgcccctttatttggcagatatgggatggcctgaatgacggcttctcggtgctagtaaactaccataagctcgattacaaaggcttagagcggctgatttacacctatcttggcgagtggatccgcacccaggagcacggcgtgaaagagggcgttgatggcgccgacagccgtttgatggccgccaaaaacctgaaagacaccctcgaagccatcctcaagggtgatgccattagcaccaagagtggcctcgatatctttgtgcgctggaaaccgctgcacgagcagcccatgggctggcacccggacttaaacgacggcgtgcgccttaatatccgcccctttatccaagcgccagatataggcaaaaaaggcgccggtattttgcgcgccaagcccaatatcaactggaataaagaccgcggcaccgacgtggcctccgccccctggtatcacttaggcccagaatacggcgaaaaagaaggcgcccgcatcaacgaccaccacttaagcctggccgaaaaacaagcggctagggacaagcaggagtaa

SEQ ID NO: 2373 - DNA, 3465 bp, Shewanella sp.
atgcgtcaagccctggataaaaccctaagaagcctgcttgaaaaatccgttgtccgtgcccgagagctgactgagattgccgcactcgaggccttaacccgcttaggcgttggtttaggcgaggcgccaatctacctaaaagaagatgagcgagcgctgcgtaaccgcctgcgcgcccatgcccgccagctcggggataggttgcacagcaatagtaagcaagacatagcgcacttaagcgccgaaatggcgtatgagcattggcatcgcatgttatttgcccgatttttagaacaaaaccagctgctcatgtatgaccaatacaccgccgttaccctggccgagtgtcaggagctggctgccgatgaaggcgtaaaagatggctggcagctcgctggagtattggccgagcggatgttgccgcagatatttcgcaccgactcgccggtgtttgccttaccgctcgccattgatagggtgcgcgagctggaagacctcattctcaccctgccaacggcggtgttcacggctcaggatagcctcggctggtgttatcagttttggcaaagcaagcgtaaagaagaggtgaatgccgccggtgtccccattggcgccgatgagctaagtccggtcactcagctctttaccgagccctatatggtgagctttttgctggataacagtctgggcgtctggtgggcgaaaaaacgcttaaccgatgccgacctgcgtagcgccagcgacgaggcgactttgcgccgcgccgccgctattaatggcgtaccgctggagtacctgcgctttgtgaaaaccaaggatagccaaggcgagctgtggcaagccgcaggcggctggtttgacacctggcctgaggatatcgctgcgcttaaaaccctcgacccctgctgtggctccggccactttttggtcgcgctgtttttgatgttggtgccgatgcgcattgagcttgaaggctgtgatgccaaaaccgccatcgaccttgtgctacggcaaaacctccacggcttggagctcgatagccgctgcgtcgaaatcgccgcctttgccctggcgctcgaagcctggcgctaccctaacgccggaggttatcgcacgctgccagcacttaacttggcctgctcgggtctcgatgtcagtgcccttagcagcgaatggcaagctctggccaaacagcgccctgagatcagcgacgccttaggctggtttgcccgcacctttaacgacgcgcccgtgctcggcagcctcatcgatgttaatagtgcttactaccacgggaaaaaagagggtgagccagcgccctggcaacgcttgctggatgcgcaggccggtatgcaaaacctaggtgacgaagcccaatccgcccaagtcaccgcccagggcctggcgatggcggctaagctgcttgccaatcaatacaccctggtagccaccaacgtaccgtatcttgctcgcggtaagcagtgcgacaccctaaaagatttctgtgaaaactattaccctgaagctaagcccgatttagcgaccgtgtttcttgagcgttgcctcgagttcagccccaaaggtggcagctcaaccatagtgctgccacaaaactggctgtttctcaccagctataaaaagttccgtgaaaaactgcttacccaagacagctggaacctggtagcgcgcctggggccaagagcctttgaaaccatctctggtgaggttgtgcaagccattctaatcaccctcagcaagggcgcggccgcccaaggtgccttgctccatggcctggatgtctccgcccccaaaaccgccgccgacaaagctgcacaactgctgattgagccgctgaaaagcgtggagcaagccaagcagttggagaatcctgatgcaagattatctctagatataagcttggagttggagttactaggagctaatgcccaaacgggtacaggaattcaaactttcgactctccaagatttttaagcccattttgggaacgctttaaaatagagaaaaattacattgtgtgccaaacaacggtagttaattcaactttgtttggtggattatctcaatgtttaaagtgggagggtggtgaaggtgaccttgcccacatgatgagtgagaaggagattttagaaaattacaaaagtggtatttggagagcttggtcgagatttgtcgggagagatggcatttgtgtcagcttaatgcgtcatttgccagttgctaggtattttggcctttcatttgataacaatacaggtgttattattccgtcaaataaatctgatttacctgcaatctgggcttattgttcttctgaggtatttaatactgaattaagaaagatagaccagaagcttaatgttactaatgccactctcgtaaaagtaccatttgacatcaaatattggtctaaagtcgccgaagaacaatatcccaaaggcctccctaagccctacagcaatgacccgattcaatggatcttccatggtcatccttgcggctctgtggtctgggatgaagacaaaaagtggactgtggttgcggaaaagcgcaccgacgagactgtgctgcaggtcgccgttgctcgcttgctgggttaccgctggcctgccgagcttgatgacaccatggatctggccgatgaaatgcgcacctgggtcgataagtgtgatgacttgttagcgctgcaagatgacgatggcattgtgtgtttgcctgctattcgcggtgaaaaggcggcagccaatcgcttagaggccatgctgcaggcagccttcgaggaggattggtcggcttcggtgctcacgaatctccttgccagtgtcggcagcaagaacctagagacctggcttagggataagttttttgagcagcactgcaaactcttccagcatcgcccgtttatttggcagatttgggatggccttaacgacggcttctcggtgctggtgaactaccataagctcgactacaaaggcctggagcggctgatttacacctaccttggtgagtggatccgcacccaagagcacggcgtaaaagagggcattgatggcgccgacagccgtttgatggccgccaaaaacttaaaagataccctcgaagccattctcgaaggtgaggccattagcggaaaaagcggcttggatatctttgtgcgctggaaaccgctgcacgaacagcccataggctggcaccctgacttaaacgacggtgtgcgcctgaatatccgcccctttatgcaagcgccagacataggtaaaaaaggcgccggtattttgcgcgccaagcccaatatcaactggaataaagaccgtggcaccgatgtcgaatccgcaccttggtatcacttaggtttgcagtatggtgagaaagaaggtgcgcgtattaacgaccaccatatcagcctggcagataaacaggcggctagggacaagcaggagtaa

SEQ ID NO: 2374 - DNA, 3396 bp, Slackia heliotrinireducens
atggactcgagcaggataaagagactggcgaccggcgtgcgcgacgagctgcgccgagaggttgagggacgcctcgaggcggtgctcgccgccgacagcccggagaggctctcggacgggaccggggttgtgcggctagaggcgaggatcgaggccgaggggcgcgacgcggtggtggaggccggggcgtacacctggttcaacaggctgtgcgcactgcgcttcatggacgcccgcggctacacgccgacgccggccgtgacgccgcgcgccggctcgaccatgcccgccgtcctcgcagacgcggcgcagggctccttcgaccccgagtacgggctcgcccccgccgtgcgcgagagggtcgtctccctgctgtccggctcgacgcagcgcgcgaacgccacggaggccgcgtacgccgagctgctgcgcgccgtgtgcgcgcactacgcgaagcccatgccgtacctcttctcggaggacgccgcatccagcctcctcatgccccgggggctgctgtccgaggggtcgatcctgggccgcatcgtcgcggagatggacgccggcgcctgctcgtcggtcgaggtgctcggatggctctaccagttctacatcgccgagttgcatgatcaggtgtattcaggcttcaaaaggagcgtgaaggcgggccccgccgagataggcccggcgacccagctgttcacgcccgagtggatcgtccgctacctgtgcgagaactcgctggggcgcctgtggatgctcaaccatcccggctcccctctggccgagcggatggactactacatcgcgcccgagggcgacgagcctcacatcgaggtctcgtccgccgaggaggtccgcgtgctcgacccggcctgcgggtcggggcacatcctcgtgtacgccttcgacctgctctactccatgtacgaggaggagggctggcttcccgaggagatccccgccatgatcctccagaacaacctcaaggggctcgagatcgacgcccgcgctgcggagatagccaagttcgccctcgagatgaaggcgctggagcgcgacccgcgcttcctcgagagggacgtggacgccgacgtcaccgtcctgcgccctgtcgccctcgacgaggccgacatgccctatctctcccagtcgttcaaggagcgggtcgggctcatcgaggcgatggcccacatgggcgaggtcggcagcctctacgtccccgaggccggggacgcccgggcggtagcggccgagatcgagcgcctcgccccgaaggcgcaatccgacatgttcgccagggacctcgcgggacgcctcggcgccatgttggagaacgttgaggcgctctccggctcctaccactgcgtggtagctaacccgccctatcttggaagcggcaatatgagtacttatctaagcagatggtgtaaggggaattatcctgatgccaaagccgacctctgtacgtgttttatcgaacgctgtttacacttcacaaagcaatatggagtggaaagcataattacttctgacacttgtatgtacatctcgtcgttcgaaaagctccgtagaaagatacttgagcaaacgactctatattcattcttagacacacgaggaacaaatgcgcaccccgatgtttttgatgcaaatgctggatggattcttgggaaaggtcacctatcgggtgtcaaaggctcttttttcaagttaagccatcgaacctcagaaaaagacacggcccttttgaatgcgattcataatccaaaatgcggttggctatacaaagctgacactgacctttttaaaacaataccaggctgtccgattgcctatttggtaagcgagacgatgatgggagcttttcggaatttaggaaatgtcgcttcattgggacgcgcttcggttgggattaaaacgggcaacaacggagcctttttaagattctggtgggaagttgcaagaggaaagatactctttaatggggtttcctcggatgcaacttttattgaaggctatcgctggtatccatgcaacaagggtggagcctttagaaagtggtacggtaatgctgaatacgtcgtggactggcgagaaaacggtaaatacgcatttgaaagcgctgagaaaaatggcaaccatgctcaagattatagtgacgatttaaagttccgtccgtatatcacatggtctgacgttacaagcggcgaacaatcattcaggttaaaaacaaacgatctctctgaaatgactggtatgggcatttatcctgatgatgacagccgaaatgccttattggggctgctgaactcgagtgttgcaaaacgttacctggaattattggcaccaacaatgcatttaaagattcgagagttgggcagtattccctggaatgatgattctcgatgcgatgaagtaagaagaactgtcgatactaatgtcgcagtagctcgtaaagattgggactccttcgagaccagctgggacttcgagaggcacccgcttgcgcggaccagccgcgttgaagacgcattcgccttgtggcaatcagagtgtcggagccgcttcgaccagctaaaggcaaatgaggagaagctcaaccgagtattcgcgcgcatctacggcatggagggtgaggttcccatcgaggtgtccgacgacaaggtgagcgtgcgcctggccgacctccagcgcgacgtgaagtcccttatcagctacggcgtaggctgcatcttcggcaggtactcgctcgacgcccccgggttcgtgctcgcgaaccagggcgacaccgcgagggacttcctggccaaggtgcccgacccctccttcgtgccggacgaggacaacatcctgcccgtgctcgacgccgagtggttcgacgacgacgtcgtcacgcagttctaccgattcctcgcggcggcctacggcgagtcgaccctcgacgagaacgtcgccttcatcgaaggggcgctgggatgcgatctgcgcacctacttcgtgcgcgacttctactccgaccatgtcaagacctaccagaagaggccgatctactggctgttccagagcccgcagaagggcttctcgtgcctcgtctacatgcaccgatacagcgagggtaccgtgggagagattctcacgaagtacctgcgcgcctacgaggacaagcttcggctgcgcgtgcaggtgctcgggcgctcggagcgggcggccgacctaaaggccgccgacaggatgcgcgcgcagatctccgagctggaggcgtgggagaaggaggtcgtgtacccgctcgctcacgagcgcgtggccatcgacctcgacgacggcgtcaagatcaactacaacaagttcccgcatgccctggccaaggtccagggactgagcgattggaggtaa

SEQ ID NO: 2375 - DNA, 3423 bp, Slackia heliotrinireducens
atggactctagcaggataaagagactggcgaccggcgtgcgcgacgagctgcgccgagaggttgagggacgcctcgaggcggtgctcgccgccgacagcccggagaggctctcggacgggaccggggttgtgcggctagaggcgaggatcgaggccgaggggcgcgacgcggtggtggaggccggggcgtacacctggttcaacaggctgtgcgcactgcgcttcatggacgcccgcggctacacgccgacgccggccgtgacgccgcgcgccggctcgaccatgcccgccgtcctcgcagacgcggcgcagggctccttcgaccccgagtacgggctcgcccccgccgtgcgcgagagggtcgtctccctgctgtccggctcgacgcagcgcgcgaacgccacggaggccgcgtacgccgagctgctgcgcgccgtgtgcgcgcactacgcgaagcccatgccgtacctcttctcggaggacgccgcatccagcctcctcatgccccgggggctgctgtctgaggggtcgatcctgggccgcatcgtcgcggagatggacgccggcgcctgctcgtcggtcgaggtgctcggatggctctaccagttctacatcgccgagcgcaaggacgaggtgttcgccggcttcaagaagaacaagaaggcgggccccgccgagataggcccggcgacccagctgttcacgcccgagtggatcgtccgctacctgtgcgagaactcgctggggcgcctctggatgctcaaccatcccggctcccctctggccgagcggatggactactacatcgcgcccgagggcgacgagcctcacatcgaggtctcgtccgccgaggaggtccgcgtgctcgacccggcctgcgggtcggggcacatcctcgtgtacgccttcgacctgctctactccatgtacgaggaggagggctggcttcccgaggagatccccgccatgatcctccagaacaacctcaaggggctcgagatcgacgcccgcgctgcggagatagccaagttcgccctcgagatgaaggcgctggagcgcgacccgcgcttcctcgagagggacgtggacgccgacgtcaccgtcctgcgccctgtcgccctcgacgaggccgacatgccctatctctcccagtcgttcaaggagcgggtcgggctcatcgaggcgatggcccacatgggcgaggtcggcagcctctacgtccccgaggccggggacgcccgggcggtagcggccgagatcgagcgcctcgccccgaaggcgcaatccgacatgttcgccagggacctcgcgggacgcctcggcgccatgttggagaacgttgaggccctctccggctcctaccattgcgtggtggccaacccgccgtacatggggaccagcaccctttacaaacccgcaagcgactttgtaaaggaaaactatccagacgagaaggcggacctatgcacatgctttattgagcgagcaaagcgcttcaatctgcgtcgaggctacagcgccctcataactatgcaaagctggatgttcctcagctcctacgaaaagatgcgtgagaaaatcatcaatcacgaatgcatcatatctatggcgcatttaggtgcacgagcattcgacgcaattggcggagaggttgtttccacgacagcaacgatattccagcatattaaagatagtgaaagggaaggtacgtatattcgcttggttgactttcttggcgaggcgaacaagtcatcaatctgccgcaaagcaatatgcgacgcatcttccacttggctatatcgtgcttatgtcagcgactataaaataattcctggaatgccaattgcctattgggtaggcaacggtatgaaaagcgcatttttgaacggaacgccgctgtcagttgacggtcggccgagaaagggattaacaacaactgataatggtcacttccttagattgtggcatgaggtatctgcagacaaagtatgcttgactgccgaaaatgctgatgttgctaaagcatcacgttgcaaatggttcccatatgataagggaggagattttagaaaatggtatgggaatagggaatgctttgtaaattgggaagatgatggcgcggaggtgaaggcgctaatcacgtccaaatacaatgggggcagttataccaaggaagtccgcagcgaagaaatgtattttgcggaatcgctaacttggactgaattatgtacaggaatgccgggattccgttattcgcccgcagggactatctttgattcaagtgggtcatcaatgtttcctcgcagtcacattctgtattatttgggtctaatgaatagttcggttatgtcagaaatactgaaaatgctcaatccaacgcttcattacaactcaggtgttgttgcaaaagccccagctcttttttcggagttcgatctcagattggtcgaagcagctgtcagtgaaaacgtttccttagccaaatccgactgggactccttcgagacgagctgggacttcgagacgcacccgctcgtgcggaccgagtgcgtcgccgatgcgtacacgctgtggcaatcagagtgccgagaccgcttcgaaatactgaagtccaacgaggaggagctcaaccggatcttcgcgcgcatctacggcatggagggcgaggtgccaatcgaggtgcccgacgacaaggtcagcgtgcgcctcgccgacctgcagcgcgacgtgaggtcgctcatcagctacggcgtcggctgcatattcggccgctactcgctcgacgcccccggcctcgtgctggccgaccagggcgcaacggtcgccgactacttggttaaagtgcccgagccgacgctggtgcccgacgcggacaacatcctccccgttctcgacgccgagtggttcgacgacgatatagtcacgcagttctaccgcttcctcgcggcggcctacggcgagtcgaccctcgacgagaacgtcgcgttcatcgagggggcgctcgggtgcgacctgcgcacctacttcgtgcgcgacttctactccgaccacgtgaagacctaccagaagaggccgatctactggctgttccagagcccgcagaagagcttctcgtgcctcgtctacatgcaccgttacaacgagggcaccgtgggcgaggtcctcacgaagtacctgcgcgcctacgaggacaagcttcggctgcgcgtgcaggtgctctcacgctcggagcgcgcggccgacctaaaggccgccgacaggatgcgcgcgcagatctccgagctggaggcgtgggagaaggaggtcgtgtacccgctcgctcacgagcgcgtggccatcgacctcgacgacggcgtcaagatcaactacaacaagttcccgcatgccctggccaaggtccagggtctgagcgattggaagtaa

SEQ ID NO: 2376 - DNA, 3660 bp, Spirosoma linguale
atggatacccgccgacttaaaccctttgcccagcaatgccgccagcgattaatgcagggcattgccgaccgactaaattactggggctttgtggccaccagccgccaacccgtcgaaacgctcgaaaaactcgacggcggttacctcttccgggggcaggtttttgatgaaaccgacgtccctcgtcgctggcaactgctggctggcgcggtacagacgcatggttttgcgcatgtgcaggaaaccgtggcctatacgtggtttaaccggctgatggcactcaagattttggcgcataataactaccagcccgatgtgctgagttttactcgtccggatacaccaacaccccagttgcttgatgaagcccggcgcgcccagccgccttacctctccgagcaactgtatcggatactgcggcccctgttaacggactatacccgcgaaaccgatgcctttgcccggctgctaacggcctactgcgtgcagcaccccgtactgcaccggctcttcgatgtggccgacgatgtatcgaccttgttgttgcccgccgatatgctgggcgaaagcggtgtgctggcatttataaataacagtacggccatcagtgaagctgattttaagcaggtcgagctgattggctggctctaccagttctacattgccgaccgaaaagacgaggtttttgccgggtttaaaaaagggttgaaagcaggccctgacgatattccggccgcgacccagatttttacgccccgctggatcgtctcctatctggtcgaaaataccctggggcggctctaccttgaccaaaaccctgactcatcgctaggcgagacgatgcggtatttggtcaaaaccgaaaagaagccaactactgttgctgacgaaaccggtcaaagcagggaggctgctccaacgactctttccttcaacgagggtgccttgccaatgcaggccgatgtctcggtggcgtctctgcgccttattgaccccgcttgtggttcgggccacattctggttacggccttcgacttgctcatgcgcatctacaatgaagaaggctacaccaaacgacaggctgtgaccgccatcctgaacagccaccttgtaggccttgacctcgacgaacgagccgcccaactcagccgctttgccctgctgctcaaagccagccagtattggcccggtgtgtgggataccgatattatcccggacgtttgggctatgcccgatccctggatgcccaccgatacagacctgttgagctttcttggtacagatgggagagagtttctggccgaattgcacactgccctgcggcttatgcaacagagtcagaaccttggctcggttatgcggcctaacctgtcccgagcgggccggacgcacttgcgtaatcgactattaatatacgaagcacagtccgacgatgcaatcgacatttttgcaggcacgaatcgccagcatctacgccactacatacatgttttgctgatcttgactgatcactatgcggctgtggcagctaacccgccgtatatcaattcaggtagtatggaagcagtattgaaagggtacattgaaaaacattactaccgatcaaaaatcaacttatcgttatcatttatggagaaatgctgcgatatgtgtcagagtaaaggaatttgggggctaataaatcaagattcatggttactcaaaacttcgtcggtcgaattacgaaaattgctattggatacaaacgcagtagagtctgttttgcatttagggccaaatgcatttgatgaattgggtggtgaagtagtacaaacaacggcagccacctttcgaaaatcagaatcgcatccttcgtcaagtggtatatactatgacttgacaatgtttgggtcaagcgcaaaaaaagaaggtgcgtttttagccggtgtcaatcaattcagtaaagtcatgcagcagagctttgctgaattgcccggaaatgcaatatcatacaggatgaggccagggttaagcactatatttaagacagaggaaaaacttggggattatgctgatgtcaaacaaggattatctaccgctgacaatgaccgctttctgaaactttggcatgagataaatattcataaaatcagtttacaaggtaaagcggaaagaaaatgggttccttgtacaaaagggggctcatttcaaaagtggtatggaaataatgagtatgtgattaactgggaaaataatggttatgagttaaagcacttctttgacaaaaacaccaaaaaactgcgctcagcaattagaaatgaaatatactattttcgaaagggtatcacttggtcagtaatgagcagtggtagtaacgggttcagaattctaccagaagggtttatttttgagcacaaaggctctgcttgttttgctaaggatgaatccgatctggagtcaataattggtttcttaaactccccggttgcttatagtctcaatcaggctctctcatcaggcaatgaaattaaagagggaattcttcaaaaattgccgtacaaagagccatataatgcaactaagattagcccaatagtccaatcctgcaccaacatcgcccgcttagattgggatagccgagaaacgagttgggattttgccgaaaatccactggttgccattcagcggcaggcatcgggttcattacggcaggcttacgaaacctgggccgcgcaggtagccgggcagtttgttgagctgcatcggcatgaggagcggctaaaccatatcttcattgacttgtatggattacaggatgagttaacgcccgaagtatcgccccgcaatattaccctcctgcccgaggagctggacaaaaaccagctaatggcggaagctgaaagagaagacaactggcttataaacccaacaggtgttgtaactagcgccatccggcgcgatgtagtggctcggcagtttatcagctatgccgtgggcttgctcatgggccgctaccggctcgacagccctggtctacacatcgcccacccaaatgccacgcccgaagaactggcagactataccgtgacgcgaacggaaaacggaataccaaaaaccgagcccttcaccatcgaccccgatggcattttgccaatactgggtgaggaaggtggttttcctgatgacctgggacgtgggcttcggcagatactcgaattgatttggggtggtcaccaactcaccgacacggtaagctggctggaagagtcgcttgggcaatcgctcgacaagtatctgacttttaatttttggggcgatcattgccgactctaccagaaacgacccatttactggttgttttcatcacctaagggcgcatttaaggccctagtttatctgcaccgcataaatggattcacggtatccacactccgtaacaagtatttgttgccatatattgaccggctcagtcgccagatcgaccactttaattcaaccaaaagtcaactcggtaccgccgaaaatcgacgcattgaaaccttacgcaaggcatatgaagagtgccgccagtatgatttgctattacgcgatgccgctgaccgccagtttgtgcccgatctcgatgctggtgtgacgcgtaactatgcgcagttgagcaaggtgctggctatcattaaatag

SEQ ID NO: 2377 - DNA, 1587 bp, Sulfuricurvum kujiense
gtgaacaaatccaagctcaaatccttcgccgcctcgatgcggcgcgatctgatggatgcggtacgtgccaaagccgactacatcctctcacacgacatcgatgagctcccgccgaagttctatgaccaccgtgacaagatcgccaccctggcgaaactggtccagaccaccggcaaagaagaggtcgtcgagcggatcgcctacatctggttcaaccgcctcatcgctctgcgttttatggacgccgctctaatcaacgaaatcgccgtcgtctcacccatcgagagacaaagcctccctcagctctacaacgaagtccgcgccggtcacgtcccggaggggtacacgtttgatcggaccaaattcttcgatctcatcgatggcaagatccaaagctccgatcccgagaacgaagcctacgcgatgctcttcatcgccgcgtgtaacgcgtggcacgagcacctcccctttatgttcgagaaaatcgccgactataccgagcttttaatccccgatgacctgctgggagccgcatctctgcgcgcccgggtcgtcgatgcgctggaagcggaggattgtcaggacgtcgaggtgatcggatggctctatcagttctacatcggcgagaaaaaagacgccgcgatggccaaaaaagggaaatacaacacgagcgaaatccccgccgtcacccagctcttcaccccagactggatcgtccgctatctggtcgagaactcactgggacgtatctggatggcgagtcgcccgaattcgaagcttcgtgaatcgatgcgctattacgtcgaacacgacgatgccacgaccccgatcaccgtcagctccgtagaagagctcaccctcctcgacccctgctgcggcagcggccatatgctcacttatgcctacgatctgctcgaaaagatctacgaggaggaaggctatcccaaaagcgacatccccggactcatcctcacccacaacctctacggctgcgacctggacgagcgggcggcatcattggcggcgtttgccctcacgatgaaagcgcgtctctcccaccgccggttttttcgcaaatcggtacgccccaatatcgtcgagcttctcccctacgatgacgatcggttcgccaacatcaaagacctcggttctctcattcgtctcaaaccctcgacggccaaactcgatgagggggttttcgcctactctaaccgcgaattcaccctccaggaacggatcctcggcggtgatttccactgcgtcgtgaccaacccgccgtatatggggggaaaggggatgaatacggttctggccgatttcgtcaaaaagcagtaccctgattccaaagccgacctgttcgcgtgttttatcgagaggtcattggatctgaccaagagcggaggctacgcggcggcggtgacgatgcactcgtggatgttcctgagcagctacgaagcgctccgtgtcaagctcctcgaaaaccatcagatcgatacgctggtccatctgggagccagagcgtttgaggagatcggtggagaagtggtgcagacggtggcgtttgtgttgcagagaggaaataaatga

SEQ ID NO: 2378 - DNA, 1737 bp, Sulfuricurvum kujiense
atggcaacatacataagattaaccgactacaaagatagcgataccaaagaacagcagttcgctaaccccgccaaccgccacaccgccaaccaaaacgatttttcgaagataccgggaagtcctattgcttattggatgagtgatacagtaagaagtaaatttattttatatccatcaattgatgacttgatgacaacaagagctggaatgtgtacgggtaataacgacttctttttaagatattggtttgaaattgaatttattaaaatagggttttacaaatcttcttttgatgaagtaatatcatcaaataaaaaatggtttcaattcaataaaggtggtgaatacaatagatggttcggcaacaatgatatctttattaaattcaacaaagaaaacattgatttactttctaattcttgtaataagttagcttctaaagaattatattttaaagagggaatcacttggaatgccgtatcaagttcaaattttggtgttagattacatcaaaaaggctcaattgtttccaacgcagcaatggttgcattcccagaaaatgaattcaattatatttttgcttttttgaatactgttattgtgaaaaaaatggtggaatttttatcacccacgataaattttaatgttggagacatatcaaaagttcctgtaatatttccaaattcttcaacaattaaatctaaaataaacactttgacagatcaatgtattgaaatttcccgcgaagaatgggacagtcgagaaacatcgtgggatttcaaacaaaacgaactgatccgccataaaaccgacgatggcaaaatcgcttccgcttttacagcctactgcgatcactggcgtgagaagttccatcagctccacgccaacgaagaggagctcaaccgcctctttatcgacatctacggcctgcagaatgaactgacccccgatgtcgcactggaagacatcacgatcctcaaatccgaatcccgtatcgaaaacggcgagctgattttcaacgcagatgaaatcgcccgtcagttcatcagctatacggtgggatgtatgttcggccgctatgcgctcgatcgcgaggggctcgtcgtggcgaatatggatcagccatacccgaccgatacgccgttcgccattgacgatgacaacatcatccccgtcctcgaagaggaggtcttcgccgacgatatcgccgcacggttcgagcggtttgtgggtgtagcgttcggcgaggagcgcgtaggagaaaatctccgctgggtcgaagaggctctggggatgagtatccgcaaatacttctacggcgagttctacaaagaccacgtccgacgctacaaaaaacgcccgatctactggctgatccaaagcccgaaaaaagggtttagcgccctcatctatatgcaccgataccaaagcgacacgatggcacgggtgcagacgatgtacctgcgcgaatacctgactaaactcgaatcgctgatcgagcactacaacgcgattgcgtccaacccatcctcctccgccaaagatgccaaagacgctgccaagctcgccagtaagctggaggggaaacaccgcgacgccctcgacttcgaccggggggatatgagccgcatcgccgcagaacaaatcaccatcgatctcgatgatggggtcaaggtcaactatcagaagttcaaaggggtattgccggatatcggcctgtccaagggtgaagattaa

SEQ ID NO: 2379 - DNA, 1569 bp, Synechococcus sp.
atgcctcgttctgctgttacccctacccctgctggagctaacctcggttacgaagcggagctattcaaagcagcggacaaactgagaggcaacatggagccatcagactataagcacgttgtcttggggctgatttttctgaagcacatctcagatcggtttgaggcaaagcagcaggaactggccgcagaattccccgatgatcccgaaattctagaggacaaggacgaatacaccgccgagaacgtcttttgggtgccgaaagagtcccgctggtcttatctccaggccaatgccaagcaaccaactatcgggaagttaattgatgaagccatgctgggcctggagaaggttaacgattcgctcaagggggtgttacccaaagaatatgccaggccagcgttaaatgctgtcatgttgggcgaactgattgacctgatttccaatattgcctttgggactagccacgataatgccagggatgtgttggggcgagtctatgaatatttcctaggtcaatttgccgggtcagagggtaagcgtggcggtgaattttataccccccggtcagtggtgcgggtgatggtggaaatgctgcaaccctaccaagggcgtgtctatgacccctgttgtggctccggtgggatgtttgttcagtcggaaaagtttgtcgaagatcacgccgggcggattggtgatattgctatttacggtcaagaaagcaattacaccacttggcggttatgcaagatgaacttggccgtgcgggggattgattcggatattcgctggaactctgaaggaacctttcataaaaacgagttgccagatttgcgagccaattttattctggcgaatccaccgtttaatatctcggattggggtggggatcggattcgagaggatgcccgctggaagtttgggattccgcccgtaggcaatgccaactatgcctggttacaacatatttggcaccatctggctccgacaggaacagcgggggtggtcttagccaatggctccatgtcatcgcaacagagtggggaaggggacattcgccaggccatgattgagggagatgcgattgactgcatgattgccttaccaggccagcttttttattccacccagattccggcctgtttatggtttttggccaaggataagtccaacggcattgcccgagataaaaaactaagagaccggcgtggcgagattctgtttattgatgctcggaagttgggctacatggtggacagaacccggcgagagttcagtgatgaagatgtggctaaaattgcagaaacttaccattgctggcgggaaggggcaggctatgaggatataccgggattttgcaagtctgccaatttagaggaaatccgggggcatggctacgttttaaccccaggccggtatgtgggagccgccgccgccgaggaagacgacaccccctttgccgaagtcatgcagcaactcacaaccaagctggggcaacagttccaagagtcagcccgtttagaatccgtgattcgggaaaatttgcagggtctggggtatgacttttga

SEQ ID NO: 2380 - DNA, 3975 bp, Synechococcus sp.
atggatcaggagattcgcaataagcttcgtaatgttgtaacgaagtgccgaaagctgctcgaagactccatttcacaggagcttgagggtaagtacaacatcttcgctaggaaggagaaggtgactgccgacccagatgctcccatgaatcacttgatggaagaggatcgggcggcgcgcagggatattctcgatcactttgcccacattaaggcccgtgggtttaagcccaaagatgcccttgaccagttgattcgggaaattgccttcacgcatctcaatcggctttgtgcctacaagatgatggaggcgcgtgaggtctacgttggtggacagaaatttcgggaagcggtcagtcggggggtgaactctaatggtgtgaagttctatctggccgagcatgaggaggacgaacgactctttaacaccggccatcaagatattgcttatcggcacttcttggactggctgggtggggcactatccgaagagatcggtgtgttgttcaatcccaacgatccggccaatcgcctctaccctcggcagaagacgctcgatgaagttctcgatttgctcaacggcggcgggatcaagaccgaggaaacagaactccgggagcaatggccacagatttggtcgcaggacgaaactattggctgggtctaccagtatttcacgcctaaagaactccgggacaaggctcgtaaggaaagtcaagctccccgtaactcctacgaactggcctttcgcaaccagttcttcacgcctcgctatgtggtcgagttcctcaccgacaacacactgggccgcatttggtatgaaatgcggaagggagacaccacgattaaagaccagtgccggtatatggttcgccgccctaccgaaatttttctgaaggaaggcgagcagtcgcccaataatgcagccgaaggaaaggatgatctttcccaggaagaactgctcaagcttccagttcacattccgcaccgcccgaagaaagacccacgggaactcaagattctcgacccagcctgtggtagtggtcacttcttgctgtactgcttcgacctgttgctcacgatttacgaggaagcttattccgaccccgacctcggcccagcgctcaaaaaggactacccaacgctcgatgccctcaagcgagatgttccccggctgatcctcgcctacaatctgcacggcattgatattgacttacgggccagccaaattgcggccctcgccttgtggctgcgttgccagcgggcctatcaagagatggggctgaagaaggatcgccctaagatcacccggtcgaactttgtttgtgccgaaccaatgccgggtgaagagccgatgcgcaaggagttcgttgaccagcttgagccaaaagtcctcggccaggtggtggaggtcgtctttgacaagatgaagctggcgggggaagctggttcgctgctcaaaatcgaggaggagattcgggatgccgtggccgctgccaagaagcagtatgtcagagagacgacccaagccacggatcgcaaaggccagccacttctgtttactcaggtggcaatggatcgcatcaccgggaagcccgatcaaccctccctctttgatctctccgacatcacggacaaccagttcttcgagcaggcggaagggcgagtgatcgaagcactgcgtttctatgcggagaaggctcagaatggtcaacgtctgcaacggcggctttttaccgaagacgctgttcgagggttttccttcgtagacctttgccgaaaccgttatgacgtagtgctgatgaatccgccatttggagaatgctctcaacttaccgcttctatccttgcttcatattacccggactggaacaccaacctgctgtgcgcatttgttgctcgtgcatgggcaatcacgtgcggcaacggatcggttggggtaatttatgacagaaccgccgccattaaaagcacctatgaagattttcgccggtgttcactcttgcccgataatcgccttttggcagttgctgatcttggctggggcgtgctagatgcgaatgtggaagtcacgaccgctgtactgcatcgttccacgtccgatccatcgtgttttgttgacgcaagggccgtaggtgttgaggagaaaggcggcttcattgagcagtctcttaagtcagccagcgatgtccccacttctacatgggttcgacccaagaccttcctgcacttgcctaatgccgtgttggcttatgatttccctgaatatctacgccgggcctttacggcatattcatcattggagaaatcgggaatcactgcagctcaaggacacgcactgaaatcagaagtccactaccgagcgttctgggaggtcagtcctcttgagccaattggcccaaaccgtcgatggatcggtgcatttaagggcggtgattacagcccattcttcctgaagacgcatcacattgcgctatacgggcgagacggatcgctagtaccgaaaagcactgcaaatgtcttgcgcaacaaatcgttgcacacactgcccggaatcgcttatggcaagcgaggagaatacctcgactcgcaagtgttgctggctggacaaatctttacacacgaaggacatgccttccctaatctgggacgccatgttgcatgggctgcgctctgcctgatgaactcccggctatttcagcatggggtcaattgctattgtggacagcacaagcactcaggttatgtgaatctctttccattcgctccggccttgctcaagtctggcgatgaactgtcgcaccttgcgaagcgaatttacagcctgaaagaaatgtgggctagaggagacgagacgcactttctcttcgtcgcgccgcacgtcatgctttgtgagcgaaccgactctttcgccaagtcagtcaacagcatcttcaatcaattggaggcgtgggacacagagattcaggctgcagatgctcggatagaagagatcgtctcagacgcctacaaggtcacagattctgacgtgcgagaacttgtagcacgaacggcaaatcgcccggtggataggactgcttatgacacgtcgatcaggtcactgaaagagatgggcatgaggttgtcccttgagatgacttcctattgcgttggaatcgtgtatgggagatgggatgtccgtttcgccattggtagtaaagtcgcttgcgttcctgagccatttggggagcttcctcaacatccgttagcaacgcttttggaagtgaacgaagtaggaacaggtggcgactatccaattgctgtgtgtaccagcggcattcttgtagacgacccagaatctgacaacgacatcgtgaccgctatccagcggtgcctagacgtactcttcgataaagggtcagaaaacgcactggaagagatgacgcagcgattggggactgacagcctcagagactacttgcgaaaagcgcccacgggtggattctggcaggctcatgtagacacatattcacaaagtagccgcaaggcgccgatctactggctactgcaatcctcgaagaagaactacgccatttggctctactaccaccggctcgacaaagacctgctgttcaaggcgctggtgaactacgtcgagccgaagattcgcttggaaaccagccgcctcgaatcgctccagtcccagaaggccgcagcgggtgacagcggcaaagaggccaagcgacttgcgaaagaagtcgaaaagcaggaagacttcctctccgaactgcaagacttcgaggacaaactacggagggcggcgaacctgcatctcgaacctgacctcaacgatggcgtcgtcctgaacattgccccacttcacgaacttgtgccgtggaaagaagccaagaaatactgggatgaattaatggcaggcaaatacgagtggtcatccatcggcaagcaactgcgggaaaaaggattagtggaaggctag

SEQ ID NO: 2381 - DNA, 903 bp, Syntrophomonas wolfei
atgaaactagctgaacatgttgaacatattcggcagataatagatcaggcatttcgtaatactctggggcgcatgggcataactgccactgtcctgcaaccgctggaaaatttatcgcagcaatttcatcttgacaggatacggatagaagatgtttttgaaaactttgctgctgaaactggttctgttgctgatgcctacgagaaactggtagaagaacttacctttaccctttttaatcgcctggcagcgctcaaggtaatggaagcccatggcctgaatagcccgatacttactcgcagcagccagcatggggatcgttcttttgctcattttctctggctggaacaaaatcccgaagggcgcaatgaagagcaggaaggtctgctgccttttatagaagaacagctgaataccttgtcggctgatattcccttattcagcccccagtatccttatcatctcctacctactgctattgaattaagggatattatagatgcttttaatgcggtggaaaaggatgaacaggttgaagcagatatctggaaaagtgatgatgttttaggttggttatatgaaagctacaacaattacaaaaaagctgcccacaaagaaagcaaagctaaaactgaatataacaaagtcagcatccagagtcaggtttatacccccggttgggttgtgaaatttctggtggacaatagcctgggcaaattatatctggaaatgtttcccgactccaccatcaaagaaaaatataaaattgccaatgccccggccaaaccaaaccgggaaaggaaaccgcttactgaaatacggcttattgatataatcatgcagagtttgatacaatttaattatcctaaaagttattgtgctcaggggtgtgcagagatatga

SEQ ID NO: 2382 - DNA, 930 bp, Syntrophomonas wolfei
atgatggaggtagcgacaaggcagactgttttgcaaaacacaatctacaaacgaaagaagcggcttccgctgtcagtccttgaccgcaggaagtctttatatcaagtggtttcagcccatttgccaaccggcaataaagcaagaatcgcttatttgcattgtatcaaagacggtaagaacatagaccccgcttgcggctcgggcaattttttgctctatgcttttgatttactatatgacctttacattgaccagattaataactatggcgctgactatgatgacgacgaaataccagaactaattattcggcacaacctgcatgggatcgatatagatgaccgagctgtacaactggctcaattagggttgcacataaaagttaaacgtcagaatcgctcggttaaaattgaacatttcaatattgtcagctcagatttctttttactcgattatcccgaggtaaagcatctctttgaaaatggggaaaaactcagtctcgaattggagaacattgttacagaaatgtgggatgagctgcagcaggcttataaatttggttctttaatacgattggaagagaaattcagcctgcgtatgcaggaactggttcagcagtgggatgaaggccgcttgtttaaagaacaaacgctggctaattatgaacagttccgggaaaacttctttaccggtttgcaaaatgcagtagctcataataccgcaaagcacggtattaattttttaaacagcaaaaccggtgatgccataagatttttagaattactgacccagaaatacgatgtagcggtagccaatcctccttataccgatagcaacgattttggccccgaattgaaaaagtttataaattccaactataagaagccgtataaatttcactcaaatctttatgcagcatttattatataa

SEQ ID NO: 2383 - DNA, 2121 bp, Syntrophomonas wolfei
atgaggtgttacgaattaattaatgaagaaggtaaactggcactaatccacccgttgacttttatgtatatcaaatctttcgaagatgttcgccgattaataatcgataagctacatataaatgttttggtcgaatttggaatgggtggactgtttcctcaagacatatgggtagacccagccttctatatattagaatcgaaaaaacataatgttttcgaatccatttttgtatcacttgataaatactcaaatacgtttaatcaatcaagaaaaaaagattttctgttagaagctataaatgactttaataatggactgaataataaacatctatttaagttggaacaatccaaatttaaacttattgaaggcttgccttttatttattggatttctgatgggtttagggaacaatttaaagagaagacaatcagtgaattatttaatcctgttcaaggtgctgcaacaacaaacaatcatagatttttaagattttggtgggaagtaaataagagtactatttcaattaattttgaagttgataaacataggtgggtttattattcaaagggtggaccttttaataaatggtatgggaatatgtgggttttgttagattggaagaataatggccaggatttgattgatgcgggtgctgttcttcgaaatagtagttattattttcaagaagggataacatattcggcaagtggttcgaaaggagcttcatacagatatttacccagcaattgcatttttgatacgggaggttcgtgtgtcttcctaaaaaaggaatacaaaaacctgcattatctcattgcgtttttaaattcaccactatctcgatatataataaactgtttgaatcctactgttaatacgcaggttggtgatatgcaaaggattccagtggttattcctttaaaagagcaggaagaatgtatttctatatttgcaaccaaaaacattgaaatcaaaaaacacctatgctcttatcgtattattgaaaccaattttgataaaacagcccttactgcctgttccgaaacagccttgcgggacaggttgttgtcttatttaaactacgaaaatgcacaattaacattggtactaatcaatgaagccattattaaccagattgttttcgatgtttatgatcttagccccgaagaccgccggcaggtagaaacccaaatgggcaaaccggtgggtgaattaccagtaatagcagaggccagagatgcatatttagcatcaactactattgaaagcgaaactgtacgggagtttatccaaaagctatccattaccacctttgatgaggaaaagatacatagcgtgaaggatgagtttgcaaccctttatcaaagcaacaacgatctggatgagttttgtatccgccatcagttaaaccccattaatgtatggtactggttccaggaaagtctggtattaccctcgggtagagctgcagaaatagctttgggatttctggcggatacctgtcgtaccgttctcatggaagatgaagacggcattattcccctggcaggcctgcctggtgaatctggtctgttggatcgtttggagcattattatttaaaccatggctttacttcagcgcagtttagccagttggatgaacttttaggccgtcccatcaatgagtatcttgaggattatttttttatgaacttgagtgatctacttaacctttttagatacttacctaaaaccccctttatctggcaccttagcagcggtccccagcagggttttgaagcctatatcatcatctataaatggaaccgggacagcctgtttaaactaaaaacccgctacctcggtaaacgggtggaaagcctggagtttcgccagattcaattggctgatagcaagactgcccaggcccaaaatgaaaaagagaaaatccggttgcaattgcaggaaatcgccgagtttaccagcaagatagatgagctaattgctgaaggatacgatccccagttggatggtggagtgggtaaaaatattgctcccctgcaaaagaaaggcttactgcgcagtgaagtgctgactgccgggcaattggacaaatacttaaaggcggattggtaa

SEQ ID NO: 2384 - DNA, 321 bp, Syntrophomonas wolfei
ttgactggtgtaatgctcgtctacctgcaccgctatcaacccgctatggttgctattcttcgcaccgactacctgcatcgcctgcaggacgtcttggaggtggagaaacagcatttacagcgcaccataaatgacgaagccggaagcagctcggcccgcaaggccgccaaagaactcacccggctggacaaacaaaccctggaactgaaaaaatacgaagaactggtccaccactacgccgacatgcacatccccctcgacctcgatgacggcgtcaaagtcaactatgctaaactgggcgaactgttggctaagatctaa

SEQ ID NO: 2385 - DNA, 3552 bp, Syntrophomonas wolfei
atgaacaaatccaatctgcgcaattttgccgttatggccagaactgaacttatagaacgggttaagcaaaaggcttatgaactgggcattactgaagaaaaggtaaaaaaagcccggattgaagctagtgatgccatatacataaacggaaaagccttggacagtgtgcaggtcaaacaaagagacagcctcattgccgccattgacaaaaaaggctatacccaggtaatggaggaaatcgcttacacctggttcaaccgcttttgcgccctgcgctttatggagattaatgattacctgcccaccggggtcagggttttatcctccacggttgcgggaagtgtagagcctgatattatgcgggaagcctttaacctggattttgattttagcggggataaggagcgcgaaacttaccgggaaaaggtctatgaaatgaaagaaaagaatgatcagaacgggctttttaagtacctggtgattaaacaatgcaacagcctgcatgatatcctgccctttttatttgaaaagattgaggattgtagcgaaatcctctttcccgacaatcttctgcaggaaaactccttcctgcgaaatatgaccaatccggaaattatccccgaagaggactggcaggaagttgaaatcatcggctggctctaccagtattacatatcagagaaaaaggatgaggtctttgccaacctgaagaagaatatcaaaatcagcaaagagaacattccggcagcgacccagcttttcaccccccactggattgtaggctacctggcggaaaactccctgggacgcctgtggatgctcaatcaccctcaatcccgcctgatagaaaaaatggaatactatattaagccggagcaggatgaggaagattacctgattattaagtccccggaagagataaaagtctgtgacccggcctgtggctccggccacatgctggtttatgccttcgatttgctctacgctatctacgaagaagccggctatatgccgacagagattccggaaaagattctcacccacaacctctacggcatcgaaatcgataagcgggccggagaactggcagcttttgccctggtgatgaaagcccggcagaaacatcgccgttttttccgccaaggaattcagccccatatatgtgtactggaaaacatccattttgaagaagacgaacttaaaaactatcaggaagaaatcggtcacgacctgtttactgctaatctctttcccaccttgaggctattcgaggaagcagataacttcggttccctgattcgtccggttatcaccgatgtctccgatatcctgcagctgctggaagcccaagacctctccggcaacctcttctttaatgccacccatcaaaaggtattacaggcattgcaacaggtagactaccttagccccaaataccatgtggtaatcgccaacccgccctatatgggggggaggggtatgaatgggcggctgaaggtctttgctgataagaattaccccgacagtaaatcggacttatttgccatgtttattgagcgtgggtttgatttgattgttgaacgtggatataatgccatggttacaatgcagagctggatgttcctatcatcctttgaaaagctacgtgagagcattctcaataaatatacaattatctcaatggcacatctgggtgccagggcatttgatagcattggtggtgaagtagtctcaactacggcttttgttattaacaacgaccattaccaggaatataaaggcgcttatttgcggttagttgacggaagaaatgaagctgaaaaagaagaggagttaatattaacacgggacaatccataccgggcctccgccgctgatttcaaaaaaataccaggatcgccgattacgtattgggtgagtgagaaaatatataaaattatagataattctcaaaagcttggtgatatttctgaagctcgaatgggtttagcaacgggaaataacgatagatatacgcgtttatggtttgagtgtagtcttaagaatataggtttttctatgcttaacagaacccatgcacaaaaaagtgctttaaagtggttcccttattgtaagggtggtaattttagaaggtggtatggaaataacgagtatgttgttgattggtacaatgatggtaaacaattacaatgtaatatgcatccatctgggacaagagtgtgggctcataatttcaatttagactacattttctgtgattcaattacatggtcggatataacatctggaatattatcggttcgattcaacgataaaggatttttatttgatggctctggaacatgtgcatttttcaaggatagcaatcaaaagcttgcggcgcttggtttgctaaatacatcgtttgttcgagatttttccaaagtacttaatcctacattacattttcaaacaggggattatcgtgttattccttacaggactgaattggagaatagagatttcctttttggcgttagaaaactgattaatctatctcgtatcgactgggactcctacgaaacctcctgggatttcaccgaactccccttattaaaaccggagtaccatgaaccaaccctccaggaaacctatcaaggcctccgcactcactggcaggaaatgaccctggagatacagcgtctggaagaggagaataaccgcatcttcattgacgcctatagtctgcaggatgaactgaccccggaagtacccttgtccgagataaccctgacctgtaatccctactaccgctatggtgatgataaaagcgaggaagaactggaagaacgtttgctgctggacaccatcaaggaatacatctcctacgccgtaggctgcatgtttggtcgctactccctggatcaggaaggactggcctttgccgggggcgatttcgagccatcattatataagaccttcccggccgatcgggataatgtcattcccatattggcagaggattacttcagcgatgacatagttacccgctttgttgattttgtccgcattactttcggtgcagcaaccctggaggaaaacctggagttcattgccgacaccctgggtaaaagagccaaagaaaccgctcgtgacaccatccgccgctattttttgaacgatttttacaaagaccatgtccagacctataaaaagcgccccatctactggctgtttacctccggcaaggagaaggccttcaatgccctggtctacctgcaccgctatcaacccgctacggttgctattcttcgcaccgactacctgcatcgcctgcaggacgtgctggaggtggagaaacagcatttacagcgtaccataaatgacgaagccggaagcagctcggcccgcaaggccgccaaagaactgacccaattggacaaacaaaccctggaactgaaaaaatatgaagaactggtccaccactacgccgacatgcgcatcccccttgacctcgatgacggcgttaaagtcaactacgccaaactgggcgaattgctggcgaagatttaa

SEQ ID NO: 2386 - DNA, 219 bp, Syntrophomonas wolfei
atgattgacatttccaaatccgattgggactcctaccaaacctcctgctcagcccgcaaggccgccaaagaactcacccggctggacaaacaaaccctggaactgaaaaaatacgaagaactggtacaccactacgccgacatgcgcatcccccttgacctcgatgaccgcgttaaagtcaactacgccaaactgggcgaactgctggcgaagatataa

SEQ ID NO: 2387 - DNA, 3507 bp, Syntrophus aciditrophicus
atggcaactctatccagtgaactacggaacaaattggagcgcgttgttattgaggcgcgggacgctgctgagactgctgctcgcgcggccctcgaaaccctggccgttcatcaccacgagccgtatccgcacatgaatccggtacagcgtgagttacgcaatcatctccgtgcccgggcgcgacaactcggggatcgcaagcttcacaaacctgatagaagtgggaaagaccatgctatctaccatctaaccggcgattgcgcctatgagcactggcatcgcatgctctttgcccgcttcctggctgagaacaacctcttgatcgaaccggaagagaacatggccatcagtttggacgaggcaggggaactggctagggatgaaggtgtggacatgtgggtcttcgcctcccggtgtgcacagaagatgctaccgcaaatcttccggccagatgatccgctccttcaagtgtcgttcgccactgagcacatcctcaagctggagaaactcctggcgtcgttgccttgggaagttttcaccgcctccgacgggttggggtgggtctaccagttctggcagagcaagaagaaaggggagattaatcgttccgaagtgaagatcggggcagacgaaatctccgcggtaacgcagctctttaccgaaccatatatggtggaatttctaatccacaacaccctgggagcctggtgggccggcaagaggctcaaagccgaaggcgccgccagcgcagggacagaagacgaactccgcgccaagcttgccttgcccgggttgacatgggactatctgcgttttgtccgtggacaggacgaaaacggaggtccatggcgacctgccgccggaacctttgaaggctggccgaaggccgccaaggatatcaaagcccttgatccctgctgcggatccggacatttcctggttgcgttgcttcgccacctcgtaccgatccgcatggacgaagagggtttgtctgcaaataatgccgtcgaggcggtgctccgtgacaacctccacgggctggagatcgatgagcgctgctgtcagatcgccgctttcgccctagctctggccgcctggacatatcctggcggcggcggctaccgactactgccaccactccacattgcctgtactggaatcagacagcaagcaacggaagaacaatgggtgaaactggccgagcaatcgggcatgcccactcaagccactgaagacgatcgcatcaagaatggcttactgaatctgcatcgcctcttctcgcaggcaccgatattggggtcgctcattaatcccaagcagctcaaggcagacgtttttactgccgactacgagatgatccagccttatctggcagccgttctcaaagcagaggaagtcgacgacgaaacccatgaacaagccgtcgctgccgccggcatggccaaagcagccaacctgttgaccggtaaatacacccttgtcataacgaacgttccatatcggcaagcagatgatctcgatcggacattactggaatatgcggaaaaaaactaccctgatgcgaaaaccgaccttgcaacagtattctactgcaggttgaacgacatgctttcattgactggatcatctgcagtcgttctgccgcaaggcttcctttacaaggattactatgcacgccttcgaaagcggctcttccgcgagcacaacttttacgtgattgcacgactaggtgcgagggccttccgcgggatcaacggagaggaagtgaaagtctgtttggttattgcggataaactgaattcaacgaaaaagatcgtcatcagtcaatacctcgtcacgtctggggatgccgatgagaagcagcaaaatctacaggtaattgcagaggtgcttgtcgctcaggaggatgccctggtaagcgcgaagtacatcttacgaggcgagcagaaggcgaaggaaaggctgctcgaagaatatgcatggtattccaatggcattcaaactggcgactacccaagattcggcaagtgcttttgggaagtacccgcttttttaacccagtggtctttgcaattatctaccgtgcaggagtcagttacgtatggtggccgagaacaatgccttctttgggaaagtggttgcggatcgttgcaccaatttattcgagaaaaagtcgggccaagccgagttaagtcatgggtgcgaggattaaactgccgcgatcgacgtggcgttgctatcagtgctatgggtgaactcaaggcaacactatattcgggtgagatatttgacgacaacactgtcgttataatcccaaaatcagttgatcattttgacgcgctatgggcgttctgtagcgacgcattatacgacaggctcgttcggaaaattgatcagtcgtcgaaagttcgcggtgcacttcttcgcgtgccattcgaccttgcccactggcagaagattgcagctgataagttccccaacggcttgccggaacccgaaagcgacgacccgacccaatggcttttccacggctggccggaagaatcgaccgctacactccaagttgctgtggcacggctaatgggttaccactggccagctgaactggattgcatgatgcgtctcagtgaacagactcgggcgctagtcaagcggtgcagggaactctccaaatttgtggacgaagacggtattgtctgtattccatctgttcatagcgaggaacctgcagccatacggttgaatgcgctgctggctgagacgaatattgagcaagcaaagatgcgcgaactgaccggtgggattgacctcgacgactggctccgcaacagctttttcgagcagcactgcaaactgttccacgatcggccgttcgtgtggcacatctgggacgggcggaagcgcgatggttttcatgccctggtcaactatcacaagctatgtgaaggcgacggtaagggccggcggctgctggagagcctcacgtacgcatacctcggtgaatggatcacccggcagaaggacggcgtgaagcgcggtgaagaaggtgcagaagaccgcctggccgcggcactggaacttcagaagcggttggaggcgattctggctggcgagccgccccttgacatctttgttcgctggaaaccgctgcaaaagcaacccatcgggtgggaaccggatatcaacgacggcgtcagactgaatatccgcccgttcctggcgtctgacctgcccggttgccggactggtgcgggaatcctccggtacaagcccaatattaaatggacaaaggatcgcggcaaggagccgcagcgcccaaaagacgaatacccatggttttggggatgggatgaaaagactgtcgacttttcaggaggtgaaaccttcgacggaaaccgttggaacgcctgccactacaccaacaaggttaagcaaatcgctcgtgagactgcgaaaaaggagaaaagtaatgccagcaaatgttcagacaatggcctattatggtga

SEQ ID NO: 2388 - DNA, 2115 bp, Tepidanaerobacter acetatoxydans
atggataaaagcttgataaaaaactatgccgtatgggcaagaaataaattaattgaagatatttctcaaagagcttatgaacttggaatcacggaaaatgaaataaaaaagcctgaagaagtatcgcaagactatataagaataaacgggaaaaaactcaagtcatttgaaataaatcagcgaaaaagccttgaggctaaaatacgcgaaaaaggattcgagcaagtagttgaagaagttgcctatacttggtttaaccggattatagccttaaggttcatggaggtaaacggttatattcccacaggggtcagagtgctgtcatcagcagaaccggggaaaacagaaccagatatcatcacatatgccgagcatatcgaccttgatttaaaccaagaagtagttgcaagactaaaagatgaaaatgatacagaagaactgttcagatatcttcttgttaaacagtgcaacaagctaaatgatattctccctgggctatttgaaaagataggagactatactgatatattgctgccgaagaatttgctgtcagaaggctcgattatacgccgcctggtttccgatataccggaggaatacttcaaagaacaagtagagataataggctggctctatcaatactatatttcagaaaagaaagatgaggtttttgcaggtcttaagaaaaatcaaaagataactaaagaaaaaattcctgctgcaacccagctgtttactcctaaatggatagtaaagtatatggtggaaaactctttggggcgattgtggctggagaagattagtgggcaggagatagtgggcagtgggaagtgggtagtggatagtaagaagttaaaagagaagtggaagtattatattgatgaggctgagcaggagccggaagtggaggagcagcttaaaaagataagggcagaaagtaaggatatgaagccagaagacataaaagtattagacccggctatgggcagtggccatatactagtctacgcatttgatgtgctttttgatatatataaaagcgccggctattctgaacgggagatacctaaacttatcctggaaaacaatctttacgggttagacattgacgatcgagcgggccaactggcctattttgcagtgatgatgaaagccagaagcaaaaacaggcgaatatttcgcgaaaacatagatataaatttgtgctctatccaagaaagtaatggaatacctgaagaaactattacatactttgccggcggaaaaaaatttatttcaaagacagagctggaagaaaagataaaaggcaaagacaacttgtccgatgcggattttgaaattcaggcaagataccttatccatgtatttcaagatgccaaggaatatggttcgatactagaagtgaaaaagcttgattttgataagacagaaaaccgattagaggaaattcggcaaaatcatcccggcgacgcatttgaatttgggcataaacaaatactacttgaaaaactcccgcccctcataaagcaggccaagataatgagcagcaaatatgatgtagtagtcaccaacccgccttatatggggcggaaggggatgaataatgcgttaaagaaatatgtagatgagcattacaaagattcgaagaatgatttatttgcagtttttatggaagttggaataaattatttggaacaatacggttttatgggaatgataaatcagcagtcatggatgtttctgtcgagttttgaaaaattaagatcaaagttaatgaaaaatataactataattaacattgtgcatttagggccaagagcatttaatgagattagaggagaagttgttcaaacagtcgcttttgtttttgctaaatggagagaattatatcctacttcgatgaaacaattaaaatcgtcatatattagattagttgatttcagttctgcttatgaaaagaaaaagaaattcattaatgccatagaagataagaacgtaaactataggtatgataacgtaaagcaagaaatgttttcaaaaatacctggtggtcccatcgcatactgggttaataaaaaaaattgtaaacatatttcaaaacaaactactaggtga

SEQ ID NO: 2389 - DNA, 1359 bp, Tepidanaerobacter acetatoxydans
ttgataagttcaaaaaactcttttggattgcggtatgttcctaaaggatttatttttgattctaatggttctgcaatatttatcgataaagataaaataagatatatacttggtttcggcattactaaggtagcaagtgaattactaaaaatacttagttcaaccttggcatttaatattagcgatgtagcaagtttgccaatcaagcttgctaattcagataagtgtttaaacaaaataaatcatattgttgacttatctatctccatctccaaaaccgactgggactccttcgaaacttcatgggactttaaaaagcatccaatactcacgcacaaaggtgatgcagataccatagagcaagcctttaacaattgggcggagtttgcggaaaaacaattttatcagctcaaagccaatgaagaggagttaaaccgaatatttatcaagatttatggtcttgaagatgagcttactcctgaagttgatgaaaaagatgtaacggtaagtaaagccgacagggagcgggacattaagtcatttatctcctatgcagtaggctgtatgttcggaaggtattctcctgatgtggaaggattggtgtatgcaggaggggagtggagcgataagtggaagatagaaaacgggcaatggaaagtccgtaaactagtcaaggatgaagataatgatatattagaagatacatggattgatgccacctttgcaccggaaagcgacaacaccatccccataaccgatgaagagtattttgaagatgatatagttgcaagatttattgaattcctgaaggtgacttttggagaggaaaaattagaagaaaatctagactatatagctgaaagtatagggaaacggaagtctgaaacttctcgtcaggcactgcgccgctatttcttaaaggatttttataaaaaccatgttcagacatataaacaaaggccaatatactggctatttgattcaggaaggcaggatgggtttaaagcgcttatatacatgcacagatatgatgaacatattgcagcccgcgttagaattgactatcttcataaacttcagagaaaatatgaggatgagataaaaagacttgatgtaatcatagattcaaacttatcactgcgagaaaagaataatgcccgaaaggcaaaggaaaagctgcaaaaacagatacaggaatgccttgagtatgaccaagtgattgcccatgtggcaaatcaaagaataaaaatagaccttgatgatggggtaatcgtgaattatgctaagtttcaaggtatagagataccacagggagaaggaaaaaaaccgttaaaggcaaatttattggcaaaaatttaa

SEQ ID NO: 2390 - DNA, 3762 bp, Tepidanaerobacter sp.
atggataaaagcttgataaaaaactatgccgtatgggcaagaaataaattaattgaagatatttctcaaagagcttatgaacttggaatcacggaaaatgaaataaaaaagcctgaagaagtatcgcaagactatataagaataaacgggaaaaaactcaagtcatttgaaataaatcagcgaaaaagccttgaggctaaaatacgcgaaaaaggattcgagcaagtagttgaagaagttgcctatacttggtttaaccggattatagccttaaggttcatggaggtaaacggttatattcccacaggggtcagagtgctgtcatcagcagaaccggggaaaacagaaccagatatcatcacatatgccgagcatatcgaccttgatttaaaccaagaagtagttgcaagactaaaagatgaaaatgatacagaagaactgttcagatatcttcttgttaaacagtgcaacaagctaaatgatattctccctgggctatttgaaaagataggagactatactgatatattgctgccgaagaatttgctgtcagaaggctcgattatacgccgcctggtttccgatataccggaggaatacttcaaagaacaagtagagataataggctggctctatcaatactatatttcagaaaagaaagatgaggtttttgcaggtcttaagaaaaatcaaaagataactaaagaaaaaattcctgctgcaacccagctgtttactcctaaatggatagtaaagtatatggtggaaaactctttggggcgattgtggctggagaagattagtgggcaggagatagtgggcagtgggaagtgggtagtggatagtaagaagttaaaagagaagtggaagtattatattgatgaggctgagcaggagccggaagtggaggagcagcttaaaaagataagggcagaaagtaaggatatgaagccagaagacataaaagtattagacccggctatgggcagtggccatatactagtctacgcatttgatgtgctttttgatatatataaaagcgccggctattctgaacgggagatacctaaacttatcctggaaaacaatctttacgggttagacattgacgatcgagcgggccaactggcctattttgcagtgatgatgaaagccagaagcaaaaacaggcgaatatttcgcgaaaacatagatataaatttgtgctctatccaagaaagtaatggaatacctgaagaaactattacatactttgccggcggaaaaaaatttatttcaaagacagagctggaagaaaagataaaaggcaaagacaacttgtccgatgcggattttgaaattcaggcaagataccttatccatgtatttcaagatgccaaggaatatggttcgatactagaagtgaaaaagcttgattttgataagacagaaaaccgattagaggaaattcggcaaaatcatcccggcgacgcatttgaatttgggcataaacaaatactacttgaaaaactcccgcccctcataaagcaggccaagataatgagcagcaaatatgatgtagtagtcaccaacccgccttatatggggcggaaggggatgaataatgcgttaaagaaatatgtagatgagcattacaaagattcgaagaatgatttatttgcagtttttatggaagttggaataaattatttggaacaatacggttttatgggaatgataaatcagcagtcatggatgtttctgtcgagttttgaaaaattaagatcaaagttaatgaaaaatataactataattaacattgtgcatttagggccaagagcatttaatgagattagaggagaagttgttcaaacagtcgcttttgtttttgctaaatggagagaattatatcctacttcgatgaaacaattaaaatcgtcatatattagattagttgatttcagttctgcttatgaaaagaaaaagaaattcattaatgccatagaagataagaacgtaaactataggtatgataacgtaaagcaagaaatgttttcaaaaatacctggtggtcccatcgcatactgggttaataaaaaaattgtaaacatatttcaaaacaaactactaggtgatatggcaaaggttcgaaaaggaatggatacagggaataatgaaagatttttgcgatattggtacgaagtgtcaagatgtaaagttggtattggattaagaaaaggagaagacacaataaagtttgcaaaaaaatggataccctataataaaggtggcgggtttaggaaatggtatggcaataatgagtatgttataaactggttgaacaatgggttagaactgaaagaacataaaagtgcaaatctacgaagtattaacttatattttaaggaagcattgtcttggactttgataagttcaaaaaactcttttggattgcggtatgttcctaaaggatttatttttgattctaatggttctgcaatatttatcgataaagataaaataagatatatacttggtttcggcattactaaggtagcaagtgaattactaaaaatacttagttcaaccttggcatttaatattagcgatgtagcaagtttgccaatcaagcttgctaattcagataagtgtttaaacaaaataaatcatattgttgacttatctatctccatctccaaaaccgactgggactccttcgaaacttcatgggactttaaaaagcatccaatactcacgcacaaaggtgatgcagataccatagagcaagcctttaacaattgggcggagtttgcggaaaaacaattttatcagctcaaagccaatgaagaggagttaaaccgaatatttatcaagatttatggtcttgaagatgagcttactcctgaagttgatgaaaaagatgtaacggtaagtaaagccgacagggagcgggacattaagtcatttatctcctatgcagtaggctgtatgttcggaaggtattctcctgatgtggaaggattggtgtatgcaggaggggagtggagcgataagtggaagatagaaaacgggcaatggaaagtccgtaaactagtcaaggatgaagataatgatatattagaagatacatggattgatgccacctttgcaccggaaagcgacaacaccatccccataaccgatgaagagtattttgaagatgatatagttgcaagatttattgaattcctgaaggtgacttttggagaggaaaaattagaagaaaatctagactatatagctgaaagtatagggaaacggaagtctgaaacttctcgtcaggcactgcgccgctatttcttaaaggatttttataaaaaccatgttcagacatataaacaaaggccaatatactggctatttgattcaggaaggcaggatgggtttaaagcgcttatatacatgcacagatatgatgaacatattgcagcccgcgttagaattgactatcttcataaacttcagagaaaatatgaggatgagataaaaagacttgatgtaatcatagattcaaacttatcactgcgagaaaagaataatgcccgaaaggcaaaggaaaagctgcaaaaacagatacaggaatgccttgagtatgaccaagtgattgcccatgtggcaaatcaaagaataaaaatagaccttgatgatggggtaatcgtgaattatgctaagtttcaaggtatagagataccacagggagaaggaaaaaaaccgttaaaggcaaatttattggcaaaaatttaa

SEQ ID NO: 2391 - DNA, 3504 bp, Thauera sp.
atgaacaaagccaaactcaaaacctacgccccccaggcccgcaaggacttcatcgccgccgtcacccagcgcgccaacctgcttggcctctctgaatccgccggcaagttcgaagcgctgccggctgagcgccggggggatgtggtgctgatcgccgggcgtgaatggccggcccgcgtcgcccagcagcgcgagcgcctggtgcgccgcatccagcgcgacgggtttggctacacgatggaggcggtggcctacacctggttcaaccgctttgctgcgctgcgctacatggagctgcacgactacctcggccacggccaccgtgtgctctccagcgccaccgccggcggcctgccggacatccttgcccacgcggcggatctcgccgccagccgcgaactgcccggtctggacaccgcccacatcgccgaactcaagctcgccggcaacaaggacggcgagctctaccgcctcttgctggtcgcccagtgcaacgcgctctccaccgccatgcccttcctcttcgagcgtatcgacgacgaaaccgagctgctgctgcccgacaacctgctgcgtaccgactcggtcatcgccaagctggtcgccgagatcccggaagaagattgggccgaggttgagatcatcggctggctctaccagttctacatcagcgagaagaaggaccaggtcatcggcaaggtggtcaagagcgaggacatccccgccgccacccagctcttcacccccaactggatcgtgcaatacctggtgcagaacagcgtcggccgcctgtggctgatggccaacccggccagcacgctcaagagcgaatggccgtactacatcgagcccgccgagcagacccccgaggtcaacgcccagctcgacgtcctcatccagactcgcatggccgaggacggcggcagcctcaaccccgaatccatcaccgtgctcgaccccgcctgcggctccggccacattctggtcgaagcgtacgcgctgctcaaaggcatctacctcgaacgcggctaccgcctgcgcgacatcccgcgcctgattctggagaaaaacctctacggcctcgacatcgacgaccgcgccgcccagctcgccggctttgccctgctgatgaaggcccgcgccgacgaccgccgcctgttcaacgacccgccccggctcaacgtgctgagcctgcaagagagcaaggggctggacctggacgaacttgccacccacctcgcgcccttcggcgtgcagcgcgccaccgtcaaggcgctgctcgacaccttcgaacacgcgaagaccttcggctcgctgatccagattccggacgtgctgaatgcgcaactgccggcgctggcggaggccttggggaaggcgaaagagaccggggatctgtatgcgcagatggcggcgcaggatttgatggctctggtggagcaggcaagagtgctggggcggaaattcgatgcggtggtggcgaatccgccgtacatgggtagcggcttcatggaccctgtgctcaaagcatttgtagaacgtcgctatccgatggaaaaaggcgatctgttcagctgcttcattcgacagggtgagcaggtatccacccctaccggttttatcgcgtttgtaacgatgcaaggttggatgtttttgtctaattatgaatcatttcggcgcgattttttgcagaggaatgttatatccagtcttctgcatttgggtaatggtgtgatgggtattgcctttggaacgtgttctgcggtattccagaggtctcccattaaagcgtttgctgctaagtatattcaggtcgatgcttcacagctctctgatgaaggtgagattgatttatcagaatcaattgcgactgttcgaagcataaatcattttcagtcttctccaggtttggccttggcgtattcacttgagcctcatcaaatggctctgtttgatcagaatcctcccatctctgaaaaggttgaagctcgcgaaggcatgacaactgccgacaacgggagattccttcgttattggtgggaaattaatacggaacagatcaaccgaagcgccctttccgaggctgatgccaagaactcccctcggcgatggtacccgtaccagaagggtggggaagctgtcaaatggttcgggaacaaccagtgggtagtggactggcaggatgacggggctggagtgaagggaaatgttgatccgaatacaaaacggattcgatcccataactacaatggggtgtactcgttcagagaaggtataacgtggtcgtcatttagtaatggagggctcgcttttcgctatgttcctccgggaagtctgttcgatagcaccggctcaatggcattttcgtcctctaatttattcggttatctggctcttctcaacactccttcggtatttcgctttctaaaagcatattctccttcgccgcgtatcaagattgaaagtctgcttgctattccagatattcttcaaaatcatgacatcaatgagctcgatgagctttcgcgggagtgcgttcaaatctcgtcaaaaattagcagatttgaggaagtgtcgccgaccttcgctatcaataaggaacaagatcttctttctccaaaggccctgagttctacgtttaaagcatggagaagccgcatcacggaaaacgagattcggatggaagaacttctttccaaaggattcggattttcagagcatggcaccattgataatggcacaggcgggagtgagttcaatgcgcgtcatctgatctcctacgccatcggctgcatgatgggccgctacagcctcgacgaacccggcctgatctacgcccacgccggcaacgtcggcttcgactcgacccgctacaagaccttcccggccgacgccgacggcatcgtgccgatcaccgacgaattctggttcgaggacgacgccgccaaccgcgtgcgcgagttccttcgcgccgtgtggggcgccgacacgctcgacgaaaacatggcctggctcgccgagagcctgggcaccaaggccggcgagacggcggacgaaaccatccgccgctacttggccgacaaattcttcaaggaccacctgcaaacttacaagaagcgccccatctactggctgttctccagcggcaaacagggcgccttccaggcgctggtctacctgcaccgctaccacgaaggcacgctcgcccgcctgcgcgccgaatacgtcgttccgcttaccggcaaaatgcagacccgcatcgacatgctggaaaaagacgccgctgccgcccccagcaccgccgcccgcaacaagctcaacaagcagatcgagaagctgcgcaagaaacacgtcgaactgctggcctacgacgaaaagctccgccactgcgccgacatgcgcatcagccttgatctggatgacggggtgaaggtgaactacggcaagttcggggatctgctggcggaggtgaaggcagtcacaggtggcacgggagaggagtga

SEQ ID NO: 2392 - DNA, 3405 bp, Thermacetogenium phaeum
atgccggtactgtcagcagaacagcgaaataaacttgaacgtactgtcgtcgaagcccgggatgttgccgaggccggagccagggcggccctggaggctttagctgtgcaccatcacgagccttacagccatatgagttcggaacagcgccggcttcgcaaccacctccgtgcccgggcgcggcagctgggggataagcaggacaaaagcggaaaactggaaattatccatctgatccaggagtgtgcttacgaatactggcatcggatgctctttgcccgtttcctggcggaaaatgacctccttatcgagccggagatgggggtggccgtcagcctggatgagtgtgatgaactggcccgggaggaaggcagcgatctttggaccctggccagccgttttgcccagcagatgctgccgcagatctttcgtccggatgacccggtgctgcaggttgcttttccgtacgaatatcaattaaagctggagcagttgctcgacgacctggagccggatatctttaaagccagcgatgccctcggatgggtctaccagttctggcagagcaagaggaagaaacaggtcaacgagtcgggcaataaaatcggcgccgatgaattgccggccgttacccaactctttacggagccttatatggtcaatttccttattcacaacaccattggcgcctggtacgccggcagggtactggcggaaaatccgcagctggccgggcaggcagaaagtgaggaagagcttcgcagggcggtttcattacccggtgtaacctgggattaccttcgttttgtccgcaccggcgatggggaggggccgtggcgccccgccgccgggaccttcaaagaatggccgaaacgggcggccggtcttaaaatcctggacccctgctgcggctcgggacatttcctggtcgcggcgctctaccacctggtcccgattcgtatggccgaggaaggcctgacggcccgggaggcatgcgatgccgtcctgagagataatctccacggcctggagatcgatgagcgctgcacgcagatcgccgcctttgccctggccttggcggcctggacctatcccggcgccggcggataccgttccttgcctcagatgcgaatagcctgttccggcatcgcccctaatgccaaaaaggaagactggctcgccctggcgggagatgacgagcgcctgcgcaacggcatggcccggctttatgagcttttccaggatgctcccattttagggagcctcatcgatccgggttccgctatagaaaataacctgtttgaagccggatttgatgaactccgccctttgttggagaaggctatgtctgtggagaaagacgactacgagcagcatgagttaggcgttgccgcctgcggcatcgctgatgcagttcagattctcggcgggcgctaccacttgataatcaccaatgtgccgtacctggcccgggggaagcaggccaataagcttaaggaattttgcctcaagtattataacgaagctaaaaatgatattgccactgtttttctaaaccgcctgctccgactcaattcgcctgaaggcacaacggctttagttttgccgcagaactggctttttttgaccgcctataagaagtttcgaacccgtatgctgaaaacaagacgatgggatatcgttgctaaacttggcccgggtgcattcgagactatatcaggcgaggtagtgaatgttgttttacttgccatttccacctctgctccgtcagatggtcacaccttcgccggcctcgacgccaccgccccccgcacggcacgggagaaagatcggtttctttgtataggagagcttcggactgtggatcagagcaatcagtttaaaaatccagaagcaagagttacaattacagaaataccattggtcgatgaaacgctagggcagtattgttcaatacttcaagggtcatcgaccggtgatgagcctaggtttgtccgttgtttttgggaattcaatagcttcaacgtgcgatggaagcttttattatctgcacctgatgaaggcgtgtattcgggacgaagccatgtatgggattggccaaatgataattgtgagctcgctaaatcagatggcgcacgaatccaaggtcttgaggctataggtaaacaaggtttttttgtttctggttctaggcgtattacggcatcaatatacaatggagaattttatagcaaggtacttgcgacgataatccccttcaattctttaaacaaacttgctatctgggcttttctagaatctgatgtctttgaaagagaagttaggaaacttgaccagaaaattcttgtaactcctggggtatttgcgaacgttcctttcgacctggaatactggcagaaagtcgccgccgagaagtatccaaagggcctccccgaaccttactcggatgacccaacccaatggatcttccacgggcacccgacagtttctaccagcccccttcaggtggcggtggcccgccttttgggctaccgctggccggcggagctggatgactcgatgcggttgtctgcggaggcacgccggttggtacggcggtgcagggaactggaaagttacgctgataacgaaggaatagtctgccttcccgccgtccgcggagaagacccggctgccgaacgcctgcgggctttacttgccgctgcctatggtgatgactggtcgccggaaaaagagcgggaacttatcgcagcaacgggctctgaagcgaaggagcttgacgagtggctccgcagcgatttctttgaacagcactgcaagctctttcaccaccgacccttcatctggcatatctgggacgggcgccggcgcgacggtttccatgccctggtcaactaccacaagctggccgggggcaacggcaagggcaggcaggttttagaaagcctcacttatagttatctcggtgagtggattacccggcagaaagatggggtgaaacggggcgaagggggtgccgaggatcgactggcggcggcattggaactgcagaaacgcctcatcgccatcctcgaaggggaacctcctttcgacattttcgttcgctggaagcctatcgaacagcagcccatcggctgggaaccggacatcaatgacggagtcagggtcaacatccggccgtttatggcttctgaccttcccggcggccggaaaggtgctggcatcctccggtggaagccgaatatcaattggagaaaggatcgcggcaaagagcctaggcgccctcaagaacagtttccctggttctggaataatggtcagtttaccggcgaccgggtcaacgacgtgcacttaaccaatgaagaaaagaggaaagcgcgtgagaatgcgaacaggagtagataa

SEQ ID NO: 2393 - DNA, 3612 bp, Thermoanaerobacterium thermosaccharolyticum
atggataaaacagcaataaaaaactttgcagtatgggccagaaaaaaacttattgaagatataaagcagaaggcttatgagataggaataaccgagaaggagattaaagaacctgaaattaccacatccgacacaatgataattggagacagaactttaaacaaggcggaaatggaacaaagaaagagccttgtgtcgaggataaagggaaagggatttaacaatgtgatagaggaggtggcatacacctggtttaacagaattttagccttgcgtttcatggaagtaaatgggtacctacctacaggggtaagggtactgtcgtcgattgagccaggcaaaaaagaacctgatattattaaggaagcccttaatactgaccttgatttggatagggaactggtgtacaggttgcaggatgccaatgatacggaaggcttatataggtatctccttgttaagcagtgtaatgccttaaatgaaatccttccaggactttttgaagagatagaggattatacagaaatcctgttgccttcaaacctgcttgctgaaggttcggtcataaggcaactggtagataatatatccgaggaggatttcaaagaccaggtggaaatcatcggctggatgtatcagtactatatatccgaaaaaaaggatgaagtattcgaagggctgaagaagaatataaagataaccaaggagaatattcctgcggctacccagttgtttactcctgattggattgtcagatatatggtggaaaactctctggggaggttatggcttgaaggacatccaaatgaagagttaaagagtaaatggaagtattaccttgaggaagcggagcaggaaccagaagtacagaaacagttggaggaaatgagggctaaaagcaaggatataaggccagaggacatcaaggtgctggaccctgctatgggtagcgggcacattttggtgtatgcttttgacgtgctttacgatatttacaagagtgcagggtactctgaaagggatattccaaggcttattcttgaaaacaatctatacggattggatatagacgacagggcggctcagcttgcctattttgcagtcatgatgaaggcgaggagcaagagcagaaggatattcagggagaaggtaaaccttaatatatgtgctatacaggaaagcaacggttttcccagagaggccatagattactttgtgaaccatgatgaaacagagattgagaagcagaaactcaggggggatgtggagtaccttataaatgtatttaatgatgctaaggagtatgggtccatacttgaggtaaagcctattgattttgaggctattgagaaaaggatagaggaaataaggaatggaggaacagggaatttatttgagtatcagtataggaatataatccttgagaagattccagcattggttaagcaggcaaggattatgagccagaagtatgatgttgtagtgactaatccgccgtatatgggttatagtggaatgaatattaatgttattaattatataatagaaaaatatccaaaatctaaaacagatttatattcagtttttatagagcaatgttctaaattagttaaaaatgattgtttttttgctatgattactatgcattcttggatgtttataaaatcgtttatcgaatttagagaatatatgctaaattacaagttaactaatatggttcatttaggagaaagagcatttgaagaattaagtggagaggttgtaaaaacagtagcatttgtttatagaaaaagaaaatgtctacaatataagccagtatatattaggttagttgaatataattcttgtgaagaaaaagaaaaggagttttttaacatcaataattattatgttaaacaatcattacagaaaattaaagaattaccaggagtgcaatatgtatatagaatgactgataaattgataaagaattataacggtaaattgattgaagaagtaacggattataatggtgctcaaaataaaacaggtaataatgataaatatattaggtttaaatgggaaatcgatgatactaagtttaaaaaagactggtacggtataactaaaggtggcaaatttagaaggtggtatggaaatttagaatcagttattgattggtcagttgatgcaaggaacttttataaaaacaataaaacttcatgtattatgaatgaagattatttgtttagggaagggatatgttggactaaatcagcatttggtaacaagccgagttttagatatttgaataatcaagtactttatgaaactgctgcaccaactatacatgtaaaaaattcagaaaatttcaagtatatacttggactattaaattcttctgtagggaatgtttatataatgtatagaaatgaatctaattcatatcaacttattgatataataaaaataccttttatacagccaaaagatagattaacaaaaaatagagttattagattggttgatgtctgtatagagttatccaaaaccgactgggactccttcgaaacttcatgggacttcaaaaagcatcctttgcttgtccacaaaggcaatagcaacatcatagaagaagccttcaacaactgggcggtttttgctgaaaagcagttttataagctgaaagccaacgaagaggaactaaaccgcatatttattgaaatatacggtttgcaggatgaactcacaccagaagttgaggacaaggatataactatacgaaaagccgacagggtaagggacatcaagtcctttatctcctacgccgttggctgtatgtttggaaggtactctattgatgcagaaggccttatttatgctggcggagacttcaaagataagtggaagtgtgaggacgggcagtggaaagtaagaaagataataaaagatgaggaaggcaaagtaatcgaggataaatgggtagatgctacttttatgcctgatatggataatgttctaccaattaccgatgatgaatattttgaggatgacatcgtcagcaggtttattgagtttctcaaggtaacatttggcgaggatactctggaagaaaacctgaactacattgctgatacactaggaagaaagtcctctgagactgcaaggcaggctataagaagatactttctcaaggatttttacaaggaccatgtgcaggtataccagaaaaagcctatctattggctttttgattctggtaagcaggatggcttcaaagcactcatctatatgcatcgatatgacgaacttacggtagcaagggtaaggaccgattacctgcataaactgcagaaatcctatgaagcagagattaagaggttggatattgtcattgactccaatgcctcccagagggaaaaggccaatgcaaggaagaaaaaggaaaagatactaaagcagatagatgaatgcctgcagtatgaccaggtaatcgcccatgttgcaaaccagaggataatgatagacttagatgacggggtaagtgtaaactatgctaagttccaagggattgagatacctcagggcgaaggcaggaggccattgaaggcggacttgctggcgaaaatatag

SEQ ID NO: 2394 - DNA, 4542 bp, Thiocystis violascens
atgacccccgccgccaagaatgcccttgcgaccaccatccgcgccctgcgcgagcgcctgctcgccgatctgcacgcagccaccgagtccgcctaccgtctgtccatccgcgttcaggatgcgggtctcagcgaggcggcacaggctcggcgtcggcgtctggagggctggatcgccgagcagcggcgtgcccagccgaacgccgagatcgcgcgggacgacgatgactttcggcgcgaggccgagaagcaggccgcctacaccctgctcaatcggctggtgatgctgcgtctgctggaggcacccggcccggcgggctccgagcatgagaagccgctgcgtgccccggccatgcttaccggcggctgggagagccaagcctacaaggactttcgtcagctcgccccggcgctggcgcgtggcgacgagaccgagggctatgcctttctgcttcggctggtcttcgaggacctggcgaccgagctgccgggtctctatggttcggcaggggtggccgagctgatcccaatcccggccgccaccttgcgccatctggtcgaggcgttcgatcggccggagctggaatcctgctggcgcgacgacatgacgctcggctgggtctaccagtattggaacgaccccgagcgcgaggcgctcgacgccaagctgcacggcggcgccaagctcgccccgcacgagatcgccagcaagacccagatgttcaccgaacgctacatggtcgactggctgctgcagaacagcctgggcgtgctctggctgaccatctgcaggaagcacggctggacgcccgaggccgagaccgacggcaccctggagcgtttggaagagcgccgcgtcgagtggcgggccaggcgcgagtcgggggaggtgacgctcaccgagctgatgccgctgcagaccgacagcgagcgccgttgggcctattacgtcccccagccgatcccggaggacgcggtcgagcaggcgcctgccagcctccgtgacctgcggctgctggatccggcggtgggctcgggtcactttctggttgccgcgctcgatctgttgttcgcgctctaccttgaagaggcgaggcaccggcgcctagccgagcatcccgactggaccgaccgcgccatcctcgagcacatcctcgcccacaacctgcacggcatcgacctcgacccgcgcgcggtgcagatcgccgctgcggcgctctggcttaaggcgcgccggctggcgcctgacgtccggcccgagcggctcaacctggtcgcctccaacctgcgtctggcgagcctgccggacgacgacccggcgctgctggagttgcgccttgaggtcgagcgcgagatcggactgcccgccgcgctcaccgacaccctggtccatgcactgcgcggcgccgaccatctgggcagcctgctgcgcatcgaccgcgcggtcgaggaggcattggagcggcacgacttggagctgggccgcgagctgcccgcgcagggcgatctgttcgacggattctcggagcctcaacgcacgccaatgggccgggaggaggcgcgggcgactctgctcgaccggttggagcgcttcctgggcaggcacaccggcggcgacgatctgggcttgcgtctgcgcggcgagcaactggccgccggggtgcgcttcatgcggatgctgggggcggggcgctacgacctggtggtggccaatccaccctatcagggcaccgccaagctggccgacgtgcgctgggtcgagcgccactatccgctcggtaaggcggacctctacgccgcctttctgctacgcgggctggaactggtgcgcgagggtggggtgtcggccatgctgaccatgcgcaactggatgttcatcaagcagtatgcggcgctgcgggcgcatctgctggagcggttcgatctgcgggcgttgggggatttcgatcgcggtgcgttcgaagacgtgccggatgaggtcgtgagtgtggccgtgagcgtcttccgcaagagtgacccttgcggcgagagcgtggcgatctgtccgacgccgcgggatgatcggtcacgggatggcgagcggacgcagcggaagcgggtggcgacggtttgtcagattgggcggtgcaagttcgatccggcggtgttgaaggtggtggctgagtggccgctagtctattggtgggacaatagcttcattaagcattacgatgctttgccgaaattcggtgatctatacgaaattaggcagggattatgcactggtgataatgcaagagcacttagattttgttgggaagtcaagcaatatcaagtcaaggtatctgcgaatcgaaacgacctttttgggaactcaatttggcttccttttatgaaaggaggggaaggtagggcatgggaagaaccgcttttattagtggttaattggtgcttcaatggactggaaataaaagtggggcatgaagcgggtttgttagctgcaaggccgcaaaatgaagcattttatttaacgcgcggggtagcagtacaaacgactggatcagacttctcggcaagacttcatcgctacaactcggtattcggtgacaaagcgcgatcgattttcccggaaaactcgtatcaagtcgtagctttgctgaattcagccaaggcgcgtgagcttgtctccgcccttaatccgactattgattttactgtaggtgatctaaagcgattgccattttggcccgttccggaatcacgtgccttggtcgagctgatcgagcatgcttttacggaacatgaagtccatcgcgagccttcggtcgaattcaaacatcccggcccctcaccctggcgccatgcccaagactgggctcagactgccgtcgaccgtcccgagggcgccccgctgccggactatgcgccagagtatgacctcgagccgccgaccgaccatctgagcttcgcgctcggtgtcgcgctcggtcgcttcggcggcggtccggggctgggcggggagggcatcctcgacccccagagcgccgatctcacgcacgcgctgcccgacggcctctgtttcctcgacatcacccttgatgccgaggaccggcgggacagtctgggccatcccgccgccgccccgctgcacgcggcctgggaccgatacggtccggccctcgacacccggcgcaagtcgctgcgcgaatggctggcgctcgactgtttcaaggacgtgcaccgctcgatgtacgagaaccgcccgatccactggtcgctgtcctcggccaaccgcaccttcgtcgcctgggtcaacatccatcgcttcaccgagcggacactgcgcctgctgctcgccgatcatctgcaaccggcactcacacggctcgacgggacgctcgccgatctgcgcgccgcccgcgacggcgccgaccccaaggcggcgcgagcggccgagcgccggctcgccgtttcgctcaaggcccgcgacgagctggccgacttcatcgccgcggttgagcagtgcgccgatcgcggaccgccgccgaccgaccccaagtgcccggcgcgcgagcgcgacgcccgctacgaccccgacctcgacgacggcgtcatgatcaacgcagccgccctctggccgctgctcgatccccaatggaaagaccccaggaaatggtggaaggagctggccagcagccagggcaagaaggactacgactggtcgcatctggccatgcgctattggcccgagcgggtcgaccgcaaatgccaggccgatccctcgctcggcgttgcccacggctgtttctggcgctaccacccggcccgcgcctgggcctgggaactgcgcctccaggacgagatcgcccccgatttccgcatcgaagagccgccgtatcgacccggcggcgatgatattggtgaccccggagatgatctgcaccgcgatgccttcctgcgcgaaaatcccgagaaggccctcgaaatcgttgagaaagaggccgagcgccgcatcggacggggcgaccaacgcaatgtggtttccgagttgatcctgctcgagtctggcctctggaccgcgcgccccggtctgatctgggcgatggagctgcgcctttccggtaggcaggatgcccattttcgtttgcgggcacccgacgagccacacgcccgcgccgacttcctgcgcgactgcccgcagcaggcattggccgcaatcgagcgggaagccgagcggcgcatacgcagtcgcggcaggcgtcgtcctgtccccgagctttgcatcctcgaagcgggactctggtcggcactgcccgctaaggtttgggagattgagctgcgtcttgccggcaggcaactagccgatttccacttccgtgcgcccgatgagcgggaggcgcgcgccgcatttgaaaccgagaatccaggattcgtccgagaccgggaggcgttcatcgccagcctggtcgtccagcaagaaatcttcgacggcaccgatgatgccggcgaagaggagccaagtgacgaaggtatggctgaggaagacgaagaggaggtcgagtag

SEQ ID NO: 2395 - DNA, 2022 bp, Thioflavicoccus mobilis
atgagtctgtttctgcggctgctgggtgaggaggacaagggtgcggccctgttggaggctgtgcgcgcggtggctgccggcgaggccgacccacgggtcttcgatgtggagcccgcctcctttgaacaggtgccgggggcgccgtttgcatattgggttcgggacggaatccgccgaatgttccgtcttcatcccgcggcggagtcggatgtgcgacggtttacgaagggtctttgcacaactgacgattttcgattccttcgcttgtactgggagaatcgtggagaaaagcaagccgttcgatggttccatttcgttaatggtggatcgactacccgattctaccaggccgtgaacatagcaattaattggtacaaagacggcttggagcttaaggcgtttctcgacgggaaaattggcaaagaaaaccaatggtcacgctggataaactcggtgacttactacttcaggccagggatcacctggccgctgcgtacaggacggttttcaccgcaggtattgccaacgggcacgatatttagtgtgcgcagctatgcggcgttcatgccgaaagacgctcttttgtgcgcccttggcttgatgggatcgtcagcgctggattttctcttgaagctgtcgctcggaaggtccggtcacccagaatttgttattggtgttattcagcaagcgccgtttccacagttggcgtcaagcgaatgcgcaatcttagcagatacggctcgtaccgcttggtcgctcaaacgcaagctcgacaccgcgaccctgacgtcccacgcttttcttctgcccgcgctgcttcaggtgcaagggaagagcctcgacacgcggtgcggttcctggtcggaccgcatgcagcaaacggagcaggcgcttgccgagatccagtccgagatcgacgcccgctgcttcgacctttatggattcgacgaggctgatcgggcgggggtgatggcgtccgactcgttgggcgaatccgggcagtccgacgacgccgagaccggggatggcgacgaggacgaaagttccggcccgagcgcggacccgaaggtcctcgccgccgagtggttcgactggctggtgggtgtcgcattcggccgtttcgacctgcggctcgctaccggcgagcgcgaagcaccgccggagcctgagccgttcgacccgctaccggtctgctcacctggcatgctcaccagtgaccaaggactccccctgaacgagcccccgtcaggttatccgatcgccttcccggcagatggcatcctggtcgccgacgcggacgaggttcagggtcaggtcggtagtgacctgatgtcgcggcttcgctcgatcctccgaattctcgccgtcaggatcgaaggtggggatgctcctggccttgccgcggaggccctggaggcggagctttgccggctgttgggtacgaagaccctgcgggactggctgcgccggccaagcgggttctttgccgatcatctcggccgttggtccaagagtcgccgcaaggccccgatctactggccgctctcgaccgagtccggcgcctatacgctctggatctactacccgcggctgaccgatcagaccctctatacctgcgtcaacgaccatatcgaccccaagctcaaggagatcggggccgacttggagcgcctgcggggcaacggcgacctggacgccaagacccgcaagcgtgccgatgccctgctggagctacagcgcgagatccaggcgctgcgcgaggagctgttgcgcgtcgcacgtctgccctacaagccggaccagaacgacggggtgctgatcagcgccgcgccgctgtggaagctgtttcgccataatccttggcggaatgcgctgcacagctgctgggagacgctggaaacaggcggctacgactggtcgcacctcgccctggccctctggcccgagcgcgtgcgggcgctgtgccggacggacaagtccgtcgccatcgcccatgggctggaagacctgtacggcgggtaa

SEQ ID NO: 2396 - DNA, 1992 bp, Thioflavicoccus mobilis
atggccttcgataccgccacaagaaacgagctgcagaagctggtcggtcgcgtccgcgacctgctggtcaaggagttcaccgcccagtgccagaccctttacggcatccagccggacggtacagccctggccctcgaaaagcttgagcatagacccgagaacgaacagacacttgcgcgcctgctgcgggaccgcatcgaccatctggccgccggtctctcgggctccaagagacgtgccgaagcaatcgaccgcttggtgcgggagcaggcattcaccgtcctcaaccggctatgcgccctgcgcatgtgcgaggagcggggcctggtccaggagtgcgtacgccagggcatgggctccaaggggtttcaggtcttcgagaagtcggccgcgtcgctggggggagataccttcagccgctatcggctctacctcgatttgctcttagacgagctggccatcgagcttggggtcctcttcgaccgcttcgcccccacggggctgctcttccccggtgagacggcactcaaggccctactggagcaggtcaatgttcagaccctctcccacatctggggcgaggacgaggccatcggatgggtctatcaatacttcaatgatcgggaagccatcaaggctaccaagaagcagagccaatcgccgcgtaacagccgcgagcttgccgagcgtaaccaatttttcacgccgcgctacgtcgtcgaatttctgaccgacaacagtctcgggcgtctctggtacgagatgcgccaaggcaggacggcgctcgccgagatctgccgatccctggtccggcgcccggacgaggtatttctggggccagacgacgaccacgcggctccccccggaacctcggtggtcccgttcagagcgaagaaggacccacgtgatctgaagatcctggacccggcctgcggcagtggccacttcctgctctacgccttcgatctgcttctggtcatctatcgggaggcatgggcggacactcatagtccccggagcgatctcaccggtacgacgctcgctgaggactacgcctccgaggcggatctcgagcgggccacccctgcgctgatccttcgccataacctgcacggaatcgatatcgaccctcgggccgcgcagatcgcggccctggctttgtggctgcgtgcccagagggcctggcgggaccaaaggctcaagcccgcggagcgaccgcgcgttgtgcgtacccacatcgtctgcgccgagccgatgcctggcgagaaagagaccttggccgacttcgctggacagcttcgcccgccggtgctcggtcagttgatccaggtggtcttcgagcggatgcgcttagccggagaggctgggtgcctgttgcgcatcgaggaggagatccgcaccgcggtagagacggcccgcgcccaatggttggagggaggcaggccggagcagaccgagctgttccccgagcttgctggcccaaagcagcaggagctgcgcttcgacctctcgggtgtgacccgcgacgccttctgggaccaggccgagggccgcatcctgagcggactgcgccgctatgccgaggaggccgatctcggggcggacatgggccggagaatgtttgccgaggacgccgcggccggattcgccttcatcgacctctgccgccagcacttcgacgtggtagtcatgaatccacccttcggcgctgccagcaccggtgccaagaactacatcacgaagacctatccgcgctcgaagaacgacctgctcgccgcctgtgtcgagcgcggcatcggctggctgcaccccggcggtctgctcggcgccatcacctcgcgcacagcgttcttcctgaccagcttccgcaactggcgccaaggcgtagtcttgggcgatgccaaaccgctggtcatggctgacctagggcatggcgtgatggatgcggccatggtcgaggcggcggcctatgtgctgcgcaagcagggctga

SEQ ID NO: 2397 - DNA, 3627 bp, Vibrio cholerae
atgaatacgaacaacattaaaaaatacgcaccaaaagcgcgccgcgaatttatggatgcggtagctaaacgattaaatacctttggtatcaccgcgaataaaaagggcgagctacaaattgcagaagcgaatctacaaggttctgtacttcaaatcgccggtaacagttttgacggtaaactggccgagcccagaaaacgcatagtagccagaagccagaaacttgggtatacacaacttattgaacaagtagcttatacctggttcaaccgtctgtgtgctattcgctatatggaaatccatgactatctaggccacggtttccgtgttttgtcgcatccagacaatcctaaaggctttgaaattatcgatcatgcgcaagatgctgcggatgaactcggattagatagagctcgcattattgaactcaagcttgcgggcaacaaagacgaagagctgtatcgtgaactgctgttaggccagtgccataagcttcatgaagcgatgcctttcttatttgacgcattggacgatgaaacagaacttctgctaccagacaacctaacacgtaccgactcaatactgcgtggattggtagacagcattcctgaagatgactggcaacaagtcgaagtgattggttggctttaccagttttacatttctgaaaagaaagatcaggtaatgggtaaggtggtcaagagtgaagacatccctgccgccacccagctatttacacccaactggattgtgaagtacctggtacaaaactcagtcggtcgccaatggctgcaaacctacccagactctgccattaaaacgcagatggaatactacattgagcctgctgaacaatctgacgaagttaaccaacagctaaaggctattacgccagaatctattgaacctgaaaccatcaaagtacttgacccagcttgtggttcgggccacatattgattgaagcctataacgtgctaaaagccatctacgaagagcgtggtttccgctctcgtgacattccaaagatgattctggagaacaacctctacggcctagacatagatgatcgtgcagcgcagttatctggctttgcgctgatgatgatggctagagatgacgataagcgtatttttacccgtaacgtgcgacttaatgtactgtcattgcaggaaagtaaccatatcgacctgccaacgttgtggaaagcactcaacctatcgggaagttggcaaagcggcacatcacaaggcttgttctcagatgatgagcaagatttaagctcgttcaacgcagacaaccgctaccaactgctgaagcgaacgttggcaagatttactcaggctaagacctttggttctttgattgatgttccaaacgatgatcatgagcagctaaaagagctactttgcactctagtcgagctacaagagtcaggagactcaatgcagaagcctgcggcgaagcaattgattgaatttgtacatcaggcactggttctgtcgattcgttacgatgctgtgattgctaatccaccatatatggggggaaaaggcatgaatgtcgagctgaagaacttcgcagtagagcgatatccaaatagtaaatcggatttgtttgctattttcatggaacgtggtttctcgttactctctcaagatggttttaatgcacaagtaaatatgcagtcttggatgtttctttcgagttatgaaaagttaagaaattcacttctagagaatcagactttactgacgatggcacacttaggcgctagagcattcggtcaaataagtggagaaattgttcaaacaactgcatgggtatttaagaatggttatgtaaggggacatcagccagtattttttagactaacggatggcaacgagcaagaaaagaaattagcccttattgaacagcagactcgccttgatgaggtgcaacaggaagattttctaattataccaggacgcccattgacatattggctttcttcaaaggtttttgaactttttaaaaacaataaaagttttggtgatatatatgatgcaaggcaaggcttggcgacgggtgataataataaattcctaaggtactggtgggaggttgatttctctaaaatattttttgatgcaaaaagtatcgaagaatcaatgacctctggctgcaagtggtttccttataataaaggtggatcatttaaaagatggtatggcaatcatgagtacattgtaaattgggagagtgacggttgtgaaattcgtaatttctttggtgagaacggtaaattgctttctcgaccacagaatacgaaatattattttaaacctagtataagctggtctgatattaatacgtcatataattcgtttagatactaccctcatggttttattcatgatgctacagggcattcagcatttaattggaatgaaaatgagaagcgtatagctttagcattttgtaacaataaattggcttctgaactgatctcggctttgaatccaacaatacattttcatattggttattttaatgctcttccttatgtgcaaaatttgattgacgctgatttgtcccatgtagatgaactgattacactgatgaagcttgattatgactcaagggaaacgagtcgggagttttctttgtgccttgcttcccacgattcagaaaagatttcggattggtttcggaataaactagcgcttaatgaactccatataaattcagtccagtctttagaaaagaagaataatgaaataacactagaagcatgtggtttgttagatgtttacggtacagatctagatgaaaaagaaatttcaatcgagaaaataactgcttgcgatatagcagttaacattgtatctctttcagttggttgtatgcttggcagatttttgctcaaaaagggaaatgatgcccttcaagacaaagtcaaattcaatttagagttttacaacagtaaagaagaagaaattttttaccaaatcgatgaagacggtatcatccctctaaccgacaaagagtggttcaaagatgacgcaaccaatcgtttccgtgagtttgtccaagttgtttggggtgaagaacacttacaagaaaatctcgattttgttgccgagtcactgtgcttaaatgccattaagcccaagaaatctgaattagcactggagacgatccgccgttatttatcgactcagttctacaaagatcatctgaagacatacaaaaaacgccctatttattggctgtttagctcaggcaaacaaaaggcatttgagtgtttggtttacctgcatcgttataacgagggtacgctttctcgtatgcgtactgagtatgtcaccccgctactaggcaaatacgatgcttatgcagagcaacttgagaagcagattgaaacggcagactcaaccagtgaagcgaaccgcttcaagaaagagttggatgctttaatcaagaaacaggtcgaactacgcgagtttgatgacaagctaaaacactacgccgatatgcgtatttcactggatcttgatgatggcgtgaaagtgaattacggcaagtttggtgatctgttggctgatgttaaggccattaccggttcggccccggaggttaactaa

SEQ ID NO: 2398 - DNA, 3741 bp, Vibrio cholerae
atgaaattagttgaccacgtagaccatttaagagagctgattgaagccgccttcgataagcaatttgctagactgggttttagtaagaccaagcaaatggacgccacccaggtagaaaaactaccagaggaagttaaaaccaagcgcgagcgcttcgccgtgatgctggagaaccatatcggtgaaaccggtggctatgaaagtgcccgtgaaaagctactggatgaattaacgtttaccttattcaaccgccttgccgccataaaagtgatggaggcagccagcttatttccgcccatattaacaaagcaaaaggagcatggtgatcgttcattcggccataaagcctggctagaaatgaatccgcacatgcgtgatgaagagctggaaggtattcgcgattatttaaaatcagcgtttgacgaacttggtcaaacgttgccgttgtatagcaaagcctacccttatgcgcttttacctgatgctattagtttaaatgatattattgacgcctttaatgtggttgatactgacgcgcaagctaatgactcatcagaagagaccatctggcaaagtgatgatgttctcggttggatgtacgaaagctacaataacgccaagaaaaaggcccacaaagacagcggtgataaaaccgaatataacaaggtatcactgcaatcacaggtgtatacgccgcgctgggtggtacaattcttggtcgaaaactctctgggtaaaatgtacctcgagatgtacccgcactctgagataaaacagcgttataaaattgccaatgcaccaacaacacaaatacgagcacctaagcctttacatgaagtgcgcaccattgatccagcttgcggctcgggcaactttttattgtatgcctttgacttctattacgagctttatctggaccaaattgaaaactatggtgcagactatgatgaaaaagacatccctaaactcatcattgaaaataacctgcatggcatagatttagacgatcgtgctatccagttagcacagcttggcttatttatcaaagctaagaaaaagcgccgtacagtcggtgagttgcatttcaaagtggtatcgtccgatttctatttgcctgagtatgtggcagtaaagcacatcttcgaacagggcaatttggtgtcggctcagcagcgggagtttatagagaaggtatggggtgatctcatgcaagcctataagtttggctcgctgattcatattgataaagagttaaaagaacagctatctcaagtaaaagaacgtgcgcttggtgaaacgtttgattcgacacaaaagttaaaaaagaaaattgttgaaggggatctcttcgcagcagcagactatgccgagcaccaagaattcgcagaaaacttctttgcaaacttattcgctgcggtagagcagtatgctcgaacagaacgcaatactttcttaagcggaaaaacgcgagatgcgattacattcttagagctgttaaccactgaatatgatctggcgactgctaatccgccgtacacggatagtgcggactttgggccagacctaaaagaattcatagaagacaactataaaaaacctcacaaatttaataccaacttatatgccacctttatcaagcgttgctgcgaacttacagataaggacggtaaggtcgccatggttcatccgccaacatttatgtatatcaagacattcgaagatgtccgaaagtatatgattgagaaaacgagcatcgatctattcgtggagtggggctatttaggaatgttccatcagtcagctcgagttgatgctgcgatgtatgtccttgataaaaataaacaagagaaagactcaacctttataaagttgaaccacatttatgaaggcaaacgttacaacgcttttgttgaggcctatgataatttgattgatggtgtagcttaccaaaataattacaccatcccacaatccaaactaaaaatcatcaaatcatggccatttatctattggatttccgatgattttagagcgaagtttggggaggaagctttaggcgataacaacaaagctcttactggtttgatgactggtaacaataacaaatttcttcgttttttctgggaagttaatccggccaatttatcagatcattacccctctgacagcaaaaggtgggtaggataccaaaaaggtggaccgtttgtacgttggtacggaaacaactggtgtgttgtagatttttcaagtaatggtgaaaaacttgccacaacagacaatcgagagttttattttaaagaaggcatttcctactcagcatctggctctaagggagttagtttccgacaaatagaaaataaatactcttttgataaaggcggtccttgcgtattcaacatccagcagaagtttaccaatgaatatttgttagggttcatgaatgctaaactttgtggatatatagtcgactgccttaatccaacggtaaatagacaggtcggtgatattaggagaattcccatagcgatacctacgaaatcacaggacagtggtatatcgatactcgtaaagacaaatgtcgaaataaagaaaagattgtgtcagttctctatagtcgaatctctgtatctctattcacctttcatatttttcacgcagggtgaatttaaattcagattatcgggattttataacctagaaaaccaccttatcactcaaatcctcctaaacgaggctatcatcaatgaaaagatattcgaggtctatgacctaactgaacatgacaaagcgatggtattggccaaagaaggcgtaagcattggtggcctgccgattacccttgaggctcgcgctgcctatctttctgaaactgaagctaccaaggaattccctcttgacgctattcgtgagtttatcgaagcattacctctcaaaaagtttagtgccgaagagcgtgaagccattgaaagtggatttggaagcctttaccagagcaacaacgatctggaggagttctgtatccgacatcaggtcaacccgattaacgtttggtattggttcaaacaaagcaaagtaatccctaagcaacgtatgcaaacgttagccatggaatttttggctaatatgattcgtgaaattctaatggaagatgaagatggcattatcccactagtgcctaatgccggtgagaaagtgcttcttgatcgtatcgaggagaagtttttcgaaaaagggtttagtactgctcaatactcaagctttgattctgttttaggacggccaatccatgactatctaaataaatatttctttgcagaactttcagatcacttaaatctgtttatgtatttgcctaaaaccccatttatctggcacttaaccagcggccctgaacaaggcttcgattgttacatcatcatctataaatggagccgcgataacttgttacgcttgcgctctgtgtatatcgaaaaccgtgaacgcgctttgcaaaaccgccagagtgatattgctggcaatgaaagcgctgaagcgcaaaacgagaaagagcgcatctttaagcaattgaaagaaatcgacgcctttaaaaagaaaatcgacgaactattggctgaaggttacaacccgattcttgatgatggtgtaggcaaaaatatcgcgccgttacaaaaaaagaaaatgctggcttatgacgtgttaaatgcgggtcagctaaaaaaatacttgaacgctgattggtaa

SEQ ID NO: 2399 - DNA, 3480 bp, Zymomonas mobilis
atggataccaacgccctgaagaaatttgcgcaaagcgcgcgcaacctgctgatcgatcaggtcaccgcccggctggacatggtgctggtcgaaggcgcagcggcgcgccgcgaacatcccaaggcaattgcaaagctggaagcggctgccaacagcaaccgcgcccaggtgatcgagcatgcggcctatacatggttcaaccgcttcaccgcgttgcgcttcatggatgtcacgggcctgaccaacccgcgcgtggtgtcgcccgcagacggcgctacccggccggaaattctggccgaggcgatggccggcaacctgccggatcgcgcccggcccgaaatcgccgaatatctgaatggcacccgccctgcccatgacgggcaggccaaagcctatcggctgctgctgatccatgcctgcaacgaatggcatggcgccatgccctatatgttcgagcgcgccgatatgctcgaccgggccgaggattataccgagctgctgatacccgacgatcttctgtcgccggacagcatccttgcccgcctgcgcgaggtgatgacggaagatgcctgccaggatgtcgagatcatcggctggctttaccaattctatatcagcgaaaagaaggatcaggtctttgctggcctgaagaagaaccagaagatcacggcggaaaatatccccgctgcgacgcagctgttcaccccgcactggatcgtccgctatctggtggaaaactcgctggggcggctgtggctgctgaaccgcccgcaatcgaagctggctttgaggatggactattacatcgcgccggaagagccggagacggattttctgcacatcacccggcccgaggatatccgcatctgcgatccggcctgcggctcgggtcatatgctgacctatgcctttgacctgctctatgaaatctatgccgaggaaggccatgacacggccgaaatcccgggcctgatcctgaagcataacctgaccggcatcgagattgatgaccgtgccggggcgctggcggctttcgcgctgtcgatgaaggcggcggcaaggctggggcggcgacggttcctgcggatggaggcgaagcccgacatcgtcgtgctgcaagatgtgcgtttcacgcctgccgagatgcaggacgtggctgccgtggtgggcaaggatctgttcaccgatgaactgcgtgaaacgctggggcagttcgagcaggccaagaatttcggctcgctgatcgtgccgaaactgcgcgatccggccgaaactctgcgggtggtcgaggcgcgggatttcggttccgatctgctgttgaaggaggttcaggcgcgtgtcgtagccgtgctacgcatgggcgaggcgctgtccccgaagcatcatgtggtgttggccaacccgccttatgcgggtgcgagtggtctgaacgagcagattcaggtcttcgcggaaaggttctatccagccagccagacggatctctttggcatgttcatcgagcggtccttgtcactcgccgtgcgccacgggttgagcgcaatggtcaccatccaaaattggatgtttctcggatcattcgagaaacttaggctttccactattgagcgctcaagtatcgtcaacctgctccaaattggcttcaacagcttcccagagctaaactcgaaggtggtccaggcggcagcgtttgtgcttgaaaaagccgcacacgacaaagtaggcgtttacatcaatgcaaatgacgcccctcagtccgcgaacaaggatgaggtctttctaaacagaaagtcgagcaacgaaaaatatttcgtctcatcagacaaatttgccaagattccaggttcaccgattgcatactggctttctgagaccgcgattcaggcatttgagtctggggaatctcttggagaccatttctcaatttctgaagggttgaagaccggcgaaaatgaaaaattcattcgcctttggcatgaacccgcagcatcacgaacaacgcactttagcaaagctgcaaattgggtgcctcattcaaaaggtggcgagtttcggcgatggtatggaaattacaattgggtcgtagagtggggaaggaatgggagcgccctccgtgcatcggggaaggccggtttccaaggtttaccaaactacggcaagaagggcgcaacttggtccaagattactacaagcccctactgtgtgcgtctgcaacccgagggcttaatcttcgactcggcgtgtccaggcttgttcgagaagggtcaagtaaagcttgaacaagcaatgggtttcttgaactcaaaagcttgccgaacaatcatttcagcgcttaatcccactctgaactaccaagttggcaacgtctcatgcttgccaatcgtttcagacgctcgaggtgatggcgtcggcattaccacagcgtccgcgctcatttcgctgtccaaatccgactgggatgcctacgaaacctcctgggatttcggcaccctcccgctgctctcacctgaccatcgtgccgagactctggcggccagctacgccaacctccgcgcccactggcagggcatgacgggcgagatgcagcggctggaggaagagaacaatcgcatcttcatcgacgcctatggcttggctgacgagcttacgcctgaagtgccgattgaggaaattaccctcacgtgcaaccctgcctatcgctacggcgtgaagggttcggaagaggaccgcgaggcgcggctgcgcgaggacacggtggccgaactcctccactacgccgttggctgcatgttcgggcgctacagtctcgacgcgcccggcctgatcctcgccaatcagggcgaagggattgaggactatctggcccgcgtgccagaaccgacgtttgcccccgaccgcgacaatgtcatccctgtgctggatgccgattggttcgccgatgacatcgtcacccgcgcccgcgacttcttgcgcgtcacctttggcgaggcaaagttccgcgaaaacctcgccttcatcgaagccgccctcggcaaggatctgcgcaagtggttcacgaaggacttcttcgactatcatgtgcgccgctataagaagcgcccgatctactggatgttctccagccccaagggcagtttcaacgcgctgatctatatgcaccgctaccggcccgacactgtctcggtcgtgctgaaccaatatgtgcgtgaattcatccataagctggaggtggagcgcacacggctggaaaagctggccctcgatcctgcagctacgcccgctcagcaaacaaaggcgcagaaggaaacggctacagtcatcaaacagattgccgagctgaccgagtgggaacgcgaagtcgtctatccgatggcgcagcagaagattgccatcgatctcgatgacggggtgaagcgcaactatccgctgttcgccggtgcgctgaagccgatcaaggggctggaggctgcggatgactga

SEQ ID NO: 2400 - DNA, 3597 bp, Magnetospirillum magneticum
atgaaccgcaataagctgaagacctatgcccccaaggctcgtcgcgacttcatcgcggcggtaaccgcccgagccatcaagttcggcatcagcaaggacgcgattgaacccgtacaggtgcaggggaatatcgccctgattgcagggcaggcccatcccagaaaggtagccgatcagcggttaaagcttgaagcacgggtcaagacccgagggttcgagcaggtcatggaggaagccgcctatacgtggttcaaccgcttcgccgcgatccgctacatggaggtccacggctacctcgaccatggctaccgagttctgagccaccctgaaggcaaggcaacaccggaaatcgtcgaacatgcccagcaccttgatctgccgggtctggataaggaaaaggtcatcgagttgaagctcgatgggaccaaggagggtgacctttatcggatgctgctgatggcacagtgcaatgcactgaattccgccatgcccttcctgttcgagcgaattgacgacgaaaccgaactgctgctgcccgataacctgctgcactcggattccgtcattcgccagatggtcattgaaatcgaggaagcagattggcaagagatcgagatcatcggctggctgtatcagttctatatctcggaaaagaaggatcaggtcatcggcaaggtggtcaagtccgaggacattcccgccgccacccagcttttcacgccgaactggatcgtgaaatacatggtccagaacacccttggtgccaaatggctggcgacctatccgcagtcgggcatccgggcgaagatggagttctacattgaacctgccgagcaaaccgatggggtgaataccaaactggccgagatcaccccgaaggaactgaaccccgaggaaattaccttcctcgaccccgcctgcgggtcgggccacatcctggtggaagcctacgacctgttcaaagacatctacctggaacgcggctatgtgctgcgggacgtgccgcgtctgatccttgagaagaacctgttcggcttggacgtcgatgaccgtgctgcccagatggcggcgttcgccctactgatgaaggctcggaatgacgacagaaggatactcgaaaaacatcagaaaatgaatgttaagagcattttatcaagcaaaaaattaaatatcgatgatcaaaaaatcgcatctgacagcaataagttcgagcttattccaagcgatgatcttctgccagaaactatccagcagccgatgttgtctatgtctgccgccacagcaacgcaaactctagcggagttggtagccatattccgcgatgctgactccattggttcgctgacaaaaattccagagagactgctgaagcggctaccaattttgaggaatcttgctgaaaagcaacttctatcgcgtgatcgcctggaagacagcttggcggcaaaatctgcttttttcgcactaaagttaattgatcaagctgaaacactttctatgcattttgactgcgttgccgcaaaccctccttatattggcaatagggctgggatgaatgacacaattaagcaatacgcacaggactattttaacaatgcacggggcgatacgttttccatgttcgtagcacgcggacttgaattttgccgcactggctatatgagtatggtaacgcttgatagctggctcacactgtccacatacgaatattttcgaagcgatatacttaacaattcaacaatactttctctcgcccatatgccttacgagggtaaaaagccaacagcaatgggcataaactttggagttgcatgcttcacgctgcggggtgtgtgcagtaaatatatggggtattttatccggcagaggtatgttgatttaatcggtgatggatcgctaaagtctttatctgcgtttactgggcttggaaagcgaattgatggcggtcaattcttaaatgctcccgctaacgcaattgtttacggactgtcagatcagggtcgtcggaaattgttttctgcaaccccgcttagggatttagtcgatgccagagaagggatggcaacggctggcaatgaccgcttcctacggtggtggcatgaggttccttacgggaacattgcctttaatattaatagcggtaccgaggcggtagaatctggctccaagtggtttccctataacaagggcggagagtataaaaggtggtttgggaacattggtttgatcgtaaattgggaaaatgatggtctggaaattaagggaaacatcgaccccataacgcagagggttagatcgcacaactacaatggcgactatgcttttttacctgggcttacatggacttctatgagcagcaaggggacggcagcacgcataatgccaaatggatttatgttcgacgcaaaaggaccaatggcatttggcagtcaagaaacaattaattttgccgctgccctcatgaacagtgtagttgggagatttttcttgtcgtctctttccgcgactaaagacttcaaaatagggcatattttggcactacctgttgagaaaagtatgatttcaaaaaatagcattcacgaatatgtgaatgagttatgggggcttgctaaaaatgaatgggcaagctttgagacatcttgggaattccaatctccacctctcataagcggacattgtattaagaatgcatttgtggaatggcaagcaaagtgccatcggtcatattcaagatcaggtgaattgcaacgacacgtagacgaagaactagttgacgaatacgggcttgcagaggagcttggcgacaaatatgaatctggtgagatcactttatacattggcgataaccagagcgacgtattttggctggcttcatattcaatcggctgcatgatgggtcgctacagcctggatgagcctgggctgatttacgcaaacagtggcaatgtcggcttcgatcccagccgctacaccaccttccccgctgacgatgacggcatcgttccgattatgcaggccgattggttcgatgacgatgccaccaaccgcgtcgtcgaattcatcaaggtcgcttggtcgcccgagactctggctgaaaacctgaaattcgttgccgacagcctggggacgaagagcggtgaaacgcccatcgacaccatccgccgctatctcagcaccgactttttcaaggaccatctgaagacctacaagaagcgtccgatctactggctattcagcagcggcaaggaaaaggcgttcgaggcgttggtctacctgcaccggtataacgaaggcaccttgtcacgaatgcggatggaatatgtcacgccgctccaggggcggatcgcatcaaagatcgatcagcttggtcgggacattgatgccgccgccagcaccgccgcccagaacaagctgcggaaggagcaggagaagctgaaaaagcagcaagccgaactggtcaagttcgatgaggaactccggcattatgccgacatgcggatcaagcttgatctcgatgacggtgtgaaagtgaattatggaaaattcggcaccctacttgccgagacgaaggcgataacgggcggttcggaggagtag

SEQ ID NO: 2401 - DNA, 3489 bp, Marinobacter aquaeolei
atggaaactgcaaaacttaaaaaattcgcccaatttgctcgccggagcctcctcgaacaggttacagccaagctcaaactggtactcgccgatgagagtcccgcccggcgagaaaggccacaagcgattaaaaagctggaagaggcggtaaccgaccaaggcaaagagcaggttatcgagcgggtggcctatatctggttcaaccgcttctgcgccctgcgttttatggacgtgaatcgttacaaccgcattggcattgtttcccctgcagaggggcagttccagcccgagatcctggctgatgccaaaatgggccatatcgatgaagaaatggtgtcggagtcaacccgtcaaaagatcttcgctctcctggatggaaagacacccagtcaggatccgcagggggaagcctatcgcctgctggtcgtagccgcctgtaactattggtacagcgcgatgccgttcctgttcgagcgcattgacgattacaccgagcttttgatgccggatgatctgctttcaggcaactcgatcctggcctatacccgcgaggcgatgacgccggatgcctgtgaggatgttgaggtaatcggttggctgtatcagttctatatctccgagaagaaagaccaggtatttgctgacctgaagaagaacaagaaggttactcccgagaatatcccggcggcgacccagctgttcacaccgcactggatcgtgcgttatctggtggaaaactcgctgggccgcctctggatgctcaaccgtcccggctctagcttaattgagcagatggattactacatcgagccggaagagcccgaggaagcttttctccgaatcaacagcccggaagaaatcaagatctgcgatccggcctgtggttcggggcatatgctgacctatgcatttgatctgctgtatgccatttatgaggaagaaggttatgagcccgccgacattccggccaagatcctgactcataacctttacggtatcgagatcgacgagcgggccggagagctggccgcttttgctttgaccatgaaggcacgggccaagcagcgccggttctttcggaagcccgtgcagccgaatgttgtcgtcctggagaacgtcacctttaccgagtccgagatgcaagatgtagctggtctggtgagtaaagatcttttcacggacgagctgcacgaaacgttgtgtcagtttgagaaagcgaagaatttcggatcgctgatcgtgccgaaactacgcgaacctgccaaggccctgcgggctatagaggagctagattttggctccgacatgttgctaaaggaagtgcaagcgcgcgttatggtggtgctccgcatgtcagaagcactgtcgccgaagtatcatgtagtcgtggccaacccaccgtatggtggggccaaaggtctgaatgaggagttaaataggtttgcaaagaaagcctactcggcatcgaagaatgatctctatgcaatgtttatggagcgtgcttttgaactgacacagacgtgcggtctaatggcgatggttaatatgcagtcatggatgtttttatcgcgatacgaagcactgagaagcaaactgcttgacgttggtacacttatttcgatggcccatcttggggagcgtgcatttgacacaatcggtggcgccgtagtctccacaactgcttttgtggtcaaaaaagcacactttccagatttcaagggtgttttccttcggctaacaggtgggtcaagcgaggcagacaaatcgcgtcttgcaagagagtcaatattagagaaaacgcgtaattggtatacagcctgctcgcgcgattttgagacattccctggaactcctatagcttattgggccacacctcagtttctgcgtgcttaccggggcggggataagcttggagatattgccgatacggcggttggcttattcacctgcgataatgaacgcttccttagatgctggtacgaagtcaacgacaaggacataagccataccactgagagcctgagcgaaacgaccttgaagtattatccgtacaacaagggtggcggatttcgcaggtggtacggcctgaatgaactggtggtattctttcaaaatgagggagttgaaatccgcgaccaccggaagagctctggtcagtcgtggtccctacctggtgaaaaatactacttcaaagaaggtataacttggtcgggccttacatcggacgctaacagttttcgctggtcggacaaaggttttgtttttgaatccaacaaggggcagatgcttttctcagattcgagtaatgagcttctccccttcttgaactcaaaggtatgtgaggagatcgtttctctaataaatccgacattatctttgcaaagtaacgaagtgaagaaaattgcttatattcgaccctccaaggctgcagtagagaatatgagcaagaaattggttcaactttcccgctccgactgggattcctacgaaacctcttgggatttcaccgcaattccgctgctctcgcctgaatatcgcggcgagaagctggaagacagctatatacgcatccgtactcactggcagagtatgacggacgacatgcagtggttggagaaagagaacaaccgaatctttattcacgcctacggcttagatgatgagttgacaccagatgtaccgctggaggaggtcactctgacctgcaaccctcactaccgctacggcaacaacaaaagtgaggaagagctggagtcacttcttctggctgacaccatgcgcgagctggtctcctacgccgttggctgtatgttcggccgctacgcgctagacaaaccggggctgatcctggccaatcagggcgagaccatcgaggactacctgaagcagatcccagagccgagcttcccggcagatgatgacaatgtcatccccatgctcgatggcgactggttcaccgacgacatcaccgagcgcttccgtgaattcctgcgcatcgcctttggcgaagagcactatggggaaaacctccgctttgtcgagcaggcactgggcaaggacatccgcaagtacttcctgaaggacttctacaacgaccacgtgcgccgttacaagaagcgacccatctactggctgttctcctcacctaagggctcattcaatgcgttgatctacatgcaccgctaccagccccacaccgtgggcacggtgctggagtatttgcgggatttcaaagacgagaaactgaaagcccggaaagaccatctggaagccgtcagtatcagcgccggggcttcccagggcgagaagaccaaggccctgaaagagatcgagaagatcaacaaaattctcgtcgaattggatgactacgaacgggatgtactttatcccctggctaccgagcaggtggaaatcgatctcgatgatggggtgaaagcgaactatccgaaatttggcgaagccttgaagaagattcctggcctctcatga

SEQ ID NO: 2402 - DNA, 3537 bp, Nostoc punctiforme
atgaaccgcaccgctatcaaaaactttgctatttgggcgcgtcgttacctacgagaacaagttaaagctcgtgctgcccaatttggtataactcacaaaagtattacagaacctcagacagtggcggggggactattagtagctggtcaaacgctaaataccacggaagcaaaccagtatcatcaactgcgaaatcgcttgcaagatttaacactaagttccagccagtcccaggcggtagatgcgctgatagatgaaattgcctacacctggtttaaccgtttggcggcattgcggtttatggaggtgaatggatatatcgggcgggtgttgagtagtagcgatccaaatttggtagaccctgatttgttacgcgatgctagttctattgccgaaatgggagatttaccgggtcttgatttggatactctcaatgagtggcgtagttttgccaatcgtgatcccaaccccgatgagtttctctaccgccgtttgctgttagctcagtgtaaagctttggcagagggaattccagcactgtttgaccctcgccagaactaccaagcgctgtttttacctggaaatttgttaaatcaggattcaattgtacggcggctggtaaaagagattccagaggaggactggcagaatattgaagtagtgggttggctgtatcagttctacatttcggaacgcaaggatgaggtgattggggcaaagtcgaaggttgcagccgcagatattccagcagcgactcaattgtttaccccccactggattgttcggtatatggtggagaacagtttagggcggttatggttagaggcgcacccagaatcacgcttgcgtgagtatatgccttactatttggaaaatcctaacgataatggtgagggtgaaaaaccgcaagctttaacgcctcaagagttgaccgtgatagaccctgcttgtggtagtggtcatattttggtgtatgcgtttgatttgctgtttgaaatttacaaagaacaaggttatttagagcgcgatattccggcgctggttttgacgcacaatttgtatggtttagatattgatgaacgtgcagcgcagttggcaagttttgcagtattgatgaaggcacgggcaaagaattcgcgtattttgcggaaatctctggctttgaatattacggcggtgcgtcctacccatagtcagactttaccaccagctacagaattgaatgctgaagattggcaaccgttaattgaggcttttaaggatgcagataatttaggaagtttaattactacgccagcttttgatggtgagaaattgaaatggcaattaaataatttagaggcgagtgattcgctatttcgggagtgtgttacggctttacaagcgttattgttacaggcagagttgttgaggaataagtattgggttgtggttgcaaatccgccttatatgggaagtaaaagtttaaatgatgttttaagaagttttgccaatcaaaattatcctgattctaaatcagacgctttctctatatttattgagcgttttttaaatatgagtttacaaaacgggttcattggcttaatgacaccatttacttggatgtttttaagttcttatgagaaattgcgtagacgtatattaagtgaaaatacaataaccagcctgattagaccggaatatcatgctttctttgattcggcttatgtaccaatctgtacttttactattttaaataaagctttacctgaataccaaggaacttttattgatcttaatcaattttatggggcgaatttgcaaccaattaaggttttagaagcaatcaaaaatcctggctgtggatatctttattattcaaattcggttgattttgcaagaactccagggagtgttattgcttattggttaagtgaaaaactattaaacatttttgaaaatgcagaatcattaggtaatgtttttgaatcaaaacaaggtttgtctactgcaaataatgatcgttttcttcgtttatggtttgaagttaacttaaatgattctggattcggattatgtagtcgagaagaagcaaaattttctggaaaacgatggtttccatataataagggtggtgaatttaggaagtggtatggaaatcaagaatttgttataaattggaataacgatggagaagaaatagatagttttagaccaaaggcagttattagaaattctagttattattttaagccctcagtaacttggtctttggtgagttcaagctactttggagttagatactcaggaaaaggctttatatttgattcagcagggtcatctgctttttgtcaatcggatatgatatttagcttaactggtttcttgtgttcaaatataactaataaattgattcaagcaatcaatcctactttgaatttctcatcaggtaatgttgctgcattaccttggatatcagaaaaagcaaatataattaaacccaaaatcaatagtattgtcgaaaattgtattaatatttcccgtcaagactgggataactttgaaacctcctgggacttccaaacccaccctctattacgccacaacaccaaacacctctccgaagccttcaccatttggcaaagcaaatcagaaaccgccttccgcgaactccaacgcctagaagaagaaaacaaccgctactggatagaagcatacggcttacaagacgaactcacctcagaagtacccgacgaccaaatcaccatccgccacgccgacttaaacaaagatatccgttccctcatctcctacgccgtcggctgcatgatggggcgctactccctcgacaaacccggactcatccacgccggacaaccatttgaccccaccctacaccaaaccttaagcgccagcagtgatgcaattattcccatcacagaccaagcatactttgataatgatattgttacccgctttatagaatttctgcgcgtcgcctacagccccgaaacccttagcgaaaacctcaatttcatcgccaatgccctcaccctcaaaaacggcgaaagcgcccaagaacgcatccgtcgctactttctgcaagaattcatttctgaccacattcaaacttataaaaaacgccccatttattggctgtttaccagtggaaaaaaacgagcttttggcgcattactatatttacaccgttacagcgaagatgctcttgctcgtatccgcaccgattatgttttggaattgcaagtcaaactagatggggaaattgccagggcgcaacaacagctagataataccacttttagcgccgctaaaaaagctgccacaaaccgcctgaaagaactacaagcccaacagctagaactacgagattaccaagccaagctgcaaacccaagccgatgcgcgaattaatcttgatcttgacgatggtgtagcgtacaactacactcgctttaaaggtttggtgtatgaaggagcagatttaaaaattgctgacttagaaaaagcctcgcagtggaaaagggaactgttgaaataa

SEQ ID NO: 2403 - DNA, 3525 bp, Rhodobacter sphaeroides
atggacaccacgaaactcaagaagttcgctcagtttgcacggcgcgcgctcatcgaacaggtcgcagcaaggctggaggccgtccgcggggaaggctctgcagctcagcgcgagcatccggtggcgttcaagaagctccaggcgagcatcgccgagcacggtgctgacgatgtcatcgagcgggtcgcctacatctggttcaaccgctttaccgccctgcgcttccttgatgtgaacgaactcagcgccgttcgcgtagtctctcctttgcctgggcagttccagcctgagatccttgcggatgcgaaggccgggaacatcaacgaacagctcgtgcctgaggcgacccgccgcaaggtccgcgacctgctggaggggctgacccccagccaggatcctcaggccgaggcgtatcgactgcttctcgtcgccatctgcaactcctggcagaccaccatgccgttcatgttcgaacggatcgatgactacaccgagcttctgctgcccgccgacctgctctccaacgcctcgatcctcgcctatctgcgcgaggccatgacgccggacgcctgtcaggatgtcgagatcatcggctggctctaccagttctacatctcggagaagaaggatcaggtcttcgccgcgctgaagaagaacaagaagatcgaggccgagaacatcccggccgcgacccagctcttcaccccgcactggatcgtcaggtatctggtcgagaactcccttgggaggctctggctgctgaaccggccggggtccaagctggccgagcggatggactactacatcgcgccgaaagagcccgagacggacttcctgaagatcggcaagcccgaggaaatcaaggtctgcgatccggcctgcgggtcggggcacatgctgacctatgccttcgacctgctctacgcgatctacgaggaagaggggtatgaggccgacaagatccccgcgctgatcttggcgaacaacctgacgggggtcgagatcgacgaccgcgcgggggcgctggcggcctttgcgctggcgatgaaggcggcggcaaagctggggcggcggcggttcctgcggatggaggcgaagcctgacatctgcgttttgcaggacgtgaagttcaccgacgcggaattgcgggacgtggccgccgtggtcggcaaagacctcttcaccgacgaactgcgcgaaacgctggggcagttcgagcaggccaagaacttcggctcgctgatcgtgccgaaactgcgcgacccagccgagacactgcgagtggtggtggctcgggattttgacgccgacctgctgctgcgcccggttctggagcgccttgaaaaagtgctgtgcatggccgaggcgctgtcgccgaagtatcatgttgtggtggccaaccccccgtatatgggcagcaaagggatgaacaagaccctcgaaagctgggccaagaaacacttcaaggatagtcgcgcggacctgtatgcgatgttcatggaaaggtcattggcgctttgtgtgcgtcatggcttcactgcaatgatcaacatgcagtcttggatgtttctttcaacgtttgacagcttgagaagcaaactcctgacgcagaacgccattgtaagcatggctcacctgggggagcgagggttcgatacgattgggggcgccgtcgtctcaacgacggctttcgtattgggcaaggcctacagccctagaacggaaggggtttttctccgcctcgtttctggtcgcaacgaggcagaaaaatcgactgcggcacgcgctgccgtgagcggtgtaaactcagatgtgaaattttgttcttcagctgcggacttccagaagcttccgggtaatccaattgcgtattgggcatcggaagcgtttctgcgcctatttgatgaaggcaagcccatcacagacttcgtatcgtctcgcgatggcctaaccactggggacaacgaagctttcatcaggtattactgggagccagcctttgaaagcgttgggtttggatacgctgacgcaaaagacttctggaaatcaggtcggaaattcgccccccttataaaaggtggctcatatcggaaatggtttggaaacctttccaatgtaatcacctatgacaaacagcactatgaagtgcttgcagtgagcggaaacaaacttccctcaagagagaagtattttcaacgaaacctgaactggactcgtatttcttcgccaagcggatcgtttcgatataccgaacctggttgcatcttcgaaagcgcaagtctttgcacatattctgactcagatcaggatatgttttatgctctggcaggtgcgaacagctgtatcacaattccacagcttgatctagtgaacccaactacgaacctgctgtccggttattttgacatgcttcacttgccggaacatgacgccgcagctcgctcaatagcagcaggaaatgccaagcaacttgtgagcttggccaaatccgactgggacgcctacgaaacctcttgggatttcactacgctcccgctgctctcgcccgatcaccgggccgggacgcttgaggccacctttgcacgcctgcgcgcccactggcagggcatgacagacgagatgaagcggctcgaggaagagaacaaccgcatcttcatcaacgcctatggtctgcaggacgagctgacccccgaagtgccgatcaaggagatcaccctcacctgcaaccccgcctattcaatcagcggcgacaagaccgaaaccgagcgcgaggacgcgcttcgcgtttgcacgatgcaggagttcctgagctatgccgtgggctgcatgttcggccgctacagcctcgatgcgccgggcctgatcctcgccaatcagggcgaaacgctggccgaatacctcgcccgcgtgcccgagccgagcttgctgcccgacgaagacaacgtcatccccgtgctgtcggaggagttcgagagctggttccccgatgacatcgcggaccgcttccgcaagttcctgcgcgtgaccttcggcgatgcgtatttccgcgagaacctcgccttcatcgaggcgcaggtgggcgacatccgcaaatacttctcaaaggcgttctacgacgaccacgtgaagcgctacaagaagcgtccgatctactggatgttctccagccccaagggcacgttccaagcgctgatctacatgcaccgctaccggcccgacaccgtctcggtcctgcggaacgagtatgtggtcgagttcatccgcaaactcgaggccgagcgtgcaaagctggcaaagcagtccgacgacccctcggccacgcaggcacagcgcgccaaggcggagaaagccattggcaccatcgtgaagcagatagcagagctcgaggaatgggagcgtgaagtcatcttccctctggcgcaggagaaaaagaaaatcgatctcgacgagggcgtcaaacggaactacccccgcttcggcgcggcgttgaaacccatcaagggcctggaggaggcggatgagtga

SEQ ID NO: 2404 - DNA, 3360 bp, Runella slithyformis
atgaataccaacgccctcaaacgctttgccaaagaagcccgcttaaaattactcagtcaggtagcccgtaaactggagtttgtgctcacgcaggataccgccgagctgcgcggcaaaaccaaggaactctcccaactccgccaaaagatcagggacctcggccaagcccaggtcatcgaaatggtagcctatacgtggtttaaccgattggtggcgctgcggtttatggacgccaacggctatacgctccccaaggtgctgacgcccctgccgggcatgaccaaccccgagatcctgcaaaacgccctcggcggtacgctcgaccccgacctgaccctcgaccgccaacgcctcaacgacctcttggacggccgcaccgccgccgccgatgcccgcaccgacgcctacaagctgctgctcgtggcggcctgcaaccagtggagcaaggccatgccgtttatgtttgagcgcatcagcgactataccgagctgctcctgcccgacgacctcctgagtgattttggcatcgtggccgatatccgcaacggcatgagcgatgaagattgccaacaggaagaactacttgggtggctgtatcagttttacatctccgatgaaaacgaaaggctcataaagtcgaaaagtatttatcaaaagcatgaattagcccctgcatcgcaactatttactcctaaatggattgtaaaatatttggtggataatacgcttggacaagtttgggcagaaatgaatcccaatactacaattcttgataagctggaattctatattgagccatcctacaaaaaccaattatcaacacgctcaaagaaacgcttagaagacatcaaattctttgaaccttgtgttggctctgctcacattctttcttatgcctttgatgtgttttatctgatgtatgaagaacagggttataattcctccgaaatacctgagcttattctaaaacataatttgtttggtgtagatattgacgaaagggcggcacaaatagcttcttttgtgatgatgatgaaaggacgaagaaaacatagccgtttcttccgaaagcaaatcgagcccaacattactttttatcagaattttgaaaatgaccccaagttcaataacgttaaagcattaggctccttggtgaaagttgagcccaatgaaattgacacgttgaaagtagaaggaggttctttatttaccgaaagacaggaaaaactaaagaagctatacacatttttaggtcaacgttatgattgtgtggtcaccaatccaccctacatttcttcctcgcgaatggaaggctctgtaaaacaatatgtagaagtaaactaccccgataccaaagctgatttgtttgctactttcattgttcgatgtttggaactgtgcaatgaagagggcttaacgggttacatgacaccttttgtatggatgtttatatcaacttaccaaaagctaagaaacaacctcattgataatcacctcattaataacttaattcaattagagtactcgggctttgatggagcaactgtaccgatttgcacatttactttacgtaacaaaaacattcaagatgccaaaggaagttatgttcgtcttagtgatttcaaaggttctgaaaaccaaggcccgaaaacattagaagccattcaaaaccctcattgcggttggttttacaccgccaatcaaaaagattttgagaaaatacctgggagcccgattggatattgggcttcacctcatttaataaaatgttttgaggagggtggtagtattgaagatattactgtttccaggaatggaatgacaacaggaaacaatgatagatttttaagaaaatggtttgagattagtaacaaaaatctcaatgtaaacattaatgatatttctcaaaagttggatgtcgggacaaaatgggttccctataataaaggtggagaatacaggaaatggtttggaaacattgtagatgtgcttttttggttcgaccatcaaaatgtactattcaaaaacaaaaatactatcgtaagaaatcgtaattattattttaaagacggcataacatggactttgttaagttcatcttattttggtgttcgttcattagaaattggctctgtgtttgacgttaatggaatgtcaatgtttacgactaatgttcacgttgataaatattatttgttaggtttattagcttctaaactctctaagaaattcttagaaataataaatccaacattagcttttcaagtaggcgatattaacaagattccgattttaacaagtttgaaatcaaataatatttcgaaaattgttttaaaaaatattgaaataagtaaaaaagattggaatttaaaggaatcattgtcatgggattttcaacaaaacgaactcattaaacagcaaaaaggcgcggtaagtgaggcattggaatcctatcaaagctattggtctgaaaaattctacgaactccacggcaacgaagaagaactcaatcggcagtttattgaaatctacggcttgcaggaggagctaacgcccgaggttccactcgaagaaatcactattttgcaggaggaagccaaaatcgtcaacggggcgttgtccattgagccggtgccggtgttactccaactcctcagctacaccgtcggctgtctgttcggtcgctacagcttggataaagaagggttaattctggccaaccaaggcgaaaccctgcaagattttctccaacaaatccccaaccccaccttcctgcccgatgaagacaacatcatccccgtattggaaggcgagtggttcaacgatgacatcgtggggcggttcagggcctttctaaaagcggcttttggcgaggagcattttgaccaaaacctccgcttcatcgaagataccctcggcaaagacatccgtaagtactttgtcaaagacttttacaacgaccacatcaagcgctacaaaaagcgtcctatttactggatgttcagcagtcccaaggggcatttcaaagccctcatgtacctgcaccgctaccaacccgacctgtgcagcaagctgctcaacgactacctgcaagccttcatcagcaagctcgaagccgccaagcacacccaaaccatgctcagcgtacgcgaggatatttcggcccgcgaaaaaatagcggccaacaaagaaattgacaaactggagctcatgctcaaagactgccgcgactacgagcgcacgctcttcttaattgctacccaaaaaataaacatggatttagacgacggcgtcaaggtcaattatcagaagtttaaagaggttttggtgcctattaaggggttggagagtgacgagtga

SEQ ID NO: 2405 - DNA, 4293 bp, Halorhabdus utahensis
atggacaacattcaagacacttccgcgggtctgaaccaaacatcggctgactctcatatggaaggggattctacgactccacgaaaggcccaactcgacaaggaggaacgcgaacatctcgaagatgtcgtcaccgagatgcgcgaacgcgttgaggcgaacgttcgctaccagctcgaagagtacgatcttgaagagcgtcccaacaaagatacgtccctgagcgacgaggaagaaggtctcgttgaggccatcaaactcgaagccgtcgacggaaacgactgggatgacggctacgagcagtatatcacgggcgtcggttataccatcgtcaatcgactcgctgcccttcgctgtatggaggttcgtgacttcatcgacgacgaggtgacgcgattccgtgaggatggactcacgccggcggccgaccgattagtcaccgaggagttcatgctcgaagaggaggccgtcctcgaagcctatcgaaatgcatgcgacgatctcgccgaggaaatcgaaattctcttcgaccgctctactgcctatagtctgattgaccccgatgatgacacttttgaagatctctgtgtgatgcttgacgaggttcccaacgaagtatggcgggccgatgatgttcttggatggatttatgaatactacaacgtcaaactccttgatgatcttcgacgaaagggagaacgtcaaggtctagagccggaagatgttccacccgctaaccagttttacaccccacattgggttgttagaatgctcactgacaattcactgggcaaactatatttagaagatacaggggaactgcagaatgtcgttgattctcaggaatcaatcactcctcaagagcgcaaaaaccgtcccctgtcacctgagaaatcagcagagttagctgatttttgcacctatattgtaccgtctgaagaaggaggtaaaccccctgaatttggcgagcctgcagacattcgcgtaatagatccagcttgcggtagtggccactttttgttatatgcctttgatattctggaacgtatttggaggaaggaaacgaaagtcgatcataaagatatacctcgtaagattttgaaacataatctctatggcgttgaccttgatatgcgagcctgccaactcgctgccttcaatctctatctgaaagggaggacacgtactgaagcagaaggtggcagtgactttgaaatgcccaaagtgagtattgtttgtgcagatgcgaagatcgccgacatagaggggatcgaagatgtatttgatgaggttatttccaatagttcgagtatcaaatcagctctaagtgaagacgatgtcgaagaagccttaaataatattgtaagatcttttgaagacattcacggccttggtagcctcctcgatgttcgaggaacccttggagaaatgtttagtgacgatagtgaggggcttcaattaactttcgaggatgattttacagctgattatactttaagcggttttctacatacactacaggaagctattgcagaacatgataacaacgaatcgttccttgcacaggatttgagaagcttcattcggttaatcgatatactcgctcaggaatatgatgttgctctgatgaatcccccctatgggtcgcgaaaacggatgcccgatgaagtaactgaatatgttgaagaacattacaggtacaaccccgaatattatataaatttcttcgaagtctgtgataacataacaaaagaaaacggccgtatcggtatgcttatcccccggtcgtttatgttcaaaaaatggtttaaacaattccgagaagactttgttggtggagagggggtttttgatttccttgctgaatttgggttaggaattcttgataatgctactgtccgtacagctgctactgttgttaggtcaggagttgaaggggatgatactggatcatttattcggctgtatgatgttgaaagcgaaagcaaagaagaagctttcttggatacaatctcaaagtcagatgatatcaaaagaaaaaggttatataatgttcagctatctgaattttcgatcgtgcccgaaactcccctgagttattctataccttcggaaatccggtatctacacgacactgatttgaaaatagatgctgaggtagcagagatcgatggaaacagtatctctacgattgcaacaggcctccagacgggtaacaacgaccggttcctacgaaaacactgggaatcaatctctgacgatttccgcccatatgcgaagggaggtgcagacgcttggattattccaccagccatccatacggtgaacttcaatggaggaggaagggagatccgcgctgctggacgtgcccgattccagaatagtcagttctatggcaaagaagggctaagctggacatacattaaggatacagggaggagatttggctatctgccagaaggttatgtattcgatgttgccggatcaatggtattccccgaggaggattactctccttggaggttgatgtctgttctaaatagtgacctatatcactgtctcttcctttcattgactccagaaagacagtggaaccaaggtgatgttggccgaattccttggatcagcgacctagatgatgaagaggagctaatagatatttccaaggagcagtatcagctaatgatttcccagcgagtatatgatcctactagtcctttctatatcggcccggccctattaccagatcaatcaaatgtcgaattcttctataaccatcctgttttagataaaatcgaagaaatttcaaagaccgattttagtgggtcgaatccggcagtatcggttactgaagcagttcaaaaagcgcaacaacggaaaagtcgaaagagtagtcagcttgaacaacttgctacccaagtagacgaaataatctatgatgagctggagatacaggataaggtgaggcagaaaatcatctctgaaatagctcttcgcacaggagaggatccagaaaatcgtgaaatctcttcagctctggtggaatccgttggagatactcaacatcaaataaagcttctacttcatcattttgcagttgaatctatccaacagaaaagcgatgggattgtgccaatttcttctgaaagaggtcatccgaatatctttgatgcagttaaagaaagaatcgaaaacgcatatgaaggacacgctgaagatcgattagcggaaattgacgacttacttgggagcagatcagcagacgaggaggcatatccgaacattcgccactgggtcagtaatgacctatttgagttccataccgacacgatggaaaatacaccgatcatctggaaaatgaccacttctggtctgacgtcagatagagaagaagatggattcgcctgctttattgattataagcaacttgatgcagccctatttgatcgtctaagcaatcagtatcttgaaccacgaaaagcagaactcagggaacaacgttctgctgcaaatcaacgtcaaaataatgaatcactttccagtactgagcgagcagaagctactgaagagttcgagttttgtacgaatgctcttgagcagatagcagtatttgaagaagtgattcaagaacttgcgatggccaatactcgagactgggatcaaagcaaacaaaatatagcctctaatttagagtctaaagtaaaggatttccgtgaaaagaccgaaaagcgtctccgtcttcttgaaaagttggcccagaaagatgacgtaagcctagctgatatatttacgaaaacattctatcctactgcacagcaggagagagaagagtggacaggatcactaaaggaactcgaagaagcctgtagggcctacagcagggacgcgtcagagcctgttgaagcacactattatgattatctctcatattttgatgaggtaattgggtcaacccactttgcaagcaacggtattttatttatgacatattacttcgaagatggcactaaatatctggaagatgggacaccgaaagaggatttatccgaagaaggccagatccttgcggaactagcagttggccttgaagactatatcaatcttgcagaagaaattaatgaggattgcgaacggcttacgaagtcaatcccttcgaattgggaagatcgagcattatctgagatcttgacacagggttatcaacccaaatataagcatggtgtagaaataaatataatacctctgtcagacaaaaatattgtaccggatattgttgaggacaaggtgatttga

SEQ ID NO: 2406 - DNA, 4122 bp, Halobacterium salinarum
atgcgcgaccgcgtcgaagcgaacgttcgctaccagctcgaggacgagtacgacctcgacgagaagccggacgacgacgcgtccctgaacgaggagcaggaagacctcgtcgaagccatcgaactcgaggccgccgatggccacagctgggacgaagcccacgagcagtacatcacgggcgtcggctacaccatcgtcaatcggctcgcagccctccgctgcatggaggttcgggacttcatcgacaacgaggtcacggcgttccgcgacgacggcctcacgccggccgccgaccggctggtcaccgaggagttcatgctcgaggaggaagccgtcctcgaggcctaccggaacgcgtgcgacgaccttgccgaggagatcgacattctcttcgaccgctcgacggcctacagccagatcgatcccgacgacgacacctacgaagacctctgtgggatgctcgatcaggtatctgacgaggtctggcgggccgacgacgtactgggctgggtctacgagtactacaaccgccctgttgtcgaggcgctcgacgcgaagaacacactcgaaccggaagacgtgggcccggccaaccagttctacacaccacactgggtcgtccggatgctcaccgacaactctctcggaaagctctatctcgaagccacaggacaggagtcggcagtaccggagcccgaggcgctcagtcccgaggagcgcaaggaacgcttagtcacgccggaggacagcccgtcggttcccgaactctgtacgtaccttatccccgacgaggaggccggcgacgctcccgagttcgaccacccgcgagaactgcgagtcattgaccctgcttgcgggagtgggcacttcctgctgtacgcgttcgacgtgctggagcgcatctggtgggccgagaccgatctcgaccgcgccgagattccggcgaaggtgctgaatcacaacctctacggcgtcgacatcgacctgcgttcgtgtcagctctcggcgttcaatctgtatctgaaggcccggacgcgtgccgaggcggaagacggccagttcgagatgcccaacgtcgacatcgtctgtgctgacgcccgcgtggcggaggttgaggaaggcacagaagtgcttgacgagatcaccggtgaagggactgacctgcgtggtgcgctgggcgagatcatcgatacattccagcacacggaagccctcgggagcctgcttgacgtgagcgggacgcttgaggaggtgttcgagagcggacaaacgggcctctcggactggggcgacgggacgcaccagtcgctgagctcgtttctgaaggcactccgtgaagcggttgatgaacgctcgtcagattcgtttggcgaacagaacctcaagagcttcttgaacttattggtcgtactaacgcaggagtacgacgtttcgttaatgaatcccccgtatgggtcgggcggacggatgcctgatcccgttcaggaatacgtttcggatacctacaactacaaggaggagtactacatcaacttcttcgaggcatgtgatcgccgaacgaagaccaacggccggacgggaatgcttgtcccacggtcgttcatgttcctcaagacgttcgaagatttcagaggggacttcatcggtggacagggtgcgtttgacttcctcgctgagtacggtatcgacatcctcgacaatgcaaccgttcgaaccgctgggacagtcgttcggtcgggcgtcgaaaccggacagacgggaacctttcttcgactcgacgacgtggagaagggtgagaaggagagttcgttcctacacgccgcgttcgtcgatgcagccgaagagggtattcagcgtcgatatacccgaaagctcgaagaattcgaatctgtaccgggggctcctctctcttactgggttccgaccaaacttcgctcttggtacgactccgaaacggtactcgactcagacaatgctgaccttccagagagagagtcatacggggtaataaaccaggggactgcgacagctgatgatcaacgctttgtccacgctttctgggaacacccgaggaatcgagattggtctcctttcgcgaagggaggatctgatgcgtggctcctgccgcgagtcaagcaaactgtgttgtggggaaattccggtaaggagttgagtcgctacccgaagtcgtacccgcgtaatacccaatattatttcaaagagggattgacctatactgttgctaaggagagtgggcgacgatttgggtacctacacgactcctcagtcttcggtcacaaggggtctgtgctgattccgaatcgggccatctggcaggcactaccctacacaaacagccatctattcacatatctgatgctcgcacagacgaccgagcgtatgtgggaggtcggtcaggtgtcgaaaatcccgtggcgtgagcaactcgaacccgtcgactccttggaaacgctctcaagaaaggccatcgggcacctgatctcgaagcgtcagtacgacttcgtctccccacattacaccgagtcgattcttctcgacgttctcggcgaaagtgatacgctcgacctgtacgaccacccgcaccgtgaactccgagaggaactgacccttgactcgccgtcctcgactgtcgatgcgagagcatcactatccgaactcgggacagccgccgcgacccatctcgagcgaatcgaagccgagctacaggactgtgccgatgagatcgacgagacggtcttcaactgcttcgacgttaccgaagaccagcgtgaaacgatcctccaagagatcgctcttcgaaccaacagagacccacgtgagcgcgaagagtatgacccagactccatcaccgaaccatcgggggatttcctggaacaggtcaaagacctccttctacacttcaccctccacgctgtcgacgatgctgacgacggtatagtcccgctctcccacatcgatgataaggacaatctcctgacccatattcagtcggagttcgaacgcgtctggggtgagcacgcaaccgatcgcctcgcagaagtcgacgacgtactcgggaaccgcagcgccgcggacgaagcctacccgaatctccgggcgtggctcgaagacgacttgttcgaataccacgtcttaaagttcgaccggactccgattctctggcagatttcgtcaaagcggctcgtctccgattccgaaagggaagggttcggctgcctcgtggactaccaccagttagacgcgagtatcttcgaccgtctacagaatcaatatcttgaaccccgacggacgcacctccgtgagcagcgggcggccgcgaacagtcaccgtaacgacgactcactctctacctcggagcgtgccggcgctgctgaagagtacgaacgctgtgagagtggactcgaacaacttagcatctttgaggaacagctcggcggactcgccgagtccgacccgcgcgactggcccgaatcgaaccaagaacgcgctgaggaggcagcacagcgggtcgctaagttccgaaaccggacggtctcccgattggacaccctcgaaacgctcgccaatctggatgacgtggatatggaagacctgttcagcccctcgttctacgagactgttcaggagaataaagacgagtggattgacgcactcgacgatctggaagcagcgttcgaggcctacgccacggacggtaccgagcccgtcgaggcccacctctacgatctcttcgagtactacgacgacctgaccggctcctcccactatgcgagtaacggaattctgttcatgacgtactacttcgaccaattcgaggatgctggccaagcccagatcgggggcgcgggcgtctctgaacgacagcggctgctctcagaactcgccgccgacgtggacgagtacaaggaactggccacggtaatctctgaagactgcgacgcggtcgccacggacatctctgccgactgggaagagcgcgcgctatcagaggtgacaactgcgggctaccagccgaaccacaagcacggcgttgtgatcaacatcactccgctcgcggagaagaacatcgtcccagaagtcgtggatgacaaggtgctctga

SEQ ID NO: 2407 - DNA, 4227 bp, Haloarcula hispanica
ttgtactgggagaatatcactgactctcatatggatgggaacgctctggccccccgaaaggcgcaactcgacaaggaagagcgcgaacacctcgaagcggtcgtcaccgagatgcgagaccgtatcgaggcgaacgttcgctaccagctcgaagcgtctgatctggcagaccgtcctgatgacgcgtccctgagcgagacgcaggaaaccctcgtggaagctatcgaactcgaagccgccgatggccacgattgggaggaggcccacgaacagtacattacgggcgtcggctacacggtcgtcaatcggctggccgcgcttcgctgcatggaggtccgggacttcatcgacgacgaagtgacggccttccgcgacgacggcctcaccccggccgctgaccggcttgtcaccgaggagttcatgctggaagaggaggccgtcctcgaagcctatcggaacgcgtgcgacaaactggccgcggagatcgagatcctcttcgaccgctcgaccgcctacagcctgatcgaccccgacgacgacacctacgaagatctctgcggaatgctggacgaggtccccgacgaagtctggcgggccgacgacgtgctgggctgggtgtacgagtactacaaccgtcccgttgtcgaggcgctcgacgcgaagaacacgctcgaaccggaggacgtgggaccggcgaaccagttctacacgccccattgggtcgtccgaatgctcaccgacaactccctcggcaaactctatctcgaagcgactgagcaggaagacgccgttccgaatccggacgctctcagccccgaagagcgaaaagagcgcttggtcacgccggaggacagcccgtccgttcccgaactctgtacgtaccttatccctgacgaggaggccggcgatgcaccggagttcgatcatccgtcggaactgcgggtcatcgacccggcctgtgggagcggccatttcctcctctatgcgttcgacgtactggagcgcatctggtgggccgaaaccgatctcgaccgagccgagatcccggcgaaggtgctggagcacaacctctacggcgtcgacatcgacctgcgctcgtgtcagctctcggcgttcaatctgtatctgaaggccagaacacgtaccgaagcggaagacggccagttcgagatgcccagcgtcgacatcgtctgtgcggacgcccgcgtggcggacgttgaggaaggcgcagaagtgctggacgacattaccggcgagggaacggacctgcgtgctgcgctgggagagatcatcgacacgttccagcacacggaagccctcgggagcctgctggacgtgagcgggacgctcgaagacgtgttcgagagcggtcagacggacctctcggactggggcgacggaacacaccagtcgctgaactccttcttgaaggcacttcgagaagccgttggtgagcgctcgtcagattcgttcggcgaacagaacctcaagagtttcctgaatctgctggtagtgttaagccaatcgtacgacgtggcgcttatgaacccgccgtatggttcggggggacgaatgccggacaccgtgcaggaatacgtcgaagagaacgagaattacaaatatacgacggagtactacatcaacttcttcgaggcgtgtgatcggctggccaaagccgacggacgcacggggatgctcgttccgtggtcgttcatgttcaacaagtccttccagaccttccgggaggatttcgtcggtgggagaggtgcgttcgacttcttctcagagttcgggtacgacatcctcgacaacgcgaccgtcggcactgtcgggacagttgttcgctccgaggcagacagcgggcagacagggacgttcatccgcctcccggatgttgcaaagggtgagaaggaaggggaattcatccgcgcgtctttcgaggggtctgaaaccggtgtcaagcgactctatcaccgagacctgtccgagtttgcgatggttcccggcacgccgctttcttattgggtgccacgaggcctgcgaagcatctatcagtccgataccgttctcgacgcggataatgcgggcttagaggaccgggagacgcttggagacatcaaacagggtaccgcaaccgcagacgattcccggttcgtgcataagttctgggaagacaggggcgctgaatgggtgccgtttgcgaaggggggcgctgatgcgtggcttttgcctcgaataaagaacaccctcctctggggagaagacgggacggaagtcgatagatacccgaaatcctacccccgcaatacagacgcctacttcaacgaatcattaacgtacaccgtcgcaaagcgaagcggtcggaggttcgggtatctccacgattcgtccgtcttcggtcacaagggctcggttctgattccggatcgggctatctggaacgctctctcgtacacgaatagccatctattcacgtatctgatgcttgcacagacctccgagcgaatgtgggaagtcgggttcgtctcgaaagtcccgtggcggacagaactcgaagagatcgacgaactggcgaccctcgcccgggaagccgtcgggcacctcatctcgaagcggcagtacgacttcgtgtcgccgcattacgatgggcctgtcctgctcgatgcactcggtgtcgatgacccgctaccgcagtacgatcatccacaccgcgagcttcgggacgaactttcgctcgatagcccgacacaaactgtgtccacggcagactcgctcaatcaggtcggaactgccgccgcgaaacacttggcgcgagtcgagcaaaccctccagtcctgtgcgaacgacatcgacgatgccgtcttcgattgcttcgacatcaccgacgggcaacgcgaaacgatccttcaggagatcgcgctccgaaccatcgaagatccacgcgaacaggaagtgtatgctccagcggccatctcagagccgtctagcgacttcccggaacaggtcaaagacctccttctccacttcacgctccgagcgatcaacgacaccgatgacggcattatcccgctttccgaaatcgacggcacggacgaccttctgacccacatcgaggcggagttcgaacgtgtctggggcgagcacgcgaccgaccgcctcgcggaagccgacgcggtactcgggaaccgcaacgcgagcgacgaagcgtacccgaaccttcgggcgtggctcgaaaacgacctgttcgagtaccacgtcgcggagttcgaccgaacgccgatcctctggcggctttcgaccgagcgactcgtttccgacgccacgggcgagggcttcggctgtctcgtcgattaccatcagttggacgcgagcatcttcgaccgactgcagaaccagtatctcgaaccgcggcggacgcacctccgcgaacgccaggcggcggcaaacagccgtcggaacgacgaatcgctctcgaccactgagcgagccgacgccgccgaagagtacgaccagtgtgagagcgccctcgaacagctcagcgcgttcgaagaacggcttggcgacctttcgcaggccaccccgcgtgactggcccagcgtgaatcaggaacgcgcggccgaggcggccgaacgcgtggcggagttccgggagcggacagcatcacggctagacactctcgaaaccctcgccgacctgaaggacgtagatatggcagacctgttcagtccctcgttctacgagacggtacaggagaacaaagacgagtgggtcgatgcgctcgacgacctacagactgccttcgaagcgtacgccgaagacggctccgaacccgtcgaagcacatctctacgacctcttcgagtactacgacgatctcgtcggctcctcccactacgcgagcaacgggatcctgttcatgacgtactacttcgaacagttcgaggatgccgagcagtcacagatcggagacaccggcgtcgccgagcggcagcgactgctcgcagaactcgcggccgacgttgacgagtatcggcaactggccgacgaaatcgctgcaaactgcgacgaggttgcgaccgatatctccggcgattgggaggaacgggcgctctcagaagtcgtgaccgcgggctaccagcccacccacaaacacggcgtcgcgatcaacatcacgccgctcgccgagcaagacatcgtcccggaagtggtggcggacaacgtactctga

SEQ ID NO: 2408 - DNA, 4368 bp, Haloarcula hispanica
atggacggacaatctacccacccccgcaaggcccagctcgacaaggaagaacgcgagcatctcgaagccgtcgtcaccgagatgcgcgaccgggtcgaggcgaacgttcgctaccagctcgaagacgagtacggcctcgacgagaagccggacaccgtcggagcaagcgccgacgagtcctccctcgctgccgctcgcgaggacggcgacgcgtccctgagcgagacgcaggaaaacctggtcgaggctatcgaactcgaagccgccgacggccacgattgggaggccgctcacgagcagtatatcacgggcgtcggctacactatcgtgaaccgtctggcggccctccgatgtatggaggttcgggacttcatcgacgacgaagtcacgtcgttccgtgacgacggcctcacaccggccgctgaccggttggttaccgaggagttcatgctggaggaggaggccgtcctcgaagcctatcggaacgaatgcgacgccctcgctgatgaaatagagatcctcttcgaccgctcgaccgcctacagcctgatcgaccccgacgacgacacctacgaagatctctgcggaatgctggacgaggtccccgacgaggtctggcgagccgacgacgtactggggtgggtgtacgagtactacaacgtcaaactcctcgatgacctgcgtcggaagggcgaccgcgaaggattggagcccgaagacgtgccggcggcgaatcagttctacacgccccattgggtcgtccggatgctcaccgacaactcgctcggcaaactctatctcgaagacaacggaacgctgcaggagaccgtcgaagcacaggacgcgctgacgccggacgagcgcaagaaccggccactctcccccgacgaatccccggacttggcggatttctgtacctatctcgttccctcggaggaggaaggcgagccaccggcgttcgacggcccagaagacattcgcgtcatcgacccggcctgtggaagcggccacttcctcctgtacgcgttcgacgtcctggagcgcatctggcgagcagagaccgaccttgaccacgcggagattccgcgggagattctgcggcacaacctccatggtgtcgacctcgatatgcgggcctgccaactggccgcgttcaatctctatctgaaggggaggacgcgtgccgaggccgaaggggcaactggcttcgatatgccagaagtcggcatcgtctgtgctgacgcgaaggtggctgacatcgagggcgtcgaggaagtgttcgacgaggtggctggcggcaaatcggacgtaaaagacgcactcaggcagatcctcgacgcatttgaaggagtccacggacttggtagtctacttgatgtacgtggtacacttgatgagctattcgaagacaaaattgatcaggaaagtgtacagatcaccctcgaagatgaccctcgtgacgatcatacacttggccagattcttcacagtcttcgagatgcagtagacgaacatcgacaaggagactcgttcttagctcaagacttacggagtttcattcggttgctagacgtgctagcacaggactatgatgttgcgttgatgaatcctccctacggatcgcggaacagaatgccaccctcagtaaaagaatatattgatgatcactatcgataccctgctgaattttatgtaaacttctttgaagtgtgtgatgacatcaccaagaatcacggtagaattgggatgctcgttccgcggacatttatgttcaaggctcgtgcggagcagttcagatctgatttcataggtggtgaggggagtttcgacttccttgcagagttcggtttaggagttttagataatgcaactgtaagaacagcaggaactgttgttaggtctggtgtagagcctgatccatctggagagtttatccgtctatatgatctcgaagcttcgagtaaagaggagaagtttgttgaagttttatcgggtgacgaaccggacgttcagaggttgttcgaggtggatttagattcattttcgaaggttccggggaatacaatctgctattccacccccgaagaagttcgggatctacatgatacagaattgaggttagactgtgaggtcagcgatattgatggagaatcaatcggatatgctcggcaaggaatcgcgacaacgaacgatttccggttcatgcggttccactgggaaactgatgatttcgatacgttcaaccctattgctactggtggatcggacgcgtggattttaccccaaattgtggaagttgttagatggagagaccaaggaactcggatcaagaggtatagtggtactgtaagaacaccaaacgagtttttatatggtagagagggtcttgtctggacacggtcgaaagagacgggtagacggttcggatattacccctctgatggattattcagccaaacagggtacttgtttgttccaaaggattcagatctactgtggcaactacttgcaagcctaaatagcgacttgtaccactctctgttcttatcacttaccgttgaacgagattgggtcggtggtattgtaggtcgtgctccttggatcacggcgtttgagggtgaggaaaaactagaatccttagcaaaagaacaactcagtataatggcgagcacaaaaacaagtgatccagttagtccatactatatctcaccggacattcttccaataacaggtgatcgagggtatttctaccaacatcctcattcaaagaagattgacctagtatctgaggcaaaggagcagtcgccaccgaaagaagaaagcattatagaggctgcgaagaccgcaaaaacggaaggaatatcgactagacaaaggttagagactcttgcagagaatattaacagtcttgtctacgatttggctggtatatcaggaaatacacagaaacaaattgaagaagagatccgccttcggactggtaaaaatcagaacagcgaaagtaatgaaactgtttctgaaacacctgataacttagaggaacaggtcaaagacctcatccaccacttcgcggtggaagccgtccgcgaagaaaacgacggcgtcattccactcaagagcgcggacgaccagcccgatatgcttgatcggatcgtcgaccggttccatgacgcgtacggcgagtacgccgaaaatcgcctcgtcgaagttgacgacatcctcggggctgagtcggccgccgacgaagcctaccccaacctccgggcgttcatcgatgacgaccttttcgagtaccacgtcgagacgatggagaacacgcccatcatatggaagctcagtacggaacggctccttgccgacgcgaaaggcgaaggcttcgcctgttttgttgactaccaccagcttgacgccagcctcttcgaccggctgagcaaccagtaccttgagccccggaaagctgaacttcgcgaacgccgggcagctgcgaatcaacggcagaacgacgagtcgctctcgaccagtgaacgggccgaggctaccgaagagtttgaattctgctcaagcgccctcgaacagatcgccgaattcgaagaggtgatgcaggaactcggcagcacgagcgagcgcgacttcgatgaggatgaccgtgaactcgtcgaagaactcgcaccgaaggtggctgcgttccgcgaagagacagccaaacgcatcgagacgctcgaacaactccgcgagatgaacggcgaggagtggttccaagacaccttctcggacaacttctgggaggcggtcaacgaatggagcgatgaatggctggaggctctcgacgaactcgaaaacgcctgcgaggagtacgccaagccgagtgacgaacccgttgaggctcacctagcagacctcttcgactactttaactggcgactcaagggctcggatcactactctagcacaggcatcctcttcatgacctactacttcgaacgtgaggggagtaagctcctcaacggcgagggcgaaccgttcgacaccctcactgaagacgaggagatgctcgcctcgcttgcgacgggcgtcaacgacgcgtccgtcctcgacgaggagtaccttcagcagatggcagacgtagaggacgtcgacgatatagacgacttaccaccgctagcggagttcaaggcgctcgccgaggagatcaacgatcgctgccagacggtagacaagcaaattccctcggactggtcagaccgggcactatcggagatcacgaccgctggctaccagcccaaccagaatcacggcgtcattatcaacatcacgccgctcacggagaagaatgttgttccggaagtcgttgaggacaaggtactctga
